United States Patent 11,931,406 (FLAVIVIRUS VACCINE) - sequence listing, part 65

SEQ ID NO: 22783 - RNA, 9876 nt, Artificial Sequence
  derived and/or modified CDS sequence (opt6) from DENV-2__EU482468__SS-prME
ucugcagguaugauuauaauguuaauaccaacggugauggcuuuucaucuaacaacaaggaacggugaaccucauaugauuguagguauucaagaaaaagggaaaucgcuacuauuuaaaacugaagauggcguaaauauguguacauuaauggcgauggaccuuggugaacuuugugaagacacaauaacauauaaauguccuuuacuacgacagaaugaaccagaagacauagacuguuggugcaacucaacgucaacuuggguuacuuacgguacauguacaacaacuggggaacaucgacgggaaaaacguucaguugcgcuuguaccacacguagggaugggauuagaaacccgaacugagacauggaugucaagugaaggcgcauggaaacaugcgcagcgaauugaaacauggauaaugagacauccaggguuuacuauaauggcugcaauucuugcauauaccauuggaaccacccauuuccagagagugcugauauuuauucuauuaacugcugucgcaccuuccaugacaaugagguguauaggcauaaguaaucgcgacuuuguugaaggggucagcggggguucauggguagacauagucuuagaacaugguaguugcgucaccacuauggcuaaaaauaaaccaacauuagacuucgagcuuauaaaaacagaagcgaaacaaccagcgacccuucguaaauauugcauagaagcgaaauugacuaauacaaccaccgaaaguagauguccgacacaaggagagccauccuuaaaagaggaacaagacaaacgcuuuguuugcaaacauucuaugguagaccgaggauggggaaacggaugcggccuauucggaaaaggagggauaguuaccugugcgauguuuacuuguaagaaaaacauggaggguaaaaucguacagcccgagaauuuagaguauacaaucguuguaaccccucacaguggagaggaacacgcggugggaaaugacacuggaaaacaugguaaagaaauuaaagucaccccucaaaguucaauaacugaagcugagcuaacaggauauggaacaguaaccauggaauguucaccacggacgggacucgauuuuaaugaaaugguguuacuccagauggagaacaaagcauggcucguucaucgucaaugguucuuggaccugccauuaccauggcuuccaggugcagacaaacaagaaucuaacuggauacaaaaagaaacauuagugacauuuaaaaauccccaugccaagaaacaagaugugguaguacuggguucacaagaaggcgcaaugcauacagcucuaacuggagcgacagaaauucaaaugucaucaggaaaucuccuguuuacaggacaccuaaaauguagacucagaauggauaaacuacaacuuaaagggaugaguuauucuauguguacuggcaaauuuaagguagucaaagaaauugcggaaacgcaacacggaacaauaguaauacgcguacaauaugaaggcgauggaucgccuugcaaaauaccuuuugagauaauggaucuggaaaagagguauguauugggccgauuaaucacaguuaacccaaucguaacugaaaaggacucgccaguaaacauugaggcugaaccaccauuuggagauaguuacauaauuauagguguggaaccuggccagcuaaaacugaauugguuuaagaaaggcucguccauaggucaaauguucgaaacuacuaugagaggagcgaaaaggauggcgauucugggagauacagcaugggacuuuggaagucuaggggguguuuucacaagcauaggcaaagcccuucaucaaguguucggagccaucuauggcgccgcuuuuuccggaguaaguuggacuaugaagauauugauaggggugauaauaaccuggauagggaugaauaguaggucgacaucuuuaagcguaucgcuaguguugguagguauaguaacucuuuacuuaggugugaugguacaagcggauaguggauguguuguuagcuggaaaaauaaagaacuuaaaugcgguucagguauauuuauaacggacaacguucauacuuggacagaacaauauaaauuccaaccggaaucccccagcaaacuagcuagcgcaauccaaaaggcucaagaggaggguauaugugguauucggagcguuacgcgccuugaaaauuugauguggaagcagaucacaccggaauuaaaucauauacuggcugaaaaugaaguaaaacuuacaauuaugacaggugacauacgugguauaaugcaggcgggaaaacguucguugagaccgcagccaacugaacuuaaauacaguuggaagacuugggguaaagcgaaaaugcuaucuacugaauccuacaaucaaacuuucuuaauagacgggccagaaacggcagagugcccaaacacgaauagagcauggaacucacuugaaguugaggauuacggauuuggaguauuuacuacuaauauauggcuaaaacuaaaggagaaacaagaugcauucugugauucaaaauugauguccgcugcgauuaaagacaauagggcaguacacgcagauaugggauauuggauggaaagcgcuuuaaacgacacauggaaaauagaaaaagcgucguuuauagagguuaaaaacugucauuggccaaaaucccauacacuauggucuaauggggugcucgaaucugaaaugauuauaccuaaaaaucuggcugguccuguuagccaacauaauuaucgaccagguuaccauacucaaauagcugggcccuggcaccuaggaaaacucgagauggauuucgauuucugugauggcacaacugucauuguaacugaagauuguggaaauagaggacccagcuuaagaacgacuacggcauccgguaaguuaauaacagagugguguugucggucguguacacuaccuccucugcgauaucguggugaagauggauguugguauggcauggagauucgaccccuuaaggaaaaagaagaaaaucuuguaaauagucuaguaacggcaggacauggucaagucgauaauuucucacuagguguauuaggaauggcccuauucuuggaagaaaugcuacggacaagaguagguacuaaacaugcaauccuuuuaguugccguaucauuuguaacccuuauaacuggaaauaugucauucaaggaucuaggcagggucguugucaugguaggagcuacgauggcggaugauaucggaaugggggugaccuaccuagcucuuuuagcugcauuuaagguacgaccaaccuucgcagcugguuugcugcuuagaaaauuaacuucuaaagaauuaaugaugacaacaauaggaauaguacuauugagccaauccacgauuccagagacgguacucgaacucacagacgcucuagcacuaggcaugaugguacucaagauagugaggaauauggaaaaguaucaauuagcagugacgauaauggcgauauuaugcguuccuaaugcuguaauccuccagaaugcuuggaaaguaagcugcaccauauuagcagucguaucagugaguccauuauugcugacaucuagucagcagaaaacugauuggaucccucucgcccuuacaauuaaaggacuaaaucccacagcgauauuuuuaacuacguuaucaagaaccaacaagaaaaggucauggccccuaaaugaagcaauuauggcuguagguaugguaaguauucuugcaucaucauuauuaaagaaugauauaccaaugacugggccccuagucgcugggggucuuuuaacgguauguuauguucuaacgggaagaagugcagaucuagaguuagaacgugccacggacgugaaaugggaagaucaagcagaaaucucuggaaguagcccaauacuaucaauaacaauaucagaggacggauccaugucuaucaaaaaugaggaagaagaacaaacucuuacgauucuaaucagaacuggacuccuaguaaucucgggauuguuuccuauuagcauaccaauuaccgccgcugcaugguaccucugggaggucaagaaacaaagagcuggaguacugugggacguaccaucuccgccaccaaugggcaaggcugaacuugaagauggagcuuaucgcauaaagcagaaagggaucuuggguuauucucaaauaggcgcgggcguauauaaagaagguacauuucacacuauguggcauguaacaagaggggcagugcuaaugcauaaaggaaaacggauugagccaucaugggccgacgucaagaaagacuuaauaucauacggaggaggauggaaguuagaaggagaauggaaagaaggagaagaaguacaaguacuagcgcuugaaccagguaaaaacccucgugcaguacaaacaaaaccuggacuuuucaagacaaauacgggaacuauaggagcaguaaguuuagauuucagccccgggaccucggguaguccaauuauagacaagaagggaaagguuguuggucuuuaugguaaugggguaguaaccagaaguggggcauacguguccgcaauugcucaaacagaaaaaucaauagaggauaauccagaaauugaggaugacauuuucagaaagcggagauugacaauaauggaucuucaucccggggcggguaaaacaaagagguaucuaccagcuaucguaagggaggcaauaaaaaggggguugcgaacccuaauucucgccccaacccgaguuguugcagcugaaauggaggaggcuuuaagagguuuaccuauacgauaucagacccccgcaauucgugcagaacacaccggacgugaaauuguagaccuuaugugccaugcuacauucaccaugagguuauugagcccuguucguguaccuaacuauaauuuaauaaucauggacgaagcacauuuuacugaccccgcuucaauugccgcaagaggcuauauauccacacgcguugagaugggcgaagccgcugguauauucaugacggcaacuccaccaggaucccgggauccauucccacaaaguaaugcuccuauaaucgacgaagaaagagaaauaccggagagguccuggaacuccggucaugaaugggucaccgauuuuaagggaaagacgguaugguuugugcccucuauuaaagcggguaacgauauugcagccugucuacgaaagaacgggaaaaaggucauucaauuaucccggaaaacguucgauagcgaauacgucaaaacacgaacaaacgauugggacuucguaguaacgaccgacauaucagaaaugggagcuaacuuuaaagcagagagaguaauagacccaaggaggugcaugaagccgguuauacuaaccgacggugaagaaagaguaauccuagccggcccuaugccaguaacucauagcucagccgcgcaaaggaggggaagaauaggaagaaaccccaaaaaugaaaacgaucaauauauauauaugggggagccucuugaaaaugaugaggacugcgcacauuggaaggaagccaaaaugcuauuagauaauaucaauacaccagagggcauuauaccaucgauguucgaacccgaaagagagaaaguagacgcaauugauggagaauaccgcuugagaggagaagcacguaaaacauuuguggauuuaaugcgcagaggagaucuaccaguuuggcuugcguacaagguagcugcagaaggaauaaacuacgcagaccgccguugguguuuugaugguaucaaaaacaaucaaauuuuggaagaaaacguagagguagaaaucuggacuaaagagggagagagaaagaaacuaaagccgcgguggcuugaugcuaggauauacagcgauccacuggcauuaaaagaguuuaaagaguucgcugcggguagaaaaagccugacuuuaaaucuaauaacagaaaugggucgcuuacccacauuuaugacccaaaagacucgagaugcacucgacaauuuggcgguguugcacacagcugaagcuggaggucgagcauauaaucaugcauuaucggaacuaccagagacuuuagaaacauuauugcuucuaacucugcucgcaacgguaacgggagguauauucuuauuuuuaaugucgggcagggggauaggaaaaaugaccuugggaaugugcuguauuaucacggcuucaacacuccuaugguacgcgcagauccaaccacauuggauugcagcaagcauaauuuuagaauuuuuccuuauugucuuacugauaccugaaccagagaaacaacgaaccccucaagacaaucaauugacuuauguagucaucgcuauauuaacaguugucgcugcaaccauggcaaaugagauggguuuucuagagaaaacuaagaaagaccucgguuugggcucgaucgcaacacagcaaccggaauccaacauuuuagacauugaccuccgacccgcuucggcguggacauuauaugccguagcuaccacauucguaacgccgauguuacgucacaguauagaaaacucuucaguaaauguaucacuuaccgcaauagcgaaccaagcaaccguucuaaugggacuagguaaagguuggccccuaucuaagauggauauuggagugccccuauuagcaaucgguugcuauucucagguuaacccaauaacucucaccgcagccuuacuacuucuaguagcgcauuaugcaauaauaggucccggccuacaagcuaaagcuacaagagaagcacaaaagcgugcggcggcaggaauuaugaagaauccgacagucgaugggaucacaguuauugaccuugacccaauaccauacgauccgaaauuugaaaaacaauuaggucaagucauguuacuaauccuaugcguuacacaaguacuaaugaugaggacgacgugggccuuaugugaagcucuaacauuagcuacaggcccaauaucuacuuugugggaaggaaauccaggaagguuuuggaauacaaccaucgcagucagcauggcaaauauauuucgaggauccuacuuggcgggugcaggacuacuauuuaguauaaugaagaauacaaccaauacaagaagggguacuggaaauauaggggaaacauuaggagaaaaauggaaauccagguuaaacgcccuaggaaaaucagaguuccaaauauacaaaaagagcgguauacaagaaguagaucgaacucuagcaaaagaaggcaucaaaagaggggaaaccgaucaucacgcaguuucacgggguagugcuaaacuaaggugguucguagaaagaaauaugguaacgccugaagguaaaguaguagaucuagguuguggucgaggugguuggucauauuacugcggagggcugaaaaauguaagagaaguaaagggauugaccaaagggggcccuggccacgaggaacccauaccuaugucgacuuauggauggaaucugguaagacuucaguccggggucgauguauucuuuauaccacccgagaaaugugacacuuuguuaugugauauaggggaaucaucgccuaauccaacaguagaagcagggaggacucuaagaguauuaaaccuaguagaaaacugguugaacaauaauacucaauuuugcauaaaaguguuaaauccauauaugccaucgguuauagagaagauggaggcacuacaacgcaaauacggaggcgcacugguuagaaauccacuaucaaggaacagcacacacgaaauguacugggugucaaacgcaucggguaacauuguaucuucaguuaacaugauaucaagaauguuaaucaaucgcuuuaccaugcggcauaagaaagcaaccuaugagcccgaugucgacuuagguucaggaacacggaauaucggaauagaaucagaaauuccaaacuuagauauaaucggaaaacgaauugagaaaauaaaacaagaacacgaaacaaguuggcacuacgaucaagaccauccuuauaaaacgugggccuaccacggaaguuaugaaacaaaacaaaccggaagugccucaagcaugguaaaugguguaguuaggcuacuuacaaaaccaugggauguccuuccaacaguuacacaaauggcuaugacagauacgacaccuuucggacaacaaagaguuuucaaagaaaaaguagacacgcguacacaagaaccaaaagaaggaaccaagaaacuaaugaagauaacagcagaaugguuauggaaagaauuagguaaaaagaagacgccacggaugugcacgcgugaagaguuuacacgaaaagucagaucaaaugcugcgcuuggcgcaauuuuuacagacgagaacaaauggaagucagcaagggaagcaguggaagauucuagauucugggaguuaguagauaaagagagaaacuuacaucuugaaggaaaaugcgaaacaugcgucuacaauaugaugggaaaaagagagaagaaacuaggugaauuugguaaggcaaaaggaucaagagcaauaugguauaugugguuaggagcuagauuccuugaguuugaggcuuuaggcuucuuaaacgaagaucacugguucucucgugaaaauucacucaguggcguagagggggagggacugcauaaacuugguuacauacucagggacguaaguaagaaagaagggggcgcaauguaugcagacgacacugcaggaugggauacuaggauuaccuuagaggaccuuaaaaaugaagaaauggugacuaaucauauggaaggugaacauaaaaagcucgcugaagcuauauuuaaauugacauaucagaauaaaguggucagaguacaaaggccaacaccucgcgguacagucauggauaucauaagcagacgagaucaaagaggcucgggacaaguaggcacuuaugguuuaaauacguucacaaauauggaagcucaauuaauuagacagauggagggcgaagguguuuucaaaaauauucagcaucugaccguaacagaagaaguagcugugcauaacuggcuagcgcguguagggcgagaaagauuaagcagaauggcaauaucgggugacgacugugucgugaaaccgcuagaugauagauuugcaaaugccuugacagcucugaaugacaugggcaaaauaagaaaggauauucaacagugggaaccgaguaaggguuggaacgacuggacacaggugccauucuguagucaucauuuucacgagcuaaucaugaaagauggccgcguuuuggucguaccauguaggaaucaggacgagcugauaggucgggcucgaauaagccagggcgcagguuggucucuucgugaaacagccuguuuaggaaagucuuaugcgcagaugugguccuugauguauuuccauagaagagaccugcgacuagcagcaaaugcaauuugcagcgcuguaccaucacauuggguaccgacaucuagaaccacauggagcauccaugccaaacaugaguggaugacaaccgaagauauguuaacagucuggaaucgggucuggauuagagaaaauccguggauggaagacaagacuccuguagaaucaugggaagaaauuccauacuuagguaaaagagaagaccaguggugcggaucucugauagggcuaacaaguagagcaacaugggccaaaaacauccaagcagcgauuaaccaaguuagaucguuaauuggaaaugaagaauacacagauuauaugccgagcaugaagcgauuucgcagggaggaagaagaagcaggcguauugugguaa

SEQ ID NO: 22784 - RNA, 9876 nt, Artificial Sequence
  derived and/or modified CDS sequence (opt6) from DENV-2__EU482469__SS-prME
ucagcaggaaugauaauuauguuaauaccuacgguuauggcuuuucauuugacaacucggaauggugaaccucacaugauaguuggaauacaagaaaaaggaaaaucacuucuauucaaaacagaagaugguguaaauaugugcacauuaauggcaauggaccuaggggaauuaugcgaagauacaauuacuuauaaaugccccuuacuucggcaaaacgaaccagaagacauagacuguugguguaacuccacaaguacauggguaacauacgggacauguacuacaacuggugaacaucgacgagaaaaacggagcguugcccuuguaccacacguaggaaugggacuagaaaccagaacagaaaccuggaugucgucagaaggagcuuggaaacacgcacaaagaauugaaacguggauauugcgacaccccggauuuaccaucauggccgcgauuuuagcgcauacaauugguacaacacacuuccaaaggguauuaauuuuuauccuuuuaacugcaguagcuccaucaaugacgaugagguguauagggaucucgaaccgcgauuucguugaaggaguauccggagguagcugggucgacauaguacuugaacauggaaguugcgucacgacgauggcuaaaaauaaaccaacacuagacuucgaauuaauuaaaaccgaagccaaacaaccugcgacacuacguaaauauugcauagaagcgaaauuaaccaauacaacaacagaaucgcgcugcccaacacaaggagaaccgucacuaaaagaagaacaagauaaacgauuuguauguaaacauucgauggucgaccgaggauggggaaacggguguggauuauuuggaaaaggcggaauaguuacaugcgccauguuuaccuguaagaaaaauauggaagguaaaaucguucaaccagaaaaucuagaguauacuauagucgugaccccgcauucaggugaagaacaugcgguggguaaugacacaggcaaacauggaauggaaaucaaaguaacaccgcaaucuucuaucacagaagcugaacuaaccggauacgggacugucacaauggaauguucccccagaacgggauuagauuuuaaugaaaugguacuauuacaaauggaaaauaaggcuugguuaguucacaggcaaugguuccuagauuugccguuaccaugguugcccggagcagacaaacaagaaucaaacuggauccaaaaagaaacccuaguaacauuuaaaaauccucacgccaagaagcaagauguaguaguauuaggcucucaagaaggcgcaaugcauacagcguuaacaggggccacagaaauacaaaugucaagugggaaccuccuuuuuaccggccacuuaaaguguagauuacguauggacaaguugcaauuaaaggguaugagcuacaguauguguacgggaaaauuuaaaguaguaaaagaaauagcggaaacacaacacgguacuauagucaucaggguucaauacgaaggugacgggagcccuugcaagauccccuuugaaaucauggauuuggagaaaagauacguacuaggcagguuaauaacaguaaauccaauagucaccgaaaaagacucuccaguuaacauagaagcagaacccccauucggagacaguuacauuauaauagguguugaaccaggucaauuaaaacuaaauugguucaagaaaggaucaaguauugggcaaauguucgaaaccacuaugcgaggugcaaaacgaauggccaucuuaggagauacagcuugggauuuuggaucuuugggaggcguauucacgagcauagguaaagcccuacaccaagucuuuggagcaauauauggagcugcuuuuucuggaguuucauggacgaugaagauacuaauuggugucauaaucacuuggaucgggaugaauagucgaucaacuagccucuccguuucccuuguauuagugggaauuguaacuuuauauuuaggugucaugguacaagcagauucaggcugcguuguuuccuggaaaaauaaggaacuaaagugugggagugggauauucaucacagauaacguacacacauggacagaacaauauaaauuccagccagaauccccuagcaagcuagccagcgcaauacaaaaagcucaagaagaaggcaucugugguauucguucagucacaagacuggaaaacuuaauguggaaacaaauaacaccggaguuaaaucauauauuagcagaaaaugaaguaaaauuaacaauuaugacuggagauauaagagguauaaugcaagcagggaaacguucucuuagaccccaaccaaccgaguuaaaguacucuuggaaaacaugggggaaagccaaaaugcuuucaacggaaucauauaaucagacuuuucuaauagacgggccggaaacugcagaauguccaaauacaaacagagccuggaacucauuagagguggaagauuaugguuuuggaguauucacaacaaacaucuggcuaaaacuuaaagaaaaacaggaugcauucugugacaguaaauugaugucagcagccauaaaagauaacagggcaguacaugcagacaugggauauuggauagagucggcauuaaacgacacauggaaaaucgaaaaagccagcuucauugaagucaaaaacugucauuggccgaaaucacauacauuauggagcaacggugugcucgaaagcgaaaugauuauuccuaaaaaccucgcaggacccguaagucaacauaauuacagaccagguuaccacacgcagauagcagggccauggcaccugggaaaacuagaaauggauuuugacuucugugacggaacaacgguaauagugacugaagacugugguaauaggggaccuaguuugagaaccacaacugccucagguaaacugauaacugaaugguguuguagauccuguacauuaccaccacuaagauacagaggugaagaugguugcugguaugguauggaaaucaggccuuuaaaagaaaaagaggaaaaccuaguuaacucguuggucacggcgggacauggacaaguugacaacuucucccuuggaguauuggggauggcgcuuuucuuagaagaaauguugaggacacgcgugggcacaaaacaugcaauuuuauugguggccgucagcuuuguuacguuaauuacggggaauaugaguuucaaagaccuuggacgaguaguggucauggucggugccacuauggcggaugacauuggaauggggguuacuuacuuagccuuguuagcugccuuuaaaguacgaccaacauuugcggcaggucuuuugcuuagaaaacuaacaaguaaagaacuaaugaugacuacgauagguauaguccuuuugucucagucgacgaucccagaaacagugcuagagcugacugaugcacuugcuuugggaaugaugguacuaaaaaucguaaggaacauggagaaguaucaacucgcggucacaaucauggccauucuuugugucccaaaugcagugauuuuacagaaugcauggaagguaucauguacgauacuagccguuguauccgucucaccucugcugcuaacauccucucagcagaaaacggacuggaucccacuagcccuaacaaucaaaggucugaacccgacagcgaucuuucuuacgacccuaucacggacuaacaagaaaaggaguuggccauugaaugaagcgauaauggcuguggguaugguaucuauccuggccucuucgcugcucaaaaacgauauaccaaugaccgggccccuaguagccgggggacuucucacaguuugcuacguucucacaggaaggagugcagaucuagaauuagagagggcaacagaugugaaaugggaagaccaagcagaaauuucggggucgaguccgauccugaguauuacuauauccgaagauggcucaaugucuaucaaaaacgaagaagaggaacaaaccuuaacaauucuaauuagaacugggcuuuuagugauuagcggacuuuucccaauaucaauuccaauaacagcagcagcaugguauuuaugggaggugaagaaacaacgggccgggguucuaugggauguucccucuccaccuccuaugggaaaagcugaacucgaggauggagccuacaggauaaagcagaagggaauacucggguacucccaaauaggggcaggaguguauaaagaagggacauuucauacgauguggcacguaacaaggggugcaguauuaaugcauaaaggaaagcguauagaaccauccugggcggaugucaagaaagaucuaauaucguacggaggaggcuggaaacuugaaggagaguggaaggagggagaagaaguucaagucuuggcucuagaaccuggcaaaaacccaagagccguccaaaccaaaccagggcuguucaaaacaaacacuggaacuauaggggcugugucccuugacuucaguccaggaacuucuggaaguccgauuaucgauaagaaaggcaaaguagucggccuguacggcaacgggguaguaacgaggagcggcgcguacguaucagcaauugcacaaacagagaaaaauaucgaagacaaucccgagauagaggaugauauauuucgaaagcguagacuaacgauaauggacuuacauccuggagcaggcaaaacuaagagguaucugcccgcaauuguaagggaagcgauuaaaagaggacuucggacacuaauccuagccccgacacgaguaguagcagccgagauggaagaagcccucagaggccuacccauacgcuaccaaacgccagcaauaagggcagagcauacuggacgagaaaucguagaucuaaugugucaugcaacauuuacaaugcgauuauuaucuccugucaggguacccaacuacaauuugauuauuauggaugaagcacacuucaccgacccagcgucaauugcugcgcguggcuauauaaguacuaggguugaaaugggggaagcugcugguauauuuaugacggccacgccgccaggaagcagggacccuuuuccgcaaagcaaugccccaauaauugaugaagaaagagagauaccagaaagaucuuggaacagcggccaugaauggguaaccgacuuuaagggaaaaacagucugguucgugccuucaaucaaagccggaaacgauauugcagcgugucuaagaaagaauggaaagaaaguaauccaacuaucuagaaaaacauuugauucagaauacguaaaaacgagaaccaacgauugggacuucguuguaacuacagacaucuccgagaugggugccaacuuuaaagcagagcgcguaauagauccuagacgaugcaugaaaccugugauauuaacugacggugaagaacgcgucauauuagccggacccaugccagucacacauagcucggcggcacaaagaagaggucgcauuggaaggaaccccaaaaacgaaaaugaccaauauauauauaugggagagcccuuagaaaacgaugaagauugugcgcauuggaaagaagccaagauguuacuugacaacauaaauacaccagaaggaauaauaccgucaauguucgaaccagaaagagaaaaagucgaugcaauugauggagaauacaggcuacgcggagaggcuaggaaaacguuuguagaucugaugcguagaggcgauuuaccagugugguuagcauauaagguugcagcagagggcauaaacuaugcggacagaagaugguguuuugauggaauuaagaacaaccaaaucuuggaggaaaauguagaaguugaaaucuggacaaaagaaggagagagaaagaaauugaaaccgagauggcuugacgccagaauauauucggauccucuagcgcuuaaagaauuuaaagaauuugcugcuggaagaaaaucacugacucuaaaccuaauuacggaaaugggucgcuuaccgaccuuuaugacacagaaaacgagagaugcccucgacaaccuagcuguacuucacacugccgaagccggagguagggcauacaaucaugcucugagcgaacuacccgaaacgcuagagacacucuuauuacuuacguuauuggccacugucacugguggaauauuuuuguuuuuaaugucagggagaggaauaggcaaaaugacacuuggaaugugcuguaucauuacagccucaaucuuacuaugguacgcccaaauacaaccucauuggauagcagccucuauuauucucgaguucuuuuuaauaguuuuauuaauaccagaaccugaaaagcaaagaacaccucaggacaaucaacuuacuuaugugguaauagcuauuuugacugugguugcugccaccauggccaacgaaaugggcuucuuggagaaaacuaagaaagacuuaggucuggguucaauagcuacgcaacaaccggagaguaauauauuggauauagacuuaagaccagcuucugcuuggaccuuauacgcggucgccacuacauucguuacaccaaugcuuaggcacuccauagaaaauucgucugugaauguuagucuuacagcaauagcaaaucaggcaacuguacuuaugggauuaggcaagggcuggccauugaguaagauggacauaggaguaccacuccuagcuauuggauguuauagccaggugaacccgaucacauugacggccgcacuucuacuccuuguagcucacuaugcaauaauaggaccuggauuacaagcaaaggcuacaagagaggcucagaaaagagcggcugcaggcaucaugaaaaacccuaccguugacggaauuaccguuaucgaccuagauccaauucccuaugacccgaaauucgagaagcaauuaggucaagugauguuacucauauuaugcguaacucagguccugaugaugcgaacaacaugggcacuuugugaagcucuaacacuugcaacaggaccaaucaguacccuuugggaaggcaauccagggagauuuuggaauacuacaauugccguaagcauggccaauauuuuuaggggcagcuaccuagcuggagcagguuugcuauuuucuaucaugaaaaacacaacaaacaccaggaggggaaccggaaacacuggggaaacguuaggggaaaaauggaaaucccgacucaacgcuuuagguaagagcgaauuucaaauuuacaaaaagucaggcauacaagaaguagaccgaacucuagccaaggaggguauuaagaggggagaaacugaucaucacgcggugucucgagggucugcaaaacuuagaugguuuguagagagaaacaugguaacacccgaagguaaagugguugaccugggcugcgguagaggcggcuggucauacuauuguggcggacucaaaaauguacgagaaguuaaaggccuuacaaaaggaggacccggacacgaagaaccaauaccaaugucuacauauggcuggaaucugguuaggcuacagucgggaguagacguauuuuucauaccaccagaaaaaugugacacuuuauugugcgauauaggugaauccucgccaaauccaaccguagaagcaggacguacauugcggguuuugaaccucguagagaauugguuaaauaauaauacccaguucugcauaaaaguacuaaauccauauaugccuaguguaauagagaaaauggaagcauuacaacggaaauacggcggggcauuaguucgaaauccuuugucgcguaacucaacacaugaaauguauugggugucuaaugcuucgggaaacaucguuucaucggugaacaugauuaguaggauguuaauaaacagauucacaaugcgucauaaaaaggcgacuuaugaaccagauguugaccuaggaucaggcacaagaaauauugggauugaaucagagauacccaaucuagacauaauagguaaacgcauagagaaaauuaagcaagagcacgagacgagcuggcauuacgaccaggaucacccauauaagacaugggcauaucacgguucuuaugagacaaagcaaacaggaagcgcaaguucaauggucaacggaguagugcgcuuauuaacgaaaccgugggacguacuccccacuguuacacaaauggcaaugacagacacaacccccuuuggacaacagagaguauuuaaggaaaaaguagauacucgaacacaagaacccaaagaaggaacaaagaaauuaaugaaaauaaccgcagaguggcuuuggaaggaauuaggcaagaagaaaacacccaggauguguacaagggaagaguuuacaaagaaaguacguaguaaugcugcacucggcgcuauuuuuacagaugaaaauaaauggaaaucugcccgagaagccguagaagauucaagauuuugggagcuuguggacaaggaaagaaaccuccauuuagaaggaaaaugcgaaaccugugucuauaacaugaugggaaagcgugagaagaaauuaggagaguucgggaaagccaaagggaguagagccauaugguacaugugguuaggugcacguuuucucgaauuugaagcacucggauuucuuaaugaagaucauugguuuaguagggaaaacucguuauccgguguggaaggugagggacuacacaaguuaggcuauauucuaagagacgucucuaagaaagagggaggagcaauguacgcugacgauacugcaggaugggacacgagaauaacgcucgaagauuugaaaaacgaagagaugguuacgaaucauauggaaggcgaacauaagaaauuggcugaagcaauauuuaaacuuacauaccaaaauaaaguuguaaggguacaaagaccuacgccucgugguacuguaauggacauuauuucaagaagagaucagcgaggcuccggucagguaggaacguacgguuuaaacacguuuacaaauauggaagcccaguugauuaggcaaauggaaggcgaaggggucuuuaaaaauauccagcacuuaacgguaacagaggaggucgcuguacacaauugguuagcucgggugggucgagagcgauuauccagaauggccaucucaggcgaugauuguguggugaagcccuuagacgauagauuugcaaacgcuuuaacagcucucaaugacaugggaaaaauaagaaaagacauacaacagugggaaccgucaaaagguuggaacgacuggacccaaguaccauuuugcucgcaucacuuccaugaacuaauaaugaaagacggaaggauucuuguagucccuugccgaaaucaggaugaauugauuggcagagcaaggaucagucagggagccggcuggucacuucgagaaaccgcaugcuuagggaaaaguuaugcccaaauguggagucugauguauuuccaccgaagagaccuacgauuagccgcaaaugccauuuguucugccgugccaucccacuggguacccaccucgaggaccaccuggucaauacacgccaaacaugaauggaugacaacugaagauaugcuuaccguauggaaucguguguggauuagggagaauccauggauggaagacaaaacacccgucgaaucuugggaagaaauacccuaucuaggaaaaagggaagaucaaugguguggaagucuaaucggauuaacuucacgagcaacgugggcuaaaaauauacaggccgcuauaaaccaggugcggucucuaauugggaacgaggaauacacagauuauaugcccuccaugaagagauucagacgagaggaggaagaggcugguguacuuugguaa

SEQ ID NO: 22785 - RNA, 9876 nt, Artificial Sequence
  derived and/or modified CDS sequence (opt6) from DENV-2__EU482470__SS-prME
agcgcaggaaugaucauaaugcugauacccacgguuauggcauuucaccuuacaacgcguaauggcgaaccgcauaugauuguaggcauucaagaaaaaggcaaaagccuacuguucaaaaccgaagaugguguaaauauguguacauugauggcuauggaccuaggugaauuaugcgaagacacaauaaccuauaaauguccccuauuacgacaaaacgaacccgaagacaucgacugcuggugcaauucaacuucaacauggguuaccuauggcacuuguaccacaacuggagaacaucgacgggaaaaacguucgguagcucugguaccacacguaggaauggguuuggaaacccgaacagaaacauggaugagcucugaaggugcguggaaacaugcucaaaggauagaaacuuggauacuaaggcacccuggcuucaccauaauggcggcuauacuggccuacacuaucgguacuacccacuuccaaaggguuuuaaucuuuauucuauuaacugcggucgcgccaaguaugacgaugagaugcauaggaaucaguaauagagauuuuguggaaggaguuucuggcggguccuggguugauauaguacuagaacauggcagcuguguaaccacuauggcuaaaaacaaacccacccuugauuuugaauuaauaaaaacugaagcaaaacagcccgcgacgcuaaggaaauauugcauagaagcgaaacuaacaaacacaacgacagaaaguagauguccaacacaaggagaaccaucucuaaaagaagaacaagacaaaagauucguuugcaaacauaguaugguagaucgugguuggggaaauggauguggccuguucggaaaaggugggauuguaacgugcgcaauguuuacaugcaagaaaaauauggaagguaaaauaguccagcccgaaaaccuagaauacacuauagucguaacaccucacuccggugaagaacacgcaguaggaaacgauacaggcaaacacgggaaagagauaaaagucaccccacagucaaguauuacagaagcagagcuaacugguuacggaacggugacuauggaguguuccccgcgcacaggcuuagauuucaaugaaaugguauuguugcaaauggaaaauaaagcgugguugguacauaggcaaugguuccuugaccugccgcuaccaugguuacccggagcugacaaacaagagucgaauuggauucaaaaagaaacgcuagucaccuucaaaaacccacacgccaagaaacaagauguagucguuuuagguagccaagaaggagcgaugcauacagcuuugaccggagccacggagauacagaugaguagugguaauuugcuuuucaccggucaccuaaaaugucgcuugcgaauggauaaauuacaacucaaaggaaugagcuauucuauguguaccggcaaauucaaaguuguuaaagaaauugcagaaacccaacacggaacgauuguaauacgaguucaauaugaaggagacggcucgcccugcaaaauaccuuuugaaauaauggaccucgaaaaacgauauguucuugggcgccuaauaacuguaaauccaaucguaacugaaaaagauucacccgugaauauugaagcugaaccacccuucggagauaguuacaucauuaucggaguagaaccaggacaacuuaaacuuaacugguucaagaaaggcuccucuauuggacagauguucgaaacaacgaugcgaggggcaaaaagaauggccauacuuggggauacagcuugggacuucgguagucucggggguguauucacaaguaucggaaaggcuuuacaccaaguguuuggagcuauauauggagcagccuuuagcgggguuucauggacgaugaaaauuuuaauaggcguuaucauaaccuggauagggaugaacucucgaucaacgucgcuaagugugagucuaguccuaguagguauagugacacuguaucucgggguaaugguucaagcagauucuggaugcgugguauccuggaaaaacaaagaacuuaagugcggaaguggaauauuuauaacugacaauguucauacuuggacugaacaauacaaauuucaaccagaauccccaucuaagcuagcgucggcuauccagaaagcucaggaagaaggaaucugcggaauacguaguguaacuagauuagaaaacuuaauguggaaacagauaacaccugaauuaaaucacauauuagcugaaaacgagguuaaacucacaauuaugacaggugauauaaaaggcauaaugcaagcaggaaaacgaucucugcgaccucaaccaacugaacugaaauauagcuggaagacauggggcaaagccaagauguuauccacagaaucguacaaucaaacauuccuuauugaugggccagagacugcagaaugccccaacacuaaucgagccuggaacucucuagagguagaagauuacgguuuugguguuuuuacaaccaauaucugguugaaauuaaaggagaaacaagaugcauuuugcgacaguaaauuaaugucugcagccauaaaagacaaucgagcaguacaugcagauaugggcuauuggauugaaagugccuugaacgauacauggaaaauagagaaggcaucauuuaucgaagucaaaaauugccauuggccaaaaucucacaccuuauggucgaauggaguauuagaaucagagaugaucauucccaaaaaucuugcggguccggucagucaacauaauuaccgacccggauaucacacgcagauugccggaccguggcauuuagggaaacuugaaauggauuuugauuuuugugacgguacaacaguuauuguaacggaagauugcgggaauagaggaccaucgcucaggacuaccaccgcaucaggaaaacuaauuaccgagugguguugccguucuuguacauuaccuccauugagauaucggggugaagacgguuguugguaugguauggagaucagaccccuaaaagaaaaagaagaaaaucuaguaaauucucuaguuacagcaggacacggacaaguugacaauuucucauuaggcguccugggaauggcacuauuucuggaggagaugcugagaacaagaguugguacaaaacacgcgauuuugcuuguagccgucucauuugugacguuaauaacuggaaauauguccuucaaagaccuaggcagagugguaguaaugguaggggccacuauggcugacgacauaggaaugggcguaaccuaucuagcgcuacuagcggcuuucaaagugagaccgacauuugcugccggcuuacuucuucgaaaauuaacaucaaaagaacuaaugaugaccaccauagggauaguauugcuaagccaaucgacaaucccggaaaccguacuugagcugacggaugcauuggcauuaggcaugauggugcucaagauaguaagaaauauggagaaguaccaauuagcugucacaauaaugaccauuuuaugcgugcccaaugcaguaauucuacaaaacgcauggaaagugagcuguacaauauuagcgguaguaucagugagccccuuacuuuuaaccucaaguagacagaaaacagacuggauaccauuggcgcugaccauaaaaggucugaauccuacugcaaucuuccucaccacguugagcagaacgaauaagaaacgaaguuggccccugaaugaagccauaauggcugucggaauggucucaauauuggcuucuagucuacugaaaaacgauauaccuaugacggggccuuuaguagccggcggcuuacuaacagucugcuacguacucacaggacggucagcugaucuagaacuugaacgagcgacagauguuaagugggaagaucaagcagaaauuucugggaguagucccauacucagcaucacuaucucugaagacggcucaauguccauuaaaaacgaggaagaagaacaaaccuugacaauacugauucguaccggauuauuagugauuagcggccuauuuccaauuaguauuccuauaacagcugcugcuugguaccuuugggagguuaagaaacagagagccggagugcugugggaugugccaucaccuccuccaaugggaaaagcagaacuagaagacggagcauaccgaauuaaacaaaagggcauacuuggguacagccaaauaggcgcaggaguauauaaggaagguacguuccauacgauguggcauguaacuagaggugcaguacucaugcauaaagggaagagaauagaaccuaguugggcagacgucaagaaagaucuaauaucauacggcggaggauggaaacuagaaggcgaauggaaagaaggugaagaagugcagguauuagcuuuagaaccagggaaaaacccaagggcgguacaaacgaaacccgggcuauuuaaaacaaauacuggaacaauaggagcgguaucauuagacuuuucaccaggaacuucuggaagcccgauuauagacaagaaagguaaaguaguagggcucuauggcaacgguguuguaaccagaucaggggcuuaugucagcgccauugcgcaaaccgaaaaaucaauagaagauaaccccgaaaucgaagacgauaucuuucgaaagcggagacugacgaucauggaucuacauccaggcgcuggaaagaccaaacguuaucugccagcaauaguaagggaagcaauaaagagaggguugaggacacucauucuugcgccuacacgugucguagcugcggaaauggaggaagccuuacgaggucucccaauucgcuaucaaacuccugcuauuagagcagagcacacgggacgugaaauuguagacuugaugugucaugcuacauucacaaugagauuacuaucacccguaagagucccaaacuacaaccuuauaauaauggacgaagcacauuucacagaucccgcaucaauagcagcacgggguuacauuucuacuagagucgaaaugggcgaagcagcaggaaucuuuaugacagcaaccccaccugggucaagagacccauuuccucaaaguaaugcgccuauaauugaugaagagagagaaauaccagaaagaucguggaacucuggacaugaauggguuacagauuuuaaaggaaaaacaguuugguucguaccaucuauaaaagcaggaaaugacauagcagcaugcuugaggaaaaauggcaagaaaguaauucaacuaagcaggaaaacguuugauagugaauauguaaaaacaagaacgaacgacugggauuuugugguaacgacagacauuagugaaaugggagcaaauuucaaggcagaacgaguaauugaucccagacguuguaugaagcccguuauucuaacagauggagaagaaagagucaucuuagcuggacccaugccaguuacccacucaagugcugcccagagaagaggcagaauuggaagaaauccuaaaaaugaaaaugaccaguauauuuauaugggugagccacucgagaacgacgaagauugcgcccacuggaaagaagcaaagauguuacuagauaauaucaauacaccagagggaaucaucccaagcauguuugaaccugaaagagaaaaggucgacgcgaucgauggagaauacaggcuuagaggggaagcccgcaaaacuuuuguugauuugaugagaagaggugacuugccagucugguuagcauauaaaguggcagcagaaggcauaaauuaugcagauaggagauggugcuucgacggaauaaagaauaaccaaauuuuggaagaaaacguagaaguagaaauuuggacaaaggaaggagaaagaaagaaauuaaaaccaagaugguuggacgcacgaauauauucggacccacuugcacucaaggaguuuaaagaguucgccgcugguagaaaaucacuaacguugaaucuuauaacagaaaugggaagacuucccaccuuuaugacacagaaaacacgagacgcacuagacaaucuagcggucuuacauacugcagaggcaggaggccgagcuuauaaccacgcacucucggaguuaccugagacacucgaaacacuacuccuacugacauuacuagccacugucacuggcggaauauuuuuauuccuaaugaguggaagaggaauagguaagaugacucuaggaauguguuguaucauaacggcuaguauacuacugugguaugcucagauacaaccacacuggaucgcagccagcauuauacuugaguucuuuuuaauagucuuauuaauaccagaaccugaaaagcaacguacaccacaagacaaccagcuaacauauguaguaaucgcaauuuuaacgguaguugcagccacaauggcgaaugaaaugggauuucuggagaaaacaaagaaagauuuaggacuuggaagcaucgcaacucaacaaccagaaucgaacauacuggacaucgauuugaggccagcuagcgccuggacgcuauacgccguagcaacgacauucgugacuccaaugcucagacauagcaucgaaaauucuaguguuaauguaucacuuacagcaaucgcgaaucaggcgacuguauuaaugggguuaggaaaaggguggccgcuaucgaaaauggacauaggcguaccacuuuuggcaauagggugcuauucccaagucaauccaauaacuuuaacagcugccuuauuguuguuaguagcucauuaugcaaucaucggaccgggacuacaggcuaaagcuacacgagaggcacaaaaacgagcagcugcugggauuaugaaaaaccccacaguggauggcauaaccguaaucgacuuagauccuauaccuuacgacccaaaauucgaaaagcagcucggacagguaaugcuucucauccucugcguuacccaaguauuaaugaugagaaccacaugggcauuaugugaggcccuaacacuagcaacaggcccuauuucaacccuaugggaaggaaauccaggcagguucuggaauacaaccauugcagucucaauggcaaauauauuuagaggaagcuauuuagccggagcuggacuacuauucucgaucaugaaaaauacgacaaauacacggcgugggacugguaauaugggugaaacauuaggagaaaaauggaaaucgcgauuaaaugcacucggcaagucagaguuccagaucuacaagaaaucuggaauccaagagguggaucgaacccuagcgaaagaaggaauuaaacgaggcgaaacagaccaucaugcuguaucccgagguucagccaaacuacgcugguuugucgagcgaaauaugguaaccccagaaggaaaaguaguagauuugggauguggaagaggugguuggaguuacuacugcgguggacucaaaaauguacgagaaguaaaaggacuaacaaaaggggguccagggcacgaagaaccaaucccuauguccaccuaugguuggaauuuagugagacuacagucggggguagauguauucuuuauaccaccagaaaaaugugauacccuacuaugugacauuggggaaucuucucccaaccccaccguugaagcaggaagaacacuaagagucuugaaccuuguagagaauuggcuaaauaacaauacacaauuuugcauuaaagugcucaaccccuauaugccgucgguaauagagaaaauggaggcuuuacaacguaaauacggcggagcccuaguaagaaauccucuaaguagaaauucuacgcaugaaauguacuggguuucaaaugccucagggaauauaguaucuaguguaaacaugauuagucgaaugcugaucaaccgauucacuaugcgccacaagaaagcgacauaugagccagacguagauuuaggaucaggaacaagaaacauuggaauugagucagaaauucccaauuuggacauaauuggaaaacguauugagaaaauaaaacaagaacaugagacaaguuggcauuacgaucaggaucauccauacaaaacuugggcauaucauggaaguuaugaaacuaaacaaacaggcucugcaagcaguauggucaacggaguaguucgauuacugaccaaaccaugggauguguuaccuaccgucacucaaauggcaaugacagauacaacuccuuuuggacagcagcgggucuuuaaggagaaaguagauacacggacacaagaaccuaaagaggguaccaagaaacuaaugaaaauaaccgcggaauggcuauggaaggaauuggggaagaagaaaacaccuagaauguguacccgagaggaguuuacccguaaaguaaggucgaacgcagcucuaggagcuauuuuuaccgacgaaaauaaauggaaaucugcgagagaagcuguugaagacucgggauucugggagcuaguagacaaagaaagaaaucuccaccuagaagguaaaugcgagacauguguauauaacaugauggguaaacgcgagaagaaauuaggugaguucgguaaagcaaaagguucccgugcuauaugguacaugugguugggggcaagguuucuggaauuugaagcucuugguuuucuaaacgaagaucacugguuuucacgagagaacucguugucaggcguagagggagaagguuuacacaaauugggcuacauucuaagagaugucagcaagaaagaggguggggccauguaugcugaugacacggcugguugggauacccgcauaacucuggaagaucuuaaaaacgaagaaaugguaacuaaucacauggaaggagaacacaagaaacuagcagaggcaauauuuaaacuaacuuaucaaaauaaaguggugcgaguacagagaccuacuccgaggggaaccguaauggacaucaucagccgacgggaccaaagaggauccggccagguagggacauaugggcuuaacacauuuacuaauauggaggcucaacuuaucaggcaaauggaaggcgaagguguuuucaaaaauauccagcaucuaacaguaaccgaagaaguagcuguacagaacuggcuugcaagaguaggucgagagcgauugucucguauggcgaucucaggggacgauuguguaguaaagcccuuggacgacagguucgcaaaugcauuaacagcccuaaaugauauggguaaaauaagaaaagacauccaacaaugggaaccgaguaagggauggaacgacuggacccaaguuccauuuugcucacaucauuuucaugaacugauaaugaaagacggaagaguucuggucguaccuuguaggaaccaagaugaacuuauuggcagagcgcguauuucacaaggagcaggauggucguuacgugagacagcaugccucgggaagaguuaugcgcaaauguggaguuuaauguauuuccaucguagagaucuaagacuggcugcaaacgccauauguucggcaguuccuagucauugggugccaacgaguaggacgaccuggaguauccaugccaaacaugaauggaugacaacugaagauauguuaaccguauggaacagaguauggauuagagagaauccauggauggaagacaagacccccguagagagcugggaagaaauaccuuaucucgggaaacgugaggaucaauggugcgggagucuuauaggauuaacaagucgagcaacgugggcgaaaaauauacaagcggcuaucaaucaaguaagaagucuaauagggaaugaagaauacacagauuauaugcccucuaugaaaagauuuagacgugaagaggaggaggcaggaguccuuugguga

SEQ ID NO: 22786 - RNA, 9876 nt, Artificial Sequence
  derived and/or modified CDS sequence (opt6) from DENV-2__EU482471__SS-prME
ucagccggaaugauuauuaugcuuauuccaacaguaauggcauuccaccuaacaacacgaaauggugaaccccacaugauaguuggaauacaagaaaaaggcaaaucauuacuuuuuaaaaccgaagauggaguaaauaugugcacacuuauggcaauggauuuaggcgaacuaugcgaagauacaauaacauauaagugcccucuuuuaagacaaaacgaaccagaagacauagacuguuggugcaacucaacaagcacuuggguuacauacggaacguguaccacaacuggugagcauaggagagaaaagcgaucggucgcccuaguaccacauguggggaugggccuugaaacgcgaaccgaaacguggaugucuucugagggugccuggaaacacgcucaaagaauagaaacuuggauacuacgacacccuggguucacaaucauggccgcaauauuagcguacacuaucggaaccacucauuuucaaagaguucuuauauuuauauuguuaacugccguagcacccaguaugaccaugagaugcauaggaaucaguaacagagauuuugucgaagguguuucaggagguuccuggguugauauuguacuugagcaugguagcugugucacaacuauggcuaaaaauaaaccgacccuagauuucgagcuaauaaaaacagaagcuaaacaacccgcuacuuuacguaaguauuguaucgaggcuaaauugacaaacacgacaacagagagucgauguccgacgcaaggugaaccuagccuaaaagaagaacaagauaaacgauuuguauguaagcacucaaugguagaccgaggaugggguaauggauguggacuuuucgguaagggaggaaucguaacaugugcaauguuuaccuguaaaaaaaacauggaaggcaagauaguacaaccggagaaucuagaguacaccauaguagugacaccccacucaggggaagaacacucuguagguaaugauacaggaaaacauggcauggagauaaaaguuacaccccaaaguucgaucacagaggccgagcuuacgggauacggaacagugacuauggagugcagucccagaacuggcuuggacuuuaacgaaaugguucuguugcagauggagaauaaagcauggcucguucaucgucaaugguuucuugacuuaccccuaccauggcuuccuggagcagacaaacaagaguccaauuggauucaaaaagagacuuuggucacauuuaagaauccccacgcuaaaaagcaggacguaguggugcuaggaucgcaagagggagcgaugcauacagccuugacaggugcaacugagauacagaugaguagcgguaauuugcuauuuacaggacaucucaaaugucgucuacgaauggauaagcuucagcuuaaaggcaugucguauuccauguguacaggcaaguuuaaaguuguaaaggaaaucgcggaaacucaacaugguacuaucgugauuagaguccaauaugagggggacggaucuccuuguaaaauaccguuugaaauuauggaucuagagaagcgauauguacuuggucgucuaaucacaguaaauccaauaguaaccgagaaagauucaccaguaaauauugaagcugagccuccguuuggugacucuuauaucauuaucgguguggagcccggucaauuaaaguuaaacugguuuaaaaagggguccagcauaggacaaauguuugagacuacgaugcguggcgcuaagaggauggccauacuaggcgauacugcaugggacuuugguagccuggguggaguuuuuaccucaauaggaaaggcacuacaccaaguguuuggagcaaucuacggcgcggcauuuucaggcgucuccuggacaaugaaaauacuaauuggaguaauuauaaccuggaucggaaugaauagccgaaguacgucucugagcgucucacuuguccucguagguauagugacauuauaucugggaguuaugguacaagcugauucuggaugcguuguaaguuggaaaaacaaagaacuaaaaugugguaguggcaucuucauaacugauaacguacauaccuggacugaacaguauaaauuccaaccggagagcccuucaaaauuggcgagugccauucaaaaagcucaagaagaaggcauuugcggcauccgaaguguaacuagacuagaaaaccucauguggaaacaaauuacaccagagcuuaaccauauccuagcagaaaacgaaguaaaauuaacuauaaugacuggagacauuagaggaauuaugcaggcaggcaaacgaucauuaagaccacaaccuaccgaauuaaaauacaguuggaaaacaugggguaaggcaaagauguuaucuacagagaguuacaaucagacauuccugauagauggacccgagacagcagaauguccaaacaccaauagagcauggaacucauuagagguagaggauuaugguuucggugucuuuacgaccaauauauggcuaaagcugaaggaaaaacaagacgcguucugugauuccaaguuaaugucggcggccauuaaagacaaccgugccguccacgcagacaugggcuauuggaucgaguccgcacuaaaugacacauggaaaauugaaaaagcuucauucauagaaguuaaaaacugccauuggccaaaaucacauacacuauggaguaaugguguuuuagagucugaaaugauaauaccuaaaaaccuagcaggaccuguuucacaacacaacuaucggccugguuaccauacucaaauugcagguccguggcaucucgguaaacucgaaauggauuuugauuuuugugaugggacaacaguaauuguuacagaagauugugguaacaggggucccucuuuacgaaccaccacggcgagugggaaauuaauaaccgaauggugcugucgaucuuguacauuaccaccccuccgguauagaggagaagacgguuguugguaugguauggaaauccgaccguuaaaagaaaaagaagaaaaccuagucaauucuuuaguaacugcuggacacgggcaaguagacaauuuuucacuggguguucuggggauggcgcuauucuuagaagaaaugcuaagaacuagggucgggacuaaacaugcaauacuucuaguagcaguaucauuuguaacucuuauaacuggaaacauguccuuuaaagaucuugguagaguaguaguaauggugggugccacaauggcugaugacauagguaugggagucaccuaucuagcuuuacuagcagcauuuaaagucagacccaccuuugcggcagguuuacuacuucgcaaacuuacgucuaaagaacugaugaugacaacuauaggcauaguucuuuuaagccaaucaacaauaccagagacuguccucgaauugaccgaugcacuugcauuaggaaugaugguuuuaaagaucguccgaaacauggaaaaauaucaacucgcaguuacuauaauggcgauccugugcguaccaaaugcuguuauucuucaaaaugccuggaaaguaucauguacaauauuagcgguaguuucuguaucacccuuguuacuaacuaguucacagcagaaaacagauuggauaccccuagcucuuaccauaaaaggguugaauccgacagcaaucuuucuaacaacauuaagcagaacaaauaaaaaaagaucuuggccacuuaaugaagcaauaauggcugugggaauggucucuauacuagcgucaucacuccuuaaaaacgacauuccgaugaccgguccccucguggcaggaggauugcuaacuguuugcuacguccucacagggcgaucggcugauuuagaauuggaacgugcaacaaauguaaaaugggaggaucaagccgaaauaucugguagcagcccaauacucucgauaacaauaucugaagauggauccaugucaauaaaaaaugaagaggaagaacaaacacuuacgauuuuaauuaggacuggcuuacuaguaauauccgggcuauucccuauuagcauaccaaucacagcggccgcgugguaucugugggaaguuaaaaaacaacgagcugguguacuaugggaugucccgaguccuccaccgauggggaaagcugaauuagaagauggagcauauaggauuaaacaaaaagggauuuuaggguacucacaaaucggcgccgggguuuauaaagaaggcacuuuccauacaauguggcauguaacuagaggagcuguucucaugcauaaagguaaacgcauagaaccaucgugggcagauguaaagaaagaccuaauuucauacgguggggguuggaaacucgaaggcgaguggaaagaaggagaagaggugcaagucuuagcauuagaaccaggaaagaauccgagagcagugcaaacaaaacccggucuauuuaaaacgaacacuggaacaauaggagccguaagccuagacuuuucaccagguacgucgggaucacccauuauagauaaaaaaggaaaagucgucggacuguacggaaauggaguagugacaagaaguggggcauauguauccgcaauugcacaaacggaaaaaucgauagaggauaauccggagaucgaagaugacauauuucggaaacgacgccuaaccauuauggaccuacaucccggagcaggaaaaacaaagcgauacuuacccgcaauaguaagagaggcaauuaagcgaggucugagaacgcuaauucuagcuccuacacgagucguagcggcugaaauggaagaggcucuucguggcuuaccgauuagauaucaaaccccugcaaucagagcggaacauaccggucgagaaauaguugauuuaaugugucacgcuaccuuuacaaugcgguuauugaguccaguuagaguaccaaauuauaacuuaauuauaauggaugaagcacauuucacugauccagccucuauagcggcaagagguuauauaagcacgcguguagaaaugggagaagcagcaggaauuuucaugaccgcuacaccuccaggaucucgugauccuuucccucagagcaaugcgccaauaaucgaugaagaaagggaaauacccgaaagauccuggaauagugggcaugaaugggugacagacuucaaaggaaaaacugugugguucguaccgaguauuaaagcggguaaugauaucgcggcaugucucagaaaaaauggaaaaaagguaauccaauuauccagaaagacguucgacucugaguaugucaaaacuagaaccaacgacugggauuucguaguaaccacagacauaagugaaaugggcgcaaauuuuaaagcggagcgcguuaucgauccaagacgauguaugaagccugugauucuuacagacggagaagagcgcguaauacuggccggacccaugccagucacucauucaagugcugcucaacguagagggcgaauaggaagaaauccaaaaaaugagaacgaucaauauauauauaugggcgaaccuuuagaaaacgaugaagacugugcgcauuggaaagaagcaaaaauguuauuggauaacaucaauacacccgaaggaaucauaccaagcauguucgaaccagaacgcgagaagguagaugcaauagauggggaauauagacuaagaggagaagcuagaaaaacuuucguugaucuuaugagaagaggagauuuaccaguuuggcuagcuuacaaaguagcagcagaagggauaaauuaugcggaccguagaugguguuuugacgguaucaaaaacaaccaaauucuagaggagaacguggaaguagaaauuuggaccaaagaaggggaaagaaagaaguugaaaccccgguggcucgacgcuagaaucuauucugacccuuuagcccuaaaggaauuuaaagaguuugccgcugggcgcaaaagccucacauuaaauuuaaucaccgaaauggggcgacuuccuacauuuaugacgcaaaagaccagagaugcacuggauaacuuagcuguacuucauacggcugaggcgggcggcagagcauauaaucacgcuuugucugagcuccccgagacgcuagaaacauuauuacuacugacauuauuagcaacgguaacgggcggaauauuccuauuuuugaugucugguagaggaaucggaaaaaugacccucggaauguguuguauaaucacggcgucuaucuuacuaugguacgcucaaauacagccucacuggaucgcagcauccaucauacucgaauucuuucugauuguuuuauuaauaccagaaccggaaaaacagagaacaccacaagauaaucagcuaacauaugugguuauagccauauuaacuguuguagcggccacuauggcaaacgaaauggguuuuuuggaaaagacgaaaaaggaccuuggauuaggaucuaucgcaacgcaacaaccggaaucuaacauacuagauauagaucuacgaccggcuuccgcauggacucuguacgcgguagcaacaacauuugucacacccaugcuaagacauagcauugaaaauuccucagugaacguaucauuaacugcuauagcuaaucaggcuacaguccucaugggccuagguaaaggauggccacuuucaaaaauggacauugggguaccgcuuuuagcaauaggaugcuacucucaggucaacccaauaacucugacagccgcauuacuuuuauuagucgcgcauuaugccauaaucggaccaggucuacaagcaaaagcaaccagagaagcacaaaagagagcggcagcuggcauaaugaagaauccaacaguagacgguauuacaguaauagaucuugauccaauucccuaugaucccaaauuugaaaaacagcuuggccaaguaaugcuuuugauacuguguguaacccagguacucaugaugagaacuacgugggcuuuaugcgaggcucucacacuagcaacaggaccaaucaguacccucugggaagguaauccaggacgauuuuggaauacuacaauugcaguaaguauggcgaacaucuucagagguaguuaucuagcaggcgcuggacuacuuuuuaguauaaugaagaauaccacuaauacucgacguggaacuggaaacaucggugagacccugggggagaaauggaaaaguaggcuuaaugcccuggguaaaucggaguuucagaucuauaaaaaaucugguauucaagaagucgaccgcacacuagcaaaggaagggauaaagcgaggagagacagaccaccaugcagucucacgagggucagcaaagcugaggugguuugucgagaggaacaugguuacaccagaaggaaaaguuguagaucuagggugcggaagagguggauggucauauuauugcggcggauuaaaaaacgucagggaaguaaaagguuugaccaagggagguccgggucacgaggaaccuaucccgaugagcacuuacggauggaacuuagucagguuacaaucagguguggauguuuuuuucauuccaccagaaaaaugugacacacuucuaugugauauaggagaaucuucccccaacccgaccguagaggccggccgcacacugagaguauuaaaucugguugaaaauugguuaaacaauaauacucaguucugcaucaaaguucuuaauccauauaugccuuccgucauagaaaaaauggaagcuuuacaaagaaaauaugguggagcacuaguaaggaauccuuuaucacgaaacaguacccaugaaauguauugggucucaaaugcaaguggcaauauaguaucaucuguuaauaugauaucgcgaaugcuuaucaacagauuuaccaugagacauaagaaagccacauaugaaccggaugucgaucuggggagugggaccaggaacauaggcauugaaucugaaauuccgaauuuagauauaaucggaaaacgcaucgaaaaaauaaaacaagaacacgaaacgucauggcauuaugaucaagaucaucccuauaaaacaugggcauaccauggaagcuaugaaacaaaacaaacagguucugcaucuagcauggucaauggaguuguaagauuguuaacaaagccaugggacgucuuacccacuguaacucagauggccaugacagauacaacaccauuuggccagcaaagggucuucaaagaaaaaguagauaccaggacucaggaaccaaaagaagggacaaaaaaacuaaugaaaauuacugcagaauggcuauggaaagaacuaggaaagaaaaaaacaccaagaaugugcacacgcgaggaauucacaagaaaggugagaagcaaugcagcauuaggggcaauuuuuacugacgagaauaaguggaaaucugcaagagaagcagucgaagauucuagauucugggaguugguagauaaagagagaaauuuacaucucgaggguaaaugugagacuugcguauacaauaugaugggaaaacgagaaaagaaacuuggggaauuuggaaaggcuaaagguucgcgcgcgauuugguacauguggcuuggagcgagguuccuugaauucgaagccuuaggguuucucaaugaggaccacugguucucaagggagaacucuuuaagcggaguugaaggagaaggcuuacauaaguuaggauauauauuaagagaugucagcaagaaagaagggggagcaauguacgcggaugacaccgcagggugggacacuaggauaacauuggaggauuuaaaaaaugaagaaaugguuacgaaccauauggaaggagaacacaaaaaauuagcugaggcuaucuuuaaguuaacuuaccaaaacaaaguuguacguguucagagaccuaccccuagaggaacgguuauggauauuauaagccggagagaucagcgaggcucuggacagguuggaaccuauggacugaacacauuuacgaacauggaagcgcaacugauaagacaaauggaaggcgaggguguuuucaaaaauauucaacaucuaacagugaccgaagaagucgccguacauaauugguuagcuagaguaggcagagaacgcuugucucgcauggcgauaaguggggacgauugcgucgugaaaccccuugaugaccguuucgcaaacgcacucacugcgcuaaaugauauggguaaaauacgcaaggauauucaacaaugggagccaagcaaagguuggaacgacuggacacaagugccguuuuguucgcaucauuuccacgaauugauaaugaaagaugguaggaucuugguggugccuugucgaaaccaagaugagcugauaggucgcgcgcggauuucccaaggugcgggauggaguuuaagagaaacggcuugucucggaaagaguuacgcacaaauguggucacuaauguauuuucaccggagggauuuacgcuuagccgcaaacgcaauaugcucggcagugccuagccauugggugccaacuuccagaacaacguggaguauccaugccaagcacgaguggaugacgacagaagauaugcuaacaguuuggaacagagucuggauccgugaaaauccguggauggaagacaaaacaccuguagaaucuugggaagaaaucccauaucugggaaagagggaagaucaaugguguggaucacuuauaggccuaacaucgagggcgacaugggcaaagaauauucaagcagcaauaaaccaaguaagauccuugauaggaaacgaagaauauacagacuauaugccgaguaugaaaagguuuagaagagaagaagaggaagcaggaguuuuaugguag

SEQ ID NO: 22787 - RNA, 9876 nt, Artificial Sequence
  derived and/or modified CDS sequence (opt6) from DENV-2__EU482472__SS-prME
ucagcagguaugaucauaaugcuaauccccacuguaauggcuuuccaccuaacaacuaggaacggagaaccccauaugauuguugguauacaggaaaaagggaaaucacuuuuauuuaaaaccgaagaugggguuaauaugugcacacuuauggcaauggacuuaggugaacuaugugaagauacaauuacuuacaaauguccuuuacuaagacagaacgaaccggaggauauugauugcuggugcaauucgacaagcacuugggucacauauggcacuugcaccacaacuggagagcacagaagagagaaaaggucaguggcucuaguaccccacguaggaauggguuuagaaacuagaaccgagaccuggaugucaucugaaggggcguggaaacacgcgcagagaauugaaacuuggauacuacggcaccccgguuuuacaauaauggcggcaauauuggcauacacgauugggacaacucacuuccaacgaguucuaauauuuauucuacuaacagcuguagccccaagcaugacaaugagaugcauugggauaaguaaccgagauuuuguagaaggagucucuggcgguucauggguggacauaguucuagaacauggaucauguguaaccacaauggcuaaaaauaaaccuacauuggacuucgaauuaauaaaaacagaagcaaaacaaccagcgacgcuaagaaaauauugcauagaagccaaacucacgaacaccacaacagaaagccguuguccaacccagggugagccgagccuuaaagaagaacaggauaaaagauucguguguaaacauucgaugguagaucgaggauggggaaacgguuguggucuuuuugguaaaggaggaaucguaaccugcgcgauguucacgugcaagaaaaauauggaaggaaaaauaguccagccagagaaccuagaauacacaauaguuguuacgccgcacucaggugaggagcaugcaguagggaaugacacuggaaaacacggaaaagaaauaaaagucacgccgcaaucgagcauaacagaagccgaguuaaccggcuacggaacagucacuauggaauguagcccaagaacggggcucgauuucaacgaaaugguucuguuacaaauggaaaauaaagcauggcuaguccaccgccaaugguuucuugauuuacccuuaccuuggcucccuggugcagauaaacaagaaaguaacuggauccaaaaagaaacauuagugacauuuaagaacccucacgcuaagaagcaagauguaguaguacuugguucgcaggaaggcgcgaugcauacagcacucacgggcgcuacugaaauacaaaugucuuccggaaaucuucuuuucacaggccacuuaaaaugucgacuuaggauggauaaauuacaauuaaaaggaaugaguuauucaaugugcaccggaaaauucaaaguaguaaaggaaauagcagaaacacaacaugguacaauaguuaucagaguucaauaugagggugaugguucuccuuguaaaauaccauuugaaauuauggaccuagagaaacgauauguguuaggaagacuaauuacagucaauccaaucgucacagaaaaagacaguccaguaaacauugaagcagaaccuccauuuggugauaguuauauuaucauagguguugaacccggacaacuuaaacugaacugguucaagaagggcaguuccauaggacaaauguuugagacaaccaugaggggagccaaacgcauggcaaucuuaggagacacagcuugggauuuugggagucuugguggugucuuuacuucaaucggaaaagcacuacaccaggucuuuggcgccauuuacggcgcugcuuuuagcgguguaaguuggacuaugaaaauacuaauaggcguaauaauaacauggauagguaugaauagucguucaacuucauuaucaguaucacucguguuagugggaauaguaacacuuuauuuaggagucaugguacaagcggacaguggcugcguaguaucuuggaaaaauaaggaacucaaguguggaagugguaucuuuaucaccgauaacguacacacuuggacagaacaauacaaauuccaaccugaaaguccaucaaaacuagcaucagcuauacaaaaagcucaggaggaaggcauauguggaauuagaucaguuaccagguuagaaaacuuaauguggaaacaaauaaccccagagcuuaaccacauucucgccgaaaaugagguaaaacuaacuauaaugaccggagauauucgugguauuaugcaagcagggaaaaggagccuacgaccgcagccaaccgaguuaaaguauaguuggaagacaugggggaaggcaaagauguugucuacggagaguuacaaucagacauuuuuaauagauggccccgaaacugcggaauguccgaacaccaauagggccuggaacucgcuagaaguggaggacuaugguuuuggcguuuucacgacuaauauauggcugaaacuaaaagagaaacaagaugcauucugugacuccaaacucaugucugcagcuaucaaagacaaccgugcaguacaugcagacaugggauauuggauggaaucagcuuugaaugauacuuggaagauagaaaaagcaucauuuauugaagucaaaaacugucacuggccgaaaagucauacgcuguggucgaauggcgucuuagagucggaaaugauaauccccaagaacuuagcgggaccuguaagucaacacaacuaucguccgggauaucacacacaaauugcaggcccuuggcaccuuggcaaacuggaaauggauuuugauuuuugcgacggaacgaccgugauuguuacggaagauuguggaaaccgugguccaagccucagaacaacaaccgcuucgggaaaacuaauaacugaauggugcugcagaaguuguacgcuaccuccacuacguuauagaggcgaagaugggugcugguauggaauggagauucgaccccuaaaagagaaagaagagaaccuaguaaauagucuuguuaccgcggggcauggacaaguagauaacuucucgcugggcguacuugggauggcucuauuuuuagaagaaauguugcguacuagagucggaacaaaacaugcuaucuuguuagucgcaguuucuuucguaacacuaauaacaggcaauaugucguuuaaggaccuagguagaguaguugucaugguuggugcuacaauggcagacgauaucgguaugggggucacuuaucuagcacuauuagcugcauuuaaaguccgaccgacauucgcagcuggacuacuucugaggaaacucacaucaaaagagcuuaugaugacaacgaucgggaucgugcuacuaagccagucuacuauaccugagacaguacucgagcuaacagaugcgcuggcguuaggaaugaugguauugaaaauaguaagaaacauggagaaauaccaauuggcaguaacuauaauggcaauucugugugugccgaaugcagucauacuacaaaacgcguggaaaguuaguugcacaauacuagcaguaguuaguguuucucccuuacuacugacaaguucacaacagaagacggauuggaucccauuggcccuuacgauuaaaggcuugaacccuacagcgauuuuucuaacaacucugucccguacuaacaagaaacguagcuggccguuaaaugaagcuauaauggcaguagggaugguaucaauucuggcuuccucacuauuaaagaacgacauccccaugaccgggccucuaguggcugguggauuauuaaccgucuguuauguauuaacugggcgaagugcggaucuagagcucgaaagagcgacggaugugaaaugggaagaccaagcagaaaucucaggaucuagcccaauccugucaauaacaauaagugaggacggaucaaugaguauuaaaaacgaagaagaagaacaaacacuuacaauucucauacggacaggauuauuaguuauuucaggauuguuccccauuucaauaccaauaacagcagccgcgugguaucuaugggaaguuaagaaacagagagccgguguacugugggacguaccuucuccaccuccuauggguaaggcagaauuagaagauggagcauacagaauaaaacagaaaggcauccuaggauauucucagauaggggcaggaguguacaaggaaggaacuuuucauacuauguggcacguaacucguggagccguacuuaugcauaaaggaaagcggauugaaccuucaugggcagauguuaagaaagaucuuauaucuuauggcgguggauggaaauuggagggcgaguggaaagaaggagaagaaguacaagucuuggcacuagaaccgggcaaaaauccucgagcaguacagaccaaaccaggccuauuuaaaacaaauacaggaauaauaggagccgucagcuuggauuucucuccaggcacaucgggaucaccuauaauugacaagaaggggaaaguagugggguuauauggaaauggcguaguaacaagaucuggagcauaugugagugcuauagcucaaacugaaaagucuauagaggacaauccggagauugaggaugacauauucagaaagaggagguuaacaauuauggaccuucacccuggugccggcaagaccaagagauaccuaccagcuauuguaagagaggcuauaaagagaggauuaagaacucugauacucgcaccaacccgcguagucgcggcugagauggaagaagccuugagaggucuuccuauccgcuaucaaacaccagccauuagagccgaacacacgggucgcgaaauagucgacuuaaugugucacgcuacauuuacaaugcgauuacuuagcccugugagaguaccgaauuacaacuugauuauaauggaugaagcucacuucacugauccagcaucaauagcagcgcgugguuacauaaguacgagaguugagaugggugaagcagcuggaauuuucaugacugcuacgccaccugguaguagagacccauuuccccagucaaacgcaccaauaauagaugaggaacgggaaauuccagaaagaagcuggaacaguggacaugaauggguaacggacuuuaagggaaaaacaguaugguucgugccaucaauuaaagccggcaacgauauagcugcgugccuacgcaaaaaugggaagaaaguuauacaacugucaaggaaaaccuuugacagugaguaugucaaaacaagaaccaacgauugggacuuuguaguuacgacugauauaucggagaugggagcaaacuuuaaagcugagagaguaauagacccaagaagguguaugaaaccaguaauucuaacggauggagaagaacgaguaauacuagcaggaccuaugccaguaacacacucgucagcugcacaaagaagaggacgaaucgggcgcaacccaaagaaugaaaaugaccaauauauuuauaugggugagccauuagaaaaugacgaagacugugcacauuggaaagaggcaaaaaugcuacuagacaauauaaacacaccagaagguauaauuccaucaauguucgaaccagaacgggaaaaaguugacgcaauugacggggaauaucggcuaagaggggaagcuagaaagacguuuguggauuugaugcgaagaggggaucuacccgucugguuagcauauaaaguagcagcagaaggaauaaauuacgcggacagaagauggugcuucgauggaauuaaaaauaaucaaauauuagaagaaaaugucgagguugaaauauggacaaaagagggagaaagaaagaaacugaaaccaagaugguuagaugcucgcauauauagcgaucccuuagcauugaaagaauuuaaagaauuugcagcaggucgaaagagcuuaacucugaaccuaaucacagagaugggaagauuaccuacauucaugacacagaaaaccagggaugcuuuagacaaccuagccgucuugcacacugcggaagcaggagguagagcauauaaucaugcccuaucagaauugccggaaacuuuggaaaccuugcucuuauugacgcuguuggcuacaguaacaggcggaauuuucuuauuccuaaugucagguaggggaauuggaaaaaugaccuuaggaaugugcugcauaauaaccgcaucaauccuacuaugguacgcacaaauccaaccgcauuggauagcagcaucaauaauccuugaauuuuuccuaauuguauuacuuauaccagaaccagaaaaacagaggacaccucaagacaaucaauuaaccuaugucguaauagcuaucuuaacaguugucgcugcaaccauggcaaacgaaaugggauucuuagagaaaacuaagaaagaccucgguuuggguucaaucgcuacucaacaaccggaaucaaauauccucgauaucgauuuacggccagcauccgcguggacauuauaugcuguugccacaacuuuuguuacucccaugcuucgacacucuauugaaaauucaucaguaaauguaucucugacagcaauugcuaaccaagcuacuguauugauggguuuaggcaaaggauggccccuaucuaaaauggacaucggcgucccacuauuagcaauaggauguuauagucaaguaaacccgaucacccugacggcagcacuucuacucuuaguagcacauuacgcuauaauuggaccaggacuucaggcuaaagcgacgagggaagcucagaaacgugcggcugccggcauuaugaagaauccaacugucgacggcauuaccguaauugaucuagauccgauucccuacgacccuaaguuugagaagcaacucggacaggucauguuacuaauauugugcgugacacaaguacuaaugaugaggacaaccugggcccuuugugaagcgcucacguuagccacugguccaauuucaacauuaugggaagguaauccuggaagauuuuggaauacaacuauagcuguaucuauggcgaauauauuuagaggaaguuauuuagcaggagccggacucuuguuuagcauuaugaaaaauacgaccaauacacgaagagguacuggaaacaucggagaaacauuaggcgagaaauggaaaucucgacuaaaugcguuagguaagucagaguuccaaauuuacaagaaauccggcauacaggagguagauagaacauuagcgaaagaagguauaaaacguggagagacagaucaccaugcuguguccagggguagugcaaaauuaagaugguucguagaaagaaacauggucacgcccgaaggaaaagucguagauuuaggaugcggcagaggagguuggaguuacuauugugguggccuaaagaauguaagagaaguaaaaggacuaacaaaaggagguccuggccaugaggaaccuauuccaaugagcaccuauggcuggaacuuaguaagauuacagucgggaguagauguauucuuuauaccacccgaaaaaugcgauacacuucugugcgacauuggcgagucuagcccaaauccaacuguugaggccggucgaacacuacgggucuuaaacuuaguagaaaauugguuaaauaacaacacucaauuuugcauuaaaguucuaaauccauauaugccaucaguuauagagaaaauggaagcacuucaacguaaauacgguggugcauuaguacgaaauccucuaaguagaaauucgacacaugaaauguacugggucaguaaugcgaguggaaauaucgucucuagcguaaauaugauuucucgaauguuaauaaaccguuuuacaaugagacauaagaaagcgacauacgaacccgacguugaucuaggaagcggaacacguaacauagguaucgagagcgaaauuccgaaccuggauauuauagggaaaaggauugagaaaauaaaacaggagcaugaaacgucuuggcauuacgaccaagaucacccguauaaaacuugggcguaucacggaaguuaugagacgaaacaaaccggguccgccuccaguauggucaauggcguaguucgacuuuuaacaaaaccuugggauguccucccuaccguuacacaaauggccaugacagauacaacgccguucggacaacaaagaguauucaaagaaaagguugauacccgaacucaagaaccuaaagaagguacuaagaaguugaugaagauaacugcugaauggcuauggaaggaacuuggcaagaagaaaacaccaaggaugugcacgagagaagaauuuacucgaaagguacguucaaaugcggcucugggagcaauauuuacagaugaaaauaaauggaaguccgcacgagaagcugucgaagauucacgauuuugggaauuaguagacaaagaacguaauuugcacuuagaagguaaaugugaaacuuguguuuacaacaugaugggaaaaagagagaagaaacuaggagaguuugggaaagccaaaggaucgagagccauuugguacaugugguuaggugcuagauuccuggaguuugaagcucuuggguuuuuaaaugaagaccacugguuuaguagggagaacucucuaucaggcguggaaggagaagggcuacauaaacuuggauacauacuaagagauguuuccaaaaaggaagguggggcaauguaugcggacgacacugcuggaugggauacgagaauaacguuagaggaucucaagaacgaagaaaugguaacuaaccacauggagggagagcauaagaaauuagcugaagcgauuuucaaauuaaccuaccagaauaaaguaguccgaguacaacgcccaacuccaagagguacaguuauggauauaauuucucgacgcgaccagagagguuccgggcaaguugggacuuacggacuuaacacauucacuaauauggaagcacaauuaaucagacaaauggaaggagaagggguauuuaaaaacauucagcaccucacuguaaccgaagaagucgcaguacauaauuggcuggcccguguggggagggaacgauuaagcagaauggccaucucuggagacgauugcguugugaaaccacuagacgauagauucgcuaaugcacugacagcucucaaugauaugggaaaaauacgcaaagauauacaacaaugggagccaucaaaaggauggaaugacuggacccaaguuccuuucugcucacaucacuuccaugaauuaauaaugaaagacggucgaguucugguaguacccuguaggaaccaagacgaauuaauaggucgugcaagaauuagucaaggagcgggcuggagcuuacgagaaacugcuugcuuaggaaagagcuaugcacaaauguggagucuaauguacuuucacaggcgagaccucagguuagcggcgaaugcaauuuguucugcagugcccucccauuggguuccaacuucacgaacaaccugguccauacaugcaaagcaugaguggaugaccacggaagauauguuaacuguauggaacagaguauggauuagagaaaauccauggauggaggauaagacgcccguugaauccugggaggaaauucccuacuuaggcaaacgugaagaccaaugguguggcaguuuaauaggacuaaccagccgggcaacaugggccaaaaauauccaagccgcaauuaaucaagugaggaguuuaauuggaaacgaagaauauacagacuauaugccaucaaugaaacgcuuucggagggaagaggaggaagcagggguacuaugguaa

SEQ ID NO: 22788 - RNA, 9876 nt, Artificial Sequence
  derived and/or modified CDS sequence (opt6) from DENV-2__EU482473__SS-prME
agugcagguaugauuauaauguuaauuccgacuguaauggcauuucauuugaccaccagaaauggagaaccacauaugauaguaggaauacaagaaaaaggaaaaucacugcuauuuaaaacagaagacggugugaauaugugcacacugauggcaauggaccuaggugaauuaugugaagacacuauaacauacaaaugcccauugcuucgacaaaacgaaccugaagacauagauuguuggugcaauucaaccucaacuuggguaacauauggcacauguacuacaaccggugaacauagacgggaaaaacguucaguggcguuaguaccucaugucgggaugggacucgaaacuagaacagaaacauggaugagcucagaaggugcauggaaacaugcacaaagaauagaaacguggauauuaagacacccgggauucacaauaauggcagcgauacuggcauauacaauaggcaccacucauuuccaacggguucucauauuuauccuuuuaacggcugucgcuccuagcaugacaaugcguugcauagguauuucuaacagggauuuuguagaagguguuucuggcggcucaugggucgacaucguccucgaacacggauccugcguaaccacaauggcgaaaaacaaaccgacacuagauuuugaguuaauuaaaacugaggcaaaacaaccagcuacuuuacgcaaauauuguauagaagcgaaguugacgaauacaacaacugaaucaagauguccuacucaaggggaaccaucuuuaaaggaagaacaagauaaacgauuuguauguaaacauucgaugguagaucgagguugggguaacggcuguggguuauucggaaagggcggaauagucacaugugccauguuuacaugcaagaaaaauauggagggaaaaaucguucagccagagaaucuagaauauacaaucguaguuacgccacauagcggugaggaacacgcaguaggcaacgauacuggaaagcauggucaagagauaaaagugacaccacaaaguucaaucacugaagcugagcuaacuggauacgguacugugacaauggaguguucuccaagaacagguuuggauuuuaacgaaaugguauuguuacaaauggaaaauaaggcauggcuagugcacagacaaugguuuuuagauuuaccccugccauggcugccgggagcugacaagcaagaaucaaauuggauccaaaaggagacgcuaguuaccuuuaaaaauccucaugcaaagaaacaggacguaguaguguuaggaucucaggaaggagcaaugcauaccgcuuuaacaggagccacggagauucaaaugucuuccggaaacuuacuguucacugggcacuugaaaugcagauuacgcauggauaaacuucaauugaaaggaaugucguacucaaugugcacggguaaguucaaaguagugaaagaaauagcagaaacccaacacggaaccaucguaauacguguacaauaugaaggcgacgggaguccauguaaaauaccguucgaaauaauggauuuagagaaaagauauguacuaggcagacugauaacaguuaauccuauugugaccgaaaaggauucaccgguaaacaucgaagcagaaccuccguuuggagacagcuacauuauaauagguguagaaccagggcaacuaaaauuaaacugguucaagaaaggaucaucuaucgggcagauguucgaaacuacgaugaggggagcaaaaagaauggcaauucucggugacacggcaugggauuucggcucucuagguggaguauucacgucgauaggaaaggcgcuacaucagguuuuuggcgcuauauauggagccgccuuuucugguguaucauggacgaugaagauauuaauaggagucauaauuacauggauaggaaugaacucucgaucaacaagucuaagcguauccuuaguucuuguaggaauaguaacacuauauuuaggaguuaugguacaagcugacucuggguguguuguaagcuggaaaaauaaagaacuaaaaugugggucugggauuuucauaaccgauaauguacauacuuggaccgaacaauacaaguuccaaccagaaagcccuaguaagcucgcgucugcaauacaaaaagcgcaggaggaaggaaucuguggaauacgauccguuacgagacuggaaaacuuaauguggaagcaaaucacaccagaacugaaucacauauuagcagaaaaugaggugaagcugacuauaaugacuggcgauauuaaagggauaaugcaagcugguaaaaggucacuucggccccaaccaacagaauuaaaguacagcuggaaaacauggggaaaagccaagaugcuaagcacagagucauauaaucagacguucuuaaucgaugggccugaaacagcugagugcccuaauacaaacagagcuuggaauagcuuggaaguugaggauuacggauucgguguauuuacaacuaauauuugguuaaaacuaaaggaaaaacaagaugcuuuuugcgacucaaaacuaaugagugcugcgauaaaagauaaccgugcgguucaugccgacaugggguauuggauagagucagcauuaaaugauacguggaaaaucgaaaaagccagcuuuauagaggucaaaaacugucauuggccaaagagucacacacuguggucaaacgguguacucgaauccgaaaugauuauuccgaaaaaccuugcuggaccagucucacaacacaauuauagaccaggauaucacacgcagauagcgggcccguggcaucuuggaaaacuagaaauggacuuugauuucugcgauggaacuacaguuauuguuacugaagauuguggcaaucgagggccuagccuaaggacgacaacggcaucagguaaauugauuacggaaugguguuguagaucguguacuuuaccaccgcuacgcuaccggggagaagaugguugcugguaugguauggaaauaagaccguugaaagagaaggaagaaaaccucgucaacucacuuguaacagcaggacauggccagguugacaauuuuucauugggaguauugggaauggcacuauuuuuggaagaaaugcuacguacucgugugggaacuaaacaugcaauacuacugguggcgguaaguuucguaacccugauuaccgguaauaugagcuucaaagacuuaggucgagucguagucaugguuggagcgacgauggccgaugauaucgguauggggguuacuuaucuagccuuacuugcagcguuuaagguacgcccaaccuucgcagcagguuuacuucugagaaagcugaccucuaaagaauuaaugaugacgaccauaggcauuguacuacucagucaaagcaccauuccugaaacaguacucgaguuaacagaugccuuggcauuagggaugaugguccuuaagauaguaaggaacauggaaaaauaccaauuagcaguuacaauaauggcuauccucugugucccaaacgcgguaauccuccaaaacgcauggaagguaucauguacgauacuggcggucguuagcguauccccacucuuacuaacgucuagccaacagaaaacagauuggaucccauuagcucuaacgaucaaaggucuaaauccgaccgccauuuuccuaaccacuuuaucgaggacuaauaagaaaagaaguuggccccugaacgaagcaauuauggcuguaggaaugguuucgauucuugcuucuucauuacuuaaaaaugacauccccaugacgggcccucuuguggcagggggucuacuaaccguauguuauguauugacuggaagaagcgcagaucuagaacuggaacgcgcuaccgauguaaaaugggaagaucaagcugagauuucgggaucaaguccaauacuaucgauuacaauaucagaagaugguagcaugucuaucaaaaaugaagaagaggaacagacguuaaccauuuuaauaaggacggggcucuuagugaucaguggucuauucccuauuucuauaccuauaacagcagcagcuugguaucuuugggaaguaaagaaacaaagagcaggcguacuuugggacguucccaguccucccccaauggggaaggcugaacuggaagauggggcauauagaauaaaacaaaagggaauacuuggauauucccaaauaggggcgggaguuuauaaggaaggaacuuuccauacuauguggcacguuacacgaggagccguuuuaaugcacaaaggaaaaagaauagaaccauccugggcugaugucaagaaagaccuuaucucuuauggaggugguuggaaacuagagggagaauggaaagaaggagaagagguacagguuuuagcucuagaacccggcaagaaucccagggccguucaaacuaaacccggauuguuuaaaacaaauacagguacaauuggugcuguaucauuagauuucaguccagggacgagugguucccccaucauugauaggaaaggaaaaguagucgggcuauacggaaauggaguugucaccagauccggggcauacgugucugcaauagcccaaaccgagaaaagcauagaggacaacccugaaauagaagaugauauauuuaggaaaagaagauuaaccaucauggauuugcauccuggagcggguaagacgaaaagauauuuaccagcuauuguacgggaagcaauuaaaagaggucuuagaacccuuauccuagcuccaacacgugugguagcggcagagauggaagaggcccuaaggggacuaccuauucgguaucaaaccccugcuauuagggcagaacauacgggaagagaaauagucgaucugaugugccacgcaacguucacuaugcgacugcucucaccgguucgaguacccaacuauaaccuaauaauaauggacgaagcccauuuuacugauccugcgucaauagcagcacguggguacauaucaaccagagucgaaaugggagaagcagccgggauauucaugacugcaacaccaccaggaagccgcgauccuuucccacaaucaaaugccccgauaauagaugaagagagggaaaucccggaacguucguggaacucaggucaugaaugggugaccgauuucaaaggaaagaccguaugguucguaccaucaauaaaggcgggcaacgauauugcggccuguuugcgaaagaacggcaagaaagucauacaacuuagcagaaaaacauucgauucagaauauguaaagacacgaacaaacgauugggacuuugugguuacuacggacauaagugaaaugggggccaacuuuaaagcagagcgagucaucgacccuaggagauguaugaaacccguuauuuuaacugauggagaggaacgaguuauacucgccggaccuaugccaguaacacauagcucagcagcccaaagaagagguagaauaggucggaacccuaaaaaugagaaugaccaauacauauacaugggagagcccuuagagaacgaugaagauugcgcccauuggaaagaagcaaaaaugcucuuagacaauauaaauacuccagaaggcauaauuccaucaauguuugaaccagaacgcgaaaaaguagacgcuauugauggcgaauaucguuugcgcggagaagcccguaagacauucgucgaucucaugagacgaggagauuuacccguauggcuugccuauaagguugcugcggaagguauuaacuaugcagacaggagaugguguuucgauggaaucaaaaacaaucaaauacucgaagaaaacguggaaguagaaauuuggacuaaggaaggagaacgcaagaaauuaaagcccagauggcuugacgcaagaauuuacagugacccccuggcacuaaaagaauuuaaagaauuugcggcgggaagaaaauccuuaacgcuaaauuuaauuacggagaugggaagacuuccaaccuuuaugacacagaaaacaagagacgcacuggauaaucuugcaguacuucauacugccgaagcgggugggcgagcguauaaccacgcccugagugaacuaccugagacucuggaaacauuacuguuacuaacgcuauuggcuacuguaacagggggaauauuucuguucuuaaugucgggacgaggaauugggaaaaugacuuuaggaaugugcugcauaauaacagcgaguauccuacuuugguaugcccaaauacaaccucauuggauagcggcuuccauaaucuuagaauuuuucuuaauuguacuccuaauuccagagccugaaaaacaaagaacaccacaagacaaucaauuaacauacguugucauagcaauauugacaguaguugccgcuacaauggcaaacgaaaugggauucuuagagaaaacuaagaaagaucucggcuuggggucgaucgcaacgcagcagccagagucaaauauacuagacaucgacuugagacccgccagugcguggacacuuuaugcugucgcaacaacauuuguuacccccaugcugagacauucuaucgaaaacucuagcgucaaugugucacucacugcaauagcgaaucaagcaaccguacuuaugggccuaggaaaaggauggcccuugucaaagauggauauuggaguuccacuuuuagccauaggguguuacagucaaguaaaucccauaacauugacagcugcacuguugcucuuaguagcucauuaugcuauaauuggcccaggacuacaagcgaaagcaacaagagaggcccaaaagcgagcugcagccggaauuaugaaaaauccgacaguagacggaauaacaguaauagacuuagauccaaucccuuaugaucccaaguuugaaaaacagcucggacaaguaauguuacucauuuuauguguuacacaaguucuaaugaugagaacuacgugggccuuaugcgaggcuuugacgcuugcaacugguccaauaucaacgcuaugggaggguaauccaggucguuucuggaacaccacuauagccguuaguauggccaacauauuuagaggaucauaucuagcgggugcgggacuauuauuuaguauaaugaaaaacacuacaaauacaagacgaggaacgggaaacaugggagaaacauugggcgagaaguggaagucacgacugaaugcgcuuggaaaaagcgaguuucagauauauaagaaaagcggcauucaagaagucgacaggacacuugcuaaagaaggaauuaaaagaggugaaacggaccaucaugcuguuucaagaggcucagccaaauuacgaugguucguggaaagaaauauggugacacccgaaggaaaaguaguagaucuaggcuguggacguggagguuggucauauuauugcgguggcuugaaaaaugugagagaagugaaaggacuaacaaaaggugggccaggacaugaagaaccuauacccaugagcacuuacggauggaauuuaguaagacuacaaagcggcguagacguuuucuuuaucccaccagaaaaaugugauacacuucuuugugacauuggcgaaucuucaccaaauccaacagucgaagcagggagaacccugaggguucuuaacuuaguagaaaacugguuaaacaauaauacacaauucugcauaaaaguccugaauccauacaugccuucaguuaucgagaaaauggaagcauuacaacguaaauacggaggagcgcuaguucgaaacccucucagccguaacaguacucacgaaauguauugggugagcaaugcuagugggaacauaguaucaucaguuaauaugauaucacgcauguuaauuaaucgguucacaaugcgucauaagaaagcaacuuaugaaccggauguggaucugggcucggggacaagaaacauagggauagaaucugagacaccgaauuuggacauaaucggaaaacgaauagagaaaauaaaacaggaacaugaaacgucauggcacuaugaucaggaucauccauacaaaacaugggcauaccacgguaguuacgaaacaaaacaaacaggaucagccagcaguauggucaaugguguaguaaggcuacuaaccaaaccaugggauguacuaccgaccguuacacaaauggcaaugaccgauacaacgccuuucggccaacagaggguuuuuaaagaaaaaguagacacaagaacacaagaaccgaaggaagggaccaaaaagcuaaugaagauaacggcugaguggcuauggaaagaacuagguaaaaagaaaaccccgcgcauguguacuagagaagaguucacccguaaaguaagaaguaaugcagcccucggagcaaucuuuacugaugaaaauaaauggaaaucagcgagagaagccguugaggacucaagauuuugggaguuaguugacaaagaaaggaacuugcaccuggaagguaagugcgagacuuguguuuauaauaugaugggaaagagggaaaagaaacuaggagaguucggcaaggccaaagggucgcgagcaaucugguacauguggcuaggggcacgcuuucuugaguucgaagcucuuggauuuuuaaaugaagaucauugguucuccagagagaacagucuuucugggguagagggagaggggcuucauaaacuuggauacauuuuaagagauguaaguaagaaagaaggcggggcgauguaugcugacgacaccgcaggcugggauacacgaauaacacuugaagaucuuaaaaaugaagaaaugguaacaaaccacauggaaggcgaacauaagaaacuagcggaagcaauuuucaaacuuacauaucagaauaaagugguacgugugcaaagaccgacaccacggggaacagugauggauaucauaucuaggagagaucaaagagggucaggacaaguaggaacauacggguuaaauaccuucacaaauauggaagcccaguuaauaagacaaauggaaggggagggaguguucaaaaauauucaacauuuaacggucacagaggaagucgcaguucaaaacuggcucgcgagaguaggacgcgaaaggcucucucgaauggcgauaaguggggaugacugcguaguuaaacccuuagaugauagauuugcaaaugcauuaacagcccugaacgauaugggaaagaucagaaaggacauacaacaaugggaacccucaaaagguuggaacgauuggacccaagugccguucuguucacaccacuuccaugaacucauaaugaaagacggcagggugcuaguuguccccugcagaaaccaggaugaacuaauaggccgugcucguaucucacaaggagcgggauggaguuuaagagaaacagcuugucuaggcaaaucuuacgcgcaaauguggucccuuauguacuuucauagacgugauuugcgacuagcggcaaaugcaauauguucugcgguccccagccauuggguaccgacaucccgcacgacguggucaauacaugcaaaacaugaauggaugacaacugaagacauguugacagucuggaaucggguauggauaagagaaaauccauggauggaagauaaaacgccaguugagaguugggaagagauaccguaucuaggcaaaagagaggaccaauggugugguucauugauaggguugaccucaagggcaacaugggccaaaaauauucagguggcaauuaaccaaguuaggagucuuauuggaaaugaagaauauacagauuacaugccuagcaugaagcgauuccgucgugaagaagaggaagcugguguacuaugguaa

SEQ ID NO: 22789 - RNA, 9876 nt, Artificial Sequence
  derived and/or modified CDS sequence (opt6) from DENV-2__EU482474__SS-prME
ucagcagguaugauaauaaugcuuauaccaacaguaauggcuuuccaucuuacaacuaggaacggugaaccacacaugauuguggggauucaagaaaaagggaaaucguuacuauucaaaacugaagauggaguaaauauguguacguuaauggcaauggauuugggugaauuaugcgaagauacaauaacuuacaaaugcccucugcuuagacaaaaugaaccagaagacauugacuguugguguaacucuacaucaacguggguaaccuacggcacauguacuaccacaggagagcacaggagagaaaaacgaaguguggcauuagugccgcauguuggaaugggguuagaaacuagaacagaaacauggauguccucagaaggugcguggaaacaugcgcaacgaauugaaacauggauacuccgacacccaggauuuaccauaauggcugccauuuuagcuuauacuauaggaaccacacacuuucaacgcguuuuaauuuuuauuuuacucacugcaguugcuccgaguaugacaaugagaugcauagguauaucaaauagggacuucguagaggguguguccgguggcaguuggguugacauagugcuggaacacgggaguugcgugacuacuauggccaaaaauaaaccaacacuagacuucgaacucauaaaaaccgaggcuaaacaaccggcaacgcuacgaaaauacuguaucgaagcaaaauuaacuaauacgacaacagaaucccgaugcccgacgcaaggugaaccuaguuugaaagaagaacaagauaaaagauucguuugcaaacauagcaugguagaccgugguuggggaaacgguugcggacuguuuggcaaaggagggauugucacgugugcuauguuuacauguaagaaaaauauggaagguaaaauaguucaacccgaaaaucuagaauauacaauuguggugacuccucauagcggcgaagaacaugccguaggcaaugauaccggcaaacaugguaaagagauuaaaguuacuccucagaguucaauuaccgaggcagaacugacagguuauggaacagugacuauggaauguucaccuaggacuggacucgauuucaaugaaaugguuuuauuacaaauggaaaauaaagcaugguuaguacaucgacaaugguuccuagauuugccccuaccuugguuaccuggagcggacaaacaggagucuaauuggauacaaaaggaaacgcuuguaacauucaaaaacccacaugcaaagaaacaagacguugugguguuagguucacaagaaggggcaaugcacacggcgcugacuggggcaacggaaauacaaaugaguucagggaaucuuuuguuuacaggacaucuuaaaugcagacucagaauggacaaacuacaguuaaaaggaauguccuacagcauguguacuggaaaauuuaaaguagugaaagaaauugcugagacucaacauggcacgauagucauaagaguucaauacgaaggagacgggucaccuugcaaaauacccuucgaaaucauggaucuagaaaaacgauauguucuagguagacugauuacaguuaacccuauugucacugaaaaagacaguccuauuaacauugaggcagaaccaccuuuuggagacuccuacauaauaauuggaguugaaccuggucaauuaaaguugaauugguuuaagaaaggcucuaguauaggucaaauguucgaaacuacaaugagaggugcaaagcggauggcuauauugggagacacugcuugggauuuugggucauugggaggaguauuuaccucaauugggaaggcacuccaucaaguuuuuggagcaauuuauggcgcugcauuuagcggcguuucuuggacaaugaaaauuuuaaucggaguuauuauaacuuggauaggcaugaacagccgcagcacgagucuaucgguguccuuagucuuaguaggcauugucacacucuaccuagguguaaugguacaagcagacucagguugcgucgucucauggaagaauaaggaguuaaaaugugggucuggcaucuucauuacggauaauguucacacguggacagagcaauauaaguuucagcccgagucacccagcaaauuggcauccgccauucaaaaagcacaagaagaaggcauaugcgguauucgaucaguaacuaggcucgagaaucucauguggaaacagaucacuccggaauuaaaccauauauuggcggaaaacgaagucaaauugacaauaaugacuggagauauaaaaggaauaaugcaagccggaaagaggucucuuaggccacaaccuacagaguuaaaauauucauggaagacaugggggaaagccaaaaugcuaaguacagaaagccacaaucaaacuuuccuaauugaugggccggagacggcagaaugucccaacacgaaucgggccuggaacucucuagaaguagaagacuauggguuuggagucuucacaacaaauauuuggcuacguuuaaaagagaaacaagaugccuuuugugacaguaaacucaugagugcagcaauuaaagauaaucgcgccguccaugcggauauggguuacuggauugaaucagcccuaaacgacaccuggaaaauagaaaaagccagcuuuauagaggucaaaaacugccacuggccgaagucacauacucuguggucuaacggaguuuuagagucugaaaugauuauacccaaaaaccuagccggaccaguuucccaacauaauuacagacccggauaucauacacagauagccggcccuuggcauuuaggaaaguuagaaauggauuucgauuuuugugacggcacaacagucauuguaacagaggauugugggaauagaggaccaaguuuacguaccacgaccgcaucuggaaaacuuauaacagaauggugcuguagaucauguacuuuaccaccacucagauaucgaggagaagauggcuguugguauggcauggagauacgaccguugaaagagaaagaagaaaauuuggugaacucacugguaacagccgggcacgggcaaguugauaacuuuagcuuaggcguuuugggaauggcauuauucuuagaagagaugcugagaacaagaguaggaacaaaacaugcuauacuauuaguagcagucagcuuuguaacauuaaucacggguaacaugagcuucaaggaccuuggaaggguggugguuaugguaggggcaacgauggccgaugauauaggaauggggguaacauaucuugcccuauuagcagcauucaaaguucgaccaacuuuugcagcaggacuucuauugcggaaguuaaccucuaaggaacuaaugaugacuacuauuggaaucguucuacuaucucagagcacaaucccagaaacuguucuggagcucaccgaugcacuugcuuuaggaaugaugguacuaaaaauuguaaggaauauggaaaaauaucaacuugcaguaaccauaauggcaauauuguguguaccaaacgcaguaauauuacagaaugccuggaaggugaguuguacaauuuuagcuguugucuccguuaguccuuuacuguuaacaucuagccaacagaaaacagauuggauaccacuugcauuaacuauaaaaggauuaaauccaacggcaaucuucuuaacuacuuuaagucguacaaacaagaaacgcaguuggccauuaaaugaagccaucauggccguagguaugguaaguauauuagcaucgucgcuucuaaagaaugauauuccgaugacuggaccacucguugccggaggauuacuuaccgucugcuauguucuaacaggaaggucggcagaucuagaauuagaacgagcuacugaugugaaaugggaagaccaagcagaaauuucuggaucaucaccuauacuaucaauaacgauaucagaagaugguucaaugagcaucaaaaaugaagaagaagaacaaacacuaacuauauuaauaaggacugguuuacucguuauaucuggacuauuuccgaucagcauucccauuacggcugcugcgugguaucuaugggaaguuaaaaagcaacgcgcaggagucuuaugggacguaccauccccgccaccuauggggaaagcugaauuagaggacggagccuauagaauaaaacaaaaaggcauacuaggguacucacagauaggagcugguguauacaaagaaggaacguuucacacaauguggcauguuaccagaggugcaguacuuaugcauaaaggaaaaagaauagagccaucuugggcugacgugaaaaaggauuuaauaaguuacggaggaggcuggaaacuagaaggugaguggaaggaaggggaagaaguccaagucuuggccuuagaaccaggcaaaaacccacgcgcuguacaaaccaaaccuggguuguuuaaaacgaauacugggaccauuggcgccgugagucuagacuuuaguccuggcacuucuggauccccgauaauagauaagaaaggaaaaguggugggcuuguauggaaacggaguugucaccaggaguggggcauauguuagugcaauugcucagacugagaaaucgauagaagauaacccagaaauagaagaugacauuuuccguaagagaagguuaacaauaauggauuugcauccaggcgcgggcaaaaccaaaagguacuuaccggcgaucguaagggaagcuauaaagagaggccuacgaacccucauuuuggcuccaacuagaguaguagcugccgagauggaagaagccuuaagaggacuaccaauaagauaccaaacaccagcaauacgagcggaacauacaggacgagaaauaguggauuugaugugccaugcaacauuuacaaugaggcuacuuucuccgguacgagugccuaacuauaaccugauuauaauggacgaagcccauuucacagaucccgccagcauagccgcaagaggcuauauuucuacuaggguagaaaugggggaggcagcugggauauuuaugacagcaacacccccagguucccgagacccauuuccacaaagcaacgcacccauaauagacgaagaaagagaaauuccagagagauccuggaauaguggucaugaaugggugacagacuuuaaaggaaaaacaguaugguuuguaccuucuauuaaagcggguaacgauauugcugcuugcuuacgcaagaacggcaagaaaguuauacaacuuucaagaaaaaccuuugauucagaauacguuaaaacccgaacaaaugauugggacuuugugguaacaacggauauuucagaaaugggcgcaaacuuuaaagcagaacgugugauagauccaaggagaugcaugaaaccaguuauacuaacagacggagaagaacgaguaaucuuagcaggaccgaugccgguaacacauucaagugcagcccaaagaagagggagaaucggaagaaaucccaaaaaugaaaaugaucaauauaucuauaugggagaaccauuagagaaugacgaagauugcgcccauuggaaagaagccaaaaugcuacuugacaacauuaauaccccagagggaaucaucccauccauguuugaaccggaacgagaaaaggucgaugcaguggacggggaauacagacuaagaggggaagcucguaagacauuuguagacuuaaugcgccgcggagaucuacccgucugguuggcauacaaagucgcugcggaaggaaucaauuacgccgauagacguuggugcuuugacgggaucaaaaacaaucagauuuuagaagaaaauguggagguugaaaucuggacaaaagaaggcgaacguaagaagcucaaaccaagauggcuggaugcuagaaucuacucagacccguuagcuuuaaaagaguuuaaagaauuugcugcgggcagaaagucgcuaacauugaaucuuauaacagagaugggacgucucccgacguucaugacacagaaaaccagagacgcauuagacaaucucgccgugcugcacaccgcggaggcgggaggcagagcauacaaucaugccuuaucugagcugccugaaacguuagaaacguuguuacuccucacacuuuuagccacagucacaggcggcauauucuuguuccuaaugagcggucgcgggauaggaaaaaugacacugggaauguguuguauaguuacagcuucaauccuacuaugguacgcacaaauucagccgcauuggauugcagccucgauaauauuagaguucuucuuaauuguucuauugaucccagaacccgaaaaacaacgcaccccacaggauaaucaguuaacuuauguugugaucgcaauuuuaacagugguggccgcaacaauggcaaaugaaaugggauuucuggagaagacgaaaaaggaucugggucuaggaucaauagcgacgcaacagccagaaagcaauauacuggacaucgaccuaaggccagccucagcauggacucuuuaugcugucgcuacgacauucguaacucccaugcuccgccacucaaucgaaaauucuagugugaauguuagucugacagccauagcuaaucaagccacaguacugaugggauuaggcaaaggguggccauugucaaagauggacauaggaguuccacuguuagcgauaggaugcuauucccaggugaauccaauaacacuaacagcggcauuauuacuuuuaguugcgcacuaugcaauuauaggacccggacuacaagccaaggcgacgagagaagcacaaaaacgagcugccgcaggaauuaugaaaaauccuacagucgacgguaucacaguuauugaccuggaucccauccccuacgacccaaaauucgagaaacaacuagggcaaguuaugcuauuaauacuauguguaacacagguauugaugaugcguacaaccugggcucuaugugaagcauugacacuagccacaggccccaucucaacccuuugggaagguaauccuggucgauuuuggaauaccacgauagccgugucuauggcuaacauuuuucgugguucauaccuggccggugcaggacuacuauuuucuaucaugaaaaauacuacuaauacuagacgagguacugggaacaugggcgaaaccuuaggggagaaauggaaaaguagacuuaacgcacuuggaaaaucagaauuucaaaucuauaaaaagagugguauacaagaaguagacagaacauuagccaaagaagggauaaagagaggggaaaccgaucaccacgcugugucgaggggcucugccaagcuaagaugguuugucgaaagaaauaugguaaccccugaaggaaagguaguggauuuaggaugcgguaggggaggguggucguauuauuguggaggccuaaagaaugugcgagaagugaaagggcuaacgaaagggggaccuggccacgaagaacccauaccaauguccacauauggguggaaucuuguacgguuacaaucgggaguagacguguucuuuauucccccggagaaaugcgauaccuuacuuugugauauaggagaaagcuccccaaacccgacgguagaagcaggucggacuuuaagaguccucaaucuuguggagaauuggcucaauaauaacacacaguucugcauaaaaguguuaaacccguauaugcccucaguuauugagaaaauggaagcacuacaacgcaaguacgguggagcauugguucgcaauccacucagcagaaacaguacucaugaaauguauugggucuccaaugcaucugguaacauaguuaguaguguaaauaugauaucuagaaugcucauaaacagguucaccaugagacacaagaaagccaccuaugagccagauguagauuuaggcucagguacaagaaauaucggaauugaaucagaaauucccaaccuugauaucauaggaaaacggauagagaaaauaaaacaggaacacgagacaucauggcauuaugaccaagaucauccuuauaagacuugggcuuaccaugggagcuaugaaacaaaacaaacugguagugcaucaucaauggugaauggagugguuagauuauuaacaaagccuugggaugucuuaccaacagugacccaaauggcaaugaccgauacgacuccauuugggcagcagagaguauuuaaggaaaaaguugacacaaggacucaagaaccgaaagagggcacuaagaaguuaaugaaaaucacugccgaauggcucuggaaagaauuaggcaagaagaaaacccccaggaugugcacgagggaggaguucacaagaaaaguuagaucuaaugcggcccugggugccauauuuacagacgaaaacaaauggaagagugcgcgagaagcaguugaagauucaagguucugggagcuaguggauaaagaaagaaacuuacaucuagaaggaaaaugugagacaugugucuacaauaugauggguaaaagagaaaagaaguuaggggaguucgguaaagcaaaaggaaguagagcaauaugguacaugugguugggcgcaagauuucuugaguucgaagccuuaggauuuuuaaaugaagaucacugguucucacgugaaaauucccuaucuggaguagagggagagggacuccacaaacucgguuacauacuacgugaugucagcaaaaaggaaggaggggcgauguacgcagaugauacagcgggaugggacacuagaauaacauuggaggaucuuaaaaacgaggaaauggucaccaaucacauggagggggaacauaagaaauuagcagaagccauauucaaauuaacauaccagaacaaaguaguuagagugcaaagaccaacgccacgaggaacgguaauggauauaauaucaaggagagaucaaagaggaaguggacaaguuggaacguauggcuugaauacuuuuacaaauauggaagcucaacucauccggcaaauggagggugaaggagucuuuaaaaauauucaacaucuaacaguaacggaagagguggcuguccaaaauuggcuugcuagaguugguagagaacguuuaagccgaauggccauaagcggagacgauugugucguaaaaccuuuagacgauagauuugccaaugcucuaacugcauuaaacgauauggguaagauaagaaaagauauacagcaaugggaaccgucaaagggcuggaacgacuggacacaaguuccauucuguagccaucauuuccacgaguuaauuaugaaggacgggcgcguuuuagucgugcccugucgcaaucaggaugaacugauagggcgugccagaauaucacagggagcagguuggucguuaagggaaacggcuugucuggggaaaagcuacgcgcagauguggagcuugauguauuuucacagaagggaccuccgauuagcagcuaaugcaauauguuccgcuguaccaucccacuggguuccuacaaguagaaccacauggaguauacacgcgaaacaugaguggaugacaacagaggacaugcugaccguguggaaucgaguguggauacgcgaaaauccuuggauggaagauaaaacaccuguagaaaguugggaagagauaccauauuuaggaaaacgagaagaccaauggugcggaucauuaauaggauugacgucacgggcuacaugggccaaaaauauacaagcugcaauaaaccaagucagaucguuaauugguaaugaggaauacacugauuacaugccaucuaugaagcguuuucgcagggaggaagaagaggcaggaguauuaugguaa

SEQ ID NO: 22790 - RNA, 9876 nt, Artificial Sequence
  derived and/or modified CDS sequence (opt6) from DENV-2__EU482475__SS-prME
agcgcuggcaugauaauaauguuaauuccuacgguaauggcguuucacuugaccacucgaaacggagaaccacauaugauugucgguauucaagaaaaaggcaaauccuugcuguuuaaaacagaagacgguguuaauauguguacgcuaauggcgauggacuuaggagaauuaugcgaagauacaauaaccuacaaauguccuuuauuaagacaaaaugaaccugaagauauagacuguugguguaauucaacaucgacaugggucacguauggaaccuguacaaccacuggagaacaucguagagagaaaagaucaguggcgcucguaccgcauguaggcauggguuuagaaacuagaacggaaacguggauguccucugaaggggcguggaaacaugcgcaacgaauagaaacuuggauucuaagacacccaggcuucacgauaauggcagcaauacuagcuuacacaaucggaacuacucauuuucaacggguucuuauauucauccuccuaacugcuguagcaccaucaaugacuaugagaugcauaggaauaagcaauagagauuuuguagaaggugucuccgggggaucaugggucgauaucguuuuagaacauggcuccugugugacaacuauggcuaaaaauaaaccuacacuagauuucgaauuaauaaaaacagaagcaaaacaaccagcaacucugagaaaauauugcauagaggcgaaacucacgaauacaacaaccgaaucacgguguccaacucaaggugagccaucucuaaaagaggaacaagacaaaagauuuguauguaaacauucaaugguggacagaggauggggaaacggaugugggcuuuuugguaaaggagguauaguaacaugugcuauguuuaccugcaaaaagaauauggaggguaaaaucguccaaccagagaaucuggaauauacuauaguagucacaccucauucaggggaagaacaugcaguaggaaaugacacaggcaaacaugggaaggagauaaaggucaccccacaaucaagcaucacagaagcagaauuaacagguuauggcacaguaaccauggaaugcagcccacgaacgggacucgacuuuaaugaaaugguucuucuccagauggaaaacaaagcaugguugguccacagacaaugguuuuuggauuugcccuuacccuggcuaccaggagcggacaaacaagaaaguaauuggauccaaaaagaaaccuugguaacauuuaaaaauccucacgccaagaaacaagauguaguugucuuaggcagucaagagggagcaaugcacacugcacuaacuggagcaacagaaauacaaaugucaucggguaaucuacucuucacggggcauuuaaaguguagauugagaauggauaaauugcaauugaaagguaugagcuacucaaugugcaccgguaaauuuaaaguaguuaaagaaaucgcagaaacacaacaugggacgauuguuauucguguucaguaugaaggugauggaucuccguguaagaucccguucgaaauuauggaccucgaaaaacgauauguucuaggacgguugaucacaguaaauccaauaguaacggaaaaagauaguccugucaauauugaggcagagccucccuuuggagacucauauauaauaaucgggguagaaccgggacaacucaaacucaauugguuuaagaaaggaucuaguauaggccagauguucgaaaccacaaugcguggagccaaacgcauggccauuuuaggggacacagcaugggacuuuggcucauuaggugguguguuuaccuccaucgguaaagccuuacaucaaguauucggugccauauauggggcagcauuuucggggguaucauggacaaugaaaauucuuauaggagucauaauuacauggauaggaaugaauagcagaucaacaaguuuaucuguaucuuuaguauuaguagguauugucacguuguacuugggugugaugguacaagcagacagcgguugugugguguccuggaaaaauaaggaacuaaaauguggcaguggaauauucauuacggauaaugugcauacguggaccgagcaauauaaauuccagccagaaaguccuucaaagcuggcaucagcaauccaaaaagcucaagaagaggggauaugcggcaucagaagcguuacuagacuugaaaacuuaauguggaaacagauaaccccugaacuaaaccauauacuugcagaaaaugagguaaaauuaacuaucaugacaggugacauuaaagguauuaugcaagcugguaaaaggagucuuaggccccaaccaacagaacuuaaauauuccuggaagacauggggaaaagcuaaaaugcuaucaacugaaaguuacaaucaaaccuuccucauugacggcccagagaccgccgaguguccaaauacaaaucgugcauggaacaguuuagagguagaagacuacggauucggcgucuuuacaacaaauaucuggcuuaaauuaaaagaaaaacaagacgcguuuugcgauaguaaacuuaugagugcggcuauaaaggacaaucgggcuguacaugcagacaugggcuauuggauugaaucugcacuaaaugauacauggaaaauagaaaaggcuucauuuaucgaagucaaaaauugccauuggccgaaaucccauacgcuguggaguaauggcguacuagaauccgaaaugauaauacccaaaaauuuggccggcccaguuagucaacacaacuauagaccaggcuaucauacacaaaucgcagguccauggcauuugggcaaauuggagauggauuucgacuuuugcgauggaacaacuguaaucguaaccgaagacuguggcaacagaggaccaagucuacguacaacaacagcaaguggaaaacuaauaacagaaugguguugucgaagcugcacauugcccccauuaagauacaggggagaagaugguugcugguauggaauggagauaagaccucuuaaagaaaaggaagaaaacuuggucaacagccuggugacagcaggacacggccaaguggauaauuuuagucuggguguauugggaauggcguuauuccuagaagaaauguugagaacacggguugguacaaaacacgcaauacuguugguagcagucuccuucguaacauugauaacagggaacauguccuuuaaagauuuaggaagaguaguagucaugguaggggcaacgauggccgacgauaucgggaugggagucacauauuuagcccucuuggcugcauuuaagguucgaccaacauucgcggcaggguuacuauuaagaaaauugacaucuaaagaacuaaugaugacaacaauugggauaguucuccugucacagucgacgaucccagaaacuguacuugaacuaacggaugcacuggcuuuagguaugaugguuuuaaagauaguacgaaacauggagaaauaucaacuagcuguaacaauaauggcaauuuuguguguucccaaugcaguaauucuacaaaacgcauggaagguuucuugcacaauacuugccguagugagcguuucucccuuauuauugacaucaucccaacagaaaacugauuggauaccguuagcacuaacuauaaaaggacuuaacccuacagccauuuuucuuacuacauugucuagaacaaauaagaaaagaucauggccgcuuaacgaggcgauaauggcaguaggaaugguaucuauacuagcaucuagccuacuuaaaaacgacauaccuaugacaggaccccuuguugcaggaggucuccuuaccguauguuacgugcuuacggggcgaucagcggauuuagaacuagaacgugcaacagauguuaaaugggaagaucaggcugagauaaguggcagcucgccaauauuaaguauaacuauaucggaagauggaagcauguccaucaaaaaugaggaggaagaacaaacucuuacgauacuaauacgaacaggacuacuuguaauaucaggccuguuuccgauaagcauuccaaucacagcagccgcuugguaucucugggaagucaagaagcaaagagcaggaguuuugugggacguaccaucaccuccuccaauggguaaagcagaguuagaagauggugcguacagaauuaaacagaaaggaauacuaggguauucacaaauaggcgccgguguauacaaagaaggaacuuuccauacuauguggcauguuacacguggggcaguacuaaugcacaaaggaaaaaggauagagccgucaugggcugacgugaagaaagacuuaauaucguauggcgguggguggaaguuagaaggagaauggaaggaaggugaggagguucaaguacuagcucuagagcccggaaagaacccuagagcaguccagaccaagccagggcuauucaagacaaauacuggaacaauuggcgcgguuaguuuggauuuuucaccaggcacaaguggaucgccgauaauugauaagaaaggcaaaguagucggucucuaugguaacggaguugucaccagaucgggagcuuacguuagugcgauagcccaaacagagaaaaguauagaagacaauccggaaauugaagacgauauuuuuagaaagagacguuuaacaauaauggacuuacauccuggugcagggaaaacaaaaagauaucuucccgccauaguacgggaggcuauaaaaaggggauuacguaccuugauauuggcaccaacaagaguagucgcggcagaaauggaagaagcauuaagaggccuaccgauccgcuaccaaacuccggcaauacgagccgagcauacuggucgcgaaauaguagauuuaaugugccacgcaacauuuacaaugcggcugcuuuccccuguaagaguucccaacuacaaccugauaauuauggacgaagcgcacuucacugauccggccucuauugcagcaagaggcuauauaaguaccagaguagaaaugggagaagcugcugguaucuucaugacugcaaccccacccggaucucgugacccauuuccacaaucaaaugccccuaucauugaugaagaaagagaaauacccgagagaagcuggaacucuggccaugaauggguaacagauuuuaaggguaaaacaguuugguucguuccauccauaaaagcgggaaaugacaucgccgcaugccugaggaaaaauggaaagaaaguaauacaacuaagcaggaaaacuuuugauucagaauacguaaaaaccaggacaaaugauugggacuucguuguuacuacagacauaagcgaaaugggagcaaauuucaaggcugaacgaguaauagacccgaggagauguaugaaaccagucauccuaacugacggagaagaacgcguaauuuuagcgggaccaaugccugucacucauucgagugcugcgcaaagaagagggagaaucggacgaaauccgaaaaaugaaaaugaucaauauauauacaugggugagccgcuggagaacgacgaagauugcgcucauuggaaagaagcaaaaauguuacuggauaauauaaauacccccgaggggauaaucccaucuauguucgagccugaaagggagaaagucgacgcgaucgauggagaauacagacuaaggggagaagcgaggaagacauuuguggacuuaaugcgacguggcgaucucccuguuugguuggccuauaaagucgcugcagaaggaauaaauuauguugauagacgauggugcuucgacggaaucaaaaauaaucaaauacuagaagaaaacguggagguugagaucuggacaaaggagggugaaaggaagaaguugaaaccuagguggcuagaugcucggaucuacagcgauccguuagcauuaaaagaauuuaaagaguucgcugcuggaaggaaaagucuaacucuuaauuugaucacagaaaugggucggcuucccacguucaugacucaaaagacacgagaugcacuggacaaucuggccgugcuucauacagcggaggcuggaggacgcgcauacaaucaugcuuuaucagaauugccagaaacccuagagaccuuacuauuguuaacuuuauuagccacaguaacuggaggaauuuuccuguuucuuaugucggggagagggauagguaaaaugacauuaggaaugugcuguauuauaacugcaucaauuuuacuaugguaugcacaaauacaaccgcauuggauagccgcaucgauuauauuagaauuuuuccuaauaguacuauugaucccagaaccagaaaaacaacguacaccccaggacaaucaacuuacuuacguagucaucgccauucucacuguaguagcggcaacaauggcuaaugaaaugggauuccuagagaaaacuaagaaagaccuuggccuagguagcaucgcuacucaacagcccgagaguaacauauuagauauagacuuaaggccagcauccgcuuggaccuuauacgcuguugcaacuacuuucguaacucccauguuaagacacagcauagaaaauaguucagucaaugucucguuaacagcaauagcaaaccaagcaacaguauugaugggucuaggaaaagguuggccacuuagcaaaauggacauuggcguaccacuauuggccauaggguguuauucacaaguaaauccaaucacacucacugcugcuuuguuacuucugguagcacacuaugcgauuaucgggcccggacuucaagcaaaagcaacuagagaggcacaaaagagagcagcagcaggaauaaugaaaaacccgacgguugauggaauuacgguuaucgaccuagaucccaucccauaugauccgaaguucgaaaaacaguuaggacaaguaauguuauugauccucuguguuacgcaaguacucaugaugcgaacuacgugggcuuugugugaggcauugacucuagcgacagguccgauuagcacacuaugggaagggaacccuggucgguucuggaacacgacuauagcaguuucaauggcaaacauauucagaggcagcuaccuagcuggugccggguuacuauuuagcauaaugaaaaauacuaccaauacuagacguggcacuggaaauaugggagaaacacugggagaaaaauggaaaucgagguuaaacgccuuagguaaaagugaauuucagaucuacaaaagaucuggaauacaggaaguggacagaaccuuagcgaaagaagguaucaaacgcggcgagacggaccaucaugcggucucucggggaucggcaaaauugcgaugguuuguugaacguaacaugguuacucccgaagguaaaguuguagacuuaggauguggccguggcggguggagcuauuauugugguggccucaaaaacguaagagaaguuaaaggcuuaacuaagggaggccccggacaugaagaacccauacccauguccaccuauggauggaacuuaguacgacugcagaguggcguagacguuuucuuuauaccaccagagaaaugugauacccuuuuaugcgauauaggggagucuaguccgaauccuacugucgaagcgggccgaacacuuagaguuuugaauuuaguugagaauuggcugaauaacaauacccaguucuguauaaagguguuaaacccauacaugccuucaguaaucgagaaaauggaggcucuccagcgaaaauaugguggagcuuuaguccguaacccauugucacgaaauaguacucacgagauguauuggguaagcaaugcaagcggaaacauuguaagcucuguuaacaugauaagcagaauguuaauaaacagauucacuaugagacacaagaaagcuacguaugaaccagacguagaucuaggauccgguacacgcaacauaggaauugaaagugaaaucccgaacuuagauauaauaggcaaacgaauagagaaaaucaagcaggagcaugaaacaaguuggcauuacgaccaagaucacccauacaagacaugggcuuaucacgguaguuacgaaaccaaacagacaggaagugcuucaucgauggugaacggaguaguuagacugcuaacaaaaccaugggauguccuucccacuguuacgcaaauggccaugacagacacaacuccguuuggucagcaacguguauucaaagaaaaagucgauacaaggacacaagaaccaaaagagggcaccaagaaauuaaugaaaauuacggcugaaugguuguggaaagaacuagguaagaagaaaaccccacgcauguguaccagagaggaauuuacaagaaaaguacgguccaaugcggcacucggagcgauuuuuacagaugaaaauaaauggaaaucugcuagagaggcgguagaagauucaagguuuugggaguuaguagacaaagaacguaauuuacaucuagaaggaaaaugugaaaccugcguuuauaauaugaugggaaaacgggagaagaaacuuggugaguuugguaaagcaaaaggaucacgcgcaauaugguauaugugguuaggggcuagauuccuugaauuugaagcacucggcuuccugaacgaagaccauugguucagucgagagaacagucuuucuggagucgagggugaaggguuacauaaacuuggauauaucuuaagggauguaagcaagaaagaagggggugccauguaugcugaugauaccgcuggaugggauacuaggauaacuuuagaagaucuuaaaaacgaggagaugguuacuaaccacaugaaaggagaacauaagaaacuagccgaagcaauuuucaaguuaacuuaccaaaauaaagucguaagagugcaacguccaacucccagaggaaccguaauggauauuaucucgagacgggaucagagggggaguggacagguagguaccuacgggcugaauacauuuacaaauauggaagcccaacucauccgccaaauggagggugaagggguauuuaaaaauauucaacaccucacgguaaccgaagaagucgcaguccaaaacugguuggcucgaguaggccgugaaagacucagucguauggcaauaaguggugaugauuguguagucaaacccuuggaugaucguuucgcuaaugcauuaacagcucucaacgauaugggaaagauaagaaaagauauucagcaaugggaaccaucaaaaggauggaaugacuggacucaaguaccauuuuguucacaucauuuccaugaacuaaucaugaaagauggacgcgucuuagugguaccaugcagaaaccaagacgaacuaauagguagggccaggauuagucagggcgccggauggucuuuaagagagacagccuguuuaggaaaauccuacgcacaaauguggagccucauguauuuucaucgccgcgaucuuagacuugcugcaaaugcuauauguagcgcaguacccagccauuggguaccuacgaguagaacgaccuggucaauacaugcaaaacaugaauggaugacaacagaagacauguugacaguauggaauagaguuuggauuagagagaacccauggauggaagauaagacacccgucgaaucaugggaagaaauacccuaccuuggcaaaagggaggaccaaugguguggauccuuaauuggauuaacgucaagagcgacuugggcgaaaaacauacaagcagcuauaaaccaagugcgaucucuaauaggaaaugaagaauauacggacuauaugccuagcaugaagagauuuaggcgagaggaagaggaggcugguguuuuaugguaa

SEQ ID NO: 22791 - RNA, 9876 nt, Artificial Sequence
  derived and/or modified CDS sequence (opt6) from DENV-2__EU482541__SS-prME
ucagcaggaaugauaauuauguuaauaccaacagugauggcauuccaccuuacaacgagaaacggugaaccucacaugauaguaggaauacaagaaaaagguaaaucacuccuauucaaaacagaagacggugucaacaugugcacauuaauggcuauggacuugggagaauuaugugaagacacaauaacuuauaaaugucccuuauuacgucaaaaugaaccugaagauauagacuguugguguaacucuacaaguacuuggguaacuuauggaacauguaccacaacuggugaacauagaagagagaaaagaucuguggcacugguaccacauguuggaaugggauuagaaacaaggaccgaaaccuggaugaguagcgaaggagcuuggaaacaugcacaacguauagaaacguggauucucagacacccgggauuuacuauaauggcagcaauauuagcguauacaauagguacuacccacuuucaaagaguguuaauauuuauauugcuaacugcaguggcaccaagcaugacaaugagauguauagguauaaguaaccgagauuuuguagaagguguuaguggaggaucuuggguugacaucguacuugaacacgguagcugcguuacaacaauggccaaaaauaaacccaccuuagauuucgaauuaauaaaaacggaagcgaaacaaccagcgacguuacgaaaauacuguauagaagcaaaacuaacaaauacgaccacggaaagcagaugccccacacaaggugaaccgagucugaaagaagaacaagacaaaagauuuguauguaaacacucaaugguagauagaggaugggguaauggaugcgggcuuuuuggaaaagggggaaucguuacgugugcuauguuuacauguaagaaaaauauggaaggcaaaaucguucaaccagaaaauuuagaauauacuauuguagucacaccucauucgggcgaagaacaugcaguaggaaaugacacaggcaaacauggcauggaaauaaaaguaacaccacaaaguucaaucacagaggccgagcuuacaggauacggaacaguaacaauggaaugcaguccaagaaccggucuggacuucaaugaaaugguccuacuccaaauggaaaauaaagcaugguuaguucacagacaaugguuucuagaccuuccuuuaccguggcucccuggagccgauaaacaggaaucaaauuggauacaaaaagaaacccuagucacauuuaaaaauccccaugccaagaaacaagauguagugguucuaggcagccaagaaggugccaugcauacagcacugacuggagcuaccgaaauacagaugaguucaggaaauuuguuauuuacaggucacuuaaaaugcagguuacgaauggauaaacuacaauuaaaaggaaugucauauucuaugugcacgggcaaauucaaaguagucaaggagauugcugaaacucaacaugggacgauuguaauacgaguccaguacgaaggggaugguuccccgugcaagauuccauuugaaauuauggaccucgaaaagcgguaugucuuaggaaggcuaauaacaguaaauccaauaguaaccgaaaaagauaguccagucaacauagaagcugaaccaccauuuggcgauucauacauuauaauaggaguagagccaggacaauuaaagcuaaacugguuuaagaaaggcaguagcauuggacaaauguucgaaacuaccaugagaggugcuaaaaggauggccauccuuggugauacugcuugggauuuuggaucguuagguggaguauuuaccucuauaggaaaagccuugcaccaaguuuuuggagcaauauauggcgccgcguuuucuggcgucagcuggacaaugaaaauucuaauugguguuauuauuacauggaucggaaugaauagucgaaguaccucgcuaagcguaagccuaguauugguaggaauuguaacucuuuacuuaggaguaaugguccaagcagauucuggguguguaguuagcuggaaaaacaaagaguuaaaaugcggaagcggaauuuuuaucacagauaauguacacacuuggacugaacaauauaaauuccagccugaauccccaaguaaacuagcuagugccauacagaaagcgcaagaagaaggaauaugugguauuaggagugugacaaggcuugaaaaucuaauguggaaacaaauaacuccugaauuaaaucauauucuagcagaaaacgaagugaagcugacuauuaugacuggcgauauuagaggaauuaugcaagcagguaaaagaucguuaaggccacaaccugcagagcuaaaauacucauggaaaacaugggggaaggcaaagaugcuaucgacagaaaguuauaaucaaacguucuuaauagacggcccggaaacugcagaauguccaaauacaaauagggcuuggaacucauuagaaguugaagacuacggguuuggaguauucacaacgaauauuuggcuaaaacucaaggagaaacaagaugcauuuugugauuccaaauugaugucggcggcaauaaaagauaaucgggcagugcaugcagauaugggauauuggauagaaagugcacugaaugacacauggaagauagaaaaagcgucuuuuauagagguuaaaaacugccauuggccaaagagucauacucuauggucaaauggaguacuugaaucagaaaugauaauacccaaaaaucucgcaggccccguuucucaacacaacuauaggccggguuaucacacgcagaucgcugguccuuggcaucucgguaaauuagaaauggauuucgauuucugugacggaacuaccgucauaguuacggaagauugugggaaucgcgguccaaguuuaagaacgacaacagcuucaggaaaauuaaucacagaauggugcuguaggaguugcacacugccuccccuaagauauagaggggaagauggauguugguacgguauggaaauacgaccauugaaagagaaagaagaaaacuuaguaaauucacucguaacagccggccauggccaagucgacaauuuuucauuaggcguucuaggaauggcgcucuuucuggaggaaaugcuacgcacuaggguagggaccaaacacgccauacuauuggucgcggucucauucguaacauuaauaacuggaaauaugucguuuaaagauuuagggagaguggucguaaugguuggggcaaccauggcugaugauauaggaauggguguaacuuaccuagcucuacuagcagcguuuaaagugagaccuaccuuugcugcaggcuuauuacugagaaagcuaacuucaaaagaacuaaugaugacuacaauagggauaguuuuguuaucgcaaucuacuauaccagagacaguuuuggaguuaacugaugcauuagcucuuggaaugaugguccuaaaaauuguuagaaauauggagaaauaccaacuggcaguaacuaucauggcaauccuaugcgucccgaacgcagugauacuacagaacgcuuggaaaguaaguuguacgaucuuggcuguugucuccguuaguccucucuugcuaaccaguucgcaacagaaaacagacuggaucccacuggcauugaccaucaaaggacucaauccaacugccauauucuuaacaacucuaucccggacaaacaagaaaagaucauggccacuuaaugaggccauaauggccgucggcaugguuagcaucuuagcaucaucucuccucaaaaaugauauaccgaugacuggcccucuaguggcggguggacucuuaacuguauguuauguguuaacgggacggucagcagaucuagaguuggagcgggccacagacguaaaaugggaagaucaagcugaaaucucgggcucaaguccuauacuaucgauuacuauuucagaagacgguucuaugagcaucaagaaugaagaagaagaacaaacucuaacuaucuuaauuaggacaggacuucuggucauaagcggucuauuuccaauuucaauaccuauuaccgcggccgcaugguaucuaugggaggucaagaaacaacgagccgggguacuuugggauguaccaagcccaccgccgaugggaaaagcugagcuggaggacggagcuuacagaauaaaacaaaaaggcaucuuaggcuauagccagaucggggcaggaguauacaaagaggguacuuuccacacgauguggcacgucacucgcggugcuguucucaugcacaaagguaaacguauagaaccaucuugggcugauguuaagaaagacuuaauuaguuacggaggcgguuggaaacucgagggugaauggaaagagggagaagagguacagguccucgccuuagaaccuggcaaaaauccuagagcuguccaaacuaaaccuggccuauuuaaaacuaacacuggcacuaucggagcagucucauuagacuucuccccaggaacauccgggucuccgauuauugacaaaaagggaaaaguugucgggcucuauggaaacggaguaguuacacguucuggagcguauguuagcgcuauugcgcagaccgaaaaaucaaucgaagacaauccagagauagaagaugacauauuccguaaaagacgauuaacuauuauggauuuacacccuggagcugggaaaacgaaacgguacuugccggcgaucgugagagaggcaauaaaacgaggucuaagaacacuuauacuggcuccuaccagggucguagcggcugaaauggaagaggcauuaagagguuuaccgauuagauaucaaaccccugcaauuagagcggagcacacaggcagagaaauaguagacuugaugugucacgccacuuucacuaugagauuauuaaguccaguacgcgucccgaauuauaauuuaauuauaauggacgaagcucauuucacugauccagccagcaucgcagcucgaggauacauaucuacgagaguagaaaugggggaagccgcggguauauucaugacugccacacccccgggaucaagggauccauuuccacagucaaaugcaccuaucauugaugaggaaagggaaauaccggaaaggagcuggaacucuggacaugaguggguaacagauuuuaaaggaaaaacagucugguucgugccaaguauaaaagccggaaacgacauagcugcgugucugaggaaaaacggcaagaaaguaauccaguuaucgcguaaaacauucgauucagaauauguaaaaacaagaacaaacgacugggauuucgucgugacaacagauauaucagaaaugggugcuaacuuuaaagccgaacgaguuauagacccgcgucguugcaugaaaccagucauucuuacagacggggaggaaagaguaauuuuagccgguccgaugccuguaacacacucuucugcagcgcaaaggcgaggucgaauuggacgcaauccuaaaaaugaaaacgaucaguauauauauaugggcgagccccuagaaaaugaugaggauugcgcgcacuggaaagaagcaaagaugcuauuagauaacauuaacaccccggaagguauuauucccucgauguuugaaccagaacgagaaaaaguagacgccauugacggggaguaucgacuacgaggagaagccagaaaaaccuucguagauuuaaugagacggggagauuugccaguauggcuagcauacaaaguagcagcagaggggauaaauuacgcagauagaagguggugcuucgauggaaucaaaaauaaucaaauucuugaagaaaacguagaaguugaaauuuggacaaaagaaggugagaggaagaagcuaaaaccgagaugguuagacgccagaauuuacucagacccacuagcacucaaagaguuuaaagaauuugcggcugguaggaaaucauuaacacugaauuuaauuacagaaaugggaaggcuaccgaccuucaugacacagaaaacuagagaugcucuugauaacuuggcaguuuugcauacggcagaggcaggcggacgggccuacaaccaugcauuaagugaauuaccagaaacucucgaaacacuacucuugcuuaccuuacuggcuacugucacggguggcauauuucucuuuuuaaugaguggccgggguauagguaaaaugacauuaggcaugugcuguauaauuacugcaaguaucuuauuaugguacgcgcagauacagccccauuggauugcugcgucaauaauacuagaguucuuucucauuguuuuacuuauaccggaacccgaaaaacaacgaacaccucaagauaaucaacuuaccuauguaguuauagcaauccugacuguagucgccgcaacaauggcaaaugaaaugggauuuuuagaaaagaccaaaaaggaccuuggauugggaaguauugccacacaacaaccagaaaguaacauacuagacauagauuuaagaccggccagcgcguggacauuguaugccgucgcuacaacguuuguuacuccaauguugcgacacucuauagaaaauucuucuguuaauguaucauuaacagcgauugcuaaucaagcaacgguauuaaugggacuugggaagggcuggccacuuucaaaaauggacauaggaguaccauuauuagccauaggauguuauucucaaguuaacccaaucacauuaacagcagcuuuacuacuucuaguagcccauuacgccauaauugguccagguuuacaagccaaagcuacacgagaggcccagaaacgcgcugccgcagguauaaugaaaaauccaacaguggacgguaucaccguuauugauuuagauccgauaccauaugaucccaaauuugagaaacaguuaggucaaguaaugcuguuaauucuuugcguuacacaagucuuaaugaugagaacgaccugggcacuuugcgaagcauugacccuugcaacaggaccaauaagcacucuaugggaaggaaacccaggcagauucuggaacacaaccauagcgguaaguauggcaaacauauuucggggaucguauuuagcuggggcaggacuguuauucucuauuaugaagaacacaaccaacacaagaagagguacgggaaauaucggggaaacauuaggcgaaaaguggaagaguagacuaaaugcacucgggaaaucugaauuucaaaucuauaagaaaucuggaauccaagaagucgauagaaccuuagcuaaagaagggauuaagagaggggaaacagaucaccaugcaguuucacgugggucggccaaauuaaggugguuuguggaacgaaauauggugacaccugaaggcaagguuguugaucuugggugcggcagaggagguuggucuuauuacuguggaggacuuaaaaacgucagagaaguuaagggccuaacaaaaggcggaccagggcacgaagaaccuauaccgaugucuacuuaugguuggaaccuuguucguuuacaaaguggagucgacguauuuuucaucccuccagaaaagugugacacuuuauugugcgauauuggagaaagcucaccgaacccaacaguagaagcaggccguacgcuucgaguacugaaucuuguagaaaacugguuaaauaauaacacccaguuuugcauuaagguacugaauccauacaugccaucagugaucgagaaaauggaagcauuacaaagaaaauaugggggugcauugguuagaaauccacuaucuaggaacucuacacaugaaauguauugggucaguaaugccagugguaauauagucaguucaguaaacaugauuaguaggauguuaauuaaccgguuuacaaugagacacaaaaaggcaaccuacgaacccgaugucgacuuaggguccgggacucguaacauagguauagaaucagaaauaccuaacuuggacauaauagguaagcgaaucgagaaaauuaaacaggagcaugaaacuagcuggcauuaugaccaggaucaccccuauaaaacaugggcguaccacggauccuaugaaacuaaacaaacuggaucugcaucuucaauggugaacgguguuguuagauuacugaccaaaccaugggacguucucccuaccguuacacaaauggcuaugacugacacaacuccguuugggcaacaaagaguguucaaggagaaaguggacacccguacgcaggagccaaaggaaggcaccaagaaacuuaugaaaauuacagccgaaugguuguggaaagaacuagggaaaaagaaaacaccaaggauguguacuagagaagaguucacacgcaaaguccguucaaacgcugcccuaggagcuauauucacagacgaaaauaaauggaaaagcgcucgugaagcaguagaggauucacguuucugggaguugguagauaaagagcguaacuugcaucuagaaggaaaaugugagacauguguauacaauaugaugggaaaaagagagaagaaauuaggcgaguucggcaaagcuaaaggaagcagggccauaugguacauguggcuuggagcaagauuccuugaguucgaggcguuaggauucuuaaacgaagaucacugguucucucgagaaaacucuuuaagcggcguugaaggugaaggacuacauaaacucggauacauauugagagauguaucuaagaaagaaggaggugcaauguaugcggaugacaccgcaggcugggauacuagaaucacauuggaagaccucaaaaacgaggaaaugguuacaaaucacauggagggugaacauaagaaacuggcggaggcuauuuucaaacucaccuaccagaauaaaguagugagagugcagcggcccacgccaagagguacuguaauggacaucauaagucguagggaucaaagaggcucaggucagguugguacauauggucucaauacauucacuaauauggaagcccagcuaauaagacaaauggagggugaaggcguuuucaaaaauauucaacgacuuacaguuacggaggagguggcaguucauaauuggcuagcuagagugggcagagagcguuuaagcaggauggcgauuucgggagacgauugugucguaaaaccuuuagacgaccgguuugcaaaugcacugacugcguugaaugauaugggaaagaucagaaaggauauccaacaaugggaaccaucaaagggauggaaugacuggacucaaguaccuuuuuguucacaccacuuucacgagcuuauaaugaaagacggucguaucuuagugguuccuugucguaaucaggacgaauuaauaggacgggccaggauaucucaaggagcaggcuggucauugcgagaaaccgcaugcuuaggaaaaaguuaugcccagauguggaguuuaauguacuuccacagaagagaucugagacuugcggcuaaugccauauguagcgcaguaccaucacacuggguaccaaccucacguacuacauggaguauacaugcuaagcaugaauggaugacuacagaagauaugcucaccguauggaacagaguguggauccgagagaacccauggauggaagauaagacaccuguagaaaguugggaggaaauuccauauuuagguaaaagagaagaccaaugguguggaaguuuaauaggauugaccucaagggcaaccugggccaaaaauauucaagcagcuaucaaucaaguucguagcuugaucgguaacgaagaauauacugauuacaugccaucaaugaagagauuuagaagagaagaagaagaagcggguguacucugguaa

SEQ ID NO: 22792 - RNA, 9876 nt, Artificial Sequence
  derived and/or modified CDS sequence (opt6) from DENV-2__EU482542__SS-prME
agugcagggaugauuauaaugcuaauaccaacuguuauggcauuucaccuaacuacgcgcaauggugaaccccacaugauagucggcauucaagaaaaaggaaagagcuugcuuuuuaaaacagaagacgggguuaauauguguacccuaauggcuauggaucuaggggaacugugugaagauacaauaacauauaaaugccccuuauuacgacaaaaugaaccagaagacauagacuguugguguaauuccacauccacguggguuacuuacgggacauguacaacuacuggagagcauaggcgggagaaaaggucuguagcuuuggugccacauguuggcauggguuuggaaacaagaaccgaaacauggaugucuucggaaggagcauggaaacacgcacaaaggaucgaaaccuggauacuaagacauccuggcuucacgaucauggcugcaauacucgcauauaccaucggaaccacgcauuuucaaagaguauuaauauuuauacucuuaaccgcgguagcaccaucaaugacaaugagaugcauaggaauuucuaauagagauuuuguagaaggaguguccggagguuccuggguagacauaguccuggaacaugggucuugugucacuacaauggcuaaaaauaaaccuacuuuggacuuugaauugauuaaaacagaagcgaaacaaccggcgacacugcgaaaauauugcauugaagcaaaacuaacaaauacuaccacagaaagucgauguccaacucaaggagagccuagccuaaaagaagaacaagauaaaagauucguaugcaaacauucaauggucgacagaggcugggggaaugguugcggacuguuuggaaaaggaggaauaguaacuugugcuauguuuacguguaagaaaaauauggaggguaaaauaguccaaccagagaaccuugaguacacgauaguagucacaccucacucaggcgaggagcacgcgguaggcaaugacacagguaaacauggacaagaaauaaaaguuacgccacaaucaucuauaaccgaggcagagcugaccgguuacgggacugucacgauggaauguaguccaaggacagguuuggauuuuaaugagauggugcuccuacaaauggaaaauaaagcauggcuaguacaucgacaaugguuuuuagacuuaccacuaccgugguuaccaggugcggacaaacaagaaaguaauuggauacaaaaagaaacauuaguaacauucaaaaauccacacgcaaagaaacaagacguaguagugcuagguucacaagagggcgcaaugcacacagcauuaacgggcgcuacggagauccagaugucuucuggaaacuuguuguuuaccggacauuuaaagugccguuugaggauggauaaacugcagcuaaaagggaugucauauagcauguguacugguaaauucaaaguuguaaaagagauugcggaaacucaacacggaacaauugugauaagaguccaauaugaaggggacgggucuccauguaaaguacccuuugagaucauggaucuugagaaaagauauguuuuaggaagacucauuacuguaaacccaauaguaacugaaaaagacucaccgguuaacauugaggcagaaccuccauucggggacuccuauaucauaauuggcguggaaccugggcaauuaaagcugaauugguucaagaaaggcaguucgaucggucaaauguuugagaccaccaugaggggagcuaaacguauggcuauucugggggauacugcgugggacuucggaucccugggaggugucuucacaucuauagggaaggcguugcaccaaguauuuggcgcgaucuacggcgcagcauuuaguggagucaguuggaccaugaaaauucuaauagguguuauaauaacguggauugguaugaacuccagaucuacaucccuuucuguaagccuaguuuuagucgguauagucacacuuuauuuaggaguaaugguacaggcugacagcggauguguaguaagcuggaaaaacaaagaguugaagugcggcucuggaauauuuauaacugacaaugugcauacuuggacggagcaauauaaauuucagccagagucaccuaguaaacuggccagugcaauccaaaaagcacaggaggaagguacuugugggauaagaucaguaacuaggcucgaaaaccuuauguggaaacaaauaacgccggaauugaaucacauucuagcagaaaaugaggucaaacuaaccauuaugacuggagacauaaaaggcauaaugcaagcagguaaaagaagucucagaccucagccuacugaguugaaauauucauggaaaaccugggggaaagcgaaaaugcuaaguacugaaucuuacaaucaaacguuccuaaucgacggacccgaaaccgcagaaugcccaaauacaaaucgagccuggaauagcuuggaggucgaagauuacggguuuggaguuuuuacuacaaauauauggcuaaaacucaaagaaaaacaggacgcuuuuugugauucaaaacuuaugucagcugcaauuaaagacaaucgagcaguccaugcugauaugggauacuggaucgaaagcgcacuaaacgacacauggaaaauagagaaagcaaguuuuauagaagucaaaaauugucacuggccaaaaagccacacucuguggucaaaugggguauuagaaucagaaaugaucauacccaagaaucuagcuggaccgguuagucagcacaauuaucgcccuggguaccauacgcagauugcagguccuuggcacuuaggaaagcuagaaauggauuuugacuuuugugauggaacaacaguaauaguaaccgaagauugcgguaaucggggccccucuuuacggacgacaacugcuuccgggaaacucaucacagaaugguguugcagaaguugcacgcugccaccguuaagguauagaggcgaagacggguguugguaugggauggaaauaagaccacugaaggaaaaagaagagaacuuagugaacagucuuguaacugcaggucaugggcaaguagacaauuuuaguuugggaguacugggaauggcauuauuucuagaagaaaugcuaaaaaccaggguggggacaaaacacgcaauacuauuaguagcaguuagcuuuguaacuuuaaucacaggaaauaugagcuuuaaagacuuaggucgaguagugguuaugguuggagcaacgauggcugaugacauaggaaugggugucacauacuuagcauuauuggcggcauuuaaaguacgaccuaccuucgcagcaggacuauuacuacguaagcucaccagcaaagaauuaaugaugacaacaauaggaaucguuuuacuuucacaaagcacaaucccagaaaccguauuggagcuaacggaugcccuggcacuagggaugaugguuuuaaagauugugagaaacauggaaaaauaccaacuugcugugaccauuauggcaaucuuaugcguacccaaugcaguuauauuacaaaacgcguggaaaguauccugcacgauacuagcuguuguaucaguauccccgcuuuugcuuacuucaagccaacagaaaacagauuggauacccuuagcccuuacgauaaagggauuaaaucccacagccauauuucucacuacuuuaagcagaacaaauaagaaaagaaguuggccacuaaacgaagcgauuauggcagugggcaugguuaguauauuagcgaguagucuauuaaagaaugauauuccaaugacaggaccacucgucgccgguggcuuacuaacuguauguuacguucuaacgggaaggucugcagauuuggaguuagaaagggcuacggauguaaaaugggaagaucaagcagaaauaucgggaaguagccccauauugucgaucacuauaagugaagacggaucuauguccauaaagaaugaagaagaagaacaaacucuuacaauccuuaucaggacagguuuauuaguuauaaguggguuauuccccauaucuauuccuauaacagccgcagcuugguacuuaugggaggugaagaaacaacgugccgguguucuaugggacguucccagcccgccucccaugggcaaagcggaacuugaagacggagcuuaucgaauaaagcagaaggguauacugggauauagucaaaucggggcaggaguauacaaagaaggaacuuuucacacgauguggcacgucacucguggagcuguacucaugcauaaaggcaaacgcauugagccauccugggcggacguuaagaaagaccuuauaaguuacggaggugguuggaaauuggaaggagaauggaaagaaggagaagaaguacaagucuuagcauuagagccagguaaaaauccgagagcgguacagacuaagccaggccuuuucaagacgaacacgggaacgauaggagcuguaagccuagauuuuucccccggaacuucaggcucuccgauaauugacaagaaaggaaaaguugucggacuguaugguaacggaguggucacaagaucaggcgcuuacgucucggccauugcacagacggagaaaucaauagaggacaacccugaaauagaagaugauauuuuucgcaaacgucgcuuaacgauuauggaccuacacccuggagccggaaaaacuaaaagguauuugccggcgauuguacgcgaagcaauuaaacgugguuuaagaacgcuaauauuagcuccaacgagagucguugcggccgagauggaagaagcauuaagaggacuaccaauaagguaccaaacaccagcgauccgcgcugaacauacaggucgggaaauuguagaccugaugugccaugcaacauuuacaaugagacuucucucgccagugaggguuccgaauuauaauuuaaucauaauggaugaagcacacuucacagauccugcgucaauugcagcaagagguuauauuagcacaagagucgaaaugggcgaagcugccggaauauuuaugacagcaacgccacccggaucccgggacccauuuccacaaagcaacgcaccaauaaucgacgaagaaagagaaaucccugaacguuccuggaacucaggacacgaauggguuacagacuuuaaaggcaaaacagucugguuugugccaagcauuaaggccgguaacgacauugcggcaugccugaggaaaaauggaaagaaagucauucaauuaucaagaaaaacuuucgacuccgaguauguaaaaacacgaacaaaugauugggacuuugugguaacaacagauauuagcgagaugggugcaaauuucaaagcagaaaggguaauagacccacguagauguaugaaaccagugauucugacagacggugaggaacgagugauuuuagccggaccaaugccaguaacacauaguagugcugcucaaagaagaggaagaauaggaagaaaccccaaaaaugaaaacgaucaauauauauauaugggugaaccucucgagaaugacgaagauugcgcccauuggaaagaagcaaagauguuacuagacaauauaaauacaccggaggguaucauuccgucuauguuugaacccgaacgcgagaaaguagacgcaauugauggcgaauaucgauugcggggugaagcuaggaagacauuuguugauuugaugagaagaggcgacuuaccuguuugguuggccuauaaaguugcggcagaaggaauaaauuaugcagaucgaagauggugcuuugacggaauaaagaacaaucaaauucuggaggaaaaugucgagguggaaauauggaccaaagagggcgagaggaagaaacuuaaaccacgaugguuagaugcaagaauuuacuccgauccauuagcccuaaaagaauuuaaagaguuugcggcuggcagaaagucauugacuuuaaaucuuauuacugaaauggggagacucccgacauuuaugacucagaaaacgcgcgaugccuuagauaacuuagcgguucuucacacggcagaagcaggcggucgggcauacaaccaugcguuaucagaauuaccggagacccuagaaacacuccuuuuacuaacacuuuuagcuacagucacagggggaauauucuuguucuuaaugagcgggaaaggaauaggcaaaaugacacuuggaauguguugcauaauaacagcuucuauuuuauuaugguaugcccaaauccaaccucauuggaucgcggcaaguauuauuuuagaguucuuucuuaucguacuacuaauucccgaaccagaaaaacaacgaacgccccaagauaaucagcuaacuuauguuguaauagcaauacucacuguaguggcagcuacaauggcaaaugagaugggguuccuugaaaagacuaagaaagauuuggggcuagguucgauagcuacacaacaaccagaaaguaauauccuugauaucgauuuacgacccgccucggcauggacauuauacgcaguggcaacuacuuucguaacccccauguugagacauaguaucgagaauaguagcgugaaugucucauugacugcaauagcaaaucaagcuacaguacucaugggucugggaaaagguuggccgcuuucaaaaauggauaucggcguaccucugcucgccauugguugcuauucucaaguaaacccuauaacauuaacugccgcauuauuacuccuuguagcgcacuacgcuauuauagggcccggucuucaggccaaggcuacacgugaagcacagaaaagagcugcagcagguauaaugaaaaacccaacaguugacgguauaacuguuauugaucuugaccccauacccuacgauccaaaguuugaaaagcaguuaggacaagugaugcuacucaucuuauguguaacccaaguauuaaugaugcggacuacgugggcucuaugugaggcguugacacuggccaccgguccuaucucuacucucugggaaggcaauccaggacgcuucuggaauaccaccauugcgguaaguauggccaacauauuucgcgguagcuauuuagccggggccggucuccucuucucuauuaugaaaaauacgacuaauacgcgaagaggaacagguaacaugggggaaacgcugggcgaaaaauggaaaucacguuugaacgcacuuggaaaaucggaauuucaaauauauaagaaaagcggaauccaggagguugaucggacauuggcuaaagagggcauuaagcggggugaaaccgaucaucaugcgguuucgcgugggagugcaaaacuuagaugguuugucgaaaggaauaugguaacgccagaaggaaaaguaguagauuuagggugcggucgcgguggauggucauauuauugugguggguugaaaaaugugcgugagguuaaaggauuaacaaaaggaggaccugggcaugaagaaccaauacccaugucaacauauggauggaaucuuguuagguuacagaguggaguagauguauucuucaucccgccagagaaaugugacacauugcuaugugauauuggagaaagcagcccaaauccaacuguugaagcuggacguacuuuaagaguauuaaaccugguagaaaacugguuaaauaauaacacacaguucuguauuaaaguucuuaacccguacaugccaagcgugauagaaaagauggaagcacuucagcguaaauacggaggggcucugguccgaaauccccucagucguaauaguacucaugaaauguacuggguaucaaaugcaucgggaaacaucguaagcaguguaaauaugauaucucgcauguuaauaaaucguuuuacaaugaggcauaagaaagcaacauaugaaccagaugucgacuuaggaucaggcacccguaacauaggcauugaaagcgaaauaccaaaucuggacauaaucgguaagagaauagagaaaauuaaacaggaacacgaaacuuccuggcauuaugaucaggaccaccccuauaagacaugggcguaccaugguagcuacgaaacaaaacaaaccggcucggcaucaucuaugguuaacggaguaguuaggcuuuuaacaaaaccuugggauguauuacccacaguaacccaaauggcaaugacagacacaacuccguuugggcaacagcgaguauuuaaagaaaagguugacacucgcacgcaagaaccaaaggaagguaccaaaaagcuaaugaaaauuacagcagaaugguuauggaaagagcuggguaagaagaaaacccccagaauguguacacgcgaagaguucacaagaaaaguacgaaguaacgcagcacuaggugcaaucuuuacagaugagaacaaauggaagucugcgagagaagccguugaagauaguagguuuugggagcuaguagauaaagaaagaaauuuacacuuagaagggaagugugaaacgugcguauacaauaugaugggaaaaagggagaagaaacuuggagaguuugggaaagcgaaggguucuagagcaauaugguauaugugguuaggagccagguuucuagaauuugaagcauugggcuuccuaaaugaagaucauugguuuagccgugaaaacagcuuaagcggagucgaaggcgaaggacuacauaagcucggauacauacucagggacgugaguaagaaagagggcggcgcuauguacgccgacgacacagcaggaugggauacacguauaacauuagaagacuugaaaaaugaagaaaugguaacgaaccauauggaaggugagcauaagaaauuagcagaagcaauauucaaacuaacuuaucaaaacaaaguugugcgcgugcaaaggccuacuccgcguggcacaguuauggauaucauaaguagaagagaucaacguggcaguggacagguagggacauacggcuuaaauacguuuacaaauauggaagcacaauuaauacgacaaauggaaggugagggcguauucaaaaacauucaacacuuaacagucacagaagaaguagccgugcaaaauugguuagcacgcguuggucgagagagauuaaguaggauggcaauaaguggggacgauugcguagucaagccguuagacgauagauuugccaacgcuuuaacagcguuaaacgacaugggaaaaauuagaaaagauauucagcagugggaaccaucuaaagguuggaacgauuggacacaagugccauucuguagucaccacuuccacgaguuaauuaugaaggauggucgcauucuugucguacccugucguaaucaagaugaacucauuggaagggcccgaauaagccagggugcaggauggagucuaagggagaccgcaugccuggguaaaagcuaugcacaaauguggucacugauguauuuucaccgccgcgaccuacgucuugcagcgaaugcuauuugcagcgcaguaccgucccauuggguaccaacaagcaggacaacgugguccauccaugccaaacaugaguggaugacaacagaagauaugcuaaccgucuggaacagaguguggauuagagaaaaucccuggauggaagauaaaacucccguagagucgugggaagagauaccauauuugggaaaaagagaggaccaguggugcggcucgcuuauaggucugaccaguagggccacaugggcaaagaacauacaagcagccauuaaucaaguccgaucucuuaucggaaacgaagaauauacagacuauaugccguccaugaagcgauucagaagagaggaagaagaagcgggaguauugugguag

SEQ ID NO: 22793 - RNA, 9876 nt, Artificial Sequence
  derived and/or modified CDS sequence (opt6) from DENV-2__JX966380__SS-prME
acagcuggaaugauaauaauguuaauuccaacugugauggcauuucauuugacgacgcguaacggugaaccgcauaugauuguuucgcgacaagaaaaaggaaaaucauuauuauucaaaacaaaagauggaacaaauaugugcacacucauggcgauggauuuaggagaacuaugcgaagacacgauuacguauaaauguccauuucuuaaacagaaugagccggaagauauagacugcuggugcaacucuacaucuacauggguaacguacgguacuuguacaacaacaggugaacauagacgggagaaacggucaguagcacuuguaccucaugucgguaugggguuagaaaccagaacagagaccuggaugucauccgagggugcuuggaaacaugcacaacggauagaaacguggauuuuacgacauccaggauuuacgauaauggcggcaaucuuagcguacacuauaggaaccacacauuuccaacggguauuaauauuuauacuucuaacugcgauugcucccucgaugacaaugagaugcauaggaauaucaaacagagacuuugucgaggguguaagcggagguaguugggucgacauaguacuugagcauggaagcuguguaacaacuauggcuaaaaacaagccaacauuagauuucgaacuaauuaaaacagaggcgaaacagcccgccacccuaagaaaguacugcaucgaagccaaauugacgaacacuacgacugauucucgaugucccacacaaggagaaccaacauugaacgaggagcaggacaaaagauuugucugcaagcacucaaugguugaccguggcuggggaaaugggugcggacuauuuggcaaagggggaaucguaacaugcgccauguucacuugcaagaaaaauauggaaggcaaaauaguucaacccgagaaucuagaauauacagugguaauuaccccucacucaggagaagaacacgcgguuggaaacgauacugggaaacacgggaaagaaguaaaaaucacaccucagaguaguauaacugaagccgaacugacgggauaugggacuguaacaauggaauguucuccgagaacugggcuagacuuuaacgaaaugguucuccuucaaaugaaagauaaggcguggcuaguccaucgacaaugguuuuuagaucucccuuuaccauggcucccgggagcagauacacaaggaaguaauuggauccaaaaggaaacacucguaacauucaaaaacccacaugcuaaaaagcaagaugucgucguauugggaucucaagaaggcgcaaugcacacagcacucacuggugcaacagaaauacaaaugucaaguggcaaucucuuguuuacaggacaucucaaaugccgacuaagaauggauaaguuacagcuaaagggcauguccuauucaauguguacggguaaguuuaaaauuguuaaagaaauagcagaaacucagcauggaacuauagucauaagggugcaauacgagggagacggcucaccguguaaaaucccuuuugagauuauggaucuagaaaaacgacacguauuaggccgacuaauaacuguaaacccaauuguaacagaaaaagauaguccaguaaacaucgaagccgaaccacccuuuggagauaguuacauaaucauuggaguggaaccgggacaacucaaacuugauugguucaaaaagggaaguaguauaggccaaauguucgaaacaacaaugcgaggagcaaaacgaauggcuauuuuaggcgauacggcaugggauuuugggagucuaggaggaguguucacaagcaucggaaaagcccuucaccaaguguucggugcuauauacggagcagccuuuucgggugucaguuggacuaugaaaauauuaauaggggugauuauaacauggauugggaugaacucgcgcucaacuucguuaucuguaucauuagugcucguaggaauaguaacauuauaucuuggagucaugguucaggcagauucggguugcgucguaaguuggaaaaauaaagagcucaagugugggagcgguauauucgugacggacaauguacauacauggacggaacaguacaaauuucaaccagaaaguccaagcaagcucgcuagugcaauccagaaggcgcacgaagagggcaucugcgggauucgaagugugacacgacuggaaaaucuaauguggaaacaaaucacaucggaacuaaaucauauuuuguccgaaaaugaaguaaagcuaacgaucaugacaggugacauaaaagggauaaugcaaguaggaaaacgcucacuaagaccccaaccgacggaacuuagauauaguuggaaaacauggggaaaagcuaaaacucuaaguacugaauuacauaaccaaacuuucuuaauagauggucccgaaacagcggaaugucccaacacgaauagagccuggaacaguuuagaggucgaagauuacggguucggaguauucacgacuaacauauggcuuagguuaagggaaaaacaagaugucuucugugacucgaaacuaaugucagcagcuauuaaagauaaucgagcuguccacgcugacauggguuacuggauugaaagcgcgcuaaacgauacuuggaagauagagaaagcuagcuuuauagaaguuaaaucaugucacuggccuaagagccauacuuugugguccaacggagucuuagaauccgaaaugguuauccccaaaaacuuugcagggccuguaucccagcauaauaacagaccagguuaucauacacaaacugccggcccuuggcaucuaggaaagcucgaaauggacuucgacuucugugaaggcacaacgguagucgugacagaagauugcgguaaccggggacccucgcuacggaccacuacugcaagcggaaaacuaauuacugaauggugcugccgaucuuguacacucccuccgcugcgauaucggggugaagacggauguugguacggcauggaaauaagacccuuaaaggaaaaggaggagaaucuaguuucaagucucguaacugcaggucacggucaaaucgauaauuuuucucugggaauauuagggauggccuuguuccucgaagaaaugcuaagaacacgaguugguacuaaacaugcaauacuauuaguagcgguuucuuuuguuacgcuuauaaccgguaacaugucauucagagaccucgguagaguuaugguaaugguuggugccaccaugacagacgacauaggaaugggugucacguacuuagcauuacuagcugccuuuaaaguaagaccgacuuucacugcgggucugcuacuccgcaaacuaacauccaaggaacuaaugaugacuacaaucgggauaguacuauugagucaaucaucaauuccagaaacgauacuagaacugacagaugcacuagcacuggguaugaugguacuuaaaauggugcguaacauggagaaauaccaauuggcagucacuauaauggcuauacucugugugccaaacgcgguuauacuacaaaacgcauggaaaguaucaugcacaauuuuggcaguuguaucuguaaguccauugcuuuuaacaaguagucaacaaaaggcggauuggauuccccuugcauuaacaauaaaaggacuuaauccuacagcaauuuucuuaacaacucucagcagaacaaguaagaaaagaaguuggccauuaaaugaggccauaauggcgguugguaugguaagcauacuagcuucaucgcuuuuaaagaacgauauaccuaugacugggccucuuguggcgggcggccuauugacaguaugcuacguacuuacaggucgaagcgcagauuuagagcuggaaagggcaacggauguaaaaugggacgaucaggcagagauaucaggaucgucgccuauacucucgauuaccauuagugaagacggaaguaugaguauuaagaaugaagaagaggaacaaacgcuaacaauuuuaauaagaacagggcuucuaguuaucaguggcuuauuuccuguuaguauuccaauaacugcagcagcaugguaucuuugggaagugaagaaacagagggcaggaguauugugggacguacccuccccaccuccuguagguaaagcagaauuagaagauggagcuuaucgcauuaaacaaaaaggcauucuggguuauucacaaauaggcgcaggaguguauaaggaagguacuuuucacacaauguggcauguaacuagaggagcagugcugaugcauaaagggaaacggaucgagccuucuugggcagacguuaagaaagauuuaauaaguuauggaggugguuggaaacuugaaggagaauggaaagaaggagaagaaguacagguccucgcauuagaaccagggaaaaauccucgcgcaguacaaacaaagccaggauuauuccguacaaacacggguacaauuggugccguuucacuagauuuuaguccuggaacgucagguucaccaaucguugauaagaaaggaaaagucguuggacuuuauggaaacggugucgugacccgaucgggugcauaugugucagccauagcccagacugagaagaguauagaagacaaccccgagauagaagaugacauuuucagaaagaggagacuaaccauaauggaucuacacccaggcgcaggaaaaacaaaaagauaccuaccggcgauuguuagagaagcaauuaaaagaggguuaagaacccugauacuggcgccaacgagaguaguggccgcugaaauggaagaggcacucagagggcuaccaauaagauaucaaacaccagcuauaagagcugaacauaccgguagagaaauagucgauuuaaugugccaugccaccuuuacaaugagguugcuuaguccaauaagaguaccaaauuacaaucuuauaauuauggacgaagcgcauuucacagauccugcuucaaucgccgcccguggauauauuuccacgaggguggaaaugggcgaggcggcagguauuuucaugacagcuacacccccaggcucuagggaccccuucccacaaucuaacgcaccuauuauggaugaggaacgugaaauaccggagagaaguuggaacuccgggcacgaauggguaaccgauuucaaagggaagacuguaugguucguaccaucaaucaagacagguaaugauauugcggcgugucucaggaaaaaugguaaacgaguaauacaacuaagucgaaagacuuuugacagcgaguacguaaaaacaagaaccaacgauugggauuucguugugacgacggauauaagcgaaaugggagcaaauuucaaagcagaaaggguaauagacccgcgcagaugcaugaaaccaguuauucuaacagauggggaagaacgcguuauuuuggcuggaccgaugccuguaacucauucaucugcagcacaacguagaggaaggauagguagaaauccucguaaugaaaaugaccaauauauauacaugggggagccauuagaaaaugaugaagauugcgcacauuggaaagaagcuaaaaugcuauuggacaauauuaauacgccagaagggauaauaccaaguauguuugaaccugaacgugaaaaaguugaugcaauagacggcgaauaccgucuaaggggagaagcacggaaaacguuugucgauuuaaugcgaagaggagauuuaccuguaugguuggcguauaagguagcagcagaagggauaaauuaugccgacagaaggugguguuucgacggcacgagaaauaaccaaauacucgaagaaaacgucgaaguggaaaucuggacuaaggaaggagaacgaaagaaauuaaaaccaagauggcucgaugcaagaauuuacagugacccacuagcacuuaaagaauuuaaagaauuugccgcaggacguaagucguuaacacuaaauuugauuaccgagaugggcagacuaccgacguuuaugacacaaaaagcgagagaugcacuggauaaucuugcggugcuccacacugcagaagcuggaggaaaagcguauaaucaugcacuuucagaacuacccgaaacuuuagaaacuuuacuacuuuuaacuuuauuggcgacagucacggguggaaucuucuuauuuuugaugagcggacgagguauuggaaagaugacauuagguauguguuguaucauuacagcgaguauuuuauuaugguacgcgcaaauacagccacacuggauugcagcuaguauaauucuagaguucuuuuugauuguguugcuaauaccagaaccugaaaaacaaagaacaccucaagauaaccagcuuacguacguaaucauugccauauuaacagucgucgccgcuacgauggcgaaugaaaugggauuuuuagaaaagacuaagaaagauuuaggauuaggaaacauagcaacccaacagccagaaagcaauauccuggauauugauuuacguccggcaagcgcauggacacuauacgcuguagcgacgacauucauuacgccaaugcuccgucauuccauagaaaacucaucaguuaacguuaguuuaacugcaauugcuaaccaagcaacgguauuaaugggauuagguaaagguuggccucuuagcaaaauggauauaggcguuccauuauuagcuauaggguguuauucgcagguuaauccgauaaccuugacugccgccuuacuacuauuaguugcucauuacgcaauaaucggaccuggucuacaagccaaagcaaccagggaagcgcaaaagagagcagcugcuggcauaaugaaaaauccuacaguugacggaauaacaguuaucgacuuagauccuauaccauacgauccaaaauuugaaaaacaacuuggucaaguaaugcuauuaguauugugcgucacucaaguauuaaugaugcguacaacaugggcuuuaugugaagcccucacucuagcaaccggucccgugucuacauugugggagggaaacccuggaagauucuggaauacaacaauugcugugagcauggcuaacauauuuagaggaucguaucuagcuggagccggauuacuuuuuaguauaaugaaaaauacuaccagcacacgacgaggaacgggaaacauuggggaaacguuaggcgaaaaauggaagagucgacucaacgcuuuaggaaaauccgaguuccaaauauacaagaaguccggaauacaagagguagaucgaacguuagccaaagaagggauaaagagaggggaaacugaccaccaugcugucucacgggguucggcaaaacuuagaugguuuguagaaagaaacuuagucacaccagaagguaaggucguugaccuaggauguggcagagggggauggucuuauuacugcggaggacuaaagaauguccgcgaaguaaaaggauugacuaaaggcggcccaggacaugaagaaccuauaccaaugaguaccuauggauggaacuugguaagacuacaaucuggcguagauguauucuuuguaccaccagaaaaaugugauacauuacugugcgacauuggugaaaguucaccaaauccaacuguagaagcuggucgaacgcucaggguguuaaaucuuguugagaacuggcuuaauaauaauacgcaauuuugcguaaaaguacuuaauccguauaugcccucuguaauagagagaauggagacccuacaacgaaaguauggaggagcauugguuaggaauccgcuuagucguaacuccacgcacgaaauguacuggguaaguaacgcuucaggcaacauaguaaguuccguaaauaugauuucaagaauguuaauaaacagauucacaaugcgacauaagaaagcgacauaugagccagauguagauuuaggaagugguacacggaauauugguauagaaagcgaaacaccuaauuuagacaucaucggaaagaggaucgaaaagauaaaacaagaacaugagaccucauggcauuaugaucaagaucacccauauaaaacgugggcauaccaugguucguaugaaaccaaacaaacagguucugcaucaaguaugguuaauggugugguaaggcuccuuacaaaaccgugggaugucguuccuaugguaacucaaauggcaaugacugacacaacaccguucggucaacaaaggguguuuaaggagaagguugacacacgaacucaggaaccaaaagaggguacuaagaaauugaugaaaaucaccgcggaauggcuauggaaggaguugggcaaaaagaaaacucccagaaugugcacacgagaggaguucacuaagaaaguacguuccaaugccgcauugggcgcaaucuucacggacgagaauaaauggaaaucugcuagagaagcaguagaggacagucguuucugggagcuaguagauaaagagagaaaucuccauuuagaagguaaaugugagacguguguauacaauaugaugggaaaaagagaaaagaaacuaggcgaguucgguaaagccaaagguagccgagcaauuugguacaugugguugggcgcacgauucuuagaguucgaagcacuagguuucuuaaacgaagaccauugguucagucgggaaaauucacuaagugguguagagggagagggacuacacaaauuaggcuacauucuuagagaggugagcaagaaagaagguggugcuauguaugcugaugacaccgcagguugggauacacggaucacaaucgaagaucuuaaaaaugaagagaugauuacgaaucacauggcaggcgaacacaaaaaguuagccgaggccauauucaaauuaacguaccagaauaaaguuguucgaguccaaagaccgacaccuagagguacuguuauggacauaauauccagaagagaucaaagagggucaggacaagucggaaccuacggucugaauaccuuuacgaauauggaagcacaacuaauuagacaaauggaaggcgaagggaucuuuaaaaauauccagcaccucacagcaagcgaagaaauagcugugcaagauuggcucgucagaguugggcgagaaagauuaagcagaauggcaauuuccggagacgacuguguaguaaaaccguuagaugaccgcuucgcacgagcgcuuacugccuuaaaugauaugggaaaaguaagaaaagacauccagcagugggaacccagucgagguuggaacgauuggacacagguucccuucugcagccaccauuuucaugaacucaucaugaaagacggccgcacgcuuguuguaccgugcagaaaccaagaugagcuuaucggcagagcuaggauuucccaaggagcgggauggucgcuuagagagacagcaugucucggaaagucuuacgcacaaauguggucacuaauguacuuccauagacgagauuuaagguuggccgcaaacgcaauaugcagugcaguuccaagccauuggguuccuacaucgaggacaacguggucaauacaugccucgcaugaguggaugacuaccgaagauauguuaacggucuggaacaagguauggauuuuagagaaucccuggauggaggauaaaacuccagucgaaaguugggaggagauaccuuauuuaggaaagcgagaagaucagugguguggaucauuaauaggauuaacuagcagggccacgugggccaaaaauauacaaacggcaaucaaucaagucagaaguuuaauagggaaugaagaauauacggauuauaugcccucaaugaagcgauucagaagagaagaggaagaagcugggguacuaugguaa

SEQ ID NO: 22794 - RNA, 9876 nt, Artificial Sequence
  derived and/or modified CDS sequence (opt6) from DENV-2__JX966379__SS-prME
acagcagggaugauuauaauguuaauaccgacgguaauggcauuucauuugacaacucggaauggggaaccucauaugaucguuucacgacaagaaaaagggaaaucacuauuauucaaaacaaaagauggaacaaacauguguacgcuuauggcuauggaucuaggagaacuuugcgaagauaccauuaccuauaaauguccauuucuuaaacagaacgaaccugaagauauugauugcuggugcaacucuacuucaacaugggugacguaugguacuuguacaacgacaggagaacacaggagggguaaaaggucgguggcauuaguaccacacguggguaugggguuagaaacaaggacagaaacauggaugaguucugaaggugcauggaaacacgcgcaaagaauagaaacuuggauccuaagacauccugguuuuacuauaauggccgcgauucuugcguauacgauaggaacuacacauuuucaaagaguauuaauauucauacuucugaccgcaauugccccaaguaugaccaugcgauguauuggaauaaguaacagagauuuuguagaaggagugucugguggaaguuggguagacaucguacuagaacacggaucauguguuacaacuauggcgaaaaauaaaccgacacuugauuuugaacugauuaaaacagaggccaaacaaccagcaagccuuaggaaauacuguauugaagcaaaauuaacuaacacgaccaccgauuccagaugucccacacaaggagagccuacacuuaaugaggagcaagacaaaagauuuguauguaaacauucgaugguugaccgaggauggggaaauggaugcggccuauucgggaaaggagggauaguaacgugcgcaauguuuacaugcaagaaaaacauggaagguaaaauaguacaaccugagaaucuugaauauacaguugugaucacuccucacucgggcgaggaacaugcugugggcaaugauaccggaaaacauggaaaggaaguaaaaaucacaccgcagaguaguauaaccgaagcagaauuaacgggcuaugggacaguaacaauggaguguucgccaaggacugggcuagacuucaaugagaugguguugcuccaaauggaggauaaagccugguuggugcauaggcaaugguuccucgaccuaccucuuccauggcuuccuggugcugauacacagggaagcaacuggauacaaaaagaaacacuuguuacguuuaaaaacccacaugcgaagaaacaagauguaguuguacuaggaucacaagaaggugcaaugcauacagcacuuacuggagcaacugaaauccaaaugucaaguggcaacuuacucuuuacgggccaccuuaaaugucgacuccgcauggauaaacuucaacuuaaaggcaugucauacucaauguguacugguaaguucaagauaguaaaagagaucgcggagacacagcaugguacaauaguaauuagaguacaguaugaaggagacggaagucccuguaaaauuccauuugagauaauggaucucgagaagcggcacguucuggguagauugauaacggucaauccaauuguuacagagaaagauagucccguaaauauagaagcggagcccccguucggcgauucuuacauuauuaucggugucgaaccaggucagcuuaaacuagauugguuuaagaaagggaguucaauagggcaaauguuugaaacuacgaugagaggagcaaagcgaauggcgauacuaggagacacagcaugggauuucgggucuuuagggggcguauuuacaagcauagggaaagcacuucaucaaguuuucggugcuauuuauggagcugccuuuagcggagugaguuggacuaugaaaauauuaaucgggguuauuauuacguggauagguaugaacucuaggaguacuucuuugucugucagcuuaguacuugucgguauaguuacacuuuaccuaggugugaugguacaagcagacucaggaugugucguaucauggaaaaauaaagaacuaaaaugugguuccggaaucuucguaacggacaacguacacacauggacagaacaauacaaguuucaaccagaaucacccucaaaacucgcgagugcuauacagaaggcacaugaggaggggauuugcggcauaagaaguguaacgagguuagaaaacuuaauguggaaacaaauaaccccagaguugaaccacauacuaagcgaaaaugaaguaaaauuaacaauuaugacgggugauaucaaaggcauaaugcaaguaggaaaacggagucuacgaccacaaccaacagaauuaagauauaguuggaaaacaugggggaaggcaaagaugcuaagcacagaacuucauaaucagacguuccuaaucgacggaccagaaaccgcagaaugcccuaacacaaaucgugcuuggaacuccuuagaaguugaagauuauggauuugggguuuuuacuacaaauauaugguugcguuuacgggaaaaacaagacgucuuuugugauucuaaguugaugucugcugcaauaaaagacaauagagcuguacacgcagauauggguuauuggaucgaaucugcucuaaacgacacuuggaagaucgaaaaggcuagcuucaucgaagugaaaucgugccacuggcccaagagucauacguuauggagcaauggcgugcuggagucugaaauggucauaccuaaaaauuaugcgggccccguuucgcagcacaauaaucggccaggcuaccacacacaaacagcagggcccuggcacuugggaaagcuagaaauggacuucgauuucugugaagguacaacuguaguggucacagaagaauguggaaaucggggaccuucuuugagaacaacaaccgccagcggaaaauugauaacggaaugguguuguagaagcugcacauuaccaccacuacgcuacagaggggaagacggguguugguauggaauggagauuagaccacuuaaagaaaaagaagaaaacuuaguaucaagucuagugacagcgggacacggccaaauugacaacuuuucucuagguaucuugggaauggcauuauuucuagaagaaauguuacguagucgaguugguaccaaacacgcuaucuuguugguugcagucucauuuguaacacuuauaacugguaauaugaguuuuagagauuugggucgaguaaugguaauggugggugccacgaugacugacgauauaggcaugggagucacguaucuugcccuucuagcggccuauaaaguacgaccaacauuugcggcaggucuuuuacuucggaaacuaacuuccaaagaauuaaugaugacuacuauagggauaguucuuuuaagccagagcucaauucccgaaacaauccuggaguuaacggaugccuuagcucucggaaugaugguuuugaaaauggucagaaacauggaaaaguaccaacucgccgucacuaucauggcaauacuaugcguaccaaacgcaguuauucugcagaaugcauggaagguuagcuguacuacccuugcagucguuuccguaaguccacuacuauuaaccucaucucaacaaaaagcagacuggauaccacuggccuuaacaauaaagggauuaaauccaacggcaauauuuuugacaacgcucagcagaacuagcaaaaagagaucauggccucucaaugaagcaauuauggcuguugggauggugagcauucuggcgucaucgcuacugaaaaacgauauccccaugacuggaccacuuguagcaggggguuuacucacaguauguuauguacucaccgguagaucagccgaccuagagcuugaaagagcaacggauguuaaaugggaugaucaggcugagaucucaggaaguucgccgauauugaguauuacgaucucagaagacggauccaugucuauuaaaaacgaagaagaagaacaaaccuuaacgauucugauccggacaggacuguuaguuauuuccggguuguuuccaguaagcacuccuauuacagcagcugcgugguaucuaugggaagucaagaaacagcgagcaggaguacuuugggauguaccaagcccuccucccguuggaaaagcggaauuggaggauggagcguaccggauaaaacaaaaaggaauccuggguuauagccaaaucggugcugguguauauaaagaaggaaccuuucauaccauguggcauguaacaagaggggccguacugaugcauaaaggcaaacgaaucgagccuucuugggcugacgucaagaaagaccuaauaucauauggaggaggauggaaauuagagggggaguggaaagaaggggaggaaguucaaguacuagcucuagagccgggcaaaaauccucgugcgguacagaccaagccuggccuguuucguacaaauacuggaacaaucggagcaguaucacuggacuucucacccggaacuagcgguaguccaauaguagauaagaaaggcaaaguaguaggauuauacgggaauggaguuguaacuaggucuggugcauacguaagugcaauugcccagacagaaaaaucaauugaagacaauccagagaucgaggaugauauuuuuagaaaacggcgacucacaaucauggaucuucauccgggggcagguaaaacuaaacgauaccuuccagcgauuguaagagaagcaaucaaacgaggucugagaacacuuaucuuggcaccaacaaggguaguagcugcggagauggaggaagcucuuagagggcuuccaauaagauaucaaacuccggccauaagggcagaacauacgggucgugagaucguugacuuaaugugucaugcaacguuuacuaugagacuguuaucaccuauuagaguaccgaauuauaaccuaauuauaauggacgaagcacacuuuacggacccggcaagcauagcagcgagagguuauaucuccacgaggguugaaaugggggaagcggcugggauuuuuaugacagcaacucccccuggaagccgggauccauuuccccagagcaaugcaccuauaauggacgaagaacgggaaauaccagaaagauccuggaauagcggucacgaaugggugacagauuuuaaaggaaaaacuguaugguucgucccuagcauuaaagcuggaaacgauauugcuacuugucuaagaaagaauggaaagcguguuauucaauuaagcagaaaaacauucgauucggaguacguaaagacucgaacuaaugauugggauuuuguaguuaccacugacauaucugaaaugggagcaaauuuuaaagcagaaagaguuauugacccacgaaggugcaugaaaccgguuauucucacugacggcgaagagagagugauacuggcagguccaaugcccguaacacauucuagcgcugcucaaagaagaggccgaaucgguagaaacccacgaaaugaaaacgaccaauacauauauaugggggaaccacuugagaacgacgaggauugugcacauuggaaagaagcgaaaaugcuacuggacaauauuaacacgccagaagggauuaucccuucuauguucgagccggaacgugaaaagguggaugcuauugacggcgaauauagauuacguggagaggcacggaaaacuuucguggaccucaugcgccgaggggauuuacccgucuggcuugcauauaaaguagcuagugaaggaauaaauuaugcagauagacguuggugcuucgaugggacgcgaaauaaccaaauuuuagaggaaaauguugaagucgagauuuggacaaaggaaggcgagagaaagaaacugaaaccaaggugguuggaugcuaggauuuacuccgacccacuagcacuuaaagaauuuaaagaguucgcugcagguagaaaaucauugacacuaaacuuaauaacagaaaugggcagacuaccuacguucaugacgcaaaaagcacgggaugcgcuugauaaccuggcagugcuucauacagcugaagcuggaggcaaagcauauaaucacgcgcuuucagaguuaccagagacacuagaaacucugcuauuauugacuuuauuggcgacaguaacgggaggaaucuuuuuauuucuuaugagcggucgcggaauaggaaaaaugacuuuaggcauguguuguauaauuacagcaaguauacuucucugguaugcacaaauacaaccucauuggauagcagccagcauaauauuagaguucuuuuuaauaguccuucuuauuccagaaccagagaaacaacggacuccucaagauaaucaauuaaccuauguuaucauagcgauuuuaacuguagucgcagcuacaauggcaaaugagauggguuuucuggagaagaccaagaaagaucuaggacugggacauauagcgacacagcagccagaaucgaauauuuuagacauugaucuaagaccagcuagcgcauggacucuuuacgcugucgcuacuaccuucauaacuccaaugcuaaggcauagcauagaaaauaguucaguuaacgucucuuuaacagcaauagccaaucaggcgacaguguuaaugggacucgguaaaggauggccucuaucaaaaauggauauaggugugccauuacuugccauaggauguuacucgcaagugaaucccauuacgcucacugcagcacuauuauuacugguugcacacuaugcaauaauagguccugggcuucaagccaaagcaacaagagaagcucagaaaagagcggcagcggggauaaugaaaaauccuacugucgacggaauaacaguuauugaccuugauccuauaccauaugauccuaaauuugaaaaacaauugggacaaguuaugcugcugguauugugugugacccaagugcuuaugaugagaaccacgugggcguuaugcgaagcacuuacacuugccacagguccaguuagcacgcuuugggaggggaacccuggucgauuuuggaauacgacaauugcaguuagcauggcuaauauauuuagagguucauacuuagcaggcgcgggacuccuguucuccauuaugaaaaauaccacuagcacaagaagaggcacaggcaauauaggagaaacccuuggcgaaaaauggaagucaaggcucaaugcacuagggaaaucagaauuucaaauauauaagaaaagcgggauucaggaaguagaucguacucucgcaaaagaaggaauaaaaaggggugagacugaccaucacgcgguaucaagaggauccgcuaaguugaggugguuuguugaaagaaaucuaguaacucccgagggaaaaguaguggaucucggcugcgggagaggggguuggucauacuacuguggaggacuaaagaaugugcgagagguaaaaggguuaacgaaaggcgggccgggccacgaagaacccauucccaugucuaccuacgguuggaauuuaguaagacuacaaucaggaguagacguguucuucguaccacccgaaaaaugugauacacuacucugcgacauuggagaaucuucaccaaacccaacaguugaagccgguaggaccuuaagaguuuugaauuuaguggagaacuggcuuaaugacaauacccaauucuguguaaagguacugaacccauacaugccgucuguaauagaaaggauggaaacccuucaacguaaguauggaggcgcauuaguccgaaacccgcuaucgcgcaauuccacacaugaaauguacuggguuaguaaugcaucgggaaacgugguguccucgguuaauaugauaagucguauguuaauuaaccgauuuacaaugcgccacaagaaagcgacguaugagccugauguugaucucggaaguggaacuaggaacauaggcauugagucagaaaccccuaaucuagacauuauagguaagaggaucgagaaaauaaaacaagaacaugaagcgaguuggcacuaugaccaagaucauccuuacaaaaccugggcauaucauggaucauaugaaacaaagcaaacaggaucugcgucuaguaugguaaacgguguaguacgguuguuaaccaagcccugggacguaguuccaaugguuacucaaauggccaugaccgacacaacgccauucggacaacaacgcguuuucaaggagaaaguagauacaagaacacaagaaccgaaagaggguaccaagaaauuaaugaaaauaacugcagaauggcuuuggaaagagcuuggcaagaagaaaacuccaagaauguguacacgcgaggaauuuacaaagaaagugagaucaaacgcagcuuuaggugccauuuuuacggacgaaaacaaauggaaguccgcacgagaagcaguagaagauaaucgauuuugggaauugguagauaaagaaagaaaccuucaucucgaaggcaaaugugaaaccugcguauacaauaugaugggaaaacgagagaagaaauuaggagaguuuggaaaagcucgaggaagcagagcaaucugguauauguggcuuggggcaagguucuuagaauuugaggcuuuagguuuucuuaacgaagaucauugguucagcagagaaaacucuuugucaggcguagaaggggaaggcuuacacaaauuaggauauaucuuacgcgaaguaucaaagaaagaaggaggggcaauguacgcugaugauacggcugguugggacacacgaauuaccauugaagaccucaaaaaugaagagaugaucacgaaucacauggccggugaacauaagaaacuagccgaagcgauuuuuaaauuaaccuaccaaaauaagguaguuagaguucaaagaccuacaccuagagguacagugauggauauaauaucaagaagggaccaacgagguaguggccaagucguaacuuaugggcuuaacacauuuacaaauauggaagcgcaauuaauccgccaaauggaaggagaaggcaucuucaaaucaauucaacaccuaacagcaucagaagaaaucgcuguacaagacugguuagcucgcgucgguagagaaagguugaguagaauggcaauuuccggcgacgacugcguagugaaaccuuuagacgacagguucgcgagggcguugaccgccuuaaaugacauggguaaagugcggaaagacauucaacaaugggaaccgucaagaggguggaaugauuggacucagguccccuucuguucacaccacuuucacgaacuaauuaugaaggaugguagaacauuaguggucccaugucgaaaucaagaugaguuaauuggacgugcucguauaagucaaggggccggauggucucuacgcgaaaccgccugccuugggaaaagcuaugcacaaauguggucauuaauguauuuucaccgacgagauuugagacuggcugcaaacgcgauauguuccgcaguaccgagucacugggugccgacaaguagaacgacuuggucaauacaugcaucucacgaguggaugacaaccgaggacauguugacuguauggaauaggguuuggauauuggaaaacccguggauggaggauaagacuccuguugaaucgugggaagaaauacccuaccuuggaaaaagagaagaccaauggugugguucuuuaauagggcuaacuucacgagcgacuugggccaaaaauauacaaacugccauuaaucaaguaagaucauugauuggaaaugaagaauauacagauuacaugccgucuaugaaaagauuucgucgagaagaggaagaagccgggguacuaugguaa

SEQ ID NO: 22795 - RNA, 9876 nt, Artificial Sequence
  derived and/or modified CDS sequence (opt6) from DENV-2__KP012546__SS-prME
acggcggggauuauuauuaugaugauuccgacaguaauggcguuccacuuaacaacacgaaauggcgaaccccacaugauaguaaguagacaggaaaaaggaaaauccuugcuauucaaaacagaaaacggcguuaacaugugcacauuaauggcaauggauuuaggagaacuaugugaagauacuauuacguauaauuguccauuacuaagacaaaaugaaccagaagacaucgauuguuggugcaauuccacgucaacgugggucacuuacgggacaugcacugcgacuggcgaacaccgccgagagaaaagaucaguagcgcuuguaccgcaugugggaaugggacuagaaacaagaacagaaacauggaugagcagugaaggcgcuuggaaacacgcacaacggauagaaacauggguacuacgacauccugguuucacaauaauggcugcuauauuagccuacacuauugggaccacguauuuucagaggguuuugauauuuaucuuauuaacugcuguggccccgucaaugacgaugagguguauaggaauuagcaacagagauuuugucgaaggugucucuggcgguucauggguagacauaguguuggagcacggcagcugugugacuacaauggccaaaaacaaacccaccuuagauuuugagcuaauaaaaacagaagcaaaacaucccgcuacuuuaaggaaauacuguauagaagccaaauuaacaaacacaaccacggcaucaaggugcccuacacagggggaaccaucauugaaugaagaacaagauaaacgauuuguaugcaaacauaguauggucgacagaggaugggguaacggcuguggcuuauucgggaaaggaggaauuguuacuugugcaauguuuacauguaagaaaaacauggagggaaaaauagugcaaccugaaaaucuugaguauacuauugucauaacgccgcacaguggggaggaaaacgccguuggcaaugauacagggaaacauggaaaagaaauuaaagucacuccccaaaguucaauuacagaggcugaacuuacaggguacgguacugucacuauggaauguucgccgagaaccggacuagacuucaacgaaauggugcuuuuacaaauggaaaacaaagccugguuaguucaucgccaaugguuucuggauuugccacuaccaugguuaccgggcgcugacacucagggcaguaacuggauccaaaaagaaacauuaguaacauucaaaaauccccaugcuaagaaacaagacguugugguacuagguagccaagagggagcgaugcacacggcauugacgggagcuacggagauacaaaugucuagcggaaaccuauuauuuacaggacacuuaaagugcagacuucggauggacaaacuacagcuaaaggguauguccuacucaauguguacagguaaauucaaaguaguuaaagaaauagcagagacccaacaugguacuauaguaauucggguacaauaugaaggagacgguucuccguguaaaauuccuuucgaaaucauggaccuggaaaagagacaugucuuaggucgauuaauaacggugaacccgauuguuacugaaaaagauucgcccguaaauauagaggcagaaccaccuuuuggagauaguuauaucaucauugggguagagccaggucaacucaaacuuucaugguuuaagaaaggaaguucuaucggccagauguuugaaacaaccaugcgaggagcgaaaagaauggcaauucugggagauacagcgugggauuuugggagcuuaggcggcgucuucacauccauaggaaaagcacuacaccaagucuuuggcgcgauuuauggagcagcguuuucaggagucucauggacaaugaagauauuaauaggaguagugauuaccuggaucgguaugaacucgaggaguacgucauugaguguuaguuuaguucuaguaggaguagugacacuauaccuuggggugauggugcaagcggacuccggauguguuguaucauggaagaauaaggaauugaaaugugggucagggauauucauuaccgauaauguucacacuuggacugagcaauauaaauuucagccagagucaccaucaaaguuagcaucugcaauccaaaaagcacaugaggaaggcauuugcggaauccgaaguguuacucgucuagaaaauuugauguggaagcaaaucacuccugaauuaaaucauauacuaucagaaaaugaagugaaguuaacaauaaugacaggagauauuaaaggaauaaugcaagcaggaaaacgaucgcuaagaccucaaccuacagaacucaaauauaguuggaaaacauggggcaaagcaaagaugcucagcaccgaacuccacaaccacacguucuuaauugaugggccugaaacagcugaaugcccaaauacgaauagagcuuggaauaguuuagagguagaagauuacgguuuuggaguguucacaacgaauauuugguugaaauuaaaagagagacaagacguauuuugcgacagcaaauuaauguccgcggcaauaaaggacaauagggcaguucaugcugacaugggcuauuggauugaaagugcucucaacgauacuuggaaaauugagaaggccagcuuuauagaagugaaaaguugucauuggccaaaaucacauacauuauggagcaauggcgucuuagaaagugaaaugauuaucccuaaaaauuuugcgggcccuguaucccaacacaauuaucgcccugguuaccauacacagacugccggcccuuggcacuuaggccgacuagaaauggauuucgauuucugcgaagguacaacgguuguugugacugaagauugcgguaauagaggaccuucuuuaagaacaacaacagccucugguaaguuaauuacagaauggugcuguagaucauguacacuucccccauuacgguaccgaggugaagacgguugcugguaugggauggaaauccgcccucuuaaagaaaaagaagaaaauuuggugaacucguuaguuacggccggucauggucaaauugauaacuuuucguuaggaguauuaggcauggcucuauuccuagaagaaauguuacguacuagagucgguacuaaacacgcaauacucuuaguugcagucagcuuugugacauuaauuaccggaaacauguccuuucgagaucuuggaagaguaaugguaauggucggggcagcuaugaccgaugauauuggcaugggcguaacuuacuuagcccugcucgcagcuuuuaaaguuagacccaccuuugcugcagguuuguugcuaaggaaguuaaccucgaaagaauuaaugaugacaacaauaggaauuguacuacuuucacaguccacuaugcccgaaacaauuuuagaguuaacugacgcccuggcauuaggaaugaugguuuuaaaaauaguuagaaauauggagaaguaucaacuugccgucacaauaauggccauucuguguguuccgaacgcgguuauccuacaaaaugcauggaaaguuucaugcacaacuuuagcgguaguuagcgugagcccguuguuacuuaccuccucacagcaaaaagcugacuggauaccauuggcccuuacaauuaagggauuaaauccaaccgcuauauuuuugacgacucuaaguagaacaaguaagaagcgcaguuggccuuuaaaugaggcgauuauggcuguggggauggucagcauccucgcuuccucacuccuuaaaaaugauauacccaugacaggaccgcuuguggcgggaggacuguuaacuguaugcuauguacucacaggucgaucagcugaucuagaacuagaaagagcugcagauguucguugggaagaacaagcggaaaucagugguaguucucccauacuuucaauaacaauuagugaagacggauccaugaguauaaagaacgaagaagaagaacagacuuuaacaauauugauacguacuggauuguuaguaauuucuggacuauuuccugugucuaucccgauaacagccgcggcaugguaucucugggaaguuaaaaagcaaagagcgggagugcuaugggacguuccaaguccuccaccuguagguaaagcugagcuugaagauggagcauacagaauaaaacaaaagggcauucuagguuacagucaaauaggugccgguguguacaaagaagggacauuucacacaauguggcacguuacaagaggugcaguacugaugcacaaaggaaaacggauugaaccaagcugggcagacguaaagaaagaccuuauaaguuauggggguggauggaaauuagaaggcgaguggaaggaaggugaagaaguccaaguacucgcgcuagaacccggcaagaauccgagggcuguucaaacuaagccaggauuguuuaaaacaaacaccgguacaauaggggcaguaucacuugauuuuaguccaggaacaagugguuccccgauaguggauaagaaaggaaaaguuguaggacucuauggaaauggcguaguuacccguuccgguacuuacguaucggcgauagcgcaaaccgaaaagucgauagaagauaacccagaaauugaggacgacauuuuucgaaagaaaagacugacuaucauggaccuacacccuggagcuggaaagacaaaaagauacuugccugcuauuguacgugaagcgaucaagcgugggcuccgaacguuaauucuagcaccaacaagggucguugccgcugaaauggaagaagcguugaggggauuacccauucgcuaccaaacuccugcgauacgagcggaacauacagggagagaaauuguagaucucaugugccacgcaacauucacuaugagauuauugaguccuauaagaguucccaauuacaaccuuauaaucauggacgaggcucauuucacggaucccgccucgauagcagcuagggguuacaucaguacucgggucgagaugggugaagcagccggaaucuucaugacugcuacaccucccggaucuagagacccauucccgcaauccaaugcaccaauaauggaugaggaacgagagauaccugaacgaaguuggaacucuggucacgaauggguuaccgauuuuaaaggcaagacgguaugguucguuccuuccauaaaagcagggaaugauauugcugccugucucaggaaaaaugguaagaaaguuauucaauugucccguaaaacuuuugauucagaguauaucaagacuaggacaaaugacugggauuuuguuguaacuacugauaucagugagaugggagcaaacuuuaaagcugaaagaguaaucgacccacgacggugcaugaaaccaguaauucuaaccgauggagaagaaagggugaucuuagcagggccaaugccagucacacacucguccgcagcccagagacgcggcagagugggaagaaauccuaaaaaugaaaaugaucaguacauauauaugggcgaaccacuggagaacgacgaagauugcgcacauuggaaagaagcgaaaauguuauuagauaauauaucaaccccugaggguauuauuccuucaauguuugaaccagaacgagagaaaguagaugccaucgacggcgaauaccgucuccgcggugaagcgaggaaaacauuuguggacuuaaugagaagaggcgacuuaccuguuugguuagcauauagggucgccgcugaaggaauuaauuacgcugaucgacgauggugcuuugacggaguaaagaauaaucaaaucuuagaagaaaauguagaggucgaaauauggaccaaagagggugaaagaaagaaacuuaagccaagaugguuagaugcuagaaucuauucugacccacuugcccuaaaagaguucaaagaauuugccgcuggaagaaaaagucugacgcucaacuuaauaacugagaugggucgacuacccacuuucaugacacaaaaagccagaaaugcccuugauaaucuggcaguucuccacacagcggaggcaggaggacgagccuacaaccaugccuugagugagcugccagagacauuagaaacauuauuauuauuaacgcuccuugcugcugucacgggcggaaucuuccuauuccuaaugagcggcaaagggauagggaaaaugacccuaggaauguguugcauaauaacagcuucaauauugcuuugguaugcucaaauacagccacacuggauugcagcaucuaucauucuagaauuuuuccuuaucguacuauuaauaccggagccagagaaacagaggacaccacaagauaaucaacuuacauauguagugaucgcgauacugacuguuguagcugcgacaauggcaaacgagaugggauuuuuagaaaagacaaagaaagauuuuggcuugggaagcacuaccacucaacagccagagucaaauauccuggauauugaucugagaccagcaagugcauggacauuauaugccguagcaacaaccuuuauuacaccaaugcuaagacauaguaucgaaaacaguucgguaaacgucagccugacagccaucgcaaaccaggcaacaguacucaugggacuaggaaaaggauggccuuuaagcaaaauggacaucgguguaccacuauuagcgauuggaugcuauagucaaguaaauccuauaacacuaaccgcugcgcuuuuacuccuaguugcccauuaugcuauaauugggccuggccuacaagcaaaggcaacaagagaagcucagaaaagagccgcagccgguauuaugaagaauccaaccguggaugguauuacuguaaucgaccuagacccuauacccuaugacccuaaauuugaaaagcaacugggucagguaauguuauuaguauugugcguaacacaagucuuaaugaugcgaacaacaugggcacuaugugaagcgcuaacauuagcaacggggccgauauccacauuaugggaaggcaaccccggacgguuuuggaacacaacgauugcugucucuauggcaaacaucuuccgugggaguuauuuagcaggcgccggauuguuauucucaauaaugaagaacacagcgaauaccagacguggaacaggcaacacaggcgagacauuaggagaaaaauggaaaaauagauuaaacgcccuaggaaaaagugaguuccaaauauacaagaaaagcgguauucaagaaguagauagaacgcuggccaaggagggaauaaagaggggagaaacagaccaucacgcaguaucuagagggagcgcuaaguuacgcugguucguagaacgaaaccuugugacaccugaaggaaaagucgucgauuuagguugugguagaggagguugguccuauuacugcgguggacugaaaaauguaaaggaaguuaaaggacuaaccaaaggcggaccagggcaugaagaaccaauaccaaugagcacauacgguuggaacuuaguacgauuacaaaguggaguagacguguucuuuacaccgccugagaaaugcgauacauugcugugugauauaggagaaaguucgccaaacccgacaguagaagcaggacgcacccuccgagucuuaaacuuagucgaaaacugguuaaacaacaauacucaauucugcauaaaaguauugaaucccuauaugccaucugucauagagaagauggaggcgcuucagagaaaauacggaggagcauuggucagaaacccuuuaaguagaaacucaacucacgaaauguacuggguaaguaaugcgucuggaaauaucguaucaucggucaauaugauauccagaaugcucauaaaccgguuuaccaugagacauaagaaagcuacuuacgagccagaugucgauuuaggaucgggcacaagaaauauuggcauagaaagugagacuccgaaucucgauaucauugguaaaagaauugagaaaauuaaacaagaacaugaaacaagcuggcacuacgaccaggaccauccuuauaagacaugggcauaucauggaaguuaugagacgaagcaaacaggaagugcaucuucaauggucaauggagucguaagacuuuugacuaagccgugggaugugauucccauggucacccaaauggcuaugacagauacaacacccuuuggacaacaaagaguauuuaaagaaaaaguggacacccgaacacaagaaccuaaagagggcaccaagaaacuaaugaaaauuacggcagaauggcuuuggaaagaguuagggaaaaagaagacuccccgaauguguacucgugaagaguuuacucguaaaguacgauccaaugcagcauuaggggcaauauucacagaugagaauaaauggaaauccgcgagagaagcggucgaagauucaggguuuugggagcuuguagauaaagagagaaacuuacaucucgaagggaagugugaaacaugcguauauaauaugaugggcaaacgcgagaagaaacucggagaguucggaaaggcuaaaggaucaagagcaauaugguacaugugguugggagcacgguuccuugaauuugaagcucuuggauuuuuaaaugaggaucauugguuuucgagagagaacagucugucaggaguagaaggagaagguuuacacaaauuaggcuacauuuuacgggaugucaguaaaaaggaagggggugcuauguacgcagaugauacagcggguugggauacuaggauaacucuugaagaccuuaagaacgaagaaaugguaacuaaccauauggaaggagaacauaaaaaguuggcagaagcaauauucaaacuuacauaucagaacaaagucguaagaguacagaggccaacaccgcguggaacugucauggauauaaucucucgacgagaucaaaggggaucaggccaggucguaacuuauggcuuaaauacuuucacuaauauggaagcacaacugauaaggcaaauggaaggagaaggaguauucaaaaguauacaacaacuaacuguuacagaagaaauugccgucaaaaacugguuaguaagaguuggacgugaaaggcuuucucgaauggccauuucuggggaugacugcguaguaaaaccucuugaugaccgauuugcuagugcacugaccgcacugaacgauauggggaaaguacguaaggacauccagcaaugggagccaucaagaggauggaaugauuggacccaaguaccauucuguucacaucacuuucacgaauuaaucaugaaagacgguagaguucuuguaguaccuugucguaaucaagacgaacuaauagguagagcuaggauaagccagggugccggauggucgcuaagagaaacagcauguuuaggcaaaaguuacgcacaaauguggaaucuaauguacuuccauaggcgcgaucuacggcuugcugcgaacgcaauauguucugccguuccuagccacuggguaccaacaucacguacaacuugguccauacacgccacucaugaguggaugacaacagaagauaugcuaacagucuggaauagaguuuggauacaagagaacccauggauggaggacaaaacuccaguagaauccugggaagaaauuccauaccuagguaagagagaagaucaaugguguggcagccucauaggacucacaucaagagccacuugggcaaagaauauccagaccgcuauuaaucagguuagaagccuaauagguaaugaggaauacacagacuacaugccaagcaugaaacguuuuagaagagaggaagaagaggccggaguacuaugguga

SEQ ID NO: 22796 - RNA, 9876 nt, Artificial Sequence
  derived and/or modified CDS sequence (opt6) from DENV-2__KP723478__SS-prME
acagcaggcaucauaaucaugaugaucccgacaguaauggcuuuucacuuaaccacccgaaauggcgaaccucacaugauugucucccgacaagaaaaggguaaaucacuucuauuuaagacugaaaaugguguaaacaugugcacauuaauggcgauggauuugggagaguuaugcgaagacacuauaacguauaauugcccauuacuacgucaaaaugaacccgaagauauugauuguuggugcaauucuaccagcacaugggugacuuauggaacuugcacugcgacaggugagcaucgacgugagaaaagaaguguggcuuugguuccacauguaggaaugggguuggaaacaagaacggagacuuggaugucgagcgaaggugcauggaagcacgcccaacgcauagagacuuggguuuuaagacauccgggcuuuacuaucauggcagccauacuugccuauacaauaggaaccacauauuuucaaagaguauuaauuuucauucuacuaacagcaguggcaccaaguaugacaaugcguugcauagguaucagcaauagggacuuuguugaagguguuucugguggcucauggguagacauuguccuugaacacggaucuugugugacaacaauggcgaaaaauaagccuacacuugacuucgaacugauuaaaaccgaagcaaagcacccagcgacuuugcguaaguacuguauagaggccaaauuaaccaauacaacaacugccucucgauguccaacgcaaggcgaaccaucccucaaugaagaacaagacaaaagguucgucugcaaacauaguaugguugauagaggauggggaaaugguugugguuuauuugguaaaggaggaaucguaacaugugcaauguuuacaugcaagaaaaacauggaaggaaaaauagugcaaccugagaacuuggaauauacaauagugauaaccccucacaguggcgaagaaaacgcgguaggcaacgacacgggaaaacaugguaaagagaucaagguaacgccacaaucgucaauaacagaagcagaauuaaccggauacggaacgguaacuauggaauguuccccucguacuggucuagauuucaacgagaugguccucuuacagauggagaauaaagcauggcuuguacauagacagugguuuuuagaucugcccuugccaugguuacccggagcugauacucaggguucgaacuggauucaaaaagaaacucugguaacguucaaaaacccacaugccaaaaagcaagauguagucguguuaggcucgcaagaaggagcuaugcauacagcacugacaggcgcuacagaaauccaaaugaguaguggcaaccuucuuuuuacaggacaucuuaaauguagguugcgaauggauaagcuucaacuuaagggaaugucauauucuaugugcacagguaaauuuaaagugguaaaggagauugcagaaacucagcacggaacgauaguaauuagagugcaauaugaaggggauggaucuccaugcaaaauccccuucgaaauaauggauuuagaaaaacgacacguacucgguagauuaaucacuguuaacccaauagucacagaaaaagauuccccagugaauauagaagcagagccuccauuuggugauucguauauaaucauuggaguugaaccaggucaguuaaaauuaagcugguuuaaaaaaggauccagcaucggacaaauguuugagacuacuaugcgcggugcaaagagaauggcgauccucggugauacggccugggauuucggcaguuuaggcggcguguuuacaucuaucgggaaagcuuuacaccaaguauucggggcaauauacggggcagcuuucaguggaguaaguuggacaaugaaaauauugauaggaguaguuauuacuuggauuggaaugaauaguagaucaaccagccucucgguaagucuaguguuaguaggaguaguaacuuuauauuuagguguaauggugcaagcugacaguggauguguaguuucauggaagaacaaagaauuaaaaugugguucaggaaucuuuauaacugacaauguucauacauggacggaacaauauaaauuucaaccagagaguccuucuaaacucgccucugccauacagaaagcacaugaggaggggauaugugggauaagaaguguaacucgguuggaaaaccuuauguggaaacaaauaacuccagaacuaaaucauauucuuagugagaaugaggugaaacuaacaauaaugacuggugacaucaaaggaaucaugcaggcuggaaaaagaaguuuaagaccccaaccaacugaguuaaaauauaguuggaaaacaugggguaaagcaaaaaugcuuucaaccgaacuucacaaccacaccuuucucauugacgguccagaaaccgcagaguguccuaauacuaaucgagcuuggaauucccuugaagucgaagacuaugguuuugggguauucacaacaaacauaugguugaaguuaaaggagaggcaagauguguucugugauucuaaacugaugagugcagcaauaaaagauaauagagcuguccaugcagacaugggauauuggaucgagucagcacuaaaugauaccuggaagaucgaaaaagcaucauucauugaaguuaaaucuugucacuggccaaagucacacacauuauggucgaacgguguacuggaaagcgaaaugauuauaccuaaaaauuucgccggaccaaugucgcaacauaacuauaggccuggauaucauacacaaacugcaggucccuggcaucuuggacgauuagaaauggauuuugacuuuugcgaagguacaacaguagugguaaccgaagauugcgguaaucguggaccgucacuuagaacaacaacugcuuccggaaaauugauuacagagugguguuguagaaguugcacguuaccgcccuuacgauacagaggagaagauggguguugguacgguauggagauucgaccacugaaagagaaagaagaaaaucuggucaauucacucguaacagccggccauggacaaauagauaauuucagcuuagguguguuagguauggcguuguucuuagaagaaaugcuuagaaccagaguugguaccaaacacgcaauacuacuaguagcaguuaguuuuguuacacuaauaacggguaacaugaguuuuagagaucugggacgcgugaugguaaugguaggagcggccaugacagaugauaucggcaugggagugacguauuuagcacuacucgcagcauuuaaaguacgaccgaccuucgcggccggacuauuauuaagaaaacuaacuaguaaggaacuuaugaugacuacgauaggcauaguguuauuaucccaaaguacgaugccggagacgauuuuagaguuaacagacgcucucgcuuuagggaugaugguccuaaagauagucaggaacauggaaaaauaccaacucgcagugacaauaauggccauacuaugcgucccaaaugcugugauucuacagaacgcuuggaaggugaguuguaccacguuagcuguuguaucuguuucgccuuuacugcuaacaucaucccaacaaaaagcagauuggauuccucuugcacucacuaucaagggauugaacccaaccgcaauuuuuuugacaacucuguccaggacuucuaagaaaagaucuuggccauugaaugaagcuauaauggcaguaggcaugguaucgauucuggccuccucauugcuuaaaaacgacauacccaugacggggccccuaguagcgggaggacuauuaacuguaugcuacguauugacuggccguagugcugauuuagaguuggaacgugcagccgauguacgaugggaagaacaagcagagauuucaggcucuucuccuauuuugucgauaaccauaucggaagaugggucaaugucaauaaaaaaugaggaagaagaacaaacucuaacuauucuaauaaggacuggauugcuggugauaucaggacucuucccuguuucaacuccuauaacagcagcagcuugguaccuuugggaaguaaagaaacaacgggccggggucuuaugggacgugcccucgccaccgccaguugguaaagcggaguuggaagauggugcauaucgcaucaaacagaaaggaauauuaggguauucacaaauuggcgcaggaguuuauaaagaaggcacuuuucauacuauguggcauguaacucgaggugcagugcuaaugcauaaggguaagagaauugaacccagcugggcugauguaaaaaaggaucuuaucucauacggagggggcuggaaacuagagggagaauggaaagagggagaggaaguucaagucuuagcuuuagaacccgguaagaacccacgagcuguacaaacgaaaccagggcuuuucaagaccaauacuggaaccauuggggcagugucacucgacuucucuccgggcacaucgggaucgccgauaguggacaaaaaaggaaaaguagucgggcuauacggaaauggagugguuacgagauccgggacauauguuucugcaauugcucaaacagagaaaucgaucgaagauaaccccgaaauugaagaugauauuuuucguaaaaaacgauuaacuauuauggauuugcacccuggagcaggcaagacaaaacgauauuuaccagccaucguuagagaagcuauaaaaaggggauugcguacauugauacuagcacccacgagagucguagcagcggagauggaagaggcacuuagagggcuaccuauccgguaccagaccccagcuauacgagcagaacauacagguagggagauaguagauuugaugugucaugccacauuuacaaugagacuucuauccccaaucagaguaccuaauuacaaucuaaucauaauggaugaagcacauuuuacugaccccgcuucuaucgccgcgcgagguuacauaucuacuagaguagaaaugggcgaagcagcggggaucuucaugacugcaaccccucccgggucaagagaucccuuuccgcagucuaaugcaccaauuauggaugaggaaagagaaaucccugaaaggagcuggaacuccgggcaugaauggguaacugacuucaaagguaagacaguuugguucguaccuucaauaaaagcugggaacgacauagcugcauguuugcgaaaaaacggaaaaaaggugauacaauuaucucgaaagacuuucgauucagaauauauuaagacgcgaaccaacgauugggacuuuguugucacuacugacauuagcgaaaugggggcaaauuuuaaagcagagcgaguaauugacccacgacgauguaugaaaccggugauacuuacggauggugaggaaagggugauuuuagccgggccaaugccgguuacucauaguucggcggcacaaagaagggggagagucggcagaaauccaaagaaugaaaacgaccaauacauauacaugggagaaccgcuagagaacgaugaagacugugcgcauuggaaggaggcaaaaaugcuauuagacaauauaucaacuccagaagguauaaucccaagcauguucgagccagaaagagaaaagguggaugcuauagauggcgaauauagacugcgaggugaagcgcguaaaacguuuguagaucuaaugagacguggagaccugccaguguggcuagccuauaggguagcugcagaaggcauuaacuacgcggaucggagguggugcuuugacggcgugaagaauaaucaaauauuagaggaaaauguagaaguggaaauauggacgaaggaaggagagagaaaaaagcuaaaaccucgaugguuagaugcaaggaucuauucggacccguuagccuuaaaagaguuuaaggaguuugcagcuggaagaaaaucuuugacacugaauuugauaacagaaauggggcgacugccgacuuucaugacacagaaagcgcggaaugcuuuggacaacuuagccgugcuucauacagcagaggccggagguagggcauacaaucaugcguugucugaauugcccgaaacucuagaaacuuuauugcuauuaacacuucuagcagcggucaccggagggauuuuucuauuucucauguccgguaagggaaucgggaagaugacauugggcauguguugcauaaucacggcaaguauuuuacuaugguacgcacagauacaaccacauuggauugcugcaucuauuauauuagaauuuuuucuaaucguucuacuuauuccugaaccggaaaaacaaagaaccccucaggacaaccaauugacuuauguuguaauagcaauuuugaccguagucgcagcaaccauggcuaaugaaauggguuuccuagaaaaaacuaagaaagauuuuggucuuggauccacuacgacacaacaaccugaaaguaauauucuagauauugaucuacguccugccucggcguggaccuuauaugcaguagcaacuacauucaucacuccaaugcugcgccauucuauagaaaauucuagcguaaacguuucacucacggcuauugcgaaccaagcgaccguacucaugggauugggaaaagguuggccccuuaguaaaauggauauuggcgucccuuuacuagcaauaggcuguuauucccaaguaaacccuauuacacuuacagcagcccugcuauuauuggucgcgcauuaugcaaucauaggaccuggauugcaagcuaaagcgacacgagaagcucagaagcgugccgcagcugggauaaugaaaaauccaacaguagacgguauuacuguaauugaucuugacccaauaccauaugauccgaaauucgagaaacaacuugggcaaguaaugcuacugguguuauguguaacccaaguucucaugaugagaacuacuugggcucuuugugaagcauuaacacuagcaacaggcccuauaagcacccuaugggaaggaaauccagguagauuuuggaauacaacaauugccguaucgauggcaaacauuuuucgaggaaguuaucuagcgggagcuggacuguuauuuucuauaaugaagaacaccgcaaauacaagaagggguacugggaacacaggugaaacccugggagaaaaauggaaaaaucgacuaaacgcccugggaaagucugaauuccagaucuauaaaaagucuggaauccaagaagucgauagaacccucgcaaaggaagguauaaaaagaggagaaacagaccaucaugcaguauccaggggguccgcaaaacuucggugguucguugaaagaaauuugguaacuccagaaggaaaaguaguagaccuaggauguggacggggaggcuggagcuauuacugugggggauuaaaaaauguaaaggaaguaaaaggacuaacgaaaggaggaccaggccacgaagaaccaaucccaaugucaacguauggcuggaauuuaguccguuugcaaagugguguugauguguucuucaccccacccgaaaaaugcgauacacuuuuaugugauauaggugaaagcucuccuaauccuacgguagaagcugguagaacucuacguguacuuaaucuuguggaaaacuggcuaaauaauaacacucaauucuguauaaaaguacuaaaccccuauaugccuagcguaaucgaaaagauggaagcucuacaaagaaaauacgggggugccuuaguacgcaacccuuuaaguagaaacucgacacacgaaauguauuggguuaguaaugcgaguggaaauaucgugucuucuguaaauaugauaucucgaaugcugauaaaucguuuuacaaugcgccacaagaaagcuacguaugaaccugauguugaccugggaucgggaacucgaaauauagggauugagucagagacaccaaaucuugauauuauaggaaaaagaauugaaaaaauuaaacaggagcacgaaacaucauggcauuaugaucaagaccauccguauaaaacuugggcuuaucauggaucauaugaaacaaaacaaaccggaucggcgucuucaauggucaacggaguaguuagguuguuaacaaaaccuugggacgugauuccaauggucacucaaauggcgaugaccgauacaacaccauucggucagcaaaggguauuuaaggaaaaaguagauacgagaacacaggaaccaaaagaagggaccaagaagcuuaugaaaauaacggcagaauggcuguggaaagaacuugguaagaaaaaaacuccacggaugugcacuagagaagaauucacgagaaaaguccguuccaacgcugcacuaggagcaauuuucacugacgaaaacaaauggaaaucagcgagagaagcaguagaagauucgggauuuugggaauuaguggauaaggaaagaaacuugcacuuagaagguaaaugcgaaacgugugucuacaauaugauggggaaacgagaaaaaaaauuaggcgaguuuggaaaggcuaaaggcagcagagcaaucugguauauguggcuuggggcgagauuucuugaguucgaggcccuagguuuccugaacgaagaccauugguuuucacgugaaaacagccugucgggcguagagggggaggguuuacacaaauuggguuauauauuacgggauguaucaaaaaaagaaggaggugcaauguaugcagaugacaccgcuggaugggacacacguauuacacuggaagauuuaaaaaacgaggaaaugguuacuaaccacauggaaggggaacauaagaaauuagcagaagcuauauucaaacuaacuuaucaaaauaaaguaguaagaguacaaagaccgacaccgagagggacaguaauggacauaaucucaagacgagaccaacgaggaucaggccagguagugaccuauggucuaaacacguuuacuaauauggaggcacaguugauaagacaaauggaaggugaaggaguguucaagucgauacagcaauuaacuguaacagaagaaauugcugucaagaauugguuaguuaggguagggagggaaagauugucccgaauggccauaucaggagaugauuguguugucaaaccauuagacgaccgauuugcuucugccuugaccgccuuaaacgacaugggcaaaguacguaaagacauucaacaaugggaaccaucgaggggauggaacgacuggacucaaguaccauucuguucucaucauuuucacgaacuuauuaugaaagauggaagaguacucguugucccaugcaggaaucaagacgaacucaucgguagagcacgaaucucccaaggagcaggguggagcuuaagggagacugcaugucugggcaaaucuuacgcacagauguggaacuuaauguacuuccaccguagggaccugcgucucgcggccaaugcaauauguuccgcagugccaucgcacugggugccgacaaguagaacaacuuggucaauacaugcaacccaugaguggaugaccacugaagacauguuaacaguauggaaccgaguuuggauucaagagaacccuuggauggaagauaaaacucccgucgaaaguugggaagaaauuccauaucugggaaaaagggaagaccaaugguguggcagccuuauaggacuaacaagcagagccacuugggcaaaaaauauucaaacggcgauuaaucaaguuaggagccuuauaggaaaugaagaguacacagacuauaugccuaguaugaaacgauuuagaagggaagaagaggaggcaggcguucucugguaa

SEQ ID NO: 22797 - RNA, 9876 nt, Artificial Sequence
  derived and/or modified CDS sequence (opt6) from DENV-2__KP723479__SS-prME
acugcagguauaauuauuaugaugauuccgacaguaauggcauuccacuuaacaacacgaaauggagaaccgcacaugauuguauccagacaagaaaaaggaaaaucauuacuauucaaaacugaaaaugguguuaauaugugcaccuugauggcgauggacuuaggagaacuuugugaagacaccaucacguauaauuguccauuacuaaggcagaacgaaccggaagauaucgauuguugguguaauucaacuuccacaugggugacauaugguacaugcacagcgacaggcgaacaucgucgugagaaaagaucuguugcucuaguaccacacguagguaugggauuggaaacgagaaccgaaacauggaugucgagugaaggcgcauggaaacaugcgcaacgaauugaaacguggguacuaagacauccaggcuuuacaauaauggcagcaauccuugcauauacuauugguacgacuuauuuccaacguguuuugauauuuauucuauuaacagcagucgcaccauccaugacuaugagauguauugggauaagcaaccgagauuuuguggaaggaguaucaggagguaguuggguugacauagucuuagaacauggcaguuguguaaccacaauggcuaaaaauaaaccaaccuuagauuucgaauuaauaaaaacugaagcgaaacauccagcaacuuuacggaaauauugcauagaagcgaaacuuacaaauacaacaaccgcaucaagauguccuacccaaggggaaccauccuugaacgaagaacaggacaaacgauuuguuuguaaacauaguaugguugauagagguugggguaacggauguggucuauucgggaaaggaggaauaguuacgugugcgauguucacauguaagaaaaauauggaagggaaaauagugcaaccugaaaaucuugaauauaccaucgugauaaccccucauucuggagaagaaaacgcaguuggaaaugacaccgguaaacauggcaaagaaauaaaaguaacaccgcaaagcucaauaaccgaagccgaacucacaggguacggcacagucacgauggaauguucuccgaggacuggacuagauuuuaaugaaauggucuuauuacaaauggagaacaaagcauggcuaguacaccgacaaugguuccuggauuuaccguuaccgugguuaccgggcgccgauacacaaggaucuaacuggauacaaaaagaaacccuagugacauuuaaaaauccucaugcuaagaaacaagauguaguaguucuagggagucaggagggagcgaugcacacggcucuaacaggagcaacggaaauacaaaugucauccgguaacuuacuuuuuacugggcaccuaaaaugccgucuaagaauggacaaauuacaauugaaaggaaugucuuauucaauguguacuggaaaauucaaaguaguuaaagagauugccgaaacacaacacggcacaauagucauuagaguucaauaugaaggcgacggaucgccaugcaaaauuccauucgaaauaauggaccuagaaaagagacauguacucggaagguugauaacgguaaaucccauugugacugaaaaagauucaccaguuaacauugaagcagagccacccuuuggagacucauacauuauaauagggguagaaccaggucaacugaaacucuccugguuuaagaaaggaaguucaauaggacagauguuugaaacuacaaugagaggggcgaagaggauggcaauacuaggagacacagcuugggacuuugguagucugggaggaguauuuacgucaauuggaaaagcauugcaccagguauucggugcgauuuacggugcagcuuuuucaggcguuucauggacuaugaaaauuuuaauaggaguagugauuacuuggauaggaaugaauagccgaaguacgucauugagcguaagucugguauuaguaggagugguaacacuauacuuaggagucauggugcaagccgauucuggaugcgugguaaguuggaaaaauaaagaauugaaaugugguagugggauauucauuacugacaacguucauacauggacugaacaauauaaguuucaaccugaaucuccuucuaaacuugcgucugccauucaaaaggcucaugaagaaggaaucugcgguauacgaucaguaacacgacuagaaaacuuaauguggaaacaaauaacgccugaacuuaaucauauucucucagaaaaugagguaaaauuaaccauaaugacaggggacauuaaaggcauuaugcaagccggaaaaaggucucuacgcccacaaccaaccgaauugaaauauucauggaaagccuggggcaaagcaaaaaugcuuagcacggaguuacauaaucacacguuccuaauagacggaccugaaacagcggaauguccaaacaccaacagagccuggaacuccuuggaaguggaagauuauggcuuuggugucuucacaacuaauauauggcuuaagaugaaagaaagacaagauguguuuugugauucaaagcucaugagugcagcaaucaaagacucgagagcuguucacgcggauaugggauacuggauugaaagugcauugaaugauaccuggaaaauugagaaggcuucuuucauugaaguuaaaaguugccauuggccuaaaagucauaccuuauggagcaauggcguacuagaaucagaaaugauaauucccaaaaauuucgcuggaccggucucccaacauaauuaccgaccugguuaucauacacaaacggcuggaccuuggcaucucggaagauuagagauggauuucgauuuuugugaaggaaccacagugguaguaacagaagacugugguaacagagguccgucacuaagaacaacaacagcuuccgguaaauugauaacagaauggugcugcagaucuuguacgcugccaccauuaagauacagaggagaagauggaugcugguaugguauggaaauaaggccguugaaagaaaaagaagaaaaccuuguaaacucacuugugacagcgggacaugggcagauugauaauuuuagucuugggguuuuggguauggcucuauuccucgaggaaauguugagaacuagaguaggaaccaagcacgcgauauuauuaguugcaguaucauuuguuacccuaauuaccggaaacauguccuuucgugauuugggcagaguaauggugaugguaggagcuacuaugacagaugacauagguauggguguaaccuauuuggcacuacuagcugcuuuuaaagugcguccaacauuugcagcaggucugcuacuucgaaaguugacaucaaaagagcuaaugaugaccaccaucgggauuguacucuuaucucaggccaccauccccgaaacaauacuugaacugacugaugcauuagcauuagggaugaugguguuaaagauagugagaaauauggagaaauaccaauuagcuguaacaauaauggcgauacuaugcguaccuaaugcaguaauucuccaaaacgcauggaagguguccuguaccacacucgcggucgugagcguguccccucuacuauuaaccucaucccaacagaaagcagauuggauuccucuagcauuaacaauuaaagggcuuaauccaacugcuauauuuuuaacaacuuuaagucgaacuaauaagaaacgaucguggccucucaaugaggcaaucauggcaguggguaugguaagcauucuagcgagcucuuuauuaaagaaugauauuccgaugacggguccucuagucgcuggcgggcuauuaacgguaugcuacguacuuaccggccgcucugcugaucuugaacuagaacgagcagcagauguaagaugggaggaacaagcugaaauuagugguucuagcccuauacugucaauuacaauaucggaggacggcucaaugucaaucaaaaaugaagaagaggaacaaacacuaaccaucuugauacgaacaggucuguuaguagucaguggcuuauuuccaguaucgacaccgauaaccgcagccgcaugguaccuaugggaagucaagaaacagcgagccggcguauuaugggacgugccaaguccuccaccaguuggaaaagccgaauuggaggacggagcguacagaaucaagcaaaaaggcauacuagguuacucucaaauaggugcaggagucuacaaagaaggcacguuucauacaauguggcacguaacaaggggugcagugcuaaugcauaaggguaaacgcauagaaccuuccugggcagaugugaagaaagauuuaauaucguacgggggugguuggaaacucgaaggagaguggaaggagggagaggaagugcagguucucgcucuagaacccggcaaaaauccaagagcaguacaaacgaaaccgggauuguuuaagacaaauacgggaacuaucggagcaguuaguuuagauuucagcccaggaaccucaggaucuccaauaguggacaagaaaggaaaagucguaggucuauacggaaacggcguagucacuagaagcgguacauauguaucagccauugcucagacagaaaaaucaaucgaagauaauccagaaaucgaagacgauauauuucgaaagaagaggcucacaauaauggaucuacacccaggagcugguaagacuaaaagauaucucccagcgauaguucgagaagcgauaaaacgaggacuaaggacacucauccucgcgccuacaagaguuguggcagcagaaauggaggaagcucuacggggcuugccaauuagauaucaaacuccggccauucgagcggaacacacagguagagaaauuguugaucuuaugugucacgcgacauucacaaugcgacugcuuaguccaauacgcguaccaaauuacaacuuaauaauaauggacgaagcucacuucaccgaucccgcuaguauugcugcacgcggcuauaucaguacucgaguagaaaugggcgaagcagcggguauauuuaugacggcgacucccccuggcucacgagauccauuuccccagucaaaugcucccauuauggacgaagaaagggaaauaccugagaggagcuggaacucuggacacgaguggguuacagauuuuaaaggaaaaacaguaugguuuguuccaaguauuaaggcaggaaaugauauugcugcuugccugaggaaaaaugggaaaaaggucauccagcuuaguagaaaaacauuugacucggaguacauuaaaacaaggaccaaugauugggauuucguaguaacuacugacauauccgaaaugggagcaaauuuuaaagcggaaagaguuaucgauccccgacguuguaugaaaccaguaauauuaacugacggagaggagaggguaauccuugcgggccccaugccuguaacacauaguagugcggcucaaagaagaggacgggugggaagaaacccaaagaaugaaaaugaucaguacauauauaugggagaaccucucgaaaaugacgaagacugcgcacauuggaaggaagcaaagaugcuucuagacaauaucaacaccccugaaggcaucauuccaucuauguuugaaccagagcgugagaaagucgacgcuauugauggugaauaucgauuacggggcgaggcccggaaaacguucguagaucuaaugaggagaggcgaucuaccuguuugguuggccuauagaguggcugcagaggggauaaacuacgcagacagacguugguguuucgacgguguaaagaauaaccaaauuuuagaagaaaacguagagguagaaauuuggacaaaggagggggagagaaagaaauugaaaccgagaugguuagaugcuagaaucuacagugacccucuagcccuuaaagaguucaaagaguucgcagcuggaagaaaaagccugacauuaaaccugauuacagaaaugggucgcuuaccuacauucaugacacaaaaagcucggaacgcacuugacaacuuagcuguuuuacacacggcggaagccggugggcgugccuauaaccacgcguuaagugaauuaccagaaacgcuagaaacauuauuacuacucacauuacuagcuacuguuaccggcggaauauuccuuuucuuaaugucggggaaaggcaucggaaaaaugacauuagguauguguuguauaauuaccgcuucaauacuacuaugguacgcacaaauucaaccgcacuggauugcagcaaguauuaucuuagaguucuuuuuaauagugcuucucaucccugagccugaaaaacaaaggacuccccaagauaaucaacugacauacgugguaauagccauacuuacuguggucgcugccacgauggcgaaugaaaugggauuuuuggagaaaaccaagaaagauuuugggcuagguucuaucacaacccaacagcccgaaaacaauauacuagauaucgauuuacguccagcauccgcauggacguuauacgcaguagcaacaacauucauaacuccgauguugcgacauucgauagaaaauucauccguuaauguuagccuuacugccauugcaaaucaagcaacuguuuuaaugggauuaggaaaaggguggccguugucgaaaauggauauaggagugccuuuauuagcgauaggguguuauucacaaguaaauccaauuacguuaacagcggcccuuuuacucuugguagcacauuaugcgauaauagguccuggucuccaggcaaaagcaacaagggaagcacaaaaacgugcagcagcuggaauaaugaaaaauccgacaguagacgguauaacagucaucgacuuagacccaauuccauaugaccccaaauucgaaaagcaacucggacaaguaaugcuucuuguccuuugcguaacacagguuuugaugaugagaacgacaugggcacuuugugaagcucuaacacuugccaccggaccuauaagcacgcuaugggaaggaaacccugguagauuuuggaacaccacuauugcuguaaguauggccaauauauucagagguagcuaucuagcaggagcgggacuguuauuuucaauaaugaagaauaccgccaauacgagaagagggacagguaacacaggagaaacacuaggggaaaaauggaaaaaccguuuaaacgcacuugguaaaagugaguuccaaaucuacaagaaaaguggaauacaggagguggaccggacuuuagcgaaagaagguauaaagagaggagagacagaucaccaugcuguaagcagggggagugcgaaauuaaggugguuuguagagagaaacuuaguaacaccagaaggaaaagucguugauuugggauguggaagaggagguuggucguacuacugcggaggguuaaagaauguaaaagaggugaagggucuaacgaaaggagggcccggucacgaagaaccuauaccgaugagcacguaugguuggaauuuagugagauuacagagcgggguggauguauuuuucacaccaccagagaagugugacacucuacuaugcgacauuggggaaucaaguccuaaucccacaguagaggcgggaaggacauuaagaguguuaaaucucgucgaaaacuggcuaaacaauaauacccaauuuugcauaaaagugcugaaucccuauaugccuuccguaauagagaaaauggaggcuuuacaacgaaaguacggcggagcauuaguaagaaauccuuuaucacgaaacuccacgcacgaaauguacuggguaaguaaugcaucuggaaauaucguaagcagugucaacaugauaaguaggaugcuuauaaacagauuuacuaugcgacauaagaaagcgacuuacgaaccugauguagaucuugguaguggcacuaggaauauugguaucgaguccgaaacaccaaaucuugauauaauaggaaagcgaaucgaaaagauuaaacaagagcaugagacgucuuggcacuaugaucaagaucacccuuauaagaccugggcauaccaugguagcuaugaaaccaagcaaacgggaagugcuucgaguaugguaaacggggucgugcgcuuauuaacaaaaccgugggauguuauaccaauggucacacaaauggcaaugacagacacuacucccuucggacaacaacgaguauuuaaagaaaaggucgauacuagaacgcaagaaccaaaagaaggcacgaaaaagcucaugaaaauuacagcggaaugguuauggaaagagcugggcaagaagaaaacaccuaggauguguacacgcgaagaguuuaccaggaaaguuaggucaaaugcggcauuaggcgccauauucacagacgaaaauaaauggaaaagugcaagagaggcagucgaggauagcggauucugggaauuaguugauaaagaacgaaauuugcaucuagaagguaaaugcgaaacauguguuuauaauaugauggggaaacgggagaaaaagcucggugaauuuggaaaagcaaaaggaucccgcgccauaugguauauguggcucggggcucgauuuuuagaauuugaagcccucggcuucuuaaacgaagaccauugguuuagucgugaaaauucacuuucaggaguugaaggugaaggccuacacaaacuaggauauauccuacgcgacguuucgaagaaggaaggcggagcgauguacgcugaugauacugcugggugggauacaagaauuaccuuggaagauuugaaaaacgaagaaaugguaacaaaucauauggaaggugaacauaagaaacuagcggaggcgauauucaagcuaacauaucagaacaaaguagucagaguacaaaggccaaccccuagagggacaguaauggauauaauaucuagacgagaccaaagaggauccggacaaguugucacguaugggcuaaacacuuuuacuaacauggaagcgcaguugauacgacaaauggaaggggagggaguguuuaagagcauacaacaauuaacagucacugaagaaauugcagucaaaaacuggcuuguucgugucggucgagaaagguuaucgaggauggcaaucuccggcgacgacuguguaguaaaaccacuggaugaucgguuugcaucagcucucacugcccuuaacgauaugggaaaagugaggaaagauauccaacagugggaaccuaguaggggguggaacgauuggacgcaaguaccauucugcucacaucacuuccaugaguuaauuaugaaagauggacgagugcuggucguaccaugcagaaaucaagaugaacuuaucgggcgugccagaauaucccaaggcgcgggguggucgcuaagagagacagcaugucuagggaaaagcuacgcacaaauguggucgcuuauguacuuucauagaagggauuugagacuugcagcaaacgcaauauguucugcaguaccuucccacuggguaccaacgucgagaacaacauggucaauucacgcaacgcacgaauggaugacaacugaagauauguuaacaguuuggaauagaguguggauacaagagaaccccuggauggaagauaagacaccgguagaauccugggaggagauuccuuaccuagguaaaagagaagaucaguggugcgggagucuaauaggccugaccucaagagccacuugggccaaaaacauccagaccgcaauaaaccaagugcgguccuuaauaggaaacgaagaauacacagauuacaugccaaguaugaagagauuuaggagagaagaggaggaagcuggaguucuuugguaa

SEQ ID NO: 22798 - RNA, 9876 nt, Artificial Sequence
  derived and/or modified CDS sequence (opt6) from DENV-2__KT187554__SS-prME
acagcuggaauaaucauaaugaugauuccgacagugauggcuuuucacuuaacaacuaggaacggagagccgcacaugaucguuagcagacaagaaaaaggaaaaucuuuacuuuuuaagaccgaaaacgggguuaacaugugcacucuuauggcgauggacuuaggagaauuaugcgaagauacaauuacauauaacugcccauuauuaaggcaaaaugagccagaagauauagauuguugguguaacucaacuucaacauggguuacauaugggacauguacugccacuggggaacauagacgagaaaagagaucaguagccuuagugccucauguagguaugggauuagaaacucgaaccgaaacauggaugucuagugaaggugcauggaaacacgcucaacggaucgaaaccuggguacugcgacauccggguuuuaccauuauggcugcaauuuuagccuauacgauaggcacaacauauuuccaacgaguauuaauauucauauugcuaacagcaguugcuccuagcaugacaaugcgauguauaggcauaucaaaucgagauuucguagaaggagugaguggggggucuuggguagacaucguccuagaacacggcagcugcgucaccacaauggcuaaaaauaaacccacccuagacuuugaauuaaucaaaacagaagcaaaacauccagccacccuuaggaaguauuguauagaagcgaagcuaacuaacaccacaacugcaagccguuguccaacucagggcgagccuucucugaaugaagaacaagacaagcgguuugucugcaagcauagcaugguagaccgagguuggggaaacgguuguggguuguuuggcaaaggagguaucgugaccugcgcaauguuuacuuguaaaaagaauauggaaggaaaaauaguucaaccugagaauuuggaauauacaauagugauuacgccccauucuggagaagaaaaugccguugggaaugacacuggaaaacacggcaaggagauuaaagucacuccacaaucuagcauaacugaggcagaauuaacggguuacggaacuguaacaauggaauguucaccacgcacaggauuggacuucaacgaaaugguacuuuugcagauggagaacaaagcauggcuaguccacagacaaugguuucuagaccuaccauuaccguggcuaccuggugcugauacgcagggaucuaacuggauucaaaaagaaacauugguuacauuuaaaaauccacacgccaaaaaacaagacguagucguuuugggaagucaggaaggcgcgaugcauacggcucugaccggugcgacagagauccaaaugaguucagguaaccuucucuuuacuggacauuuaaaauguagacuaagaauggauaaacugcaguuaaaggggaugaguuauucaauguguaccgggaaguuuaaaguagugaaagaaauugcagaaacacaacauggaacuauuguaauuagaguccaauaugagggagaugggucaccuugcaagauacccuuugaaauaauggaucuggaaaaaagacaugugcugggcagacuaauuaccgucaauccuauaguuaccgaaaaggauucaccaguaaacauagaggcagagcccccuuuuggugacaguuacaucauaaucgggguagaaccuggacaguuaaaauuaucaugguuuaaaaagggaucuucaauaggccagauguuugaaacaacaaugagaggugcgaaaagaauggcaauauuaggggacaccgcaugggacuucgggucuuuaggugguguauucacaucgauuggaaaggcguuacaccaagucuuuggcgccauauauggagcagcauuuucuggaguuucuuggacaaugaaaauauuaauaggaguagucauuacauggaucggcaugaauaguagaucaaccucccuaucgguauccuuaguucuaguaggcguaguaacucucuauuuaggagucaugguccaagcagacuccggauguguuguaagcuggaagaacaaagaguugaaaugugguucggggauauuuauaacugacaacguucacacauggacugagcaauauaaguuccaaccggagucgccauccaaacucgcgucggccauccagaaagcucacgaagagggaauauguggaaucaggucugugacucggcuagaaaaccuuauguggaaacagauaacaccagagcugaaucauauccugagcgaaaaugaagucaaacugacuauuaugaccggagauaucaagggcauaaugcaagccggcaaacggagccuccgcccacaaccaacagaacucaaauauucuuggaagacaugggguaaagcuaaaaugcuaaguaccgaauuacauaaucacaccuuucuuaucgaugguccagaaacugcagagugcccgaauacgaaucgagcauggaacaguuuagagguagaggauuacgguuuuggcguuuucaccacaaacauaugguuaaaauuaaaagaaagacaagacguauuuugugacuccaaauugaugucggcagcaauaaaggauaaccgggcaguccaugcugauaugggguauuggauugagucagcucuuaacgacacuuggaaaaucgagaaagcgaguuucauugaagucaaaucuugccauuggccaaaaucccauacacuuuggucuaacggaguguuggaaucagaaaugauaauaccaaaaaauuucgcuggaccuguaagccaacauaauuauaggccaggauaucauacacagacugccggaccauggcauuugggucguuuagaaauggacuuugauuuuugugaaggaacuacagugguagugacugaagacugcggcaacagaggcccaucacugcguacuaccaccgcuucaggcaaauuaauaacagaauggugcuguagaaguugcacacuucccccauuaagauacagaggugaagacggguguugguacgggauggagauucgaccauugaaagaaaaggaagagaaucuaguaaauagcuuaguaacugcuggucauggucaaauugauaacuucaguuuagguguccuugguauggcacuuuuuuuagaagaaaugcuccgaacaagaguaggaacaaaacaugcuauucuacugguagccguauccuuugugacauugauaaccgguaauaugucauuuagagauuuaggaaggguaauggucaugguuggcgcagccaugacagaugauauaggcaugggagugacauaccuagcgcuacuagcagcguuuaaagugcgacccacguucgcggcugguuuacuauuacgaaaacuuacgaguaaagaguuaaugaugacuacaauaggcauuguucuccuaucacaaagcacuaugccagaaacgauauuggagcuuacugaugcacuagcuuugggaaugaugguccucaagauuguccggaauauggaaaaauaccaauuggcagucacaaucauggcaauacuguguguaccaaaugcagucauuuuacaaaacgcauggaagguaagcugcacaacuuuagcuguaguauccguaucccccuuguuucuaaccaguagccaacaaaaagccgacuggauaccuuuagcauuaaccauuaaagguuuaaacccuaccgcuaucuuuuugacgacucugagucgaacuaguaagaaacgaucauggccuuugaacgaagcaauaauggccguuggaaugguaucgaucuuagcaucaucacuguuaaaaaaugauauaccaaugacaggcccucugguagcagguggauuacuaacaguuuguuauguacuaacaggacguagcgcagauuuagaacuugaaagggcagcggacguucgaugggaagaacaagcagaaaucuccggcucgaguccaauauuaaguauuacgauaucugaggaugguuccaugucuaucaaaaacgaagaagaggaacaaacgcucacuauacuaauucgcacgggccuuuuggugauaucagguuuauucccgguuagcauaccuauaaccgcugcggccugguauuuaugggaagugaaaaaacaaagagcaggaguccuuugggauguacccagcccaccacccguagggaaagcugaacuugaagauggcgcauaccgcaucaaacaaaaagguauacuaggauauagucagauuggggcugggguauauaaggaagguacauuccauacaauguggcacgucaccaggggugcuguacuuaugcauaagggaaaaagaauugaaccgaguugggcagacgugaaaaaggaucuaaucucguauggcggaggauggaaacuugagggagaauggaaagaaggagaagagguccaaguacuagcgcuagaaccuggaaaaaacccgagagcaguucaaacaaaaccaggguuauucaagacuaacaccggaacaauaggagccgucucacucgacuucucuccaggcaccucuggaucaccuauaguugauaaaaaggguaaaguggucggguuauacgggaauggcgucgugacgaggaguggcacuuauguuagcgccauugcacaaacggaaaaaagcauugaagauaaucccgaaaucgaagacgacaucuuuagaaaaaaacgacugacuauuauggaucugcauccaggggccggcaagacgaaacgguaucuaccagccauuguaagagaggcuauaaaaagaggucuaagaacauugauacuagcaccgacucgcguagucgcugcagagauggaagaagcgcuacgaggacuaccuauacguuaccagacgccggcuauaagggcagaacauacuggucgagaaauuguugacuuaaugugccacgccacguucacgaugcgacuccugaguccaauccgaguuccaaacuauaaucuuaucauaauggaugaggcccacuuuacggacccagcaucuauagcagcaaggggcuauauaagcacacgcguagagaugggagaagccgcagguaucuuuaugaccgcuacuccacccggaucucgcgauccguuuccccagucaaaugcccccauaauggaugaagaacgggaaauucccgaaaggagcuggaauuccggacacgaaugggucacagauuucaaaggaaaaacgguaugguuugugccaucuauaaaggcagggaaugacauugcugcuugucuuagaaaaaacgggaaaaaaguuauacaauugagccgaaagacuuucgacagcgaauacaucaaaacuaggaccaacgacugggacuuuguaguaacgacagacauaucugagaugggugcaaacuucaaagcugaaaggguaauagacccuagacgauguaugaaaccagugauccuaacagacggcgaagaacgagucauacuggcaggaccaaugccaguaacucauucaucagcagcacaaagaagaggacgaguuggaagaaaucccaaaaacgaaaacgaccaauauaucuauaugggcgaaccgcuagaaaacgacgaagauugugcccauuggaaagaagcaaaaauguuacuugauaauaucucuacgccugaagggaucauaccauccauguuugaaccagaacgagaaaaaguagacgcaaucgauggagaguaucgauuacgaggagaagcgcggaaaacauuugucgaccuuaugcgacgaggagaucuaccagucugguuggcauaccgagucgccgcagaggguaucaauuacgcagauagaagauggugcuucgacggaguuaaaaauaaucagauauuagaagaaaacgucgaaguagaaauuuggacgaaagagggcgaacgaaaaaaacuuaaaccuagaugguuagaugcuagaauauacucagauccauuagcauuaaaagaauuuaaagaguucgcagcuggacgcaaaucucuuacauuaaaucuaauuacugaaaugggacgguugccuacauuuaugacacaaaaggcccggaaugcacuggauaaccuagcaguauuacauacugcagaagcugguggucgagcuuauaaccacgcgcuuagugaacuacccgaaacauuagagacauuacuccucuuaacacugcuagccgcaguuacagguggcauauuuuuauucuuaaugagcggcaaaggcauaggaaagaugacauuaggaaugugcugcauaauaacggccuccauucuacuuugguaugcacaaauacagccucauuggaucgcagcuucgauuaucuuagaguucuuccuuauugugcuuuuaauaccagaacccgaaaaacaacgaacuccucaagacaaucaauuaacguauguggugauagcgauucuaacugucgucgcugcaacaauggccaaugagauggguuucuuagaaaaaaccaaaaaagacuuuggauugggaagcaccacaacacaacaaccggaaucaaacauacuugacauagacuuacguccagccagugcguggacuuuauacgcgguugccacuacuuucaucacaccuauguugaggcauucgauagagaacucaagcguaaacguuucacucacagccaucgcaaaucaagcgacgguacucaugggacuugguaaaggauggccacuaagcaaaauggacaucggaguaccacuuuuagcuauuggcugcuacucgcaaguuaauccaauuacguuaaccgccgcauuauuauuauuagucgcccauuacgcaauuauaggucccgguuuacaagcaaaagcaacacgggaggcccaaaaaagagccgcggcagguauaaugaaaaauccuacggucgacggaauaacuguaauagaucuugauccaauuccauacgaucccaaauuugaaaagcaguuaggacaaguaauguuacuugucuuaugcguaacacagguauuaaugaugaggacaacaugggcauugugugaggcacucacccuagcuacgggacccauaucgacgcuaugggagggcaauccugguagguuuuggaauaccacaauagcagucucuauggcuaacauuuuuagaggcagcuauuuagcaggugcaggcuuauuauuuagcauaaugaaaaacacagcuaauacaaggcgaggaacagguaauacuggggaaacauuaggagaaaaauggaaaaaucgguugaacgccuuaggcaaaagugaauuccaaauuuauaagaagagcggcauacaggaaguugauagaacuuuagcgaaagaagguauuaaaagaggcgaaacagaucaccaugccguaaguagaggaagugccaaacuccggugguuuguggaaaggaaucugguaacaccugaagguaagguaguagacuugggcugcggacgaggcggcuggucauauuauugugggggccuuaagaauguaaaagaaguuaagggacuaacgaaaggcgggccuggucaugaagaaccuauaccgauguccacauacgguuggaauuuaguucgacugcagucaggcguagauguguuuuuuacgccuccagagaaaugcgauacauuacuuugugacauaggugaaagcuccccgaauccuacuguggaggcuggacggacccuuagaguacuaaauuuagucgaaaacugguuaaacaauaauacucaauuuuguauaaaaguuuuaaacccauauaugccgagcgucauagaaaaaauggaagcccuacaacgcaaguacggcggggcucuaguacgaaaucccuuaucacgaaauucaacucaugaaauguauuggguuaguaaugcaucaggaaauauaguuuccagcguaaacaugaucucgagaaugcuaauaaaucguuuuacuaugagacauaaaaaagcgacguacgaaccggauguggauuuaggauccgguacacggaauaucggaauagaguccgagacaccaaaccuagauaucauaggaaaaaggauagaaaagauaaagcaagaacaugaaacuucguggcacuaugaccaagaucauccuuauaaaacuugggccuaucacgguucauaugaaaccaagcaaacuggaagcgcaagcucaauggugaacggaguaguacgauugcugacgaaacccugggacguaauaccaauggucacacaaauggcaaugacugauaccacuccauucgggcaacaaaggguauuuaaagaaaaaguugauacaaggacccaagaaccaaaggaaggaacgaaaaagcuaaugaaaauuacggccgaauggcuauggaaggaguuaggaaagaaaaagaccccgaggaugugcacacgggaagaauucacuagaaaaguacgaagcaaugcggcucuaggagcgaucuucaccgaugaaaauaaauggaagagugcucgagaagcaguugaagauucgggcuucugggaacuuguagauaaggaacgaaaucuacacuuagaaggaaaaugugaaacuugcguuuacaauaugauggguaaaagggagaaaaaguuaggagaauuugguaaggcgaaaggaucucgugccauaugguacauguggcuaggugcaagauuucuggaauuugaggcacugggauuuuuaaaugaagaucacugguuuagucgggaaaacagucuuucugggguagaaggugaaggauugcacaaauugggcuauauucugcgagauguuagcaaaagggaaggaggcgccauguaugcugacgacacagcugguugggauacuagaauaacacucgaagauuuaaaaaaugaagaaaugguaacgaaucauauggaaggagaacauaaaaaauuagcugaagcuaucuucaaauugacauaccaaaauaaagucguuaggguccaacgaccuacgcccagaggaaccgucauggauauuauuagccgacgugaucaacguggauccggacaggugguuaccuacggccugaacacauuuacaaauauggaagcucaguugauccgacagauggaaggugagggaguuuuuaaguccauucaacaacuaacaguuacagaagaaaucgcagucaagaauugguuaguuaggguuggacgagaacgccuaucaaggauggcuauuucuggagaugauugcguugugaaaccuuuagacgaccgauuugcuucagcccugacugcauugaaugacaugggcaaagugagaaaagacauucaacaaugggaaccuucuagagguuggaacgacuggacucaagucccguuuugcucgcaccauuuucaugaauuaauuaugaaagaugggcguguauuaguuguaccuugcagaaaccaggacgaguugauagggagagcgcgaaucucucagggugcgggauggucguuacgugaaacggcaugucuaggaaaaagcuaugcucaaauguggaacuugauguauuuucaccgaagggaccuccgacucgcagcgaacgcgauuuguagcgccguacccucccauugggugcccaccucucgcacaacaugguccauucaugcuacacaugaauggaugacaacagaagacaugcuuacugucuggaaccgagucuggauccaagaaaauccauggauggaggauaaaacuccagucgaaagcugggaagaaauaccguauuuaggcaaacgugaagaucaauggugcgggagucucauaggacuuacuucaagggcaacaugggcaaagaauauccaaacggcaauuaaucaagucagaagucuaauagguaacgaagaguacacggauuacaugccgagcaugaaaagguuucggagagaagaagaggaagcaggaguucucugguaa

SEQ ID NO: 22799 - RNA, 9876 nt, Artificial Sequence
  derived and/or modified CDS sequence (opt6) from DENV-2__KT187557__SS-prME
acagcaggcauaauaauuaugaugauaccgacgguaauggcuuuucacuuaacuacucggaacggugaaccgcacaugauugugucaaggcaagaaaaaggaaagucauuauuauucaagacagagaacgggguuaauaugugcacacuuauggcgauggaccuaggugaacuaugcgaggauacaauaacuuauaacuguccccuuuuaagacagaaugaaccugaagacauagacuguugguguaauucaacaucaaccugggugacuuauggaaccuguacagcaacaggagaacaucgccgcgagaaaaggucgguugcacugguuccacacguagguaugggauuagaaacgcguaccgagacuuggaugucaagugaaggagccuggaaacacgcgcagagaauagagacaugggucuuacgacacccggguuuuacuaucauggcagccauccuugcuuacaccauuggaacgaccuauuuucaaagaguacugauauuuaucuuacuaacagcaguugcuccaucaaugacaaugcguuguaucgguauuaguaaucgugauuuuguagaagggguaaguggaggcucuuggguagauauagugcuagagcauggaucauguguuacuacaauggcaaagaacaagccgacgcuagacuucgaauugauuaaaaccgaagccaaacauccugcaacacuuagaaaauacuguauagaggcaaaacuuacaaauacaacaacugccucaagaugcccuacacaaggcgaacccucgcuuaaugaggaacaagacaaaagauucgucuguaaacauucuaugguugaucgcggauggggaaaugguugugggcucuucgguaaaggcgguauagugacaugcgcuauguucacaugcaaaaaaaacauggaaggaaagaucguccagccugagaauuuagaguacaccauugucauuacaccacacucaggcgaggaaaaugccguagguaacgacacaggaaaacaugggaaagaaauuaaaguaacuccgcagucuagcauaaccgaagcggaauuaacgggguacgguacuguuaccauggaauguuccccuagaacuggauuagacuuuaacgaaaugguauugcuccagauggaaaacaaagcaugguugguccaucgucaaugguucuuagaucugccccuuccauggcuucccggagcugacacucaggguagcaauuggauacaaaaggagacauuaguuaccuucaaaaauccacacgcuaaaaaacaggaugucgugguccucggaucgcaagaaggugcgaugcauacugcauuaacaggagcaaccgagauacaaaugucaagcggaaaccuucuauuuacugggcacuugaaaugcaggcuuaggauggauaaacuacaacuaaaggguaugucuuauaguauguguacugggaaauuuaaaguaguaaaagaaauugcagaaacacaacacggcacuauaguaauaagagugcaguacgaaggcgacggaucuccaugcaaaauuccauuugaaauaauggauuuggaaaaaaggcauguucuagguagauuaauaacaguaaauccaauaguuacugagaaggauucaccuguuaauauagaagcugaacccccauuuggagauagcuacauaauuauagguguagaaccgggacaauuaaaauuaagcugguuuaaaaaagggagcuccauagggcaaauguuugaaacuacaaugcgcggagcgaaaagaauggccauucuaggagauacugccugggauuucggaaguuuaggcggaguauuuacuucgauuggcaaagcccuucaucaaguauuuggugcuauauauggcgccgccuucucaggagugagcuggacaaugaaaauauuaauaggggugguuauaacuuggauugggaugaauucuaggagcacuucauugucaguuaguuugguuuuaguuggugugguuacucucuauuuaggugucaugguacaagcugacucaggauguguaguaucauggaaaaacaaggaguugaaauguggaucagggauauuuauaacggauaaugugcauacuuggacugaacaauauaaguuucaacccgagucucccuccaaguuagcuucagccauccaaaaagcccaugaggaaggcauauguggcauuagauccgucacgcgacuggaaaacuuaauguggaaacagauuacuccagaacuuaaccacauuuugucagaaaaugaaguuaaacuaacgauuaugacgggagauaucaaagguauaaugcaagcagggaagagaucgcuucgcccgcaaccaacagaguuaaaauacucuuggaagacuuggggaaaggcgaagauguuaucgacagaguuacauaaucauacauuccuuaucgaugguccugaaacugccgaaugcccuaauacuaacagagcauggaauucucuagaaguagaggauuauggauuuggaguauucaccacuaauauauggcucaaauugaaagagagacaagauguuuucugcgauaguaaauuaaugagcgcagccauaaaagauaaccgagccguacacgcagacaugggauauuggauugagucagcacuuaaugacacuuggaagaucgaaaaagccagcuuuaucgaaguuaaaucaugucauuggccgaaaucacacacccuuuggucaaaugguguacuagaaucagagaugauaauuccaaaaaacuucgcagguccaaugucacaacauaauuacagaccgggcuaucauacucaaacagcgggacccuggcaccugggaagacucgaaauggacuuugacuucugugaaggcacgacgguuguggucacagaagauugcggaaauagaggaccauccuuacgaacaacaacagcaucaggaaagcucauuacagaauggugcuguaggaguuguaccuuaccuccccuacgauacagaggugaggauggcugcugguacggcauggaaauaagaccacugaaagaaaaggaggaaaaucuagugaauucgcucguuacugccggucacggccaaauagacaauuucucacuaggagugcugggaauggcacuauucuuagaagaaaugcuucgcacucggguggguacuaaacacgccauccucuuggucgccgugucuuucgucacucuuauuacggggaauaugucguucagagaccuagggaggguuaugguuaugguaggugcugcuaugacugaugauauagguaugggugugacuuaucucgcucuauuggccgcauucaaaguacgaccaaccuucgcagcggggcuauuauuacgcaaacuaacgucaaaagaacuaaugaugacaaccauagguauagucuugcugagccagaguacaaugccggagacaauuuuggagcuuacagacgcacucgcucuugggaugauggugcuaaaaauaguccgaaacauggaaaaguaucaacuagcagugacaauaauggcuauucuaugcguaccuaaugcaguuauacuucaaaacgccuggaaaguaucaugcacgacucucgcuguaguaucuguuaguccacuucuucuuacgaguucacaacaaaaagcugacuggauaccuuuagcuuugacuauaaaagguuuaaacccgacugcaauuuuuuuaacuacacucucacggacuucaaagaaacguucauggccacuaaaugaagcgauaauggcuguagggaugguaaguauauuagccaguucccucuugaagaaugacauaccuaugacuggcccguuaguagcaggcggguuacuuacaguauguuacguacucacaggucgaucagcagaucuggaacucgaacgagcugcagacguaagaugggaggaacaagcagaaaucucgggcucguccccaauauuaucuauuacuauauccgaagaugguaguaugaguaucaaaaacgaagaagaggaacaaacacugacaauuuuaauucgcacaggauuacuuguuauaaguggauuauuuccaguuucaaucccaaucacggcugcagcaugguauuuaugggaaguuaaaaaacaacgcgcaggcguucuuugggauguaccuucgccucccccaguagguaaagcagaauuagaagauggagcauauagaauaaaacaaaaagguauauuggguuauagucaaauuggagcaggcguuuacaaggaaggcacauuccacacaauguggcacguaacccgaggagcuguauuaaugcacaaaggcaaacguauugaaccuucuugggcagauguaaagaaggaucuaauaaguuacggaggaggguggaaacuagaaggagaguggaaagaaggugaggaaguccaggugcuagcauuagagccggguaaaaauccccgagcaguacaaacaaagccuggguuguuuaaaacgaauacaggaacaaucggggcggucuccuuggauuucucuccaggaacgaguggaagcccuauagucgacaaaaagggaaaaguuguuggacuguauggaaacggaguaguaacgagaucgggaacuuacguauccgcaauugcacaaacagaaaagaguauugaggauaauccugaaaucgaagacgacauuuuccgaaaaaaaaggcuaacuauaauggaucuucacccuggagcaggaaagacaaagagauaucugcccgccaucguacgcgaagcuauaaagagaggucuacgaacauuaauucuagcgccaacgagagugguugcggcugaaauggaagaagccuugagaggcuuaccuauucguuaucagacuccagccauccgcgccgaacauacuggucgcgaaauuguagauuugaugugccacgcuacauuuacaaugagacuucuaucgccuauuagaguaccgaauuauaacuuaaucauaauggacgaagcgcauuucacugauccagcuucaaucgccgcacguggauacauuaguacuagggucgagaugggugaggcagcgggaauauuuaugacagcaacaccgccagggucucgcgacccauuuccgcaaaguaacgcuccaauuauggaugaagagagagaaauccccgaaagaagcuggaacucaggacaugaguggguuacagauuuuaaaggaaaaaccgucugguucgucccaagcauaaaagcaggcaacgacaucgcagcuugccucagaaaaaacggcaaaaaagugauacaacuaucaagaaaaacguucgauagugaauacauaaagacacguaccaaugauugggacuucgucgugacaaccgauauauccgaaaugggugccaauuucaaagcagaaagaguaauugacccacguagauguaugaaaccaguaauauugacugacggugaagaaagaguaauauuagcgggaccgaugccuguaacacacaguucagcagcacaaagaagagggcgaguugggcggaauccuaagaacgaaaaugaucaauauauauacaugggagagccacuagaaaaugacgaggauugugcgcauuggaaagaagcgaaaauguuacuugacaacauaaguacuccugaagggauaauaccaucaauguuugagcccgaacgagaaaagguugaugcuauagauggugaauaccgacuacgaggagaagcaagaaagacuuuuguagacuugaugagacgaggggaucucccgguauggcuugcauaccgaguugcagcggaggguaucaacuaugcagauagaaggugguguuuugauggaguaaagaauaaucaaauauuagaagagaauguugaggucgagauauggacuaaagaaggagagaggaaaaaacuuaaacccagauggcuugaugcacgaaucuacuccgaucccuuagcucuuaaagaguuuaaagaguuugcugcaggucgaaaauccuuaaccuuaaacuuaauaacagagaugggaagacugccgaccuucaugacgcaaaaagccagaaaugcucuagacaaccucgcaguccuacauacggcagaagcaggaggucgagcuuacaaucacgcacucucugaacucccagaaacacucgaaacguuacuacuuuugaccuuacuggcugcagucacuggaggaauauuccuguuucuuauguccgggaaggguauaggcaaaaugacucuaggcaugugcuguaucaucacugcaagcauauuacuaugguaugcucaaauccaaccccauuggauagccgcaaguauaaucuuagaguucuuucucaucguucuauugauaccagaaccagaaaaacaaaggacaccacaggacaaucaauuaacauauguagugauagcaauauuaacggucguggcagcaacgauggcaaaugaaauggguuuucuugaaaaaacuaaaaaagacuuuggacuaggaucgacaacaacgcagcaaccagaaucuaauauacuugauauagauuuaagaccugcgagcgcguggacacuauaugccguugcuacaaccuuuauaacuccaaugcuucgucauaguauugaaaauucgagugugaacguaagucugacagcaaucgcuaaccaggcaacaguccuaaugggguuagggaaaggguggccuuuaaguaaaauggauauagguguaccucuuuuagcuaucggcugcuacucacaagucaaccccauuacauuaacggcagcucuguuacugcugguagcacauuacgccauaauuggcccgggguuacaagcaaaggcaacgagggaagcacaaaagcgggcugcggcagguauaaugaaaaacccaaccguagauggaauaacugucauagaucuggaccccauccccuaugauccaaaauuugaaaaacaauuaggucaaguuaugcuucucguuuuauguguaacucaaguccuaaugaugaggacgacgugggcucugugugaagcccuaacauuagcgacagguccaaucucaacacuaugggaagguaauccaggcagauucuggaacaccaccauagcugucucaauggcgaauaucuuuagaggaagcuaucuagcaggggcagggcuucuuuucucaaucaugaaaaacacugcgaacacaagaagaggaacaggaaauaccggagaaacucuuggagagaaauggaagaacagacugaaugcccuagggaaaucugaauuccagauuuacaaaaaaaguggaauacaagaaguagaucggacacuggcuaaagaagggauaaaaaggggagaaaccgaccaucacgcaguaagccgaggcucagccaaacuaagaugguuuguggagagaaaucucguuacuccagagggcaaaguggucgauuuagguuguggaaggggagguuggucauauuauugugguggccuaaaaaauguaaaagaaguaaaaggauuaacgaagggagguccaggacacgaggaaccaauaccaaugucaacguaugguuggaacuugguccgcuugcagucaggaguggauguuuuuuucacaccaccagagaagugcgauacauugcugugcgauauaggcgaaucuaguccuaacccuacggucgaagcagguagaacacuucguguuuuaaaccuaguagaaaacugguuaaacaauaacacacaguucuguauaaaaguccugaauccauacaugccuucgguaauugaaaaaauggaagcgcuacaaagaaaguacggaggggcgcuaguuaggaauccauugucuaggaacaguacucacgaaauguauugggucucaaacgccaguggcaauauagucaguagcgucaauaugaucagucgaaugcuaauuaauagauuuacuaugaggcacaaaaaagcuaccuacgaaccagauguagaucugggcagcggcacgcgaaauauaggaauugaguccgaaacaccuaauuuagacaucaucggcaaacggauagagaaaaucaagcaagaacacgagacgucauggcacuaugaccaggaucaccccuauaaaacaugggcauaccacgggucauacgaaacaaagcaaacgggcagugcaucaagcaugguaaacggcguugugcgccuacuuacuaaaccgugggacgugauacccaugguaacacaaauggcaaugacagauacaacgccauucggacaacagagaguuuuuaaggagaagguggauaccaggacacaagaaccgaaagagggaacaaaaaaguuaaugaaaauaacagcagaauggcuauggaaagagcuaggaaaaaaaaaaacacccaggaugugcacacgcgaagaauuuacuagaaaaguaagaucaaacgcggcacuaggcgcaaucuuuacugacgaaaauaaauggaagucagcucgcgaagcaguagaggauucaggauuuugggaacuuguagauaaagagcgaaauuuacacuuagaagggaaaugugaaaccuguguuuacaacaugaugggaaaaagagaaaaaaaauuaggcgaauuuggaaaggcaaaaggaucaagggcuauuugguauauguggcucggagcgagguuuuuagaguucgaagcucuuggauuucuaaacgaagaccauugguuuagucgugaaaacaguuugucugguguggaaggcgaagguuuacauaaacuuggguacaucuuacgggaugugucaaaaaaagaaggaggagcuauguaugcagacgacacagccggcugggacacgaggauuacccuagaagacuuaaaaaacgaagagaugguuacaaaccauauggaaggugaacacaaaaaguuagccgaagcaauuuuuaaacuaacauaccaaaauaaaguuguucguguacagcgaccuacaccacgagggaccguuauggacauaaucucacguagagaccaaagagguucaggacaagugguaacuuauggucuaaauacuuucacuaauauggaagcucaacugauacgacaaauggaaggagaagggguuuuuaaaucgauacaacaacugacaguuacagaggagauagcaguaaagaauuggcuuguuagaguggggagggaacggcuaucaagaauggccaucaguggugacgacugcguagucaaaccucuugaugacagguucgcaucagcacuaacagcuuuaaacgauaugggaaaaguccguaaagauauacaacaaugggaaccuagucgcggauggaacgauuggacacaagugccauucuguucacaccauuuccacgaauuaaucaugaaagaugguaggguucuaguaguacccugccgcaaucaggaugaauuaauaggaagggcaagaauaagccaaggcgcaggauggucacuuagagaaacagcgugucuuggaaagucuuaugcgcaaauguggaaucuaauguacuuucauagacgagacuuacguuuagcagccaacgccaucugcagugccgucccaucacauuggguucccacaucccgaacuacguggaguauccacgcaacgcaugaauggaugacaaccgaggacauguuaacaguguggaaucgagucuggauucaagaaaauccuuggauggaagacaaaacuccaguagaaucaugggaagaaaucccguaccucgguaaacgagaggaccaauggugcggcucuuugauuggauuaacaagcagagcuacgugggcuaaaaacauccagacagcuauaaaucaaguaagaucucuaauaggaaaugaagaguauacggauuauaugccauccaugaagagguuucgccgggaagaagaagaagcuggaguguugugguga

SEQ ID NO: 22800 - RNA, 9876 nt, Artificial Sequence
  derived and/or modified CDS sequence (opt6) from DENV-2__JQ045670__SS-prME
ucggcaggaaugauaauaauguugauuccuacagucauggcauuucaccuaacuacccggaauggcgaaccucauaugaucguagggauucaggaaaaagguaagagucuccuauuuaaaacagaggaugguguaaacauguguacuuugauggcuauggacuugggcgaauuaugugaggauacaauaaccuacaaaugcccgcuacuuagacagaaugaacccgaagauauagauuguugguguaauaguacauccacuuggguuacuuaugggacauguacaacaacaggagaacaccgaagggagaaacggucagucgcauuggugccacauguaggaaugggauuagaaacacgaacugaaacauggaugucaagugaaggggccuggaagcaugcucaaagaauagaaacauggauacuucgccacccuggauucacgaucauggcagcgauauuggcauacacaauaggaacaacgcauuuccagcgaguucuuauuuuuauauuacuaacagcagucgcgccgaguaugaccaugcgaugcauaggaaucagcaauagagauuucguagaaggagucuccggggggaguugggucgacauuguauuagagcacggcucguguguaacaacgauggcgaagaacaaaccgacauuggacuucgaacuaauaaaaacugaggcgaaacaaccugcaacguuaagaaaauauuguauagaagcuaaacuuacgaauaccaccacggaaucaagauguccuacccagggggagcccucauuaaaagaagaacaggauaagagauuuguauguaaacauucaaugguggauagagggugggggaacggauguggucucuucgggaaaggggguauagugacuugugcuauguuuacuuguaagaaaaacauggaggguaagauagugcaaccggaaaaucuagaauauaccaucguaguaacuccacauaguggugaggagcacgcgguugggaacgacacggguaagcauggaaaagaaauuaaggugacaccacaaucuuccauaacugaagcagaauuaacaggcuaugggacaguuaccauggaauguucaccaagaacuggccuggauuucaacgaaaugguucuacuacagauggaaaauaaggcauggcuaguacauaggcaaugguucuuggaucucccacuuccaugguuaccuggagcagacaaacaagaaaguaacuggauccaaaaagaaacuuugguaacauucaagaacccucacgcgaagaaacaggacguaguuguucucgguucacaagaaggagccaugcauacagcgcuaaccggagcaacagaaauacaaaugucaaguggaaaccucuuauuuacgggacauuugaaauguagauugaggauggauaaacuccaauuaaagggcaugucauacucaauguguaccggcaaauuuaagguaguaaaagaaaucgcagaaacccaacauggaaccauaguaaucaggguucaauaugaaggugacggaucucccuguaaaauaccuuucgaaauaauggaucuugagaaaagguacguauugggucgacugauuacgguaaacccuauagucacggaaaaagauucaccuguuaauauugaagccgaacccccauuuggugauuccuauauuauuauagggguugaaccugggcaacuaaaacuaaacugguuuaaaaaagguagcuccauaggucagauguucgaaaccacuaugagaggugcaaagcguauggcgauccucggugauacggcaugggacuuuggcagucuaggaggugucuuuacaucaauaggaaaagcguuacaccaaguguucggugcuauauauggagcagccuuuaguggaguuucauggacaaugaaaauuuugauaggcguuaucauaacauggaucggaaugaauuccaggucaaccucccuuucaguuucacuaguccucgucgguauaguaacucuuuaucucggggucaugguacaagcugauagcggaugcgucguaucauggaaaaauaaggagcuuaaaugugggucggggauuuuuauaacggauaacguucacacuuggacugaacaguauaaguuucaaccggagucacccuccaaacuagcaucggcuauacaaaaagcucaggaagaagguauuugugggauucgcuccguuacaagauuggagaauuuaauguggaaacaaauuaccccagaacucaaucauauacuugccgagaacgaaguuaaacuuacaaucaugacuggcgauauaaagggcauaaugcaagcagggaagaggucccuacgaccacaaccgacggaguugaaguauaguuggaaaacauggggaaaagcuaaaaugcugucaacagagucauauaaucaaacauuucugauagacggaccugaaacugcagaaugcccaaauacaaaccgagcguggaacucauuagaagucgaagacuauggauuuggugucuuuacaaccaacauaugguugaagcucaaagaaaagcaagacgcguuuugcgacucaaaauuaaugagcgcagcaauaaaagacaauagggcaguccacgcagauaugggauauuggauagaaucugcacuaaacgauacguggaagauugagaaagcaucuuucaucgaagugaagaauugccauuggccgaaaagucauacucuuuggagcaacggaguucuggaaagugagaugauaauuccgaaaaaccuagccggacccguaucgcaacacaacuauaggccaggauaucacacacagauugcugguccauggcaucucgggaaacuagaaauggacuucgauuuuugugaugggacuacagucauaguuacagaagacugcgguaaucgaggaccaucacuuagaacaaccaccgccucagggaaguugauaacugaaugguguugucgcucauguacauuaccucccuuacgauacaggggugaggauggauguugguaugguauggaaauacgcccccuuaaggaaaaggaagaaaaccuuguuaauucauuaguaaccgcuggacaugggcaaguagauaacuucucguuggggguauuagguauggcucuauuuuuagaagaaaugcuaaggacaagaguggguaccaagcaugcgauacuucuaguagcaguuaguuuuguuacacuaauaacaggaaacaugaguuuuaaggacuugggaagaguaguuguuauggugggcgccgcaauggcagacgauauaggcaugggagucacguaccuggcacuauuggcggcguuuaaaguaagaccuaccuuugcagcggguuugcuacugagaaagcuaacuucgaaggagcuaaugaugacgacuauuggaauuguguuacuaucccagucaacaauucccgaaacagucuuagaauugacagaugcauuagcacuagguaugaugguccugaagauuguaagaaacauggagaaauaucaauuagcaguaacuauuauggcaauuuuguguguaccaaacgcaguuauuuugcaaaaugcauggaaaguaagcugcacgauucucgcagucguaucaguuagcccgcuacuauuaacaaguucucagcaaaaaacagacuggaucccuuuggccuuaaccauaaaagguuuaaacccgacugcaauauuucugacaacccugucacgcacuaacaaaaaacggaguuggccuuuaaaugaagcaauuauggcaguggggaugguuagcauauuagcaagcuccuuauuaaaaaacgacauuccuaugacaggaccuuuaguagcugggggacuguugaccgucuguuacguuuugacaggaagaucagcugaccuagaauuagaaagagcaacagauguaaaaugggaagaccaagcagagauuaguggcaguucgccuauacuuucaaucacuauaagugaagauggaucaaugaguaucaaaaacgaagaggaagaacagacgcuaacuauucuuauaagaaccggauuauuagucaucagcggauuguuuccgauuagcauaccgauaaccgcagcagcaugguaucuaugggaaguuaaaaaacaaagagccggcguccucugggauguaccaaguccuccaccaauggggaaagcggaacuugaagacggagccuaucgaauuaagcaaaaaggaauucuagguuauucgcagauaggagcaggugucuacaaggaagggacauuucauacgauguggcacgucacaagaggugcuguacuuaugcacaaaggcaaacgaauagaaccaucaugggcagacgucaaaaaagauuuaauuucguacggagggggauggaaacuggaaggagaauggaaagaaggcgaagaaguccaaguauuagcucuagaaccaggaaagaacccaagggcaguccaaacgaaacccgggcuauuuaaaacuaauacuggcacaaucggagcagucagcuuggacuucagccccggcacaucaggauccccaaucauagauaaaaagggcaaaguaguuggcuuauauggaaaugggguaguaacgagaagcggggcguacguaucagcaauugcgcaaacugaaaaaucaauagaggacaauccugaaauagaagacgacauuuuuagaaaacggagacucaccauaauggaucugcauccgggagccgguaaaacaaaacgguaccucccggccauugucagagaagcaauaaaacgaggucuccggacccuaauacuagccccuacgagagugguugcagcagaaauggaggaagcacuuaggggauugccaauccgauaccagacucccgcaauuagagcagaacauaccggcagggaaauaguagaucuaaugugccaugcaaccuucacaaugagguuacuuucuccaguacgugucccaaauuacaaccuaauuauuauggaugaagcacacuuuacagauccggcgaguauugcagcacgaggauauauuucuacaagaguagagaugggugaagccgcagguauuuuuaugacagcuacaccgcccggaucuagggacccguucccacagucgaaugcacccauaauggacgaggaaagagaaaucccagagagauccuggaacucuggacacgaguggguaacggauuuuaagggaaagacgguaugguuuguuccaucuauuaaagcaggaaacgacaucgcagcauguuugagaaaaaaugguaaaaaaguaauacaacugagcagaaaaacauucgauucugaguauguaaaaacgagaacuaaugauugggauuuuguggucacaacagauauaucagaaaugggagcuaauuucaaagcagaaagagugauagauccgagacgauguaugaaaccugugauauuaaccgauggagaagaaagaguaauuuuagcuggacccaugccuguaacacauucguccgcagcccaaagaagaggacgaauuggcagaaacccuaaaaaugaaaaugaucaguauaucuacaugggagaaccauuagaaaacgacgaagacugugcgcauuggaaggaagcaaaaauguuacuggacaacauaaacacaccagaaggcauaaucccuucuauguuugaaccggaaagagaaaagguagacgcuaucgacggggaguaucggcuacguggugaagcacguaaaacguucguugaucuuaugagaagaggcgauuuaccggucuggcuggcauauaagguagcagcugagggaaucaauuacgccgauaggagaugguguuuugacgguaucaagaacaaccaaaucuuagaggagaacguugaaguagaaauauggacaaaagaaggagaacgaaaaaaacugaagccacguugguuagaugcuaggauauacucugacccccuagcuuuaaaagaauucaaggaauuugcugcagggcgaaaaucgcuuacucucaauuuaaucacugaaaugggacgguuaccaacuuucaugacacaaaaaacacgcgaugcucuagauaacuuagcuguuuuacauacagcagaagcaggaggcagagcuuauaaccaugcucuuucagagcuaccugagacuuuagaaacauuauuacuauuaacauuguuggccaccguaacaggagguauauuucuauucuuaaugucagggcgaggcauaggaaaaaugacuuuaggaaugugcuguauuauuaccgcuaguauacuacuaugguacgcacaaauacagccucacuggauagcggcuaguaucauauuagaauucuuucuuauuguuuuauuaauuccagaaccagaaaagcaaagaacgccgcaagacaaucaauugacauacguagucauugcgauacuuacuguaguagcagcuacuauggcgaacgaaauggguuuuuuagagaaaacgaaaaaagacuuuggauuaggguccauugcgacacagcaacccgaaucuaacauacucgauauagaccugaggcccgcguccgcauggacguuguaugcuguagcaaccacguucguuacuccuaugcuaagacauucaaucgagaacucgucuguaaacgucaguuuaacugcaauagccaaucaagcgacuguauugaugggucuuggaaaaggauggccucuuucgaaaauggauauaggcguuccgcuauuagcgauagguuguuacucacagguaaauccaauuacauugacugcagcguuacuucuuuugguagcccauuaugcgaucauaggcccgggauuacaagcuaaagcgacccgggaagcucaaaaaagagccgccgccgggauuaugaaaaacccaaccguagacggaauuacaguaaucgauuuagauccuauaccuuacgaccccaaauucgaaaaacaacuuggacaaguaaugcuuuugaucuuaugcguuacacaaguccuuaugaugcggacuacaugggcauugugcgaggcucuaacccuagccacagguccaauauccacgcuaugggaagguaaccccgguagauucuggaacacaacaauagcgguuaguauggccaauaucuucagaggaucauauuuagcaggcgcgggucuacucuucaguauaaugaaaaacacuacuaacacuagaaggggcacuggcaauauuggagagacacucggcgaaaaguggaaauccagauuaaacgccuuaggcaaaagugaauuccaaaccuauaaaaagaguggaauucaagaaguggaccggacgcuggccaaagaggguauuaaaagaggagaaaccgaccaccaugcaguaaguagaggcagcgcaaaacuaagaugguuuguggaaagaaaccuggugacgccagaaggaaaaguuguugaccuagguuguggccgaggggguuggaguuacuacuguggaggccuaaagaacguucgggaagugaaaggauuaacaaaaggaggcccuggucacgaagaaccgauaccaaugucaacauacggcuggaaccuggugagacugcaaucggggguugauguuuucuuuauuccaccggaaaaaugcgauacauuauuaugugauauaggcgaaucaucacccaaccccacaguggaggcgggaagaacgcuaagaguauuaaaucugguugaaaauugguuaaacaacaacacucaauucuguauaaaaguuuugaauccuuacaugccaagcgugaucgaaaagauggaagcucuucaacgcaaguacgguggagccuuaguucguaaugaccuaucucgcaacucaacacacgaaauguauuggguaucaaacgcgaguggaaacauuguauccucuguuaacaugauuucuagaauguuaauaaacagguuuacaaugaggcacaaaaaagcgacguaugaaccugauguggaucuuggaagcggcacacgaaauaucgguauugagagugaaauaccuaaucucgacauaauaggcaagcggauagaaaaaauaaaacaagaacaugaaacgaguuggcauuacgaucaagaccauccauauaaaacuugggcuuaccauggcucguacgaaacaaaacaaacuggaucggccucgucaauggucaauggaguaguuagacuucucaccaaacccugggauguauugccaacgguaacacaaauggcaaugacagauacaacucccuucgggcaacaacggguauuuaaggaaaagguagacacgcggacacaagaacccaaagaaggaacuaaaaaacuaaugaaaauaacugcagaauggcucuggaaagaauuagguaaaaaaaaaacaccacgaauguguacacgagaagaauucaccaggaaaguacguagcaaugcagcacuaggagcaauuuucacggaugaaaacaaauggaaaucagcucgagaagcaguggaggauuccagauucugggaacuaguugacaaagaaaggaaucuacaucucgaaggcaaaugcgaaacaugcguauacaacaugaugggaaaaagggagaaaaaguuaggagaguucggaaaagcgaaaggaucuagagcaauaugguauauguggcuuggagcuagguuucuggaguuugaagcauuagguuuuuuaaacgaagaucacugguuuagcagggaaaauagccucagcggagucgaaggagaaggauuacauaaauuaggauauauacuacgagacgugaguaaaaaggagggaggagcaauguacgcagaugauacggcuggaugggacacuaggauuaccuuggaggaucuaaaaaaugaagaaaugguaaccaaccauauggaaggcgaacauaaaaaauuggcugaggcgauauuuaaacucacguaccaaaacaagguaguaagaguacagcgaccuacuccaagaggaacgguaauggauauaauaagcagaagagaccaacguggaucaggucaaguaggcacguauggacuaaacacauucaccaacauggaggcucaauuaauccggcagauggagggcgaagggguauucaaaaauauccaacauuuaacaguuacggaagaggucgcaguucagaauuggcuagcgagagugggaagagaacgacuaaguagaauggcuauuucuggggacgauugcgucgugaagccgcuagaugaccguuuugccaaugcucucacagcgcuaaaugacaugggaaaaauuagaaaagauauccaacagugggaacccuccaaagguuggaacgacuggacgcagguaccauuuuguucgcaucauuuccaugaacucaucaugaaagacggcaggguguuaguuguuccuugccggaaucaagacgaacuaauaggucgagcaagaauaagccagggcgcugguugguccuuaagagaaacagcuugccuggggaaaucguaugcccaaauguggagccuuauguauuuucauagaagagauuuaagguuagcggcuaaugcaaucugcucggcugugccgucacauugggugcccacaucucgaacuacauggagcauacaugcgaaacaugaauggaugacaaccgaagauauguugacuguauggaaucgaguguggauucgagaaaauccuuggauggaagauaagacgccaguagaaaguugggaagaaauacccuaucuagguaagcgggaagaucaguggugcgguucuuugaucgggcuaacuucaagagcaacuugggcaaaaaacauccaagcugccauaaaccagguccguaguuuaauagguaacgaagaauacacagauuauaugccgucaaugaaaagguuuaggcgcgaggaagaagaggcgggaguacuuugguaa

SEQ ID NO: 22801 - RNA, 9876 nt, Artificial Sequence
  derived and/or modified CDS sequence (opt6) from DENV-2__JQ045686__SS-prME
agcgcuggaaugauuauuaugcuuauaccgaccguaauggcauuucaucucaccacgcguaauggcgaaccacacaugauugugggcauacaagaaaaaggaaaaucauuacuguuuaaaacagaagaugguguuaauaugugcacacuaauggcaauggauuugggagaacuaugcgaagacacaauaacauauaaauguccuuuauuaagacaaaacgaacccgaagauauugauugcuggugcaacaguacaucaacguggguuacguaugggacgugcacaacaaccggagaacaccggcgagaaaaacggucaguggcauugguaccacauguaggaaugggguuagaaacucgaacugaaacauggauguccagugaaggggcauggaaacacgcacaaagaauagaaacauggauauuacgucacccaggguuuacaauaauggcugucauccuagcuuauacaauagguacaacucauuuucaacgaguacuaauauucauucuacuuacggccguugcccccucaaugacuaugcggugcauaggaauuucaaauagagauuuuguagaaggagucagcggaggaucauggguagacauaguuuuagaacacgguucuugcgugacgacuauggccaaaaauaaacccacucuagacuuugaacucauaaaaaccgaagccaaacaaccugccacuuugaggaaauauugcauugaagcaaaacuaacaaacacgacaacagaguccagaugccccacucaaggagaaccuaguuuaaaagaggaacaagauaaaagguuuguuugcaaacacucaauggucgacagaggcuggggaaauggaugcggacuuuuugggaaaggagggauaguaacaugugcuauguucacauguaagaaaaacauggaaggcaaaauuguucaaccagagaauuuagaguacacuauuguaguuacaccccacucaggagaagaacacgcuguagguaaugauacuggaaaacauggacaagagauaaaaguuacuccacagucuagcauaacugaagcugaauuaacggguuacgguaccguaacgauggaguguaguccacgcacgggacuagauuuuaaugaaaugguacuacuccaaauggaaaauaaagcaugguuaguacacagacaaugguuuuuagaucuacccuuaccaugguuaccgggggccgacaaacaagaauccaauuggauucagaaagaaacucuugugacauucaaaaauccacaugccaagaaacaggaugucgucguauuaggaucccaagagggugcaaugcauacugcucuuacaggagcaacugagauacaaaugaguucugggaaucuacuauuuacaggacaccugaaauguagguuaagaauggacaaacuacaacucaaagguaugagcuacucuauguguacuggaaaauucaaaguggugaaagaaauugcugaaacucaacacgguacgauaguaauacggguucaauacgaaggcgacggaaguccauguaaaauaccauuugaaauuauggaucucgagaaaagauacguccuugggagacugauaacaguaaaccccauagucacugaaaaagauaguccuguaaacauagaagcagagccgccauucggggacaguuacauuauuauagggguagaaccgggucaacucaaauuaaacugguuuaagaaagguuccucuauuggucaaauguuugagacuacuaugagaggagcgaaacgaauggcuauucuaggagacacagcaugggauuuuggaucucuuggagguguauuuacuucaauuggaaaagccuugcaccaaguauuuggugccauauacggcgcagcuuucaguggugugucuuggacaaugaaaauccuuauaggggugauaaucacguggauaggaaugaauagucgcucaaccucucuuucuguaaguuuaguauugguuggaauuguuacacuuuaucuaggaguaaugguucaggcugauucgggaugcguaguauccuggaaaaacaaagaacuuaaaugcgggucgggaauuuuuaucacggauaaugugcacacuuggacggagcaauauaaauuucagccagaaaguccaucaaaacuugccucggccauacaaaaagcccaagaagagggaauaugugguauaagaucuguaacacgauuggagaauuuaauguggaaacaaauaacaccagaauugaaucacauucuagccgagaaugaagugaaacugacaauaauaacuggagauauuaaggguauaaugcaagccgguaaaagaucauuaaggccccaaccaacggaacuaaaauauuccuggaagacaugggguaaagcaaaaauguuaucuacagaauccuacaaucaaacauuucuuauagacggcccagagacugcggagugcccaaacacaaauagagcguggaacucuuuagaaguagaagauuacggauucggcgucuucacuacaaauauauggcucaagcucaaagaaaaacaggaugcuuuuugugauuccaaacuuaugagugcggccauuaaagauaaucgagcugugcaugccgauaugggguacuggauagaaagcgcacuaaaugauacauggaaaauagaaaaagcaaguuuuauagaagucaaaaacugucauuggccaaaaagucauacacuauggucuaacggaguacucgaaucggaaaugaucaucccgaaaaaccucgcuggcccgguaucucaacacaauuaucgcccagguuaccauacucagauagcaggcccuuggcaucuuggaaaguuggaaauggacuucaacuuuugugauggaacaacgguaauuguaaccgaagauugcgguaaucguggaccgucucuacgaacaacaacggcaagcggaaaacuaauuacagaaugguguugccgauccugcacgcuuccuccccuuagguauagaggggaagacggauguugguaugguauggagauaagaccccuaaaggaaaaggaagagaauuuagucaacucgcuugugacugcaggccauggucaaguagauaauuuuaguuuggggguacuaggcauggcuuuauuucuagaggaaaugcuaaggacccgcguaggaacaaaacacgcaauccuauuaguagcagucuccuucgugacacuaauaaccgggaauaugaguuuuaaagaucuagggcgggucguaguaaugguaggcgcaacaaugaccgaugauauaggaaugggaguuacauaucuagcgcuauuagcggcauuuaaaguacgaccuacauuugcugcaggucugcuauuacgaaaacuuacaucgaaagaacugaugaugaccacaauuggcaucgugcuuuugagucaaagcacaauaccagagacaguacuagagcucaccgaugcacucgcauuaggaaugaugguacucaaaauaguacgaaacauggaaaaauaccaacuagcagugacuauuauggcaauucugugcguaccaaaugcggugauccuacaaaaugccuggaaagucucguguacgauauuagccgugguauccguuucgccgcuucuacuaacuucaucacaacagaaaacagauuggauuccucuugccuuaaccauaaaaggacuaaauccuacggccauauuuuuaacgaccuuaucacggacaaauaagaaacgcaguuggccauuaaaugaagcuauuauggcugucgguaugguauccaucuuagcuaguucccuacucaaaaaugauauaccuaugacaggaccccuaguagcugguggauuauuaacaguguguuacguacugaccggacgaucugcagauuuagaacuugaacgcgcuacugaugucaagugggaagaucaggcggaaauaucaggcucaucucccauauuauccauaacaauauccgaggauggcaguaugaguaucaagaaugaggaggaggaacaaaccuugacgauucuaauuagaacgggccuccuugugauaucuggauuauuucccauauccaucccgaucacagcggccgcaugguauuuaugggaaguaaagaaacaacgcgcagggguuuugugggaugugccuucaccaccacccauggggaaagcggaguuagaggauggagcuuauagaauuaaacaaaaaggaauuuuaggauacagccagauuggcgccgguguauauaaagaaggaacuuuccacacaauguggcauguaacaagaggcgcuguacuaaugcauaaagguaaacgcaucgaaccaucuugggcagacguuaagaaagaucuuauaucauacggaggagguuggaaauuggaaggggaguggaaagaaggugaagaaguacaaguacuugcacuggaacccgggaaaaacccccgagcgguucagacuaaaccgggucuguuuaaaacaaacacgggaacaauuggagcuguuucguuggacuucucuccugguaccucgggcucgccuauuauagacaagaaaggaaaaguaguaggccuguauggcaauggagugguuacucguuccggagcauacguuucagcuaucgcacaaacagaaaagucaaucgaggauaauccagaaaucgaggacgauauauuuagaaaacgucggcuaacgauuauggauuuacacccuggugcugguaaaaccaaaagguaucugccagcaauagugagagaagcuauuaaaagggguuugcguaccuugauacuagcuccuacgagaguaguagccgcagagauggaggaggccuuaagaggacuuccgauacgauaccaaacgccugcaauucgugccgaacauacgggaagagaaauaguagaccugaugugccaugccaccuucacuaugagauuauuaucaccggugcgggugccaaacuacaaccugaucauaauggacgaagcccauuucacugauccagcuuccaucgccgcuagaggguauauaucaacaagaguugaaaugggagaggcagcagggaucuucaugacugcaacacccccugguucucgcgacccauuuccucaaucuaacgcuccaauaaucgacgaagaacgagaaauaccggaaagaucguggaacucgggucaugaguggguuacugauuucaaaggaaagacgguuugguuuguuccaaguauuaaagcagguaaugacauagcagcguguuuacggaaaaaugguaagaaaguaauucaguugucacgaaaaacauucgacagugaauacguaaaaacuaggacaaacgauugggacuuugucguuacaacagauauaucggaaaugggggcaaacuuuaaggcggaacguguuaucgaucccagacgauguaugaaaccaguaauacuaacugacggagaggaaaggguaauuuuagcaggcccuaugccuguuacacacaguucagcagcucaaagaagagguagaauuggccgaaaucccaagaacgagaacgaucaauauauauauaugggagaaccccuugaaaaugacgaggauugugcgcauuggaaagaggcgaaaaugcucuuagacaauauuaauacuccugaagggauaauaccaucgauguuugagccagagagagaaaagguugacgcuauaguaggugaauauaggcuccgcggggaagcgaggaaaacuuucguagaccugaugcgacgaggagauuugcccguaugguuagcauacaagguagcugcagaaggaaucaacuacgcugauaggagaugguguuuugaugguaucaaaaauaaucaaauacuugaagagaacauggagguugaaauuuggacaaaagagggggagaggaagaaacugaagccgcgauggcucgaugcuaggauauauucggauccauuggcucugaaggaauuuaaagaauuugcugcugggaggaaauccuugacucuaaauuuaauuacagaaaugggacgauuacccacauucaugacccagaaaacacgggacgcauuagauaacuuagcgguacugcauacugcugaggcaggagggagggcauacaaucaugcacuaucggaacugccugaaacauuggagacccuacugcuacuaacacuccuagcaacaguaacugggggaaucuucuuauucuuaaugucaggaagagguauaggaaaaaugacacuaggaauguguugcauaauaacagcaaguauacuucuuugguaugcacaaauacaaccacauuggauagcugcaagcauaauauuagaauuuuuccucaucguuuuacuaauacccgaaccugaaaaacaacguacgccgcaggacaaccagcuaacauaugugguuauugcuauccuuacuguaguagcggcgacgauggcaaaugaaaugggguuccuggaaaagacuaagaaagauuugggacuaggguccauagcaacacaacaaccugaaucuaauauccucgauauagaccuaagaccagcaagugcauggaccuuguacgcaguagcaacuacauucguuacaccaaugcuucgucacucgauugagaacucaucuguuaaugucagucuaacggccauagcaaaucaagcuacaguuuuaaugggacuggggaaaggcuggccacuuagcaaaauggauauaggcguaccucuacucgcaauugguugcuacucccaaguaaauccaauuacacugacagcagcauuacuccuacucguagcacauuacgcaauaauaggacccggguugcaagcuaaggcgacuagggaagcacagaaaagggcagcagccgggauaaugaaaaauccaacaguugaugggauaacuguuauagauuuagaucccaucccauacgacccaaaauuugaaaaacaacuaggucaaguuaugcuauuaguuuuauguguaacacaagucuuaaugaugaggacuacgugggcacuaugcgaagccuuaacacuagcaacuggaccuaucaguacucuaugggaaggaaaucccggaagauuuuggaauacgacaauugcuguuucgauggcgaacauauucagaggaagcuacuuggccggagcuggacuucuguuuaguauuaugaaaaauacuacaaacacucgcaggggaaccgguaauaugggggaaacacuaggggagaaauggaaaucacgguuaaaugcauugggaaaaucagaguuccaaaucuauaagaaaagcggcauacaagaaguagaccguacuuuggcaaaagaggguauuaaaagaggggaaacggaucaccacgccguaagcagagguucugccaaacuuaggugguuuguggagaggaauaugguaacaccggaaggaaagguaguugauuugggcuguggucgcggaggauggucauacuacugugguggauuaaagaauguuagagaggucaaaggauuaacuaaaggggguccaggccacgaagaacccauuccaauguccacuuaugguuggaaucuagugaggcuacagagcgguguagauguauucuuuauaccaccagaaaagugugacacauuacuaugugauauaggugagucgaguccaaauccaacgguggaagcagguagaacgcuucgcguacuuaaucuaguagaaaauugguuaaauaauaacacgcaauuuugcaucaaaguucuaaaucccuacaugccuucagucauagagaaaauggaggcuuuacagcgaaaguaugguggugcauuaguacggaauccccugucccguaacagcacucacgaaauguacugggugagcaaugcaucaggaaacauugucucuucuguuaauaugauuaguagaaugcuaaucaauagauuuacuaugcgucauaagaaagcgacuuacgagccugacguggaucuugggucggguacucggaacauugggauagaaucugagaucccaaauuuagauauaauuggaaaaaggauagagaaaauaaaacaggaacaugaaacuagcuggcauuacgaccaagaucacccauacaagacgugggcauaucaugguucauaugagacaaaacaaacaggcucggcaucaagcaugguaaacggaguaguuagguuacuaacuaaaccuugggauguuuugccgacuguuacgcaaauggcuaugacugauacaacaccauuugggcaacaaagaguuuucaaagaaaaaguugauacucggacccaagagccgaaggaaggcaccaagaaauuaaugaaaauaacugccgaauggcuauggaaagaacucgguaaaaagaagacaccucguauguguacaagagaggaguucacgcgaaaaguuagaucaaacgcugcacucggagccauauucaccgaugaaaauaaauggaaaucggccagggaggcuguagaagauucaagguucugggaauuagucgacaaggaaaggaaccuacaucuagaaggaaaaugcgaaacuugcgucuauaauaugauggguaaaagagagaagaaacuaggggaguucggaaaagcgaaaggaucacgcgccauaugguauaugugguuaggagcacgauuuuuagaauuugaggcccugggguuucuaaaugaagaccacugguuuaguagggaaaauucucucucgggcgucgaaggcgagggccugcauaaacuuggcuauauacuccgagaugugaguaagaaagaaggaggugcuauguaugcagaugauacugccggaugggauacuagaguuacacucgaagacuuaaagaacgaagaaauggugacaaaucauauggaaggagaacacaagaaauuagcugaagcgauuuucaaacuaacguaucaaaauaaagucguacgagugcaaagaccuacgccuagagguacaguuauggauauuaucagccguagagaccaacgagguuccggccaaguaggcacuuacggacuaaauacuuuuacuaauauggaggcucagcucauaaggcaaauggaaggugagggggucuuuaaaaauauacaacauuugacuguaacugaagaaguugcuguuaaaaacugguuagcgagaguagggcgugaaagauuaaguagaauggcuauaucuggggacgacuguguaguaaaaccucuggaugaucgauucgcgaaugcucuuacggccuuaaacgacaugggaaagaucagaaaggauauucaacaaugggagccgucuagaggcuggaacgauuggacgcaaguuccuuuuuguucucaucacuuucacgaguugaucaugaaagauggaagaguauugguaguacccugccguaaucaagaugaauugauagggagagcucguauaucacagggcgcgggauggucuuuacgugaaacagcaugucucgguaaaucuuaugcccaaauguggagucuuauguacuuucacaggagagaccuccgacuugcagcaaacgcgauuuguucugcgguuccuagucauugggugcccacaaguagaaccacauggagcauucaugcgaaacaugaguggaugacaacggaagacaugcuaaccguguggaacagaguauggauuagagaaaauccuuggauggaggauaaaacaccugucgaaucgugggaagaaauaccauacuuggguaaaagagaggaucaguggugcgguagucuuauuggacugacauccagggcaacuugggcgaagaacauccaagcggcuauaaaucaaguucgcagcuuaauaggaaacgaagaauauacugauuauaugccuucuaugaagcgcuuucguagagaagaggaagaggcaggaguacuuugguag

SEQ ID NO: 22802 - RNA, 9876 nt, Artificial Sequence
  derived and/or modified CDS sequence (opt6) from DENV-2__KU094070__SS-prME
acugcagggaugauaauuauguugaucccaacagugauggcguuccauuugacgaccagaaauggagaaccacauaugauaguaucaagacaagaaaaaggaaaauccuuacuguuuaaaacagaagacggagugaauauguguacguuaauggcaauggauuuaggagaaugguuagaagauaaaauaacuuauaaauguccacuauuacgacaaaaugaaccagaagauaucgauuguugguguaauagcacaucaacguggguaacuuacggaaccugcacaacaacaggggaacacagaagagaaaaacggucaguugcauuggucccccacguugggaugggucuagaaaccagaacagaaacauggaugucuucagaaggagccuggaaacacgcgcaacgaauagaaacauggauuuuaagacauccaggauuuacgaucauggcagcgauauuagcauacacgauaggaacuacucacuuucagcgcgccuuaauauuuauacuauugaccgccguggcgcccaguaugaccaugcgauguauaggaaucucuaauagagacuucgucgaaggaguaucgggaggauccuggguagacaucgugcuagaacacggaagcuguguaacuacuauggcgaaaaauaaaccgacauuagauuuugaacuaauaaaaacggaagccaaacaaccggccacauuaaggaaauauuguauagaggcgaaacuaaccaauacgacaacagaaucucgaugcccaacacaaggagagccuucacuuaaugaagaacaagacaaaagguuuguguguaaacacucaaugguugaucgcggauggggcaauggaugugggcuauucgggaaaggcagcauaguaacaugcgcaauguuuacguguaagaaaauaaugaaaggaaaaguaguacaaccugaaaaucucgaguauacgaucguuauuacaccccauucuggagaggagcacgcagucggaaacgacaccggaaagcacgguaaagaaauaaagauuacaccucaaucaucuauaacugaggccgaauuaaccggauauggaacuguuacgauggaaugcucuccaaggacggggcuugauuucaacgaaauggucuuauuacaaauggagaacaaagccuggcucguacauagacaaugguuucuugauuuaccauuaccuuggcugccaggagccgacacacaagggucuaauuggauacaaaaagaaacauuagucacauucaaaaacccgcacgcaaagaaacaagauguagucguucucggcagccaagaaggagccaugcacacagcuuuaacaggagcaacugaaauacaaaugucgagcggcuaccuucucuuuaccgggcaccuaaagugccgccucagaauggacaaacuacaacuaaagggaaugucauacucuauguguacuggaaaauuuaaaguaguaaaagagauagcagaaacccaacacggcacaauagucauccguguucaauaugaaggugacgggucuccuuguaaaauuccuuucgagauuauggaucuugagaagcgucacguucuaggcagacuuauaaccguaaacccaaucgucacagaaaaggacagcccugugaauauugaagcagaaccaccauucggagacucauacauaauaauuggaguagaaccaggacaauugaaacugaacugguuuaagaagggaaguaguauaggacaaauguuugaaacaacuaugagaggagccaaacggauggcuauuuuaggcgauaccgccugggacuuugguucuuuggguggaguauuuacaucuauaggcaaggcacuacaucagguauucggggcuauuuauggugcagcuuuuaguggaguuucguggacuaugaaaaucuugacugggguuauuauuacuuggauaggaaugaacucaagauccacgagucuaucaguuucgcuuguacuugugggcgcaguaacucuauauuugggugucaugguucaagcugacagcggaugugugguaucguggaagaacaaagaacuaaaaugugguucagguauauucauaacagauaacguccauacguggaccgagcaguauaaauuucaaccugaaaguccauccaaauuagccagugccauacaaaaagcacaugaagaggggaucugugggauaaggucugugacuaggcuggagaaucuaauguggaaacaaauaacacccgagcucaaucacaucuuaucagagaacgaaguuaaacuuacuaucaugacaggugauauuaaagguauaaugcaagcugguaagagaucucugagaccacagccgacagaauuaaaguauagcuggaaaacgugggguaaagcaaaaauguuaucaacggagucacauaaucaaacauuuuugaucgacgggccagaaacugcagaaugcccaaauacaaacagggcauggaacuccuuagaaguagaagacuaugguuuugggguuuuuacaacaaauauauggcucaaauuaagagaggaacaagaugucuuuugugauaguaagcuaaugagcgcagcuauaaaagacaacagagcgguucaugcggacaugggguauuggauugaaucggcguuaaacgacacauggaaaaucgaaaaagcaucauucauagaaguaaaaaguugccauuggccaaagucgcacaccuuaugguccaauggaguucucgaaucagaaaugauuauaccuaagaacuuugcagggccaguaucccaacauaauuauagaccgggauaccacacucagaccgcaggcccguggcaucuugguaagcuagaaauggauuuugacuuuugugagggaacaacgguugucguuacggaggauugugggaauagggguccgucccuacgaaccacaaccgcuagcgggaaacucauaacugaaugguguuguaggaguugcacguugccgccacuaagauaccgaggggaagaugguuguugguacggcauggagaucagaccucuuaaagaaaaagaggaaaauuuggucaauuccuuaguaacagcaggacaugggcagauugacaacuuuucguuagguguuuuaggaauggcucucuuuuuagaagagaugcucagaacacgaguugggacaaaacaugcaauucuauuaguugcugucuccuuuguaacacucauuacaggaaauauguccuuuagggaucuaggaagaguaaugguuauggucggugcaacaaugacggaugauaucgggaugggugucaccuaccucgccuuacuagcggcauucaaaguaaggccaaccuuugcugcaggauuguuacuaaggaaauuaacauccaaggagcuuaugaugacaacaauuggaauuguacuuuuaucccagucaaccauaccugaaaccauacuugaacugacugacgcccuagcucuaggaaugaugguacuaaaaaugguacgaaaaauggaaaaauaccagcuagcaguaacaauaauggcaauuuuaugugucccaaaugcaguaauucugcaaaacgcauggaaaguaaguuguacaauauuagcugucguaucgguaagcccacuguuccuuacaaguagccaacaaaaagcagauuggauacccuuagcacuuacgaucaaaggguuaaauccaacggccauauuucuuaccacgcuaucgagaaccaauaagaaaagaucguggccauugaaugaagcuauuauggcaguuggaaugguaucaauacuugcuucgaguuuacuaaagaacgacauaccgaugacaggaccgcuagucgccggaggguuauuaaccguguguuacgucuuaacugggaggagugcggaccuggagcuggaacgcgcggcugauguuaagugggaagaucaagcagaaauaaguggaucaagcccaauacugaguauaacaauaucagaagaugggucgaugaguauaaagaacgaagaagaagaacagacguuaacaauauuaauuaggacggguuuauuagugauaucaggucuauuucccgucagcauaccuauaacggcagcggcuugguaccuaugggaagugaagaaacaaagagccgguguucucugggacguaccaaguccuccacccguaggcaaagcggaacuagaagauggagcuuaccgaauaaaacaaaaaggcauucuugguuauagucagauaggagccggaguauauaaagaagguacuuuccacacaauguggcacguuacuagaggcgcuguccuuaugcauaaaggaaaaagaauagagccgucaugggcugaugugaagaaagauuugauaagcuauggugggggcuggaaacuugaaggcgaauggaaagaaggggaagaaguucaaguccucgcucuagagccuggcaaaaauccuagagcagugcaaacgaaaccaggcuuguucaagacuaacgcaggaacaauuggcgcuguuucgcuugacuucagcccugggacaaguggcaguccuauaauagacaagaaaggcaagguaguuggccuauauggaaacggcguuguaacacguucgggagcauauguaucugcuaucgcucaaacagagaagaguauagaagacaauccagagaucgaagaugacauauuuaggaaaaggaaacucacuauaauggaccugcacccaggagcgggaaagacaaaaagauacuuaccggcuauagugcgagaagcaauaaaacgcggauuacguacacucauucuggcuccgacucguguuguagcagcagagauggaagaggcguugcgaggacuacccauaagguaccaaacgccagcuauacgggccgagcacacagggagagaaauuguagauuuaaugugccaugcuacuuuuacuaugagacuuuuaagccccguuagaguuccaaauuauaaucugauuauuauggacgaagcacacuuuacagauccugcaucgauugcugcccgaggauacauaagcacacgcguagaaaugggcgaggcugcuggcauauuuaugaccgcgacgccgccaggcucgagagauccauuuccucagucuaaugcaccgauaauggaugaagaacgagaaauaccagaacguagcuggaguucaggacacgaguggguuacugacuuuaaagguaagacaguaugguucguaccaucuauuaaagcaggcaacgacauagcagcuugccuccgcaaaaauggcaagaaaguaauucaauuaagcagaaagacauuugauucagaguauguaaaaacuaggacgaaugauugggacuuugugguuacaacagacauaagcgaaaugggagcaaacuucaaagcagaacgcguuauagacccuagaagguguaugaaaccagugauacuaacagauggugaggaaagaguuacgcucgcaggaccuaugccaguuacacacuccuccgcagcacagcgacguggacggauaggccguaauccgaaaaacgagaaugaucaauacauuuauaugggagagccuuuagaaaaugaugaggacugugcucauuggaaagaggcgaagauguuacuagauaauauuaacaccccggaggggaucauacccucgauguucgaaccugagagagaaaaaguagaugcgaucgauggagaguaucgacuacgaggggaggcucggaaaacuuuuguugaucuuaugagacgaggggauuuaccaguauggcucgccuaucggguagcagcagaaggaauuaauuacgcugaccggcgcugguguuuugacggaaucaaaaauaaccaaauauuagaggagaacgucgaagucgaaauauggacaaaggaaggugaaaggaagaaacuaaaaccacgauggcuagaugcucggauauauucagacccucuggcauugaaagaauuuaaagaguucgcggccggucguaaaucacuaacauuaaaucuaauuacagaaauggggagauugcccacauucaugacacaaaaggcacgagacgcacuagauaaucuugcuguacuucacacagcggaggcaggaggcagagcguauaaucaugcauuaucagaacuaccagaaacauuagaaaccuuauuacuuuuaaccuuauuagcuacugugacaggagggauuuuccuauuuuuaaugucgggaagaggaaucggaaaaaugacacuggggauguguugcaucaucacagcuucgauucucuugugguaugcucaaauucaaccacacuggauagcagcauccauuauuuuagaguucuuuuuaauagugcugcuaaucccagaaccugagaaacagcgaacaccucaagacaaucaauuaacauauguuguaaucgcaauacuaaccguuguagcugcgaccauggcaaaugaaaugggauuucucgagaaaacuaaaaaggaucuaggacuaggauccauaacaacccaacaaccugagucaaacauucucgauauugaccuuagaccugcuagcgcguggacucucuacgcaguagcgacuacuuuuguuacaccgauguuacgacauaguauagaaaacucuucagugaauguaucucuuaccgccaucgcuaaccaagcaacgguuuuaauggggcucggaaaaggcuggccacugucuaagauggacauaggaguaccacuauuagcgauagguuguuauucacagguaaauccuaucacucuuacugcagcucuauuccugcuuguugcacauuacgccauaaucggaccuggauugcaagcaaaagcuacucgggaggcccagaaacgagcugcugcgggcauuaugaagaauccaacuguagacggaauuacagugauagaccuagaucccauuccuuaugauccuaaauuugagaaacaauuaggucaaguaaugcucuuaguucuaugugucacacaaguauugaugaugagaacaacuugggcgcuaugugaagcucugacacuagcuaccggccccauaaguacacucugggagggaaauccugguagauuuuggaacacgacuauagcaguaucgauggcuaacaucuuucgcggcucuuaucuggccggagcgggacuauuguucucuaucaugaaaaacacaaccaacacacgaagaggaacuggcaacauaggcgaaacuuuaggagaaaaguggaaaucaagacuuaaugcacuugguaaaucagaguuccaaauuuacaagaaaucaggcauucaggaaguagaccggacucucgccaaagaagggauuaaacgaggggaaacugaccaucaugcaguuucacguggaucugcuaaacucaggugguucguugaaagaaaucuaguuacuccugaaggaaaaguugucgauuuaggcugcggacggggaggauggaguuauuauugugguggucucaaaaauguaagagaaguaaagggacuaacuaaagggggacccggacaugaagaaccaauaccaaugaguacguaugguuggaaucuugucaggcuacaaucugguguugauguauucuucacacccccagagaaaugugauacgcuuuuaugugauauuggagagagcucuccaaauccaacuguagaagccggaagaacacugagaguacugaacuuggucgaaaacuggcuuaacaacaauacucaguucuguaucaaaguucugaacccuuacaugccauccguuauugaaaagauggaggcucuacagcguaaauacgggggagcguuggugagaaauccacuaucccgaaauagcacgcaugaaauguauuggguaucuaaugcuucaggcaacauaguaucuagcguaaauaugauaucaagaaugcuaauuaauagguuuacgaugcgucauaagaaagcgacauacgaaccugaugucgaccuuggcucgggaacucgaaacauagggauagaaucggagauaccuaaucuugacaucauaggaaagcgaaucgaaaagaucaagcaagaacaugagacgucuuggcauuacgaucaagaucauccauacaagacaugggcauaucaugguucauacgaaaccaaacaaaccggaucagcaucauccaugguaaaugguguggucagauugcugacaaaaccuugggauguaguaccaaugguaacccaaauggcaaugacagacaccacacccuuuggacaacaacgcguuuucaaggaaaagguagauaccaggacucaagaacccaaagaggggacuaaaaagcugaugaaaaucacagccgagugguuauggaaagaguuggguaagaaaaagacuccucgcauguguacgcgggaagaguuuacucguaaagucaggaguaacgcugcccuaggagccauauuuacagacgaaaauaaauggaaaucggcaagagaagcaguagaagauucgcgauuuugggaguuaguugacaaagaaagaaaucuacaucuggaaggaaaaugcgaaaccuguguuuauaacaugaugggaaagagagagaaaaaguugggagaguucgggaaagcaaaaggcucuagggcaauuugguacauguggcuaggcgccagauuuuuggaauuugaagcauuaggauuccuuaaugaagaucauugguuuucaagggaaaacucacuaagcggggucgagggugaagggcuacacaaacuuggcuauauacuccgugacguaagcaagaaagaagguggagcaauguacgcagaugauacggccggaugggauacaaggaucacuuuggaagaucugaaaaaugaagaaauggugacaaaccacauggaaggugaacacaagaaacuagcagaagccauuuucaaauugacauaccaaaauaaaguggugagggugcagaggccaaccccgagaggaacagucauggauauuauaucuagaagggaccaacgcggaaguggacaaguuggaacguacggccuaaacacuuucacaaauauggaagcucaguugauacgccagauggaaggagaaggaguguuuaaaucuauucaacauuugaccgucaccgaagaaauugcaguacagaauugguuggcacgaguagggagagagaggcuaagucggauggcaaucagcggggaugauugcguagucaaaccucuugaugauagauuugcgucagcacugacugcacucaaugauauggggaaagugagaaaggauauccagcagugggaaccgucucgaggcuggaaugauuggacacagguaccauucugcucccaucauuuccaugaauugauaaugaaagacggaagaguacucguagugcccugcaggaaucaagaugaauuaaucggcagggcgaggaucucccaaggugcuggguggagucugcgcgaaacggcgugucuaggaaaauccuaugcucaaauguggaguuuaauguauuuucaccgacgagaccuaagacuugccgcuaacgcaauuuguucugcaguuccuucccacugggucccaacaucaagaacaacauggucaauacaugcuaaacaugaauggaugacuacagaggacauguuaacuguauggaauaggguuuggauacaggagaauccauggauggaagauaagacucccguugagagcugggaagagaucccauaucuaggcaaaagagaagaccaauggugcggcaguuuaauaggacugacaaguagaguuacuuggggcaaaaauauacagacagccauaaaccagguaagaucguuaaucggaaaugaagaauauacagauuauaugcccucaaugaagcgauuucgcagagaggaagaagaagcagggguucuaugguaa

SEQ ID NO: 22803 - RNA, 9876 nt, Artificial Sequence
  derived and/or modified CDS sequence (opt6) from DENV-2__FM210215__SS-prME
agugcagguaugauuguaauguuaauaccaaccguaauggcauuccaccugacuacgaggaacggcgaaccacauaugauagucgguauucaagaaaaagguaaauccuuauuauucaaaaccgaagauggaguuaauaugugcacguuaauggcaauggacuugggggaauuaugugaagauacgauaacauauaaauguccccucuuaagacaaaaugaaccugaagauauagauuguugguguaauaguacaaguacuuggguuacauaugggaccuguacaacaacaggcgaacacagaagggaaaaacgaucgguagcgcugguaccccaugucgguaugggauuagaaaccaggacugaaacauggaugucuagcgaaggugcuuggaaacaugcacaacgaauagaaaccuggauacucagacacccagguuuuacaauuauggcagcuauacuugcuuauacaauuggaacaacccauuuccaacgcguacuaauauucauuuuauugacagcaguggccccaaguaugacaaugcgcuguauaggcauuagcaacagagauuuuguagaaggggucucuggaggauccuggguagacauuguauuagaacaugguucauguguuacaacaauggcgaaaaauaaaccuacacuagauuucgaauugauaaaaacugaagccaaacagccagcaacucuaaggaaauauuguauagaagcaaaauuaacaaauacaacgacugagaguagguguccgacucagggagaaccuagccugaaagaagaacaggauaaaagauucguuugcaaacauucaaugguagauagaggcuggggaaauggaugcggacuauuuggcaaaggggguauuguaacgugugcuauguuuacauguaagaaaaacauggagggaaaaauuguacaaccggaaaacuuggaguacacaauuguuguuaccccgcauagcggcgaagaacacgcagugggaaaugacacugguaaacacggaaaagagauaaaaguaacaccccaaagcucaaucacagaagcagaacuuacagguuacggaacggugacaauggaaugcucacccagaaccggacuggauuucaaugaaaugguacuccuucagauggaaaauaaagccuggcuaguucaucgacaaugguuccuggauuugccauugccauggcuacccggugccgacaaacaggaaaguaacuggauacaaaaagagacucugguaacguuuaaaaauccgcaugcuaagaaacaggacguaguagucuuaggaagccaagaaggugcaaugcacacugcauugacaggugcuacagaaauacaaaugaguaguggaaacuuacucuucacgggacaucuaaagugcagacugagaauggauaaacuacaauugaaaggaaugucauacucuauguguacuggaaaauuuaaaguggucaaagaaaucgcagaaacccaacacgggaccauuguuauacgaguacaauaugaaggggacggaaguccaugcaaaauaccuuucgaaauaauggaucuagagaaaagguauguacuagguagauuaaucacaguaaaucccauugucacggaaaaagauucccccguaaauauugaagcagaaccaccguucggagauucuuacauaauaauaggcguugagcccgggcaacuuaaauuaaauugguuuaagaaagguuccagcauuggacaaauguucgaaacgaccaugagaggugcuaagagaauggcgauucuuggagauacggcaugggauuuuggauccuugggcggaguguucacaucaauugguaaagcguugcaucaaguauuuggagcgaucuacggagcagcauucucagguguuagcuggacuaugaaaauacuaauaggcgugaucauuacauggauaggaaugaauaguagaucgacaucuuuaucaguauccuuggugcuaguugggauaguaacucuauauuuaggaguaaugguacaagcagacagcgguugugucguaucauggaaaaauaaagaauugaaguguggaucugggauuuucauaacagacaauguacacacauggacugaacaguacaaauuccaaccggagucaccguccaaauuggcuucagccauacagaaggcccaagaggaagguauaugcggcauacguucgguaacucgacucgaaaaccucauguggaagcaaauuaccccugaauuaaaucacauacucgcagagaaugaaguaaaguuaacgaucaugaccggagauauuaaaggaauaaugcaagcaggcaagcguucucugcgaccucaaccuacagagcuaaaauauagcuggaaaacaugggguaaggccaagaugcuaagcacugaaagcuauaaucagacauuuuuaauugacggccccgagacagcagaguguccuaauacgaauagggcauggaacucacuagagguagaagacuacgguuuuggaguguucacaacaaacauuuggcuuaagcuaaaggaaaaacaagaugcguuuugcgacucuaagcuaaugucggcagcuauaaaggauaaucgcgcaguacaugcagacaugggauacuggauagaaucugcauuaaaugauacuuggaaaauagaaaaagcuagcuuuauugaagucaaaaauugccacuggccuaaaucgcacacacuuuggaguaacggaguacuugaaucagagaugauaauuccuaagaaccuugcggguccuguuucacaacacaauuauagaccuggcuaucauacucaaauagccgggccauggcaucuagggaaauuggagauggauuucgacuucugugaugguaccacuguaauugugacugaggacuguggaaacagaggccccagucuaaggacaacaaccgcgaguggaaaacuaaucaccgaauggugcuguagaaguuguaccuuacccccacuaagauacagaggggaagaugguuguugguacggcauggaaauuaggccauuaaaagaaaaagaagagaaucugguuaauagucuagucacugcuggacacggacaaguggacaacuucagccuugggguacuuggaauggcgcuauuuuuagaggaaauguugaggacaaggguggguacaaaacacgccauauugcuuguagccguaucauuugucacuuuaauuacaggcaacaugucauuuaaggaucuaggcaggguaguagugaugguaggggcuacgauggcggaugacauaggaaugggaguaacguacuuagcgcuuuuagcggcauuuaaagugagaccaacauuugcagcuggacuccuacuacgaaaacugacaagcaaagaauuaaugaugacgaccauugggauaguucuacuaucucaaagcaccauaccggaaacaguacucgaacugaccgaugcacuagcauuaggaaugaugguuuuaaaaauuguacguaacauggaaaaauaucaacuagcggucacaauuauggcaauucuaugugugccaaacgcggugguauuacagaacgcauggaaagugucuuguacaauacuggcuguuguuuccguuagcccgcuuuuacuuacuagcagccaacagaaaacugauuggaucccauuagcuuuaacgauuaaaggccugaacccaacagcaaucuuuuuaaccacauuaucacgaacgaauaagaaaaggucauggccacuaaaugaagccauaauggcagugggaaugguuucuauccuugcuuccucauuacuaaagaaugauaucccaaugacagguccauuggucgcugguggguuauuaacgguaugcuauguccuaaccggcagguccgcagacuuagaacuugaaaaagcaacagaugucaaaugggaagaucaagcagaaaucaguggcuccaguccaauuuuaagcaucacuauuucugaagauggaagcaugagcauuaagaaugaagaagaagaacaaacacugacgauacuaauacggaccggauuacucgugauuaguggauuauuuccuauaucgauaccuauuaccgcggcugccugguaucuaugggaagucaagaaacaacgagccgggguucuaugggauguaccgagcccaccuccaaugggcaaagcagagcucgaagacggggcauaccgaauaaaacagaagggaauauugggcuacagccaaauuggagcuggcguguauaaagaggguacuuuucauaccauguggcaugugacaagaggcgcaguacuuaugcauaaagguaaacgcauagaaccaucuugggcggacgucaagaaagauuuaauaucauaugguggaggguggaaauuagaaggagaauggaaagagggggaagaaguacaaguauuagcauuagaaccggguaaaaauccacgugcuguucaaacaaaaccaggucuauuuaaaacaaacacagguacgauaggagccgucaguuuagauuuuucuccaggaacaaguggcaguccaauaauugauaagaaagggaaagucgucggccuauauggaaacgguguaguaaccagaucaggagcguacguaucagcaauagcucagacagagaaaagcauagaagauaauccagagauugaagaugacauauuucggaaaagacgacugaccauaauggacuuacacccuggcgcuggaaagacgaaaagauauuuaccugcaaucguuagggaggccauaaaacgaggcuugagaacuuuaauuuuagcuccaacgcguguaguagcagcugagauggaagaagcauugagagguuuaccuauuagauaccagacuccugcaauaaaagcagaacauacaggaagggaaaucguagaucuaaugugccaugcaacauuuacgaugagacuccuaucuccagucagaguaccaaacuauaaucuaaucaucauggaugaagcucacuuuaccgacccugcaagcauugcagccagagguuacauuucuacucgaguggaaaugggagaggcagcgggaaucuucaugacagcaacaccgccagggucacgagauccauucccucagucuaacgcucccauaaucgacgaggaacgagagauuccugaacguaguuggaacucgggacaugaguggguuacagauuuuaaggggaagacggugugguucguaccaucaauuaaagcugguaaugauauagcggcuugcuugcggaaaaauggaaagaaaguaauacaacuaucacgaaaaaccuucgauucagaguacgucaaaacuaggacuaaugauugggacuuuguaguaaccacugacauaucagaaaugggggcuaauuuuaaagcugaaagaguaauugacccuagaagauguaugaaaccuguaauacuaaccgacggugaagaaagagucauuuuagcaggcccuaugccuguaacacauaguucugcugcacaaaggcgaggaaggauaggucgaaaucccaaaaaugagaaugaucaauacaucuacaugggagaaccacuggaaaaugaugaagauugugcucauuggaaggaagcuaagaugcuuuuggacaauauaaauacuccagaaggaauaauaccaaguauguuugaaccagagagagaaaaaguagaugcaauugacggugaguauagacugcgcggugaagcucgcaaaacuuucguagaccuuaugcgacggggagauuuaccaguuugguuagcauacaagguagcggcagaaggcauuaauuaugcagaccgacgaugguguuuugauggaaucaaaaauaaccaaauauuagaagaaaauguugaaguugaaauauggacaaaggaaggugaaagaaagaaacuaaaaccgaggugguuggaugcuagaaucuauuccgacccacuagcauugaaagaauuuaaagaguucgcugccggccguaagagucuaacacuaaaucugauaaccgaaauggguaggcuacccaccuuuaugacucagaaaacuagagaugcauuggacaaucucgcuguuuuacacacggcagaagccggaggacgagccuacaaucacgcgcugagcgagcuaccugagacguuagaaacauugcugcuauugacauuacuggcuacagugacgggagguauuuuccucuuucugaugucaggucguggcauaggaaagaugacauuggguauguguuguauuauuaccgcgucaauacuucuuugguacgcacaaauacaaccacacuggauagcggccaguaucauauuggaguucuucuuaaucguacuucucauuccagaaccagaaaaacaaagaacaccccaagauaaucaacugacauauguagugauugcaauucuuacugucguagcagccacaauggcaaaugaaaugggauuucucgagaaaacuaagaaagaucucgggcuuggaagcaucgcaacucaacagccagaaaguaauauacuugacauagauuugagaccagcgucggcuuggacuuuguaugcgguggcgacaacauucguaacuccaauguuacgacauaguauagaaaauaguagugugaacguaagucuaacagcuauugcgaaccaagcuacuguacuaauggggcuaggaaagggcuggccccuaaguaagauggacauagggguaccccuauuggcuauaggauguuacucccaaguaaauccaaucacacugacagccgcauuauugcuauuaguggcacauuaugcuauaauagguccuggacuacaagcaaaagcgacucgggaagcacaaaagcgcgcagcagcaggcauaaugaaaaauccuacuguggacggcauaaccgugauugaccuugacccaauaccguaugauccaaaauuugaaaagcaacuaggacaaguuaugcuacuuauuuuauguguuacacaaguauuaaugaugcgcacuacgugggcacugugugaggcuuuaacacuagcuacggguccuaucucgaccuugugggaggguaauccugggagauucuggaauacuaccauugcuguuuccauggcgaauaucuuucgaggaaguuaucuagcgggugcuggucuacuguucucaauaaugaaaaacaccaccaauacgcggcggggaacgggaaacauaggggaaacucucggggaaaaguggaaaucucggcucaacucccuaggaaaaagugaauuucaaauauacaagaaaucugguauucaagaaguugauaggaccuuagcaaaagaaggaauaaaaagaggcgagacagaccaucaugcagucagcagaggcucagcaaaauuacgaugguucguagaaaggaauaugguuacucccgaagguaaaguuguugacuuaggauguggcagaggaggauggucuuacuauuguggaggccuaaaaagcguucgcgaaguuaaagguuuaacaaaaggagggccgggucaugaagaaccgauaccaaugagcacauacgguuggaaccuagucaggcugcaaucuggagucgacguauucuuuauaccuccagaaaagugugacacacuacuaugcgacauaggugaaucgucuccuaaucccacagucgaagcgggaagaacuuuaagaguucugaaccuugucgaaaauuggcuuaacaacaauacucaauucugcauuaaaguauuaaauccauauaugccgucuguaaucgagaaaauggaagcucuacagagaaaauauggaggagcacucguaagaaacccacuaucaagaaacagcacccacgaaauguacuggguaucaaacgcuucaggaaauaucguauccaguguaaauaugauuucccgaauguugaucaauagauuuacuaugagacauaaaaaggcgacuuaugaacccgacgucgacuuggguuccggcacaaggaacauagggauugaauccgaaauuccuaauuuggacauaaucgguaaacguauugaaaagauuaaacaagagcaugaaacaagcuggcacuacgaccaagaucaccccuauaaaacuugggcuuaucauggcagcuacgagaccaagcaaacuggcuccgcaucaucgauggugaauggugugguuagguuauuaacuaaacccugggauguacuuccgacaguuacccaaauggcaaugacagacacaacuccauuugggcagcaaagaguuuuuaaagagaaaguagacacccgaacacaagaaccaaaagaagguacgaagaaauuaaugaaaauaaccgcggagugguuauggaaagaacuggggaagaagaaaacaccacguauguguacaagagaggaauuuacaagaaaaguuagaaguaacgcggcccuaggugccauuuucacagaugaaaauaaauggaaaagugcgcgagaagcuguggaggauagucgguucugggaauuaguggacaaagaaaggaacuugcauuuagaaggaaaaugcgagacuuguguauacaacaugaugggaaaaagagaaaagaaacugggagaguucggcaaagcgaaaggaucccgagcgauuugguacauguggcucggagcuagauuucuugaguucgaggcuuuaggauucuuaaaugaggaucauugguuuagucgagaaaacucuuugagcgggguugaaggcgaaggucuacacaaacucggauacauuuuacgggauguaagcaagaaagagggcggcgcaauguaugccgaugauaccgcuggcugggauacucguauuacacuagaagaucucaaaaaugaggaaaugguuacuaaucacauggaaggagaacacaagaaacuugcugaagcuauuuucaagcugaccuaccaaaacaaaguaguacgaguacagcgaccgacuccacgugguaccgugauggauauaauuagucggcgugaccagagggguucuggacaaguaggaacuuacggucugaauacauucacaaacauggaggcucaacugauucgucagauggagggagaaggaguuuucaaaaacauucaacaccuaaccgucacagaagaaguggcgguucagaacugguuagcuaggguagggcgagagagguugucccgcauggcaauaucgggugacgacugugucgucaaaccacuugacgauagguuugccaacgcccuuacugcccuuaaugacaugggaaaaauaaggaaagacauucaacaaugggaaccgucuaaaggcuggaacgacuggacccaggucccguuuuguucucaucauuuccaugaacuaauuaugaaagacgggaggguccuuguaguaccaugcagaaaucaagaugaacuuauugggagagcaagaauaucccaaggcgccggguggagucugagggagacggccuguuugggcaaaucauacgcccagauguggucccuaauguacuuucauagacgggaccuuagacuagcggcgaaugcaaucugcucagcagucccaucacacuggguuccaacuucuagaacuacuuggaguauucacgccaaacaugaauggaugacgaccgaggacauguuaacuguguggaacaggguauggauuagagagaauccauggauggaagauaaaacuccaguugagucuugggaagaaauaccuuaccucggaaagcgggaagaccaauggugcggguccuuaaucggauuaacaagcagagccacgugggccaaaaauauacaagcggcaauuaaccagguacgcucuuugauaggaaacgaagaauacacggauuacaugccuucaaugaaaagguuccggcgagaagaagaggaagccggcgucuugugguag

SEQ ID NO: 22804 - RNA, 9876 nt, Artificial Sequence
  derived and/or modified CDS sequence (opt6) from DENV-2__FM210216__SS-prME
agugcuggcaugauaaucauguuaaucccaaccguaauggcauuucaucucacgacuagaaacggggagccccauaugauaguagggauucaagagaaagguaagucacuucuguucaaaacugaagauggcguaaauaugugcacauuaauggcaauggaucuaggagaauuaugcgaagacacuauuacuuauaaauguccgcuccugagacagaaugaaccagaagauaucgacugcugguguaacucuacuaguacauggguaaccuacggcacguguacaacaacuggggaacauagacgagaaaaaagaucaguagcacuagugccacacguaggaaugggacuagagacaaggaccgaaacuuggaugaguucugaaggggccuggaaacaugcgcaacgcauagagacuuggauucucagacacccgggcuucacgauuauggcggcaauucuugcuuauacaauaggaacuacacacuuucaaagagugcugauauuuauauuauuaacagcaguagccccuuccaugacgaugcguuguauagggaucagcaacagggauuucguagagggaguauccggggggucauggguugacauuguucuagaacacggaucguguguuaccaccauggccaaaaauaaaccaacacucgauuucgaacuaauaaaaaccgaagccaaacaaccagcgacauuaagaaaauacuguauagaagcgaagcucacaaauaccacgacagaaucgagauguccaacucagggcgaaccaagucuuaaggaggaacaggauaaacgauuugugugcaaacauucaaugguagacagagguuggggaaacggaugcggcuuguuugguaaaggagguauaguaacuugcgccauguuuacauguaagaaaaacauggaaggaaagauaguacaaccagaaaaucuagaauacacaaucguaguuacaccucacucaggagaagaacaugcugucggaaaugauacagguaaacacggaaaagaaauuaaggucacgccacaaaguucaaucaccgaggcagaacuuacaggauaugguacaguaacaauggaauguucacccagaacaggcuuagauuuuaacgaaauggugcuauuacaaauggaaaauaaagcuuggcuuguccacagacaaugguuccuggaucuaccguugccguggcuuccaggugcugauaaacaggagucuaacuggauacagaaagaaaccuuagugacauuuaagaacccgcaugcuaaaaagcaagacgucguaguacuggggagucaggagggugccaugcacacagcccuuaccggugccacagagauacagaugaguuccgguaaucugcuauucacagggcaucuaaaauguaggcuucggauggauaaacuacaacuuaaagguaugucguacucaaugugcacaggcaaauuuaaaguagugaaagaaauagcagaaacacaacacgggaccaucguuauacgagugcaguaugaaggagaugguagucccuguaagauaccuuucgaaauaauggaucuugaaaagagauacguacuagggagacuuauuacuguuaauccgauuguuacagaaaaagauagccccgucaacauugaggcagaaccaccauucggggacucauauaucaucaucgggguugaaccgggucaacugaaacuaaauugguucaaaaagggaaguaguaucgggcagauguucgaaaccaccaugcguggagcaaagcgaauggcuauccuaggagauacggcaugggacuucgguuccuuaggcgggguauuuacuagcauaggaaaagcccuccaucaaguauuuggugcuauuuacggggccgcauuuaguggugugaguuggacuaugaaaauucucauuggagucauaauuacauggauuggaaugaacucgcguagcacaucacuuucggucagcuuaguauugguaggaauagugacacuauauuuggguguuaugguacaggcugauucaggcugugugguguccuggaaaaauaaggaauuaaaguguggaucuggaauuuuuauaacugacaacguucacacauggacugaacaauacaaauuccaacccgaaaguccaucaaagcuggccucagcaauccaaaaagcgcaggaagaggggauaugugggauaaggucgguaacgcguuuggagaaucuaauguggaaacaaauaacgccugaacuuaaucauauccuugcagaaaaugaagucaaacuuaccauaaugaccggggauaucaaaggaauuaugcaagcggggaagagguccuuacgcccacagccuaccgaacuaaaauacucuuggaaaacuuggggaaaagcuaagauguugagcacagagaguuacaaccagaccuuccucauagaugggcccgagacaacugaauguccaaacaccaauagggcauggaauucucuggagguggaggacuauggguuugguguauucacgacaaacauauggcucaagcuuaaagaaaaacaagacgcguuuugcgauaguaaauuaaugagcgcggcaauaaaagauaauagagcaguccaugcugacaugggauauuggauugaaucggcacugaaugacacuuggaaaauagaaaaagcaucuuucauugaaguaaaaaauugccacuggccgaagucacauacucuaugguccaauggaguguuagaaucugaaaugauaaucccaaagaacuuagcaggcccugucucucaacauaauuaccguccaggauaccauacacaaaucgcggguccauggcaccucggaaaacuggagauggacuucgauuuuugugacgggacgaccguaauagucacagaagauugcgguaauagagggccaagucuuagaacaacuacggcaucagguaaguuaauaacagaauggugcuguagaaguuguacucuaccucccuuaagauauagaggggaagauggaugcugguacgggauggagauacgaccgcuaaaagaaaaagaggaaaacuuagugaauagccugguaacagcgggacauggucagguagauaacuuuucccuaggcguucuaggaauggcgcuuuuucucgaagaaaugcuaagaacgcgcguaggaacgaaacacgcgauacucuugguagcggugaguuuuguaacccuaauaacgggaaauaugucauuuaaagaccucggaagagugguaguaaugguuggagcuacaauggcugacgauauugguaugggaguuacauaucuugcccuuuuggcggcauucaagguaagaccuacauuugcggcaggauuacuacuuaggaaacugacauccaaagaacuaaugaugacuacaauagguauaguccuuuuaagccaaaguacaauaccggaaacugugcuggagcuaacagaugcgcuugcuuuggguaugauggugcuuaaaaucguacgaaacauggagaaauaccaauuggcggucaccauuauggcaauacuuuguguacccaaugccgugauucuucaaaaugcguggaaagucucuuguaccauacuagcuguuguuuccguauccccuuuauuauugacuaguucgcaacaaaagacagauuggaucccccuugcccucacgauuaaagggcugaaucccacugcaauauuuuuaacgacauuaucgagaacgaacaagaaacgaucguggccgcugaacgaggcaauuauggcaguuggaauggucucaauuuuagcgaguagucuguugaaaaaugauauuccaaugacaggaccauuaguugcuggugguuuauuaacuguaugcuauguauuaacagggcgaucggccgaucuagaguuagaaagagcaacugacguaaaaugggaagaucaggcagaaauaucuggaagcaguccaauccuuuccauaaccauuagcgaagauggcucuaugucgauuaaaaacgaagaagaggagcaaaccuuaacgauccugauuaggacaggccuuuugguaaucucagggcucuuccccauaucaauuccgauaacagcggcggcuugguaucucugggaagucaagaagcaacgugcugguguacuaugggacguuccaucaccuccucccaugggaaaagcugaacuagaggauggcgcauauaggauaaaacagaaagguauuuuggguuacagccaaauaggagcggggguuuauaaagaaggcacauuucacacgauguggcauguaacccgaggcgccguucuuaugcauaaggggaaaaggauagaaccaaguugggcggauguuaagaaagauuuaauaagcuaugggggaggauggaaacuagaaggagaauggaaagaaggagaagaaguacaagugcucgcauuagaaccgggcaaaaacccaagagcaguucagaccaaaccagguuuguuuaaaacuaacacaggaacgauaggugcgguaagccuugacuuuucaccuggaacaucaggaucucccauaauugauaaaaaaggaaaaguaguaggauuguacgguaacgguguuguaacucgauccggagcuuacguaucagccaucgcacagacggaaaaguccauagaagauaacccugagauagaagaugacaucuuucgaaaaagacgccuaacgauaauggaucugcauccgggcgcaggaaaaacgaaaagauaccuaccugcgauaguaagagaggcgauaaaaagaggacuacgaacgcucauacucgcgccaacaagagugguagcugccgaaauggaagaagcccuacguggauuaccaauaagauaucaaacaccugcaauccgggcugaacacaccggaagggaaauuguggauuuaaugugucacgccaccuuuacaaugagauuacucucaccgguuagagucccaaacuacaacuuaaucauuauggacgaagcccacuuuacagauccugcaagcaucgccgcgaggggguacauaucgacacgaguagagaugggggaagcugcgggaaucuucaugaccgcuaccccaccaggcagccgagauccguuuccacaaucaaaugcaccgauaauagacgaagaaagggaaauaccggaaagaagcuggaacaguggucaugaauggguuacagacuuuaaaggaaaaacaguaugguuuguuccgucuauaaaagcuggaaaugacauagcagcauguuuacgaaaaaauggaaaaaaaguuauucaacuaucacgaaaaacuuucgauagugaauaugugaaaacgaggacaaaugacugggacuuuguagucacuacugauauaucagagaugggagcuaauuuuaaggcagaaagaguaauagaucccaggagaugcaugaaaccuguuauacucacagacggagaggaacguguaauccuagcagguccgaugccagucacacauaguucggcggcacagcgcagggguaggauaggaaggaacccgaaaaaugagaaugaucaauauaucuauaugggggaaccacuagaaaaugaugaggacugcgcucauuggaaagaggcaaagauguugcuagauaacauuaauacaccagaagguaucauacccucaauguuugaaccagaacgugaaaagguggacgcaaucgacggggaauacagauuacggggggaagcucgaaagacauucguagaucuaaugagacggggagaucuaccuguuugguuggccuauaagguugcggcagaggggauaaauuacgccgauaggaggugguguuuugaugguauuaaaaacaaccagauuuuagaagaaaauguagaaguugaaaucuggacaaaagagggagaacgcaagaaauuaaagccucgauggcuagaugcucguauuuacagcgauccacuggcauuaaaagaauuuaaagaauucgcugccggacgcaaaagccucacccuaaaccuuauuacagaaaugggacgucuuccuaccuucaugacacaaaagacgagagacgccuuagauaaucuggcuguguuacauacagcagaagcagggggcagagccuauaaucaugcuuugucagaacuuccagaaacguuggaaacauuguuacuacuuacacuuuuagcaaccguaacaggagguauauuuuuguuuuugaugucagggcgcggaaucggaaaaaugacauuagguauguguugcauuauuacugcaucuaucuuacuaugguaugcacaaauacaaccgcacuggauagcugcaagcaucauuuuagaauuuuuuuugaucguccuauuaaucccagaaccggaaaaacaaagaacaccacaagacaaccagcuaacguacguaguuauugcuauacuaaccguaguagccgcaacgauggcgaaugaaaugggauuuuuagagaagacaaaaaaagaucuaggacuuggaucuauagcaacacaacaacccgaaaguaauauuuuagauauagaucuaagaccggcuagugcuuggacacuauaugcuguagccacaacauucgucacacccauguugcgacacuccauagaaaacagcucuguaaacguaucauuaacagccauugcuaaccaagccacuguauuaaugggucuaggcaagggcuggccacucucaaagauggauauaggagucccacuuuuggccauaggauguuauagucaaguuaacccuauuacauuaaccgcggcucuccuguuacuuguagcucacuaugcaauuauugggccaggccuacaagccaaagcaacuagagaagcucagaaacgagcggcugcuggaauuaugaaaaauccaacuguugauggaauuaccguuauugauuuagacccaaucccauaugauccaaaauucgaaaaacaguuaggucaagucaugcuauugauacuaugcguaacgcaaguacuaaugaugagaaccacaugggccuuaugugaagcuuuaacgcuggcaacuggcccaaucucaacauugugggaagguaauccuggcagauuuuggaacacaacgauugcagucucaauggcuaacauuuuccgaggaucuuaucuagcgggggcugguuuauuauucuccauaaugaagaauacaacaaauacccgcagagguacugggaauauaggagaaacccuuggugaaaaauggaaguccaggcuaaaugcauuggguaagucugaauuucaaauauacaagaaaaguggaauacaggaaguagauagaacguuggcaaaagaggguauuaagagaggagaaaccgaucaucacgccgugaguaggggaagugccaagcuacgaugguuugucgagagaaacaugguaacaccugaggguaaaguuguagaccuugguuguggacggggaggguggucuuauuacuguggugguuuaaaaaauguuagagagguaaaaggauuaacuaaaggaggaccaggccacgaagaaccgauaccgaugucgacuuaugguuggaacuuaguucgauuacagucagguguggauguauucuuuauuccaccagaaaaaugugauaccuuacuaugugacaucggagaaucuucaccuaacccgacggucgaagcaggaaggaccuuaagaguacucaaucuaguagaaaacugguugaauaacaauacacaauuuuguaucaagguucuaaacccguacaugccauccguaauagaaaagauggaagcacuacaaagaaaauacggaggugcucucguaagaaacccacuuucuaggaauucaacucaugagauguacugggucucaaaugcaagcggaaacauagugagcaguguaaauaugauuaguagaaugcuaauuaacagauucaccaugagacauaaaaaagcuacuuaugagccagacguagaucuugguucagguacgagaaauauagguaucgaaagcgaaauuccaaauuuagauauaauugguaagagaauagaaaaaauuaaacaagaacacgagacgucauggcauuaugaucaagaucaucccuauaagacuugggcuuaccaugggagcuaugaaacaaagcaaacuggaucggccucuagcaugguaaauggaguaguacgauuacuuacgaaaccgugggauguacugccuacuguaacacagauggcaaugacagauacaacaccuuucggccaacagagaguauuuaaagagaaaguggacacaagaacacaagagcccaaagagggaacgaaaaaauuaaugaaaauaaccgcugagugguuauggaaggaacucgggaaaaaaaagacuccccgaaugugcacccgggaagaauuuacgagaaagguuagaaguaaugccgcauugggagcuauuuucacugaugaaaauaaauggaaauccgcuagggaagcaguggaagacucucgauucugggaacuaguugauaaagaacguaauuuacauuuagagggcaaaugcgaaacuuguguauacaauaugauggguaaacgggagaaaaaacucggcgaauucgguaaagcgaaaggaucccgcgccauaugguacaugugguuaggugcgcguuuccuugaauuugaagccuuagguuuuuuaaaugaagaccauugguuuucuagggagaauucacucucuggugucgaaggagaaggccuucauaagcucggguauauauuaagagaugucucaaagaaagaaggaggagcuauguaugccgacgacacagcagguugggauacucgaauaacuuuagaagaucuuaaaaaugaagaaaugguaacgaaucauauggaaggagaacauaaaaaacuugcugaagcaauauucaaauuaacauaccaaaacaaagugguccgaguacaaaggccaacuccgagaggcacaguaauggauauuauaagucgucgagaucaaagaggaucaggacaaguaggaacguacggauuaaacacguuuacuaacauggaggcacaacugauccgacaaauggaaggugagggaguuuuuaagaacauucagcaccugaccguaaccgaggaaguagcaguacaaaacuggcuagcacgcguagguagggagagauuaucaaggauggcgaucagcggagacgacugcguuguaaaaccguuagacgaucgauuugccaaugcccuuacagcacuaaacgauaugggaaaaauacguaaagacauacaacaaugggaaccaucuaaggguuggaacgauuggacacaagugccauucuguucacaucauuuucaugaacugauuaugaaagauggaagagugcucguaguuccauguaggaaucaggaugaacuuauaggcagagcuagaauaagccaaggagcaggauggagucucagagaaacggcuuguuuggggaaaaguuacgcucagauguggucauuaauguacuuucauagacgagacuuaagauuagccgcuaaugcaauuuguucugccguaccgagccauuggguucccacaaguagaacuacuuggagcauucaugcgaaacacgaauggaugacaacggaggauaugcuaacgguauggaacagaguauggauacgugagaaccccuggauggaagacaaaacaccaguugaauccugggaagaaauaccguauuuagguaaaagagaagaccaaugguguggaucguuaauagggcuaacaucgagggcaaccugggcgaagaauauucaggcugccaucaaucaaguccgaucuuuaauugguaaugaggaauauacagauuacaugcccucuaugaaacgcuuuaggcgugaagaagaagaagccggaguguuaugguag

SEQ ID NO: 22805 - RNA, 9876 nt, Artificial Sequence
  derived and/or modified CDS sequence (opt6) from DENV-2__FM210217__SS-prME
acugcaggcgugaucaucauguuaaucccaacagcgauggcauuucacuuaacaacucgaaacggagaaccacauaugauagugggacggcaggaaaaaggaaaaaguuuacuuuucaaaacagaagauggaguaaauaugugcacacuaauggcuauugauuuaggugaacuuugugaagauacgauuacauacaaauguccuuuauuacgucaaaaugaaccugaagacauugacugcugguguaacuccacauccacuuggguuacguaugguaccuguacaacaacuggugaucacaggagggagaaaaggucaguagcauugguaccacaugugggaaugggauuagaaacuagaacagaaacauggaugagcucagaaggcgcauggaaacacgcacagcgaauagaaacauggauauuacgccacccagguuucacaauaauggcugcaauucuagcauauacagugggaacgacacauuuccagagagcauugauauuuauauuacuagcugcaguagcaccuuccaugacaaugcgaugcauaggcaucucgaauagagauuuuguagaaggaguuaguggaggaucuuggguugauaucguuuuagaacaugggucauguguaacgacgauggccaaaaauaaaccaacacuggauuucgaacucauuaaaacagaagcaaaacaaccagccacuuuaagaaaauacuguauagaagcaaaacugacaaauacuacaacggaaucacggugcccuacccaaggagagccaagccucaacgaggaacaagauaaaagauucguauguaaacacucuauggucgaucgcgguuggggcaauggauguggauuguuugguaaagguggaauuguaaccugcgccauguuuacaugcaagaaaaacauggaagggaaaaucguucaaccagaaaaucuugaguauacaauaguuauaacuccgcacaguggagaagaacacgcugugggcaaugauaccgggaagcaugggaaagaaauuaaaauuacuccacagaguccuauuacugaggcggaauugaccgguuaugggaccguaacaauggaaugcaguccccgcacagguuuggacuucaaugaaaugguguuguuacaaauggaagauaaagcaugguugguccauaggcaaugguuccuugaucuaccguuacccugguuaccaggugcagacacgcaaggaagcaacuggauacaaaaggaaacccuaguuacauuuaaaaauccacacgcgaagaagcaagauguagucguacugggaucacaagaaggggcaaugcauacugcacucacaggagcaacagaaauacaaaugucaagugggaaccucuuauuuacuggucaucuaaagugucgauugcggauggauaaacuacaguuaaaaggcaugagcuacagcaugugcacaggaaaauuuaagauugucaaagaaauugcggaaacgcagcauggaacaaucgugauaaggguacaauacgaaggggaugguucaccuugcaaaaucccauucgaaaucauggaccuagagaaacgacacgugcuuggaagguuaauaaccguaaauccuauaguaacugaaaaagacucgccugugaacauagaagcagaaccuccuuucggcgauucuuacaucauaaucggcguugaaccaggacaacuaaaacucaacugguuuaagaaagguucaaguauaggccaaauguuugagacuacuaugagaggagcaaaacguauggcaauacuaggagauacagcuugggacuucggcagcuugggaggaguuuucaccucuauagguaaggcacuacaccaaguauucggugcaauauacggggcagcauuuucuggaguuucauggacaaugaagauauuaauaggcguaaucaucaccuggaucggaaugaacagucgcagcacgucucuaagcguaaguuugguuuuaguugguguaauaacacuuuaccuuggagcaaugguccaagcugauucaggauguguaguaagcuggaagaacaaagagcucaaauguggaucuggcauuuuuauaacagauaauguacauacuuggacagagcaguacaaguuccaaccugaaucuccaucaaaacuggccagcgcgauccaaaaagcacacgaagaaggaauaugcggcauacgaucaguuacacgacuagagaacuugauguggaagcaaauaacaccagaacuuaaucauauuuuauccgaaaacgaaguaaaauuaacuauaaugacuggggacauaaaaggaauaaugcaagcagggaaaagauccuuacguccacaaccaacugagcuuaaauacucauggaaaacaugggggaaggccaaaaugcuuaguacagaaucucacaaccaaacuuucuuaauagauggcccggaaacagccgaaugcccaaauacaaaccgagcguggaacuccuuggaaguagaagauuacggauuugggguguuuaccaccaauauaugguuaaaauugcgagaaaagcaagaugucuuuugugacagcaaauugaugagugccgcaauuaaagacaauagagcuguacacgccgauaugggauacuggaucgaguccgcuuugaacgauacuuggaagauggagaaggcuucuuuuauugaggucaaaucgugccauuggccaaaaagccacacuuuguggucaaauggggugcuugaaucugagaugauuauuccuaaauccuucgcagggccgguaucccaacauaacuauagaccgggauauuauacacaaacugcaggcccauggcaucucgggaaacuagagauggacuucgauuucugugaagggacaacagugguuguaacagaagacugugggaaccgagggccgucauuaaggaccacaaccgcuucagggaaacuaaucacggaauggugcugcagauccuguacuuuaccuccauuacgauacagaggugaagacgguugcugguacgggauggaaauaagaccacuuaaagaaaaggaagaaaauuuaguaaauucguuaguaacagcuggacauggucaaauagacaauuucucguuagguguucugggaauggcauuauucuuggaagaaaugcuaaggaccagagugggaacaaaacaugcgauacuauugguggcaguauccuucguaacacuaaucacgggaaacauguccuuucgagacuuaggucgaguuauggugaugguaggagcagcgaugacugaugauauagguauugguguaacauaccuggcuuuacuugcugccuucaaaguacggccgacauuugccgcugggcucuuacuucgaaaauuaacaucaaaagaacuuaugauggcaacgauugguauagcguuauuaucacaaagcaccauucccgaaacaauacuugagcuuacugaugcauuggcgcugggaaugaugguucuaaagauuguacgcaauauggaaaaauaccaacuggcuguaacaaucauggcgaucucaugcguucccaaugccguuauauuacaaaaugcuuggaagguaucaugcacaauccuggccacagugaguguuagcccucuauuauuaacuucgagccaacaaaaggcugacuggauaccacucgcacuaacuaucaagggguugaauccaacugcaauauucuuaacuacauugucucggacgagcaagaaacgaucuuggccuuuaaacgaagccauaauggcaguagggaugguuagcaucuuagcuagcucacugcucaaaaaugauaucccaaugacaggcccuuuagucgccgguggauuacucacaguuugcuacgucuugacgggacgcucagcagacuuggaacucgaaagggcaacagaugucaaaugggaggaucaagcagagauaucagggaguaguccuauauuaucaauaacgauagccgaagauggcagcaugucuaucaaaaaugaagaagaagaacaaacccuaacaauauugauccgaacuggacuucucgucaucucuggcuuauucccugucucaauuccuauaacggccgcugcuugguauuuaugggaagucaagaaacaaagagcuggugucuuaugggacguaccauccccucccccuguagguaaggcagagcuagaggacggagcauaucguauaaaacaaaaaggcauauuaggauacagucagauaggcgcgggaguuuauaaagaggguacuuuccauacaauguggcauguuacgagaggagcaguucuaaugcacagaggcaagaggauagaacccucgugggcugaugugaaaaaggauuuaauuucauaugguggugguuggaaauuagaaggagaauggaaggagggcgaggaaguacagguucuugcccucgagccugguaaaaaccccagagcaguucagacaaaaccaggacuguucaaaaccaauacagggaccauaggagccguaucacuugacuuuagcccagguacgagcgguucuccuaucguugauagaaaaggaaagguugugggucuuuauggaaacggcgucguaacgcgaucuggagcauauguaagcgcuauugcucaaaccgaaaaaucuauagaggauaacccggagauugaggacgauaucuuucguaagaaacgauuaacgauuauggaucuacauccuggcgcaggaaaaacaaaacgcuauuuaccugccauaguacgagaagcaauaaaaaggggucuacgaacccugauuuuagcacccacgcgcguuguagcugcagagauggaagaagcacuacgaggucucccaauaagauaccaaaccccggcaauacgagcggagcauacaggacgugaaaucguugaucuuaugugucaugcuaccuucaccaugaggcuacucagcccgguucgugucccaaauuauaacuuaauaaucauggaugaagcgcauuuuacagaucccgcaucuauagcagcucguggauacaucucaacaagaguagaaaugggggaagcagcaggaaucuucaugacagccacgccuccgggaaguaaagauccauuuccccagucuaacgcaccaauuauggacgaggaaagggaaauccccgaacgaucuuggaacuccggacacgaguggguaaccgauuuuaaaggaaaaacgguaugguucguaccuucgauaaaagcagguaacgacauagcagcaugucuuaggaagaacggaaagaaaguaauacaacuuagccgcaaaacuuuugauucggaguaugucaagacaagaacuaaugauugggauuucguaguuaccacagacauuucagagaugggugcuaauuucaaagcugagagaguaauagaucccagacguuguaugaaacccguuauucuaacggacggagaggagcguguuauucuugcggguccgaugccugugacccauucaagcgcagcacaaaggagggguagaaucggacgcaaucccaaaaaugaaaacgaucaauauauauauaugggcgaaccucuugagaaugacgaagauugcgcacauuggaaagaggcgaaaauguuauuagacaacaucaacacaccagaaggcauuauccccagcauguuugaaccugaacgugaaaaagucgacgcaauugauggcgaguacagauuaagaggugaagcaagaaaaaccuucguugauuuaaugcggagaggagauuuaccaguauggcuggcauacagaguagcugcagaagguauuaacuacgcugaccguagauggugcuuugauggggucaaaaauaaccaaauauuagaagaaaaugucgaaguagaaaucuggaccaaagaaggggaacggaagaaacuaaaaccuagauggcuagaugcgcgaaucuauucagauccauuagcuuuaaaagaauuuaaagaauuugcagcugguagaaagucacuaacacuaaaucuaaucacagagaugggaagauugccaacuuucaugacacaaaaagcacgugacgcauuagacaauuuagcuguacuacacacggcggaagccgguggacgagcauauaaccacgcacuaagugaauuaccugagacauuagagaccuugcuucuacuuacacuauuagccacgguaacaggcgguauauuuuuauuucucaugucugggaagggaguugggaaaaugacauuaggcauguguuguaucauaacagcuaguauucuuuuauggcacgcacaaauacaaccccacuggaucgcagcuaguauaauucuagaauuuuuccuuauuguacuauugaucccagaaccugaaaagcaacggacuccacaagacaaucaacuuacguauguaguuauugcaauccugacaguagucgcagcaacgauggcaaaugagauggguuucuuagaaaagacuaagaaagacuuaggcuuggguuccauugcaacucaggagccagaaucuaacauucuagauauugaucuaaggccggcauccgcauggacacuauacgccguagcuacaacuuucguuacgccuaugcucaggcauucaauugaaaauaguagcguaaacgugaguuuaacagcaauagcaaaccaagcaacgguauugauggggcuagguaaaggauggccuuugucaaaaauggauauuggagugccccuacucgcuauuggauguuacagccaagucaacccaauaacauuaacagcagcacuauuauuacucguagcucauuaugcaauuaucgguccgggguuacaagccaaagcaacaagagaagcucaaaagcgugcagcggcgggaauuaugaaaaauccuacaguagauggcauaaccguaauugauuuagauccuauaccuuaugauccuaaauuugaaaagcaacuuggucaaguuauguuguuaauucuaugcguuacucaagucuuaaugaugagaaccacaugggcuuuaugugaagcacuuacauuagcuacaggaccgauuaguacucuaugggaagguaauccgggaagauuuuggaacacgacuauagccguaucuauggcuaauauauuuagaggauccuauuuagccggagcaggauuguuauuuaguauaaugaaaaauacuacaaauacgaggagagguacagguaauauaggagaaacauugggggaaaaauggaaaagcaggcuaaaugcucuugggaaaucugaguuccagaucuacaagaaaaguggaauacaagaaguagauagaaccuuagcuaaagagggaauaaaaagaggagagaccgaccaucacgcuguuucucgcggauccgcaaaauuacguugguuuguugaacguaacaugguuacgccagaaggaaaaguggucgaccuaggaugcgggcguggcggauggucauacuauuguggaggacuaaagaacguccgagaagucaaaggauuaacaaaaggaggaccuggucacgaagaaccaauuccaaugucaaccuacgguuggaaucuaguucgucuccaaagcgguguagacgucuucuuuaccccucccgaaaagugcgauacgcuacucugugauauaggagagucaucucccaacccaaccauugaagcagggagaacucuacggguauuaucacugguggagaacuggcuuaauaaugacacucaauucuguauuaaaguucucaacccguauaugccaucgguuauagaaaagauggaaacccuccaaagaaaauacgguggagcauuaguuagaaauccacuaucuagaaauucaacgcacgagauguauugggucagcaacgcuacugguaauauuguuaguagugucaauaugauuuccagaaugcugauuaaucgguuuacuaugaaacauaaaaaggcuacguaugaaccagauguagaccuagggucugggacaagaaauauagguauugaaagcgaaauaccaaaucuugauauaauaggcaagagaauagaaaagauaaaacaggaacaugagacuucguggcacuaugaucaagaucauccuuacaaaaccugggcguaucaugguagcuacgaaacaaaacaaacagguagugcgucaucaaugguaaauggggugguaagacuucuaacaaaaccgugggaugucgugccaaugguuacucaaauggccaugacugauacaaccccuuucggacagcagagaguauuuaaggaaaaaguagauacuagaacgcaagaaccaaaagaagggacuaagaaauuaaugaaaauaaccgcggaauggcuauggaaagaauugggaaagaagaaaacaccaaggaugugcacaagagaggaguucacacgaaagguccguucuaaugcugcuuuaggagcaauuuuuacugacgaaaacaaguggaaaucagcaagagaggcaguugaagauucaagauucugggagcuaguugauaaggagcgaaaucuacaccuugaaggaaaaugcgagacguguguauacaacaugauggggaaaagagagaagaaauuaggggaguucgggaaagccaaaggaucucgagcuauaugguacaugugguuaggcgcucgauuucuagaguucgaagccuugggauuuuuaaacgaagaccacugguucucaagggaaaauucccucucgggaguggaaggagaaggacuacauaaacucgguuauauacuccgagacguuucaaagaaggaagggggagcuauguaugcagaugauacagccgggugggacacgagaauaacuuuagaagaucuuaagaacgaggagauggucaccaaucauauggaaggggaacacaagaaauuggcagaggcaauauucaaauugaccuaucaaaacaaaguaguaagaguacaacgaccuacaccuaggggaacagugauggauauaauuucgcgacgagaucagcguggaucaggucagguagggacguauggcuuaaauacauuuacgaacauggaagcucagcuuauuaggcaaauggaaggagaaggaaucuuuaaaagcauucaacaucuuaccgcgacugaggaaauagcgguucaaaauuggcuugcgagaguuggaagggaacguuuaucgaggauggcaauuucgggugacgauuguguuguaaaaccacuugaugaccgauuugcgagcgcuuuaacagcuuuaaacgacaugggaaaaguccggaaagauauucaacaaugggaacccaguagagguuggaaugacuggacccagguuccauuuuguucucaucauuuucaugaauugauuaugaaagauggacggguuuugguggugccaugucguaaucaggaugaacuuauaggucgagcccguaucagucaaggggccggguggucacuaaaggagaccgcguguuuaggaaagucauaugcucaaauguggucuuuaauguacuuucaucggagagaucuucgauuggcugcgaaugccauuuguucagcagucccgagucacuggguucccacaagccgaacuacuuggucaauacacgccaaacacgaguggaugacaacagaggauauguuaacaguauggaauagaguuuggauacaagaaaacccuuggauggaagauaaaacuccaguagaaucaugggaagaaguuccuuauuugggaaagagagaggaucaauggugugggagccuuauuggacuaaccucacgagcaacaugggcgaaaaacauacagacagcaauaaaucagguucgaucacuuauaggaaacgaagaauauacagauuacaugcccucuaugaaacguuucagacgugaagaagaagaggcggguguucuuugguga

SEQ ID NO: 22806 - RNA, 9876 nt, Artificial Sequence
  derived and/or modified CDS sequence (opt6) from DENV-2__JX286524__SS-prME
acugcaggggucauugugauguuaauacccacugcgauggcauuccaucuaacgacuagaaauggggaaccgcauaugauaguagguagacaagaaaaaggaaagagcuuguuguucaaaacggaagacgggguaaauauguguacacuaauggcaauagaucuuggcgaauugugugaagauacgauaacauauaaaugcccuuuauugcgacaaaacgaaccggaagauauugauuguugguguaacucuacaagcacauggguuacauacggaacgugcaccacaacaggugaacauagaagagaaaagagguccguagcgcugguaccacauguugggaugggcuuagaaacaagaacugaaaccuggaugucgucagaaggggccuggaaacauguucagcgaauagaaacauggaucuuaagacacccugguuucacaaucauggccgcgauucuagcauauacuauagggaccacacauuuccagagagcauuaauauucauauugcuaacggcuguugcaccaagcaugacuaugcgauguaucggcaucucuaaccgggauuuuguggaggggguuagcggcggcucaugggucgacauuguacuggaacauggaagcugcgugaccacuauggccaaaaauaaacccacacuugacuuugaacuaauaaaaacugaagcaaaacagccagccacacucagaaaauacuguauugaagcaaaacugacaaauacaacuacggaauccagauguccaacacaaggagaaccuucgcugaaugaagaacaagacaaacgcuucauaugcaaacacucaaugguagaccgcggauggggaaauggcugugguuuauucgguaaaggugggauuguaaccugcgcgauguucacguguaagaaaaacauggaaggcaaaauaguacagccagagaaucucgaauacacaauuguaauaacuccucacucgggugaagaacaugcugucgguaacgauacaggcaaacauggcaaagaaauuaaaaucacaccucaaucuaguacgaccgaagcagagcuuacaggauauggcacuguaacaauggaaugcagucccagaacagguuuagacuucaacgagaugguacuccuacaaauggaagacaaagcauggcugguucaccgccaaugguuuuuagauuuaccucuaccauggcucccaggagcagauacacaagguucgaacuggauacaaaaagaaacauugguaacauuuaaaaacccacacgcgaagaaacaagacguugucguauuagggagucaagagggagcgaugcauaccgcacucacgggagccacagagauucaaaugaguagugguaaccuauuauucacuggacaccuaaaaugcagauuaaggauggacaaauuacaauuaaaaggaaugucauacaguauguguacggggaaauucaaaauuguaaaagaaauugcggaaacgcaacaugguacgauagucauuagaguccaauaugaaggggauggaagcccauguaagauaccuuuugaaaucacagauuuagagaaacgacacguauuaggaagacuaauaaccguaaauccaauaguuacagaaaaggauucuccugucaauaucgaagcagagccgccauuuggugauuccuauauuauaguuggaguagaaccuggucaguugaaauugaacugguucaagaaaggaucgucgauugggcaaauguucgaaaccacgaugagaggagcaaaacggauggcgauuuuaggagauacagccugggacuucggaagccuaggaggaguuuucacaaguauaggaaaagcucuacaccaagucuucggugcaauuuacggugcagcuuuuucuggaguaaguuggacuaugaaaauuuugauaggaguuauuauuaccuggaucgguaugaauagcagaucgacaagucugucagucucguuaguauuaguaggaguagucacguuauaucuaggagcgaugguacaagcagacucaggcuguaucguaucauggaagaacaaagagcuuaagugugguucaggaauauuuaucacagauaacguacauacauggacagagcaauacaaguuucaaccagaguccccaaguaaauuagcuuccgcaauucagaaagcccacgaagaaggcaucuguggaauaagaucugugacuagauuagagaauuuaauguggaaacaaauaacgccagaauuaaaucacauauuauccgagaaugaagugaaauuaacuauaaugacaggugauauuaagggaauuaugcaggcagguaaaagaucucuuagaccccaaccgacugagcuaaaauauucauggaaaaccuggggaaaggcaaaaaugcuauccacggaaucccauaaucagacuuucuuaauagauggccccgaaacggcugaaugccccaacacaaacagagcuuggaacucacuugaaguggaagacuacggcuucgggguauucacaacgaacauauggcucaaacuucgugaaaaacaagauguauuuugcgauucgaaauuaaugagugcggcaaucaaagacaacagagccguacaugcagauaugggguauuggauagaaagugcacuaaacgacacauggaaaauggaaaaggcuucauuuauugaaguuaagaguugccacuggcccaaaucccauacacuauggucgaacgguguccuugaaucugaaaugauaauaccuaagagcuuugcugggccagucagccagcauaacuaccgaccagguuaucauacccagacagcaggaccauggcaucugggcaaauuagaaauggacuucgauuuuugcgaggguacaacaguaguagucacagaagacugugggaacagaggaccuucgcugagaacuacaacagccucggguaaauugauaacugagugguguugucgaucauguacucugccaccgcugagauacagaggagaggauggaugcugguacggaauggaaaucagaccauuaaaagagaaagaagaaaaucuaguuaacagccuaguaacagcuggacauggacaaauagauaauuucucacuaggagugcucgguauggcucuauuuuuagaagaaaugcuacguacccggguaggcacuaagcaugcgaucuuauugguugcacucucuuuugugacccuaaucacggggaacauguccuuuagagacuuagguagggugauggucaugguaggcgccacgaugaccgaugauauugguaugggaguuacauaccuagcucuacuagcggcauucaaaguucgaccuaccuucgcagcaggacugcuccugcgaaaauugaccuccaaagaauugaugauggccacuaucggaauagcauuacucagucaaagcacgcuaccagagaccauacuugagcucacagacgcguuagcguuggguaugauggcacuaaaaauugugcggaauauggagaaguaucaacuugccguaacuauuauggcuauuucaugcgugccaaaugcggucauacuccaaaaugcuuggaaagugaguuguacuauacuggcugcaguaucagugucuccgcucuuguuaaccucaagccaacagaaagcagacuggauuccauuagcgcucacaauuaaaggucucaacccaacagccauauucuuaacaaccuuaucccguaccucuaaaaagagaucauggccacuaaacgaagcuauaauggcaguaggaauggugaguauauuagcaaguucuuuacugaagaaugauauacccaugacuggaccucugguagcgggaggacucuuaacaguuuguuacguacuaacuggaagaagugcagaccuagaauuagaacgggcggcagacgugaaaugggaagaucaagccgaaauaagcggauccucucccauucuauccauuacaauuagugaggacgguucuaugucgaucaaaaacgaagaggaagaacaaacucuuacuauucuaauucguaccggauuauugguaauaucaggcgucuuccccguuaguauuccgauuaccgccgcggccugguaucuaugggagguuaaaaagcaaagggcaggaguauuaugggauguaccuucuccaccuccaguaggcaaagccgaacuagaagacggagcuuacagaauuaaacaaagaggcauacuuggauauucacagauaggagcagggguuuacaaagagggcacauuccauacuauguggcauguaacaaggggagcaguuuuaaugcaccgaggcaaacgaauagaacccucaugggcugauguuaaaaaggaucuaauuuccuacggagggggcuggaaauuagagggugaauggaaagaaggagaagagguacaaguacucgcacuugaaccaggcaaaaauccuagggccguucaaacuaaaccaggaauauuuaagacuaauaccgguacaauuggggcaguaagucuggauuucucgccgggcacauccggcucuccaauuguugaucgaaaaggaaagguuguuggguuauauggaaauggagucgucacaagaaguggugcuuacguaucagcgauugcucaaacagaaaaguccauugaagacaaccccgaaauagaagaugauauauuuaggaagaaaagacuuacuauaauggacuuacauccaggcgccggcaaaacuaaacgauacuuaccugcgauaguuagagaggccauaaagagaggacugcgcacuuuaauccucgccccgacccguguagucgcagccgaaauggaagaagcacuuagaggcuuaccaauaagguaucagacgccugccauaagagccgagcacacgggcagagagauagucgaucugaugugccaugcuacauuuacaaugagguuguuaucgccuguacgaguacccaauuauaaccuaauuaucauggacgaagcacauuuuacagaucccgcuucuauagccgcccgagguuacauaucaacuagagucgaaaugggcgaagcagcggguauauuuaugacagcgacgccacccggaucucgagacccguuuccacaaagcaacgcacccauuauggaugaagaaagagagauuccagaacgcaguuggaacucgggacacgaguggguaacagacuucaaagguaaaacugucugguuuguaccaucaauuaaagcgggaaacgauauagcagcaugccuacguaaaaauggcaaaaagguaauucaacuaagucgcaagacauucgacucugaauacguaaaaacaagagcaaacgauugggacuuuguggucacaacggacaucagugagaugggggccaacuucaaagcagagaggguuauagauccaagaagguguaugaaacccguuauauuaacggauggagaagaacgcguuauacuagcaggcccaaugccgguaacccauucaagugcggcacagcggcgaggaagaauugguaggaauccuaagaaugaaaacgaccaauauauauauaugggggagccuuuggaaaacgaugaggauugugcucauuggaaagaagcaaaaauguugcuagacaacauaaacacaccugaggguauaauucccagcauguuugaaccugaacgagagaaaguagaugcaaucgacggugaauauagacugagaggcgaggccagaaaaacguucguagaucucaugagaagaggggaucuaccugucuggcuagcauauaaaguagcagccgaaggaaucaacuacgccgaucgcaagugguguuuugaugguaucaaaaauaaucaaauacuagaagagaacguugagguagaaauuuggacaaaggaaggggaaagaaagaaacuaaaaccacgaugguuggacgccagaauuuacucagacccacucgcuuugaaagaauuuaaggaguucgcagcagguaggaagucguuaaccuugaaucucauuacagaaaugggccgcuugccgacauucaugacucaaaaggccagaaacgcucuagacaacuuagcaguucuacacaccgcugaggucggugggaaagcguacacccacgcucuaagugaacuaccugaaacgcuggaaacacuacuccuauugacucuccuagcugcagucacaggaggcaucuuuuuguuuuugaugucaggcaaaggcauagggaagaugacguuaggaauguguugcauuaucacugcaucgauauuauuaugguaugcacaaauccaaccacauuggauugccgcuagcauaauuuuagaguucuuucuuauaguauuauugauaccggaaccagaaaaacaacgaacuccacaagauaaccaauuaaccuauguuguuauugccauauugacagugguagccgcgacaauggcgaacgaaaugggguuucucgaaaagacaaagaaagaucucgguuucggaucgauaacaacacaggaguccgaaagcaauauccuggauauugaccugaggccugcaucggccuggacacuuuaugcuguugcaacaacauucguaacucccaugcuuagacacucaauugaaaacucuucgguaaacgucucguuaacugcuauagccaaucaagcgacaguauuaaugggucuugguaaaggauggccauugucaaagauggauauuggugucccccuacuagcgauuggaugcuauagucaagucaauccgaucacacuaacagccgcguuacuccuauuaguugcacauuacgcaauaauuggacccggccuucaagccaaagcaacuagggaagcacaaaaacgagcggcugccgggauaaugaaaaauccuacagucgaugguauuaccguaauagauuuagaaccaauaccauaugauccaaaauucgagaaacaauuaggccaagugauguuauuaauccuuugcguaacgcaaguacuuaugaugcgaacgacaugggcuuuaugugaagcacuaacacucgcuacaggaccuaucaguacauuaugggagggaaaccccggccguuuuuggaauacuacaaucgccguuaguauggcuaauauuuuuagaggauccuaccuagcgggagcuggcuuauuguucuccauuaugaaaaauaccacgaauacucgcaggggaacuggcaacguaggggaaacccuaggagagaaauggaaaaguaggcuaaaugccuuaggaaagucugaguuucaaaucuauaagaaaagugggauacaagaaguagaucguacauuggcaaaagaggggauaaaaagaggagaaacugaccaucacgcaguuucuagaggaagcgcuaaauuaagaugguuuguggaaaggaauaugguaacaccagagggaaaaguagucgaucuaggaugugguagagguggauggaguuauuacugcggaggauugaagaacguuagggaaguaaaaggacucacaaaaggugguccaggucacgaagaacccauaccaaugucaacauauggauggaacuuaguaaggcugcaaucugggguugacguauucuuuaccccaccagagaaaugugacacauuguuaugcgauauuggcgaaucauccccaaaccccacgauagaagcaggaagaacauugcgaguauuaaaucucguagaaaacugguugaauaacaacacccaauucugcauuaaaguccugaaccccuauaugcccagcguuauagagaaaauggagacucuacaaagaaaguauggaggcgccuuagucagaaauccccucucaagaaacaguacccaugaaauguauuggguuaguaacgcgacaggaaacaucguaaguagcguaaauaugaucucuagaauguuaauaaauagauuuacuaugaagcauaagaaggcaacauaugaaccagaugucgacuuaggaucaggcacucguaauauaggaauugaaucagaaauuccgaaucuagacauuaucggcaagagaauugagaaaauaaaacaagaacaugaaacaucauggcacuacgaccaggaucauccguacaagacgugggcuuaccacggauccuaugaaacaaagcaaacggggagcgcaucaucuaugguaaaugguguaguaaggcuauuaacuaaaccaugggauguugucccaauggugacacaaauggccaugacggauacgacaccauucgggcaacaaagaguuuuuaaagaaaaaguagacacacgcacacaagaaccaaaagaaggcacgaaaaagcugaugaaaauaacagcugaaugguuguggaaagaguuaggaaaggagaaaacgccgaggauguguacaagagaagaguucacaagaaaaguacggaguaacgcagcacuuggcgcaguauuuaccgaugagaauaaguggaagagugcacgcgaggcaguagaagaugguagauuuugggaguuaguagaucgugaaagaaacuuacaccucgaagggaaaugugaaacuuguguauauaacaugaugggaaagagggaaaagaaacuaggagaguucgggaaagcaaagggaucacgagcaaucugguauauguggcugggagcaagauuucuagaauuugaagcccucggauuuuuaaaugaagaccacugguuuucacgcgggaauagucuaucugggguggagggugaaggauugcaccgguuaggauacauucugagggaaguagggaagaaagagggaggagcaauguaugcagacgacacugccgguugggauacuaggauaacuuuggaggaccugaagaaugaagaaaugguaacaaaucacaugaaaggugagcacaagaaacuagcagaggcaauauuuaagcucaccuaccaaaacaagguaguacguguucagagaccuacuccaagaggaacgguaauggacauaauaaguagaaaagaucaaagaggaaguggccaaguuggaacguauggucugaauacuuucacaaacauggaagcucaguugauuaggcaaauggaaggggaaggcauuuuuaagagcauacaacaccuaacagcaacagaagaaauagcgguucagaacuggcuugcgagaguaggaagagaacguuuaagcaggauggcaaucucaggugaugauugcgucgugaagccaauagacgacagauucgcaucggcgcuaacagcucugaaugacaugggcaaaguacggaaagacauucaacaaugggaaccuucccgcgguuggaaugauuggacacaggucccauuuuguucacaucacuuccaugagcuaguaaugaaagacggccgcguauuaguagugccuugccgaaaucaagacgaacucaucgggagagcucggauuagccagggagcaggcuggucgcuuaaagaaacugcaugucuaggaaaaagcuacgcacaaauguggacgcucauguacuuccaucgacgggaucugcgauuggccgcuaaugcaaucuguucugcuguuccaucacauuggguaccuacuucuagaacgacauggaguauacaugcaaaacaugaauggaugacuacugaggauaugcuagcaguauggaauaggguauggauucaggaaaauccauggauggaggauaaaaccccggucgaaagcugggaagaaguaccauaucuuggaaaaagagaagaucaaugguguggaucuuuaauaggacuuacuagcagagcgacaugggcuaaaaauauucagacagcuauuaaucagguacggucuuugauaggcaacgaaggcuauaccgauuacaugcccuccaugaaaagauuuaggcgggaagaagaggaggcaggaguauuaugguag

SEQ ID NO: 22807 - RNA, 9876 nt, Artificial Sequence
  derived and/or modified CDS sequence (opt6) from DENV-2__JX286520__SS-prME
acggcugggguaauaguuaugcuaauuccaacagcaauggcguuccaucuuacaacaagaaacggagaaccacauaugauaguagggcgucaagaaaaaggaaaaucacuacuguuuaaaacagaagacggagugaacaugugcacacuaauggcuauugacuuaggugaauugugugaagauacaauaacuuacaaauguccccuacuacgucaaaaugaaccugaagacaucgauuguuggugcaauucaacaucaacuuggguuacauaugggaccuguacaaccacuggagaacauagaagagagaaaagaaguguagcacuugugccgcacguugguauggguuuagaaaccagaacugaaaccuggaugucuagugaaggagcuuggaaacaugugcaacggauagaaacauggauacuaagacauccaggauucacuauaauggcagcaauacuagcuuacacgauaggaacuacacacuuccaacgagcccucaucuuuauccuguugacagcaguggcuccuucaaugacgaugagauguaucgggaucaguaaucgcgauuuugucgaaggggucucuggagguuccugggucgauauaguauuggaacacgggucauguguuacaacaauggcgaaaaacaaaccgacguuagauuuugaauuaaucaaaacagaagcuaaacaaccugcgacauuaagaaaauauugcauugaagcaaaacuaacaaauacuacuacagaaucaagauguccgacacaaggagaaccuaguuuaaaugaagaacaagauaaaagauucauuugcaaacauagcaugguagauagagguugggguaacgggugcgggcuauuuggaaaaggugguauuguaacaugcgcgauguuuacgugcaaaaagaacauggaaggaaaaauaguacaacccgaaaaucuggaauauaccaucguaaucacuccgcauucaggugaagaacaugcaguaggcaaugacacagggaaacacgggaaagaaauuaaaaucacaccccagaguucaacaaccgaagcagaacucaccggguauggaaucguaacgauggaauguagcccgcgaacagggcuagauuuuaaugaaaugguacuuuuacagauggaagacaaagcguggcuaguacacagacaaugguuuuuggauuuaccauugccguggcuacccggggcagauacacagggaucaaacuggauccaaaaagaaacuuuggugacauucaaaaauccacacgcaaagaaacaggaugucguugugcucgggucgcaagaaggagcaaugcauaccgcccuuacuggcgcaacggaaauucagaugucaucaggaaaccucuuguucacuggucaucuuaaaugcagguugagaauggauaaacuucaacuaaaaggaaugucuuacucaauguguacaggaaaauuuaaaauaguaaaagaaauugcagaaacccaacaugguaccauuguuauacgaguacaguaugaaggugacggaucaccgugcaaaaucccauuugaaauuaccgauuuggagaaaagacauguccuggguagacuaauuacaguuaaucccaucguaacggaaaaagauucaccaguaaacauugaagcagaaccaccauucggagacucauauaucauaguagguguagaaccgggucaacuaaaacugaacugguuuaagaaaggaucaucaauaggucaaauguuugaaaccacgaugcgcggggcgaaaaggauggcgauacucggagauaccgcuugggacuucggaucacuuggugggguguucacgucaaucggaaaagcacuacaucaaguauuuggcgcgauuuacggugcugcauucagcggcguuaguuggacuaugaaaauacuaauagggguaauuaucacauggauaggcaugaacucccgauccacaagucucaguguuucauuaguucugguaggggucguuaccuuauauuuaggggcaaugguacaggcagacaguggauguaucguuucauggaaaaauaaggaacuuaaauguggaucuggaauauuuauaacagacaaugugcauacauggacugaacaauauaaguuucaaccugaaucgccuaguaaguuagcguccgccauccaaaaagcacaugaagaagggaucugcggaauacgaucaguaacuagauuggagaaucucauguggaaacagauaacgccagagcuuaaccacauccugucugagaacgaagugaaauugacuauuaugaccggugauaucaaaggcauuaugcaggcaggaaaaagaucgcuacguccacaaccuacugagcugaaauacucauggaaaacuuggggaaaagcuaaaaugcuaaguacggaaucccauaaucaaacguuuuugauagacgguccagagaccgccgaaugcccaaacacaaaucgagccuggaacucacuggaagucgaggauuaugguuucgguguauucacuacgaauauaugguuaaaacuuagagaaaaacaggaugucuuuugugacucuaaguuaaugucggcggcaauaaaagauaaucgcgcuguacaugccgauaugggguacuggauagaaagugcuuuaaacgauacguggaaaauggaaaaggcuucauuuauagaggucaaaagcugucauuggccuaaaagucacacuuuguggagcaauggaguauuagaaucugagaugauuaucccgaaaaauuucgccggcccaguuucucagcauaacuacagaccugguuaucacacccaaacugcaggaccuuggcacuuagggaaauuagaaauggacuucgauuuuugugaaggcaccacuguaguaguaaccgaggacugugguaaccguggacccagcuuacgcacgacaacggcaucagggaaacugauaaccgaaugguguugucgaaguugcacucuaccgccgcucagauacaggggcgaggauggguguugguauggcauggagauuagaccacuuaaagaaaaagaggaaaauuuagugaacagucuuguuacugcgggacauggacaaauugacaauuuuagcuuagggguucuuggcauggcuuuauuucuugaagaaaugcuuagaacaagaguuggcacaaaacaugcaauauuauuggucgcauuaucauucgucacgcuaauaaccggaaauaugaguuuucgagauuuagggaggguaauggugaugguuggagcgacgaugacugaugauauuggcaugggagugacauaccuugcacuuuuggcagcauuuaagguuagaccaacuuuugccgcaggucuauuacuuagaaaacuuacuucuaaggaguuaaugauggcaacgauuggaauugcccuguuaucccaaucaacacuuccugaaacaauucucgaacuuaccgaugcucuagcacuggggaugauggcguuaaagauagucagaaauauggaaaaauaucagcuagcgguaacuauuauggcuauaucaugcguaccuaacgcggucauacuccaaaaugcuuggaaaguauccugcacaaucuuggcggcggucucagugucaccucuacuacuuacaagcucucaacagaaagcagauuggaucccccuugccuugacaauuaaaggucuuaacccuaccgccauauucuugacuacauuaagccgaacaucaaagaagaggucauggccacuuaaugaagcuauuauggcgguaggaaugguuaguauccuugcgucaucucuauuaaagaaugacauuccaaugacagguccauuaguagccgguggguuacuaacggucugcuaugugcugacaggccgaucggccgauuuagagcuagagagagccgccgaugucaaaugggaagaucaggcagaaaucucagguucaucaccgauucuaaguauaacuaucagcgaagaugguaguaugucuaucaaaaaugaagaagaggaacaaacccuuacaauccuaauacgaacaggguuauuagucaucagcggaguauucccgguuucaauuccaauuacagcagccgcaugguauuuaugggaagugaagaaacaaagggccggagugcuaugggacguuccgaguccaccaccggugggaaaggcagaacucgaggauggugcauauagaauaaaacaaagagguaucuuggguuacagucagauuggugcagggguauauaaagaaggcacguuccauaccauguggcauguuacucgaggggcaguccucaugcauaggggaaagagaauagaaccuaguugggcugacguuaagaaagaucuaaucucguauggaggaggcuggaaacuugaaggagaguggaaagaaggggaagaaguacagguacucgccuuagaaccgggaaagaauccgcgagcaguacaaaccaaaccagggauauuuaaaaccaauacagggacaauuggggcagucucuuuagauuucaguccagguacuucaggcagcccaauuguagaccgcaaagguaagguugucggguuguacggcaauggcguaguaacuagaucaggagcguauguaagcgcaauugcucaaaccgaaaaaucuauugaagauaauccggaaauugaagaugacaucuucaggaagaaaagacuuacgauuauggauuuacacccgggcgccgguaagacaaagagguaucuuccagcaauugucagagaagcaauaaaacgaggacuacguacauuaauuuuagcaccuacucgaguaguagcggcagaaauggaagaagcacugaggggacucccuauccgauaccaaacuccagcaaucagagcugaacauaccggccgggagauuguggaccugaugugucacgcaacguucaccaugagacuauuaucuccaguuagagugcccaauuauaauuugauaauuauggaugaagcacauuuuacagauccggccaguauugccgccaggggauauauaucuaccagaguagaaaugggagaagccgccggaauauuuaugacagcgacuccaccagguucacgagacccguucccucaaucuaaugcaccaaucauggaugaagaaagagaaauuccagaaagaaguuggaacucagggcaugaauggguuacagacuucaaaggcaaaacuguuugguuugucccauccauaaaagcagggaacgauauagccgccugucugaggaaaaauggcaagaaaguaauacaacuuagcagaaagacauucgauucugaguauguaaaaacaagagcaaaugauugggacuucguagugacuacugauaucucggagaugggggccaacuuuaaagcggaacggguuaucgacccucgucgaugcaugaaaccaguuauuuugacagacggugaagaacgaguaauauuggcuggacccaugccaguaacccauagcagcgcugcacaacgacgaggacguauugggagaaaucccaagaaugaaaacgaucaauauauauauaugggagagccuuuggagaacgacgaagauugugcccacuggaaagaagccaaaaugcuacuagauaacauuaauacacccgaaggaauaauccccucaauguucgaaccggagagagaaaagguugacgcuauagacggugaauauagauugagaggagaagcacgaaaaacguuuguggaucuuaugaggcggggugauuugccaguauggcuugcuuauaaaguagccgcagaggguaucaauuacgcagauaggaaaugguguuuugauggcauuaaaaacaaucagauauuagaagaaaacgucgaaguagaaauauggacaaaggaaggugaaagaaagaaauugaaaccgagauggcuagaugcccgaauauauucagaucccuuagcauugaaggaauuuaaagaauuugcagccgguagaaagucguuaacuuuaaauuugaucacugaaaugggacggcucccaacguucaugacacaaaaagcgcgcaaugcacuggauaaucuggcuguacuccacacagccgaggucgggggaaaagcauauacacaugcauuauccgaacugccggaaaccuuagagaccuuauuacuacuaacuuuguuagcugcagucacaggagggauauuucucuuccuaaugagugguaagggaauuggaaaaaugacccucgguauguguugcauuauuacggcuucaauucuuuuaugguaugcacagauucaaccacauuggauagcagcgucaaucauauuagaguuuuucuuaaucguguuacuaauacccgaaccagaaaaacaaagaacgccacaggauaaccaacuaaccuacguaguuauugccauuuugacugucguagcagcaacuauggccaacgaaaugggcuuucuggagaaaaccaagaaagacuuuggauucggaagcauaacgacgcaggaaagugaaucgaauauacuagacaucgauuuacgaccggcgagcgccuggacgcuauacgcaguagcaacuacguucguaacuccuaugcuaagacauaguauugaaaauaguucaguaaacguuucucuuacagccauagcgaaccaagcuaccguccuuauggguuuaggaaaaggcuggccccucucaaagauggauaucggugugccccuacuagcuauagggugcuauucucagguaaauccuaucacacuaaccgccgcguuacugcuacucguagcucauuacgcaaucauaggaccuggacugcaagcaaaagcgacccgugaagcacagaaaagagcagcugcugguauuaugaaaaauccaacaguggacgguauuacagucauagaucuugagccuauaccauaugaucccaaguuugagaaacaauuaggacaggugauguuacuaauuuuaugcguaacucaaguacuuaugaugcgaaccacaugggcauugugcgaggcuuuaacguuagcuaccggacccauuucaaccuuaugggaaggaaauccuggccgcuuuuggaacacuacaauagcugugucaauggcaaacauauuccgaggaucuuaucuugcuggagcaggccucuuauuuucuauaaugaaaaacacuacgaauacuaggagggguacagguaacguaggagaaacccuaggggaaaaauggaaaucgagacuaaaugcacuagguaaaucagaauuucaaauauauaagaaaucagggauucaagaaguagauagaacgcucgcuaaagagggaauuaaaagaggagaaacagaccaucaugcaguaagcaggggaucagccaaauugagaugguuuguugagagaaauauggucacgcccgaaggaaaggucguggacuuaggauguggccgaggcggauggaguuacuauugugguggacucaaaaauguaagagaagugaaaggacuuacgaagggcgggccaggacacgaggaaccgauucccaugagcacauauggauggaaccuuguaagauugcaaucugggguugauguauucuuuacuccuccugagaaaugugauacuuugcucugugauauuggugagaguagucccaauccaacuauagaagcaggcagaaccuugcgaguacuaaaccucguggaaaacugguuaaacaauaauacgcaauuuuguauuaaagugcucaauccuuauaugccaagugugaucgagaaaauggaaacccugcaaagaaaauaugguggcgcccuagucaggaacccacuuucaagaaacagcacacacgagauguauugggugucgaacgcaacagggaacauagucucuuccguuaacaugauaucaagaauguuaauuaacagguucacaaugaagcauaagaaggcaacauaugagccagaugucgacuuagggucagguacuaggaacauuggaauagagucagaaaucccuaaccucgauauaauagguaagagaauugagaaaauuaaacaggaacaugaaacaucguggcacuacgaccaagaucauccauauaaaaccugggcuuaccauggcucauaugaaaccaaacaaacagguucugccaguuccaugguuaauggaguaguuagacucuuaaccaaaccaugggacguuguuccaaugguaacacagauggcaaugacagauacuacaccauucggccaacaacguguauucaaagaaaaaguugauaccagaacucaggaacccaaagaaggcacuaagaaauuaaugaagaucaccgcugagugguuguggaaggaacuaggaaaagagaagacuccucgaaugugcacaagagaggaguucaccagaaaagucagaaguaaugccgcacugggcgcuguauuuaccgaugagaauaaauggaaguccgcuagagaagccguagaggaugguagauucugggaauuagucgauagagaacguaauuugcaucucgaagggaaaugugaaacaugugucuauaacaugauggguaaacgugagaagaaacucggagaguucggaaaggcuaaagggagucgagcuaucugguauauguggcuuggggcaagguuucuagaguucgaggcucuagguuucuuaaaugaagaucauugguuuucacgcggaaauagccuauccggagucgaaggcgagggguuacaccggcucggguacaucuugagggaagugggcaagaaagaaggaggggcgauguacgcggacgauacggccggaugggauacucggauaacauuagaagaucugaaaaacgaagaaaugguaacaaaccauaugaaaggggagcauaagaaacuagcugaagcaauauuuaaacuaacuuaucagaauaagguaguaagaguucaaagaccuaccccuagaggcacaguaauggacauuauaaguagaaaggaucaaagaggaaguggacaaguaggaacauauggauuaaacacguuuacuaauauggaggcgcaauuaauucgacaaauggagggcgaagguaucuuuaaaucuauucagcaccuaacugcgacggaagaaauagcuguccagaauuggcuugcaagaguagggcgagaaagacugucucgcauggcuauuucaggcgaugacuguguaguuaaaccuauagacgaccgguuugcaucugcacuuaccgcauugaacgacaugggaaaaguucgaaaagacauccaacaaugggaaccaagucgagguuggaaugauuggacacagguuccauuuuguagccaccauuuucacgaguuaguaaugaaagacggacguguccuagugguuccauguagaaaccaggaugagcugaucggcagggccagaauaucccaaggggcuggauggucacuaaaagaaacggcgugccuaggcaaaucauacgcacagauguggacauuaauguauuuccaucgucgagaucuacguuuagccgcgaacgcuauaugcucagcaguuccaucucauuggguaccaacuucgcgaaccaccuggaguauccacgcaaagcaugaauggaugacaacagaagauaugcuagccguauggaacagaguauggauucaagaaaaccccuggauggaagacaagaccccaguggaauccugggaggagguucccuauuuaggaaagcgugaagaccaauggugcggcagccuaauuggacucaccaguagagcuaccugggcgaaaaauauccaaacagcaauaaaccaaguacggucauuaauuggaaaugagggguauacggauuauaugccgucaaugaaaagguuuagaagagaagaagaggaggcaggaguccucugguaa

SEQ ID NO: 22808 - RNA, 9876 nt, Artificial Sequence
  derived and/or modified CDS sequence (opt6) from DENV-2__JX286525__SS-prME
accgcggguguaauagugaugcuaauaccaacugcaauggcauuccaccuuacuacgaggaauggggaaccacauaugauaguagggagacaagaaaaagguaaaucacuacuauucaaaaccgaagacggcgugaauauguguaccuuaauggcaaucgaccugggagaacuaugugaagacacgauaacauauaaaugcccguuauugcggcaaaaugaaccugaagacauagauugcugguguaauagcacaagcaccuggguuacauacgggacauguacgacuaccggagaacaccgacgagagaaaagauccguugcauuaguaccucacgugggaaugggccuagaaacccgaacagaaacuuggaugaguucugaaggggcauggaaacauguacaaaggauugaaaccuggauccugaggcauccaggauuuacuauaauggcagccauacuggcauacaccauaggcacaacucacuuccaacgcgcguugaucuucauucuacuaacagcuguugcgccuaguaugacaaugagaugcauaggcauaucuaaucgagauuuuguagaaggugucucuggagggucgugggucgauauaguacuugaacacggaagcuguguaacaacaauggccaaaaauaaacccacacuugacuuugaacuaauaaaaacugaagccaaacagccugcgacacuucgcaaauauugcauugaagcuaaacuaacgaacacaacuacagaaaguagauguccaacccaaggagaaccuucuuuaaaugaagaacaagacaaacgauuuauuugcaaacauucuaugguugaucgcgguugggguaacgggugcggauuguucgguaaagggggaauaguaacaugugcgauguuuacguguaagaaaaauauggaaggcaaaauuguacaacccgaaaauuuagaauauaccauaguaauuacgccacacucuggagaagaacacgcgguggguaaugacacaggaaaacaugguaaagagauuaaaauuacgccacaaucuucuacgacagaagcagaguuaacggguuauggaacaguaacuauggaaugcaguccaaggacaggauuagacuucaaugagaugguccuauuacaaauggaggauaaggcuugguuagugcauagacagugguucuuagauuuaccucuaccauggcugccgggggcagacacgcaagguucgaauuggauucaaaaagagacauuaguuacuuuuaaaaacccacaugcuaagaaacaggaugugguaguauugggaucacaagagggagcuaugcacacagccuugaccggggccaccgagauccaaaugaguucugguaacuuauuauuuacaggacaucuaaaaugcagacuacggauggauaaacugcaauuaaaagguaugagcuauucuaugugcaccggaaaauuuaaaauuguaaaagaaauagcagaaacacaacauggaacuaucgucauaagaguucaguaugaaggcgacggaucaccauguaaaauaccuuuugaaauaaccgaucuggagaaacgacacgugcuaggaagauugaucacagucaauccaauaguaacagagaaagacucaccggugaauauagaagcagagccaccguucggggauaguuauauuauuguagguguagaaccuggacaacugaaacuuaacugguucaagaaagguaguucaauuggccaaauguuugaaacuacaaugcgaggcgccaaacgaauggcuauuuuaggcgauacugcaugggauuuuggcucgcuuggaggaguuuuuaccucaauuggaaaggcuuuacaccaaguguuuggugcaauuuauggggcagcauucuccgguguaaguuggacgaugaaaaucuuaauaggaguuaucauaacguggauagguaugaacaguagaaguacgucauugaguguuagucuaguucugguuggagugguaacacucuaucugggggcaauggugcaagcugacagcgggugcauaguguccuggaaaaauaaagagcuaaaaugugguaguggcauuuucauaacugacaacguccauacauggacagaacaauauaaauuucaaccagaaucacccaguaaacuggcaagugcaauucaaaaagcucaugaagaaggcauuugcgggauaagaagugugaccagauuagaaaacuugauguggaaacagauaacacccgaacuuaaccauauccuaucagagaacgaaguaaaacucacaaucaugacaggggacauaaaaggaauuaugcaagcuggaaaaagaaguuuaagaccacaaccuacggaacuuaaauacuccuggaaaaccuggggaaaagccaaaaugcugucuacugaaucacauaaccaaacauuccuaaucgaugguccugaaacagcggaauguccuaauacaaauagggcauggaacucucuugaaguugaagauuacggauuuggaguauuuacuacuaacauauggcuaaaacucagagaaaagcaagacguguucugcgauuccaaacuuaugagugcugcgauuaaagauaaucgagcgguacacgcggacaugggauauuggauagaauccgcccucaaugauacguggaaaauggagaaggcaucuuuuaucgaagucaaaucgugucauuggccaaaaagucauacauuguggucuaacggaguacuagaaagcgaaaugaucauuccaaagaguuucgcggggccagugagucaacacaacuauagaccgggauaucauacgcaaacagcugggccauggcauuugggaaaauuagagauggacuucgauuuuugcgagggaacaacaguaguaguuacggaggauugcgguaaccgugguccuagcuuacggacaacuacagcaucagguaaacuuauuacggaauggugcuguagaucuuguacgcuucccccacuucgcuaucgcggugaggacggcuguugguacggcauggaaauaaggccucuuaaggaaaaggaagaaaacuuagucaauagucuggucacagcaggacacggucaaauugacaacuucuccuugggggucuuggguauggccuuauucuuggaagagaugcuacguaccagagucggcacaaaacacgcaauacuauuagucgcacuaaguuucgugacacuaauuacagguaacaugucguucagagaccucggcaggguuaugguaauggugggagcaacgaugaccgaugauauaggcaugggugucacuuaucuggcacuucuagccgcuuuuaaagugagaccuaccuucgcggcuggacugcuuuuaagaaagcuaacaaguaaagaauugaugauggcaacaauuggaauagcguuauugagccaauccacacuuccggaaaccauauuagaauuaacugacgcacuugcucuugguaugauggcauuaaagaucguaagaaauauggaaaaauaccaacuagcagugacaauaauggcaaucucuugugugccaaaugcaguuauuuuacaaaaugcuuggaaaguaucguguacuaucuuagcagcaguaagcgugucaccucucuugcugacuagcucucaacaaaaggcagauuggauuccccuggcauuaacuauaaaaggguuaaacccaacugcgauuuuucuaacaacuuugucgcgaacuucuaagaaaagaagcuggccacucaacgaagcuauuauggccguggguaugguaaguauacuagcuucaucacuacuuaaaaaugauauaccuaugaccggaccguuaguagcaggaggauuauuaacggucuguuauguauuaacugguagaagcgcagacuuggaauuagaacgagcagcagauguaaaaugggaagaucaagcggaaauaagcggaucuucucccauuuugaguauaacgauaucagaagauggcucgaugaguaucaaaaacgaggaagaagaacaaacauugacuauccuaauaagaacggggcuccuagugaucagugggguguuccccguauccauaccaaucacagcggccgccugguaucuaugggaggucaagaaacaaagggcaggcguguugugggacgucccaaguccaccaccagucggaaaagcggaacuggaagacggagcauauaggauaaaacaacguggaauacucggauacucacaaauuggugccggaguuuacaaagaaggaacauuucauaccauguggcacguuacucggggugcuguacuaaugcaccgggggaaacguauugaaccgaguugggcagaugugaagaaagaccucauuucauaugguggcggguggaaauuagaaggugaauggaaggaaggggaggagguucagguacucgcguuggaaccagguaagaauccaagagcaguccaaacgaagccugguauuuuuaaaacuaauacagggacaauaggagcgguaagccuugacuucucaccaggaacaucugguucaccuauaguagacaggaaagguaaagucguuggccuauauggaaacggagugguuacuagaucaggugcauacguuagugcaauagcacaaacugagaaaaguauagaggacaaucccgaaaucgaagaugauaucuuccggaaaaagcgguuaacgauaauggaucugcaucccggugcaggaaaaaccaaaagguacuuaccagcaaucgugagagaagcaaucaaaagaggacuuaggacccuuauacuugcuccuacaaggguagucgcagccgaaauggaggaggcuuuacgaggacuacccauuagauaccagacuccagccauccgcgcugaacauacugguagggaaauuguugauuuaaugugccaugcaacauuuacaaugagguugcucucacccauaagagugccgaacuacaauuugaucauaauggaugaagcacacuucacagaccccgcuuccauagcagcuagagguuacauuaguacacgagucgagaugggggaagcagcuggaauauuuaugaccgcaacaccaccuggcucacgcgauccauuuccacagucaaaugcaccaauaauggaugaagaaagagaaauaccugagagaucguggaauaguggccaugaaugggucacugauuuuaaggggaagacuguaugguucgugccaagcauaaaagcagguaacgacaucgcagccugucuucgaaagaauggaaagaagguuauccaauuaucacgaaagaccuuugacucugaauaugucaaaacacgugcaaacgauugggacuuuguugucaccacagauauaagcgaaaugggugcuaacuucaaagcagaacgagucauagauccaagaagauguaugaaacccguaauacuuacagacggcgaggagaggguaauccuagcaggaccaaugccaguaacacauucaagugcugcucagcguagaggaagaauagguagaaacccuaaaaaugagaaugaucaauauaucuauaugggagaaccccuugagaacgaugaagacugcgcgcauuggaaggaagcgaaaauguuguuagauaauaucaacacuccugaagggaucauuccaagcauguuugagcccgagagagaaaaaguugaugcgauagacggagaauauaggcuaagaggcgaagccaggaagaccuuuguagaccuaaugaggcguggugaccucccuguaugguuggcauauaaaguugcagcggaaggcauaaauuacgcagacagaaaauggugcuuugauggaaucaaaaauaaccagauacuagaggaaaauguagagguagaaauauggacuaaagagggagagagaaagaaauugaaaccuagaugguuggacgcaagaauauacucagacccacuagcacuaaaagaguucaaagaguucgcugcagggaggaaaaguuugacuuuaaacuuaauuacagagaugggacgacucccuacauuuaugacacaaaaagccagaaaugcauuagauaacuuagcaguacuucacaccgcagaaguaggaggcaaggccuacacacaugcacuuuccgaacuaccagaaacuuuagaaacuuuacuacuucuuacuuugcuagcugcagucacgggaggaauauuccuauuuuugaugucagguaaggguauugguaagaugacccuaggcaugugcuguauuauaacggcgucaauccuucuaugguaugcacaaauacagccucauuggauagcggccagcauuaucuuagaguucuuucugaucguucuguugaucccugaaccggaaaagcaaagaacaccucaagauaaucaacugaccuauguagucauugcgauuuuaacagugguagcagcuacaauggcgaaugaaaugggguuuuuagagaaaaccaagaaagauuugggguuugguucaauuacgacccaagaaagcgaaucaaauauccuagauauugacuuaaggccagcuagcgcauggacauuauacgcuguggcuacgacguuuguuacaccgaugcugagacacaguaucgaaaauaguucuguuaauguuucacuuacagcaauagcuaaucaggcuacaguuuuaaugggauuggggaaaggguggccauugagcaaaauggauauagguguaccauuguuagccauaggcugcuacucucaaguuaaccccauaacguuaaccgcagcucuuuuacugcuaguagcucacuacgcaauaauaggcccaggguuacaagcaaaggccacgagagaagcucagaaaagggcugcagcugggauaaugaaaaaccccacuguggauggaauuacaguaauagaucuagaaccuauaccauacgacccgaaguucgagaaacagcuaggucaaguuauguuauuaauccucugcgucacacaaguauuaaugaugagaacaaccugggcauuaugcgaagcacucacacuagcaacggguccaauaagcacccugugggagggaaacccuggucgguucuggaacacaaccauugcaguaucaauggcaaauaucuuuagagguucguaccuagcaggcgcaggacuauuauucuccauaaugaagaacacuacaaauacaagaagggguacgggaaacguaggcgaaacucugggagagaaguggaaaucacggcuaaacgcucuugggaagucugaguuccaaauauauaagaaaucgggaauacaggaaguugaccggacguuagcgaaagaagguauaaagcguggggaaacagaccaucacgcagugagccgaggcagugcaaagcuaaggugguuuguagagaggaacauggugacaccagaggguaaaguaguagacuuaggaugcggaagaggcgguuggaguuacuauugcggggguuugaaaaauguuagagaagugaaaggcuuaacgaaaggaggaccaggucaugaagaaccuauaccgaugucuacauauggguggaaucuaguaaggcuucagagcggagucgauguauucuuuacuccaccagagaagugcgauacauugcuuugugauaucggugaauccucaccuaauccaacaauagaggcaggcagaaccuuacgaguacucaacuuaguugaaaauugguuaaacaacaauacucaauuuuguaucaaaguacuaaauccauauaugccaagcgugauagagaaaauggaaacguuacaacgaaaauaugguggggcccuagucagaaauccuuuaaguagaaacagcacacaugagauguacuggguaaguaacgcaacugggaacauaguaaguucaguuaacaugauuucuagaaugcuuauaaaccgauuuacaaugaagcacaagaaggcuacauaugagccagauguagacuuagggagcggaacuagaaacauaggcaucgaguccgaaauccccaauuuagauauuauaggaaaacgaauugagaaaauuaagcaagaacacgaaacaucauggcauuaugaucaagaccauccguacaaaacaugggcguaccaugggucauaugagacaaaacaaaccggauccgcaagcaguaugguuaauggugugguucgauuacugacuaagccuugggauguaguaccuaugguuacucaaauggccaugaccgauaccacgcccuucggacagcaaagggucuuuaaagaaaaaguagauacacgaacucaggaaccuaaagaagggacuaagaaauuaaugaaaauaacugcagaauggcuuuggaaagaacuaggaaaagagaaaacuccaagaauguguacaagggaggaauuuacucggaagguacgaaguaacgcggcacucggugcaguuuucacagacgaaaauaaauggaaaagcgcgagggaagcgguugaagacggaagauuuugggaguuagucgaucgagaacgaaaccuccaccuagagggaaagugcgaaacauguguuuauaauaugaugggcaaaagggaaaagaagcucggugaauuuggcaaagcgaaaggaucucgcgccauaugguauaugugguuaggcgcacgauuucuugaguucgaagcccuaggauuuuuaaaugaggaucauugguucucacgagguaauagcuuaucgggcguagaaggagaaggacuucacagauugggauacaucuugagggaaguggguaagaaagagggaggggcaauguacgcagacgauaccgcaggaugggauacuagaauaacgcuugaggaucuuaaaaacgaagagauggucacaaaucacaugaaaggagagcacaagaaacuugcagaggcgauuuuuaaacuuacauaccaaaauaaggucguuaggguucaacgacccacaccgcggggaacgguuauggauauaauuagucgcaaagaucaacgaggcucaggacagguggguaccuauggucugaacaccuucacgaauauggaagcucaauuaauacgacaaauggaaggcgagggaauauucaaaagcauucagcauuuaaccgccacugaagaaauagcaguccagaacugguuagcaaggguaggacgagagagguuaagcagaauggcaauaagcggcgaugauugugucguaaaaccaauagaugauagauucgcgucagcauuaacagcgcuuaaugacaugggaaagguacgaaaggauauucaacaaugggaaccaaguagaggauggaaugauuggacacaagucccuuuuugcagucaucauuuucaugagcuaguaaugaaagacggaagaguacuuguuguuccaugcagaaaucaggacgaacuaauugggagagcaagaaucagucagggggcgggauggucacucaaagaaaccgcaugcuuaggaaaaaguuaugcacaaauguggacguuaauguacuuccaucgacgagacuugagauuggccgcuaaugcgauaugcagcgccguacccucccacugggugccuacaaguagaacuacauggucaauucaugcuaagcacgaauggaugaccacagaggauaugcucgcuguauggaaucggguauggauccaggagaauccauggauggaagacaaaacaccuguagaauccugggaggaaguuccguaucuugggaaaagagaggaucaauggugugggucacuuaucggauuaacuuccagagccacaugggcgaagaacauacaaacugcaaucaaccaaguaaggaguuuaauaggcaacgaggguuacacugacuauaugccaucaaugaaaagauucagaagagaagaagaagaagcaggaguucucugguga

SEQ ID NO: 22809 - RNA, 9876 nt, Artificial Sequence
  derived and/or modified CDS sequence (opt6) from DENV-2__KM279598__SS-prME
acugcagguaucaucauaaugaugauaccgaccguuauggcauuucauuuaacaacaagaaauggggaaccccauaugauaguaucuagacaagaaaaaggaaaaaguuuauuauucaaaacugaaaauggagugaauauguguacauugauggcaauggaucuaggagaauugugugaagacacaaucacuuacaauugcccacuacuaagacaaaacgaaccugaagauauagauugcuggugcaauucaacaucgacauggguuacauacgguaccuguacggcaaccggagaacauagacgugaaaaacgaucgguggcacucguaccacacgucgguaugggacuugaaacacgaacugaaacauggaugagcagcgaaggcgcauggaaacacgcgcaaagaauagaaaccuggauccucagacacccaggauucacuauaauggcagcaauauuggcauacacuauaggaacuacauacuuucaacgaguuuuaauuuucauuuuauuaacugccgucacccccagcauggcgaugcguugcauaggcauaucgaauagagauuuuguagaaggaguuagcggugggagcuggguggacauuguauuagaacacggaucuugugucacuaccauggccaaaaauaaacccacauuagauuuugaauugauuaaaacagaagcuaaacaccuagcgacucugcgaaaauauuguguugaagcaaaauuaacaaacacuacuacugcaucucgauguccaacccaaggagaacccucuuugaacgaagaacaagacaaaagauuugucugcaaacacaguaugguugaucgagguuggggaaaugguugugguuuguuugggaaaggcggcaucgugacgugugcuauguuuacuugcaagaaaaauauggaagguaaaguaguacagcccgaaaauuuggaauacacgauaguaauuaccccgcacucaggggaagaaaaugcgguuggaaaugauaccgggaaacauggaaaagaaauuaaaguaacaccucaguccucaauaacagaagcugaauugacugguuacggaacggugacaauggaauguucuccacgaacgggauuagauuuuaaugaaaugguguuauuacaaauggaaaacaaagcaugguuaguucacagacaaugguuucuagacuugcccuugccauggcuccccggagcggacacucaaggaaguaacuggauacagaaagaaacacugguuacauuuaaaaauccacaugcuaagaaacaggacguuguaguucucgggucgcaagaaggcgccaugcacacugccuuaacaggagcaacagagauucagaugucgucugggaauuuacuuuuuacaggacaucuaaaaugucgcuugagaauggacaaacuacaacucaaaggcaugucuuacucaauguguacaggaaaauucaaagucgucaaagaaaucgcagaaacccaacacgggacaaucgucauaagagugcaauacgagggagacggaucuccguguaaaauaccguucgaaauaauggaucuugagaaacgacacgugcucggacgccuuaucacaguuaacccaaucgucaccgaaaaagauucuccgguaaauauagaggcagaaccuccauucggagauaguuacauaauaauaggcguagaaccaggucaauuaaaacuaagcugguucaagaaagggagcucaauaggucaaauguuugagacuacuaugagaggagcuaaaagaauggcgauucuuggagauaccgcuugggacuuugguucauuaggagggguauucacaucaauugggaaagccuugcaccagguauucggagcuauuuacggggcugcauucucagguguuucauggacaaugaaaauacuuauaggagucguaauaacguggauaggcaugaacucucguaguacuagcuuaucagucucacuuguuuuaguaggagucguaacauuauacuuaggaguuaugguucaagcagauaguggaugugugguuaguuggaaaaauaaagaacuaaaauguggcagcgguauauucaucaccgacaauguacacacauggacugaacaauauaaauuccaaccagaaucuccaucaaaacuggcaucggccauucagaaagcccacgaggaagguaucuguggaauuagaagugugacgagauuagaaaauuuaauguggaaacagauaacgcccgaacuaaaucacaucuuaaccgaaaaugaaguaaaauuaacaaucaugacaggcgacaucaaaggaauuaugcaagcagguaaaaggacacugcguccacaaccaacagagcuaaaauauucuuggaaggccuggggaaaagcuaaaaugcuaucaacugaacuacacaaucauacauuccugauugauggaccggaaacagcugaaugcccuaacacaaauagagcauggaacucgcuugagguugaagacuauggguucggagucuuuacgaccaauaucuggcuuaaguuaaaagaacgacaagauguguuuugugauuccaaauugaugagcgcagcaauaaaggauaauagagcggugcaugcagauaugggauauuggauugaaucagcuuugaaugacacuuggaaaaucgaaaaggccagcuuuauugagguuaaauccugucauuggccgaaaagccacacccucuggaguaacggaguauuagaaagcgaaaugauuauaccuaaaaacuuugccggcccuguuucucaacacaauuaucgcccaggauaccauacucaaacagcuggacccuggcaucuugguaggcuagagauggauuucgacuuuugcgagggcacgaccguaguugucacugaagauugugguaaucgagguccuagcuuacggaccaccacggcuucaggaaaacuuauaaccgaauggugcugccguagcuguacgcuacccccacuaagauauagaggagaagauggcuguugguacggaauggagauucguccuuuaaaagagaaggaggaaaaccugguaaauagucucguaacugcgggacacggucaaauagacaacuuuagucucggagugcuagggauggcgcuauuucucgaggaaauguuaagaacaagggucggaacaaaacaugcuaucuuacuuguugcagugaguuucgugacuuugauuacggguaacaugucuuucagggacguggggcgaguuaugguaaugguaggagcgacuaugacugacgauauagggauggguguuacauauuuagcccuacuggcagcguucaaaauccggccaacauucgcugcugguuuguuacuaagaaaguuaacaaguaaagaauugaugaugacaacuaucggcauuguuuuauuaucucagucaacuauuccggagaguaucuuggaacugacagaugcacuagcacuugguaugaugguacuuaaaaucguucgcaacauggagaaauaccagcuugcagugacaauuauggccauccuaugcguaccuaacgccguuauucuccaaaacgcuuggaaaguuucguguacgacgcucgcaguaguaucgguuucuccacugcuucuuacaaguucacaacagaaggcagauuggaucccacuagcgcuaaccaucaaaggauuaaacccgacugcuauauuucugacaacacuaagcagaacgagcaagaaaagaagcuggccacucaacgaagcaauaauggccguugguaugguaaguauauuagcaaguucacuucucaaaaaugacauucccaugacggguccauuaguagcugguggauuguuaacugucuguuauguucugacuggucgaagugccgaucuagaauuagaaagggcugcagaugucagaugggaagaacaagccgaaauaagcggaaguuccccuauauuaagcauuacgaucagcgaggauggaucaaugucuaucaaaaaugaggaagaagaacaaacucuaacaauacuaauacguacaggccuuuuaguuauaucuggauuauuuccaguaucuauaccaauaaccgcugcagccugguacuuaugggagguaaagaaacaacgggcagggguacugugggaugugccaucaccgccaccuguuggaaaagcagaauuggaagacggcgcauauagaauuaaacaaaaaggaauauuaggauauagccaaauuggcgccggaguauacaaagaaggcacauuccacacaauguggcacgugaccagaggggcggugcugaugcauaaaggcaaaaggauugagccuucaugggcagacgugaaaaaggauuugauaaguuacggaggcggcuggaaauuggaaggggaguggaaggaaggggaagaaguucaaguacucgcucuugaaccuggcaaaaaucccagagccguacaaacaaagccaggucuuuuuaaaacuaauacaggaacuauaggagccguaucucuugacuuuuccccaggaacauccggaagccccaucguagacaagaaagguaagguaguuggucuuuaugguaacggcgucguaacuagaucugggacuuacguaucagcaauugcccaaacugaaaaaucaauugaagacaacccggaaauagaggaugauauuuuuagaaagaagagguuaacaaucauggaccugcaucccggagcaggaaaaacuaaaagguaccuacccgcuauaguaagagaagcuauaaaaagggguuugagaacguuaauacuggcacccacgcguguuguagccgcagaaauggaagaagcauuacguggucuucccauacguuaucaaaccccugcaauaagggcagaacauacaggucgugaaaucguagacuuaaugugucacgcgaccuucacuaugagacuacuaagcccaauucgaguacccaauuauaacuuaauuauuauggacgaagcucauuucacagauccagccaguaucgcagcgagagguuacauuuccacuagaguagagaugggagaggccgccgguauauuuaugacugcaacaccaccuggcaguagagaucccuuuccacaaagcaaugcacccauuauggacgaagaaaaagaaauuccggaacgaucuuggaacuccgggcaugagugggucacggauuuuaaagguaaaacggucugguuuguuccauccaucaaagcggggaaugauaucgcugcaugccuucgcaaaaaugggaagaaagugauacaacucucaagaaaaaccuuugacuccgaauauaucaaaacgaggacaaacgauugggacuuugugguaacuacagauauuucugagaugggcgcaaacuuuaaggcagagagaguaaucgauccaagaagauguaugaaacccguuauauuaaccgauggugaagaacggguaauucuggcagguccaaugcccguaacucauuccagugcggcccaaaggcguggucgugucgguaggaauccuaaaaacgaaaacgaucaauacaucuauaugggcgaacccuuagagaaugaugaggauugugcccacuggaaagaggcaaagauguuauuagauaauauaaauacaccagaagggaucauaccgaguauguuugagccugaaagagaaaaaguugaugcaauugauggagaauauaggcuaaggggagaggcucgaaaaacguucguugaucuaaugagaagaggagauuuaccuguauggcucgcauauagagucgcagccgagggcauaaauuaugcagauagaagaugguguuuugauggugucaaaaauaaucaaauacucgaagaaaauguagaaguagagaucuggacaaaagaaggggaaaggaagaaacuaaaaccacguugguuggacgccagaauauauagugacccacuagcuuuaaaggaauuuaaggaguuugcagcagguagaaaaucuuugacguugaaucucauaacggaaaugggaagguugccaacguucaugacacaaaaagccaaaaaugcccuugauaaccuugcaguuuuacacacugcggaagcuggcggacgagcauauaaucaugcucuaucugagcucccugagacauuggaaaccuuauuauuguugacacuucuagccaccguaaccgguggaauuuuucucuuucuaauguccggaaaagguauuggcaagaugacucuuggaauguguuguaucauuacggcaucgauacucuuaugguaugcucaaauacagccacacuggaucgcagcuaguauuauuuuagaauuuuucuuaauuguucugcucaucccagaacccgaaaaacaacguacaccacaggauaaccaauuaacauacguagucauagcgauuuuaaccguuguugcugcaacuauggcaaacgaaaugggauuuuuagaaaagacuaagaaagauuuuggcuuaggcaguauaaccacacaacaaccugaaagcaacauacuugacauugaccuacgacccgccagugcuuggacuuuauacgccguagccacgaccuuuauaaccccaaugcugcgucacucgauagaaaacaguucaguuaacguaucacuuacugccaucgcaaaucaggcaacuguucucaugggauugggcaaagguuggccgcuaaguaagauggauauaggagugccuuuacuugcuauaggcugcuacucucaggucaacccuauuacacuaacagcugcuuuacuccuauuaguggcacauuaugcaauuauaggcccaggucuacaggcuaaagccacccgcgaagcacagaaacgggcugccgcuggaauuaugaaaaauccaacaguugauggaaugacaguaauagaccuugauccgauaccuuacgauccuaaauuugaaaaacaacuaggacaaguaaugcuauuaguuuuaugcguaacacagguuuuaaugaugaggacaaccugggcacuuugcgaggcuuuaacacucgcaacggguccaaucucaaccuuaugggaaggcaacccuggaagauuuuggaauacaacaauagcgguaaguauggcaaauauauucaggggaaguuaucuugcuggagcgggcuuguuguucucgauaaugaaaaacacagcgaauaccaggcgaggaacagguaauaccggagaaacgcucggggaaaaauggaaaaacaggcugaaugcccuggggaaaucggaguuccagauuuauaagaaaaguggaauccaagaaguagaucgaacucucgcuaaagaaggaaucaaaagaggcgagacugaucaucacgcuguaucgagagguucagcgaaauuacgcugguucguugaacgaaauuuaguuacacccgaaggaaagguaguggaccuuggauguggacguggaggcuggucuuauuauugugguggacucaagaacguuaaagaagucaaaggacuaacuaagggugggccgggacaugaagaacccauaccaaugagcacguaugguuggaacuuaguaagacuacaaagcggcguagacguauucuuuacuccucccgaaaaaugugauacgcuauuaugugauaucggcgaaucaucuccaaacccuacgguagaagcuggaagaaccuuacgaguacuaaaucuagucgaaaauuggcuaaauaacaauacgcaguucugcauaaaaguauuaaaucccuacaugccaaguguaauugagaaaauggaggcuuuacagaggaaauaugggggagcccuagucagaaauccauugagucgaaauaguacacaugaaauguacuggguaucaaacgcaucaggaaacauaguaagcucugucaacaugaucucacgaauguuaauaaaucgauuuaccaugaggcauaaaaaggcuaccuacgaaccugacgucgaccuuggaaguggaacucguaacauaggaauagaaucagaaacaccuaaucuugauauaauaggaaaaagaauugagaaaauaaaacaggaacaugaaacaucuuggcauuaugaucaggaccauccuuauaagacaugggcauaccacgggaguuacgaaaccaaacaaacaggaagugcaaguucaauggucaauggagugguacgccuacuaacuaaaccuugggacgugauaccgauggucacccaaauggcuaugacugacacaacgccauucgggcaacagagagucuucaaagaaaaaguugauacgagaacacaagaaccaaaagagggaacuaagaaauuaaugaaaauaacagcugaguggcuguggaaagagcucggcaagaagaaaaccccuaggaugugcacacgugaagaguuuacaaggaaagugagaaguaacgcagcucuuggugcaauauuuacagacgaaaacaaauggaaaagcgcuagagaggcgguugaagacuccgguuuuugggaacucgucgauaaagagcggaacuuacaucuggaagguaaaugugaaacuuguguguauaacaugaugggaaaacgagagaagaaacuaggcgaguucggaaaggccaaaggaagucgcgcuaucugguauauguggcucggagcacgauuuuuagaguucgaggccuuaggauucuuaaacgaagaccauugguuuagucgcgaaaauucacuaucuggaguugaaggugagggauuacacaaguuagguuauaucuuaagagaugugucaaagaaggaagguggagccauguacgccgaugacacagcaggaugggauacacguauuacauuagaggaucucaaaaaugaagagauggugaccaaucauauggagggcgaacauaagaaacuagccgaagcuauuuucaaauuaacauaucaaaacaaaguaguucgaguacaaagaccgacgccuagagguacuguuauggauauaauaucccgccgggaucaaaggggcucgggucaagucguaacauacggacugaauacauuuacuaauauggaagcacaacuaauacgucagauggaaggagaaggagucuuuaaguccauccaacaguuaacgguuaaggaagaaauugcagugaaaaacuggcuaauuagaguagggcgagaaagauuauccagaauggcaauaucuggcgacgacugcguuguaaagccucuugacgaucgcuuugcuucggcccucacugcacuuaaugauaugggcaaaguacggaaggauauacagcagugggaaccaucacgaggauggaaugauuggacccaagugccguuuuguagucaucacuuucacgaauuaauaaugaaagauggacgaguucuaguagucccuugucgaaaccaagaugagcucauaggucgagcgaggauuagucaaggugcaggauggucguuacgagagacggcaugccuuggaaaauccuaugcacaaauguggucacuuauguauuuccaccgucgagauuuacgucuugcugccaaugcuauuuguagugcagucccuucgcacuggauaccaacaaguagaaccacauggagcauacaugcaacccaugaauggaugacaacugaagacaugcuaaccguuuggaaucgugucuggauucaagaaaauccauggauggaagacaaaacgccagucgaaucaugggaagaaauccccuaccuuggaaaaagggaagaucaauggugcgguucauuaauaggguuaaccucuagagcaacuugggcaaagaacauacaaacagcaaucaaucaaguacguucacugaucggaaacgaagaguacaccgauuauaugccuucaaugaaacgauuucguagagaagaagaagaggcugggguacuuugguag

SEQ ID NO: 22810 - RNA, 9876 nt, Artificial Sequence
  derived and/or modified CDS sequence (opt6) from DENV-2__KM279576__SS-prME
accgcagggauaauaauaaugaugaucccuacuguaauggcauuccauuuaacuacuaggaauggcgaaccucauaugauagucagccggcaagaaaaaggcaaaagccuacuauucaaaacagaaaacggcguaaauaugugcaccuuaauggcuauggauuuaggcgaauuaugugaagauacaauaaccuacaacuguccucuauugaggcaaaaugaacccgaagauauugauugcuggugcaauucaaccucuacuuggguuaccuacgguacuuguacugcgacgggcgaacaucgucgggagaaacgaucaguagcacuuguaccccacguuggcauggguuuagaaacaagaacagaaacauggaugucgagcgaaggagcuuggaaacaugcacagaggauagaaacauggauccuucgccacccggguuuuacaauaauggcagcaauauuggcuuauaccauaggaacaaccuauuuucaacgaguucuuauauuuauacuauugacugcaguaacccccucgauggcgaugagauguaucggaaucucuaauagggacuucguggaaggcgucucgggugguucaugggucgacauuguucuagaacauggaucauguguuaccacaauggccaaaaacaaaccgacauuggauuucgaauuaauaaaaaccgaagcaaaacaucuggcuacauuacggaaauauugcguagaagcaaaauuaacuaauacuaccacugcuagcagauguccaacacaaggggaaccgucacugaacgaagaacaagauaaaagguucguuugcaaacacucuaugguagauagaggauggggaaacgggugcggacucuucggcaaagguggcauaguuacuugugccauguuuacaugcaagaaaaauauggagggcaaaguuguacagcccgaaaaucuagaauacacaauaguaauuacaccacacucgggugaagaaaaugcuguaggaaacgacacuggaaaacauggaaaagaaauaaaaguaacuccacagaguagcauaacagaagcagaauuaacaggauaugggacaguaacuauggaauguaguccaagaacaggauuagacuucaaugaaaugguuuuacuacaaauggaaaacaaagccuggcuaguccaucgacagugguuucuggauuugccacuaccauggcucccaggggcugacacgcaagggagcaauuggauacaaaaagaaacucuaguuacauucaaaaauccucacgccaagaaacaggauguugucguucuugggucucaagaaggagcuaugcacacagcucuuaccggugcaacggagauucaaaugucuagcgggaacuuacuauucacaggccaucucaaauguagacuccggauggacaaacugcagcuaaaagggauguccuacuccauguguacagguaaauuuaaaguugugaaagaaaucgccgagacacagcauggcacaaucguuauaagagugcaauaugaaggagacgguucgccguguaaaauuccuuuugaaauaauggauuuggagaaaagacauguccucggccgguugauuacugugaacccuauuguaacagaaaaagauuccccaguuaauaucgaagcugaaccacccuucggugauucuuauauuauaauuggcguugaaccaggucaauuaaaauugagcugguucaagaaaggcucaucaauaggccaaauguuugaaacaacaaugcguggcgcaaaaagaauggcgauauuaggagacacugcuugggacuuuggaucauuaggagguguauuuacgucgauaggcaaagcgcuccaccaaguguuuggcgccauuuauggagcagccuuuucaggaguaucauggacuaugaaaauccuuauuggaguuguuauuacauggauagguaugaacucacguagcaccagccuuaguguaucucuuguucuaguuggcguaguaacuuuguaucuaggagucaugguucaagcagauaguggcugcgucguauccuggaaaaauaaagaacuaaaauguggaucagggaucuuuauuacugauaauguacauacguggacagaacaguacaaauuccagccagaaucaccauccaaacuugcaagcgccauucaaaaagcucacgaagaggggauuugcgguauacguagcguaacaagguuggaaaaucucauguggaaacaaauaacgccagaguuaaaucauauacuaaccgagaaugaagugaaacuaacaauuaugacaggcgauauaaaaggaaucaugcaagcaggcaaaagaacacugagaccccaaccuacagaauugaaauauuccuggaaagccuggggcaaggcuaaaauguuauccacagaacugcauaaucauacuuuccuaaucgaugguccugaaacagcagaauguccuaacacuaaccgagccuggaacucacucgaaguugaagacuauggauuuggugucuucacuaccaauauuuggcuaaaacuuaaggaacgacaagacguauuuugugauaguaaacugaugagcgcggcuauaaaagauaaucgggcagugcacgcagauaugggauacuggauugaaucagcauuaaacgauacguggaaaauugagaaagccuccuuuauugaaguuaaaucaugccauuggccaaaaagucacacauuauggucuaauggcguucuugagucugaaaugaucauuccuaaaaauuuugcggggccgguuucacaacacaauuaccgaccgggauaucacacucaaacggcaggaccauggcaccuaggaagacuagaaauggauuuugacuucugugaaggaaccacgguugugguuacagaggacugcggaaauagaggcccuaguuuaagaacaacaacggcgaguggcaaacuuauuacagaaugguguugcagaucauguacucuaccacccuuacgauaucgaggugaagaugguugcugguaugguauggaaauacguccccuaaaggaaaaagaagaaaacuuaguaaauucucuaguaaccgcuggacaugggcaaauagauaacuuuucucucgguguccuagguauggcacucuuucuugaagaaaugcuacguacacgggucggaacaaaacacgcgauacuucucguagcuguuagcuucguaacccucauaacggguaacaugucauuccgagaccugggucgugucaugguaaugguaggagccacaaugaccgacgauauagggaugggcgucacauacuuagcguuauuagcagcuuuuaaaauaagaccaacuuuugcagcgggacuacuuuuaagaaaacucaccagcaaagaacuaaugaugacuacgauugggauaguuuuacugagccagucaacaaucccggaaucaauccuagaauugacagaugcucuagcguuaggaaugaugguucuuaaaauaguaaggaauauggagaaauaucaacuugccgucacuaucauggccauacuaugcguucccaacgccguuauauugcaaaacgcuuggaaaguaaguugcacuacacuagcuguagugucaguaagcccacuacugcuaacaaguucacaacagaaggcagacuggauucccuuagcgcucacuaucaagggcuuaaacccgacagcaauauuccugacuacccuuucccguacgagcaagaaacggucauggcccuuaaaugaagcuaucauggccguaggcaugguaaguauccuagcuucaucauuauuaaagaacgauauaccaaugacuggaccuuuaguagcagggggauugcuaacaguguguuacguucugacugggagauccgcggaccuggagcuagaacgugcggcggauguuaggugggaagaacaagcugaaauuagcgguagcaguccuauuuugagcauaacgauuagcgaagauggaagcaugucaauuaaaaacgaagaagaagaacaaacuuuaacaauauugauacggacaggacuucugguaauaucaggacucuucccgguaaguauccccauuacagcagccgcaugguauuuaugggaagugaagaaacaacgcgcagggguacuuugggacguacccucaccaccaccgguugggaaggccgaauuggaggauggagcguaccguaucaaacaaaaaggaauauuagguuauagccagauaggugccggaguguacaaggagggcacauuucacaccauguggcauguuacaagaggagcugucuuaaugcacaaaggaaagcgaauugaaccaagcugggcagacgucaagaaagaucuaauaucuuauggcggcggauggaaacuagagggugaauggaaagaaggugaagaaguccaaguuuuagcuuuagaaccugguaaaaauccacgugccguacaaaccaagcccggacuauucaaaacaaacacuggaaccaucggcgcgguuucacuagauuucuccccuggaacaagugguagcccaauaguggacaagaaaggcaaaguaguuggcuuauacgggaauggaguaguaacaagguccggcacauacgucuccgcaauugcgcaaacugagaaaaguauagaagauaauccagaaaucgaagaugauauuuuuagaaagaaacgucuuacaauuauggauuugcauccaggagccggcaaaaccaagagauaucuccccgcaaucgucagggaagcaauaaaacgggggcuaagaacgcuuaucuuagcaccaacaagagugguggcagcugaaauggaagaagccuuaagaggacuucccauccgauaucagacuccagcuauaagggccgagcauaccggaagagagauaguagauuuaaugugccaugcaaccuuuaccaugcgcuuguuaucccccauaagaguacccaauuauaauuuaauaaucauggacgaagcucauuucacggaucccgcaagcauugcggccagaggcuauauaucaacaagaguugaaaugggcgaggcagcuggcauauuuaugaccgcaacaccuccaggcucccgagauccuuuuccucaaucgaaugcuccaaucauggacgaagaaaaggaaauaccugaacguaguuggaauaguggucaugaaugggugacagacuucaaagggaaaacagucugguuugugcccucaauaaaagcuggaaaugacauagcggcaugcuuacguaaaaacgguaagaaagucauccagcuaucucgcaaaacauuugacagcgaauauauuaaaacccguacaaaugauugggacuucguaguaaccacugacauuucagagaugggcgcuaacuuuaaagcagaaaggguaauagacccaagaagaugcaugaagccgguuauacuuacagacggagaagaacgugucauccuugcagguccaaugccggugacucauucuagugcggcgcagagacgagggagagucgguaggaaucccaagaacgaaaaugaucaauacauauauaugggcgaaccacuggagaacgaugaagacugugcccacuggaaagaagcaaaaauguuacuagacaauauuaauacuccggaaggaauaauacccaguauguuugaaccagaaagggagaaaguagacgcaaucgauggagaguacagacuaagaggcgaagccagaaagacuuuuguagaccuaaugaggagaggagauuuacccguaugguuagcauaccguguagcggcagaagguaucaauuaugcugacagaagaugguguuucgauggaguuaaaaacaaucaaauauuagaggagaacguagaaguggaaaucuggaccaaagagggagagaggaagaaauuaaaaccaagauggcuugaugccagaacauauagugauccacuggcauuaaaagaguucaaagaguuugccgcaggcagaaagucucuaacauuaaaucuuauuacagaaaugggaagauuaccgacauuuaugacucagaaagccaaaaaugcacuugacaaccuugcugucuuacauacagcugaagcuggggguagagcauacaaccacgcccuauccgaacucccagaaacuuuggaaacacuacuauuauuaacucuucuugcaacaguuaccggugguaucuucuuguuuuuaaugaguggcaaggguauaggcaaaaugacauuggguaugugcuguauuauaacggcaagcauacuuuugugguaugcccaaauacaaccacacuggauagcggcgucaauuaucuuagaguucuuucuaauaguccuucucauaccugaaccagaaaagcaaagaacaccccaagauaaccaguugacauaugugguaauagcuauauuaacugugguugccgccaccauggcaaaugagaugggcuuuuuggagaaaaccaagaaagacuuuggucuaggaucaauaaccacacagcaaccagagaguaauauacuugauauagaucuucgaccagcuagcgcuuggacauuguaugccguugcuacuaccuuuaucacccccauguuacgacacucaauagaaaauucuuccguuaacgugucacuuacugcaauugcaaaucaggcuacaguauuaauggguuuggggaagggauggcccuuaucgaagauggauauaggcgucccccuucuagcgaucgguugcuauagucaagucaauccuauuacccucacagcagcucuacuacuguuaguagcacauuaugcaauaaucggaccaggguuacaagcaaaagcaacgcgugaggcucagaaaagagcagccgcuggcauuaugaaaaacccgacuguagauggcaugacuguuauugaucuagacccuauacccuaugauccuaaguuugaaaagcaauuaggucaaguaauguuguuggugcucugcgugacacaaguauuaaugaugagaaccacuugggcacuaugugaagcguugacccuagcaacagggccaauuucgacauuaugggaaggaaaccccggcagauucuggaacaccacgauagcuguguccauggcaaacaucuuuagggggucuuaucuagccggagccgguuuauuauuuucaauaaugaaaaacacugcaaacacaagaagaggcacagguaauacgggugaaacuuugggggaaaaauggaaaaauagacuuaacgcucuaggaaagucugaguuccaaaucuacaagaaaucggguauacaagaaguggacagaacucucgcaaaagaagguauaaaaaggggugaaaccgaccaccaugcaguuucacggggaucagcuaaauuacgaugguucguugaacguaaucucguaacuccagaaggaaaagugguagaucuaggcugugguagggguggauggucauacuacuguggagggcuuaaaaaugucaaggaaguaaaaggacuaacuaaaggcggaccuggacaugaagaaccaauacccaugagcacguauggauggaaucucguccgacuccaaagugggguagauguauuuuucacaccgccugaaaaaugugauacgcucuuaugcgauauuggagagucaucaccgaacccgacaguugaggcggggcgaacacugagaguucugaaucuaguggagaauugguugaacaauaauacacaauuuuguauuaaaguccucaauccuuauaugcccucagugaucgagaaaauggaggcacugcaacggaaauacggcggcgcauuaguuaggaacccuuuaucuagaaauaguacccaugagauguacugggucucuaaugccucagggaauauaguaagcucgguaaacaugauuaguagaauguuaauaaauagauucacuaugaggcauaagaaggcaacguacgaaccugacguagaucuaggaagcggcacacgaaacauaggaauugaaucugaaacaccaaaucuagauauuauagggaaaaggauagaaaagaucaaacaagaacacgagacaucauggcacuacgaccaagaucacccauacaaaacaugggcauaccauggcaguuacgagaccaaacaaacagguuccgccucaucuauggugaauggaguuguuaggcucuuaacgaaacccugggauguaauuccuauggucacacaaauggcaaugacugauacaacuccguuuggacaacaaagaguguuuaaagagaaaguggauacucgaacacaagaaccaaaagagggaacuaagaaacucaugaaaauuaccgcagagugguuauggaaagaguuggggaagaagaaaacuccaagaauguguacaagagaggaauuuaccagaaaaguacgcucaaaugccgcacuuggcgccauauuuaccgacgaaaacaaauggaaaagugccagagaagcaguugaagauaguggguuuugggaauugguagauaaagaacgcaauuuacaccucgaaggaaaaugugagacguguguauauaacaugaugggaaagagagagaagaaacuuggagaguucggaaaggccaaaggcagucgugcuauaugguauauguggcucggagcacgcuuucuagaguucgaagcguuaggauuccuuaacgaagaucacugguucucaagagaaaauucgcuaucaggcguagaaggugaaggacuacauaaguuaggauacauauuaagagacguuucuaaaaaggaaggcggugcgauguaugcugacgauaccgcaggcugggacaccagaauuacuuuggaagaccuaaagaaugaggaaauggugacaaaucauauggagggagaacacaagaaguuagcugaagcaauuuuuaaacuuacuuaccaaaacaaaguaguaagaguccaaagaccaacgccucgugguacaguaauggauauuauuaguagaagggaucaacgcggaucaggucaaguugugacuuauggacucaauacauucacaaacauggaggcucaguuaauacgccaaauggaaggugaaggaguguuuaagucaauccaacagcuaacgguaaaagaagaaauagcaguuaaaaacugguugauccgaguaggaagagagagacuaucucguauggcuaucucuggagacgauuguguaguuaaaccuuuagaugaucguuucgcauccgcucucacugcguuaaaugauauggguaaaguccgcaaagacauucaacaaugggaacccucaagggguuggaaugauuggacucaaguuccauucugcagucaucauuuccacgaacuaauuaugaaagacggaagaguauuagucgugccaugccggaaccaagaugagcuuauugggagagcuagaauaucucagggcgcugguuggucguuaagagaaacagcgugccuaggaaaaaguuaugcccaaauguggagucuuauguauuuucauagacgcgacuuaagauuggccgccaacgcaauauguagugcaguacccucacacuggaucccaacaagucggacaaccuggagcauacacgcaacccaugaguggaugacaaccgaagauaugcugaccgucuggaaucgggucuggauccaagagaauccguggauggaagauaaaacacccguugaauccugggaggagauaccauauuuggguaaaagagaagaccaauggugcggaucguugauuggacugacaucucgagcaacgugggcuaaaaacauucaaacggcuauuaaucaaguacgaaguuugauaggaaaugaagaauauacagauuauaugccaagcaugaaacgguuucgacgugaagaggaagaagccgguguacuuugguaa

SEQ ID NO: 22811 - RNA, 9876 nt, Artificial Sequence
  derived and/or modified CDS sequence (opt6) from DENV-2__KC964095__SS-prME
ucagcgggaaugauaauuaugcuuauaccaacaguaauggcauuccacuugacgacucgaaacggugaaccgcacaugauugugagcauacaggaaaaaggaaaaaguuuauuguuuaaaacagaagauggaguaaacaugugcacuuuaauggccauggauuuaggggaacuuugugaagauacaauuacauauaaaugcccgcuacuuagacaaaacgaaccugaagacauugaucgcuggugcaacucuacaaguacauggguaacguaugguacauguaccacuaccggggaacauagacgcgagaaaagaucugucgcacucgugccacauguuggaaugggucuagaaacucgaacugaaacauggaugaguucugagggagcuuggaaacacgcacaaagaaucgaaacauggauucuaagacauccaggcuuuacaauaauggcugcaaucuuagcguauaccaucggaaccacgcacuuccaaagggcucugauauucauauuauugacagcagucgcucccccaaugacgaugagauguauuggcaucucgaacagggauuucguggaaggaguuucaggaggaaguuggguugacauagugcuagagcauggauccugcguaacaacaauggcuaaaaacaaaccaacccuugauuucgagcugauaaaaacugaagccaaacaaccggccaccuuaagaaaauacuguauagaagcuaaauuaacuaauaccacaacagagucgagaugcccaacucagggugaaccgucauuaaaagaagaacaagacaaaagguucguauguaaacauucgauuguggauaggggaugggguaacggcugugggagcuuuggcaaaggagggauuguaaccugugcaauguuuacauguaagaaaaauauggagggcaagauaguacagccggaaaauuuagaauauacaauaguagugacaccacauaguggugaggagcaugcaauugguaacgacacgggcaaacacggcaaagaaauuaaaguuacgccccaaaguucaguuacggaagcggaacuuacaggauacgguacagugacaaucgaaugcagcccucguacugguuuagauuucaacgagauggugcuccuacaaauggguaauaaggcuuggcuaguucauagacaaugguucuuggauuuacccuuacccugguuaccgggagccgacacacaggguucaaauuggauccaaaaagaaacgcuuguaacauucaaaaauccucacgcuaagaaacaagauguugucguucucgguucacaggaaggugccaugcauaccgcauuaacuggugcuacugaaauucaaaugucgucuggcaauuuacucuuuacaggacaccuuaaaugcggccuacguauggauaaauuacaacucaaagggaugucuuauaguaugugcaccggcaaauucaaagugguaaaggaaauagcggaaacucagcacggaacaauagucauacggguacaauaugaaggcgauggcucaccgugcaaaauaccauucgaaauaauggauuuagagaagagauacguacucggaagauuaaucacggucaaucccauugugacagaaaaggauucacccguaaacauagaggcugagcccccauucggugauaguuauaucauaauaggcguagaaccggggcaguuaaaacucaauugguucaagaaaggaucaucaauaggccaaauguucgaaacuacaaugagaggagcaaaaagaauggcaauacuaggggacacagcgugggauuucgguucucuaggcggaguauuuacauccauagguaaagcgcuucaucaaguauuuggagcaaucuauggggccgccuuuucagguguaucguggacuaugaaaauacuaauuggcguuauuauaacuuggaucgguaugaacaguaggucgaccagucuaucuguuagccugguccucguugguauaguuacccuauaucugggaguuaugguucaggccgauucagguugcguuguuagcuggaaaaauaaggaauugaaauguggaaguggaauauucaucacagacaauguacguacauggacagagcaauacaaauuucagccggagucaccuaguaaacuagcuucagcgauucaaaaagcccaagaagaagggauuuguggcauucguucagugacaaggcuagaaaaccuaauguggaaacaaauaaccccagaacuaaaucauauucuugcugagaacgaaguuaaauuaacaauuaugacuggcgacauaaaaggaacaaugcaagcgggcaaacgcucguuaaggccacaaccaacagaacuuaaguauaguuggaaaacauggggcaaggcaaaaaugcuaucuacugaaagucauaaucagacuuuucuaauagauggaccugagacggcugaauguccaaauacuaaucgcgcauggaacucauuagaagucgaagauuauggauucggaauguucacgacgaacauauggcuacaacuuaaagagaaacaggaugcauucugcgauucaaagcuaaugucagcagcuauuaaggacaauagagcagugcaugcugacaugggguauuggauagaaucagcgcuaaacgauacauggaaaauagaaaaggcaucauucauagagguuaagaacugucauuggcccaaaagucacacucucuggucaaaugggguguuagaaagugagaugaucauucccaaaaauuuggcgggaccaguaucucaacacaacuaucgcccaggauaucacacacaaauagcugggccguggcaccaaggaaaacccgagauggacuuugacuuuugugaugguacuacaguuguaguaacggaagauugcgguaauaggggcccgucauuacguacuacaacagccagcggaaaauugaucacagaguggugcuguagaaguugcacgcugccgccacucagauauagaggggaagauggauguugguacgggauggaaauaagaccgcucaaagaaaaagaagaaaaucuaguaaauaguuuagucacagcaggccauggucaaauagauaauuuuucauuggguguacuaggaauggcgcuuuuccuugaagagaugcuacgaacuagagucgggacuaaacaugcgauacuauuaguagcaguaaguuuuguuacauugaucaccggcaauaugucauuuaaagaccuaggccgggucguagucaugguaggagcaacuaugacagacgauaucgguaugggcgucacguaucuagcauugcuagcugcuuucaagguuagaccaacauucgccgcugguuuauuauuacgaaaauuaacuucaaaagaguugaugaugacuacaauugguauaguuuugcuaagccaauccacaauccccgaaacuguuuuagaauuaaccgacgcucucgcacuggguaugauggcacuuaaaauugucagagauauggaaaaguaccaacuugcagugacaaucauggcaauucuuugugucccaaacgcgguaauucuccaaaacgcauggaaaguaaguuguaccauccuagcaguaguuucuguaaguccucuucuacugacaagcagucagcagaaaacagauuggauuccacuugcucuaaccaucaaaggacuuaauccaacagcgauauuuuuaacgacgcuaucucgaacuaacaagaaaaggaguuggccucuaaaugaagcaauuauggcgguaggcauggucagcauauuggccaguagccuccuuaagaaugauauuccaaugacagguccucugguugcaggaggauuacuuacagugugcuauguacuaacagggagaucugccgauuuggaauuagaaagggcaacggacguuaacugggaagaccaagcggaaauaagugggagcucaccaauacuuucaauaaccaucucggaagacggaaguaugagcaucaaaaaugaagaagaagaacaaacccucacgauucuaauucgaacuggccuuuuaguuaucagcggacucuuuccugugucaauuccgauuacagcagcggccugguauuugugggaggugaagaaacagcgggcugguguacugugggacguuccgucaccaccaccuaugggaaaagcagaacucgaggauggggccuauagaauaaaacaaaaaggaguguuagguuauucacaaauaggggcaggggucuauaaagaaggaacauuucauacgauguggcacguuaccagaggggcgguuuuaaugcauaaagguaaacguauagagccuucuugggcagaugucaagaaagauuuaauaucguauggaggaggguggaaauuaggcggcgaguggaaggaaggagaagaaguacagguguuggcacuugagccgggcaaaaacccaagggcagugcagacgaagccuggacucuuuaaaacaaacaccggaacaauaggcgcagugucuuuagacuuuucgccuggcacaaguggcucaccaaucauagacaagaaaggaaaaguagaaggacuuuaugguaacggagugguuacaagaaguggaacuuauguaagcgcgauagcgcaaacagagaaaucuaucgaggacaacccagaaauagaggacgacauuuuccggaagaaacgauuaaccauuauggaucugcacccgggagcaggaaagacuaagagguaccucccagccauuguuagagaggcaauaaagagaggucuccgaacuuuaauucuagcuccaacgcgugucgucgcagcggaaauggaagaggcacuucgcggauugccaauacgcuaucaaacaccggcaaucagagccgaacauacuggcagggaaaucguugaccuuaugugucaugcaacauuuacaaugcgacugcucucuccagugagaguaccgaauuacaaucugauaauuauggaugaagcccacuucacagacccagcgucuauugcagcuagagguuacauauccacgaggguagaaaugggcgaagcagcgggaauauuuaugacugcuacgccacccgguucacgugaccccuucccacaaucaaaugcaccaauaauagaugaagagagggaaauaccagaacgcaguuggaacucaggccaugaguggguaaccgacuuuaaagguaagaccguuugguucguccccaguauaaaagccggaaacgauauugcagcaugccuaaggaaaaaugguaaaaagguaauucagcuaucuagaaaaacauucgacagcgaauauguuaagacaagaaccaacgacugggacuuuguagugacuacugacauuagugaaaugggcgcgaauuuuaaggccgaaagaguaaucgaucccaggagaugcaugaagccaguaauucuuacagauggagaggaacgggucaucuuagcaggaccaaugccgguaacacauucuuccgccgcacaaagaagaggaagaauaggucggaauccuaagaaugaaaaugaucaguauauauauaugggugaaccacuagaaaacgaugaagauugcgcacauuggaaagaagccaaaauguugcuggauaauauaaauaccccugaaggcauaauaccauccauguucgagcccgagagggaaaaaguagaugcaaucgauggagaguaccgacuaaggggcgaagcuaggaaaacuuucguagaucuaaugagaagaggugacuuaccuguuugguuagccuacaaaguggcagcagaaggaauaaauuaugcugacagaagauggugcuucgauggaauuaaaaacaaucagauccuagaagaaaauguagaaguagaaauauggaccaaagaaggagagcggaagaaauugaaaccgcgauggcuagaugcccguauuuauagugauccauuagcucuaaaagaauuuaaagaauuugcagcggguagaaagagucuaaccuugaacuuaauuaccgaaaugggacgucuaccgacauucaugacucagaagacacgggaugcucuggacaauuuagcuguauuacauaccgcagaggccggaggcagagcauacaaucacgcucuaucagaguugccggagacacuagaaacacuacugcucuugacccuucuggcgacugucacuggaggcauauuucucuuuuuaaugucagggagaggaauugggaaaaugacccugggaaugugcugcauaauuacagccucuauauuacuaugguaugcccaaauucaaccacacuggauugccgcgagcauaauacuugaguucuuucuuauuguuuuacugauuccagaacccgaaaaacaaagaacaccgcaagacaaucaacucaccuacgucguuauugcuauacugacuguuguagcagcgacaauggcuaacgaaaugggauuucuagagaaaaccaagaaagaucuaggauuagggucuauaacaacacaacaaccagaaaguaacauccuagacauugaccuaccuccagcaucugcuuggacccucuaugcugucgcgacaacauuuguaacuccaaugcucagacacucgauugaaaauuccucagucaacgugucuuuaacggccaucgcuaaucaggcaacaguauugaugggacucggcaagggguggccacuuucuaaaauggauauuggaguuccuuuacuugccauugggugcuauucacagguaaauccuaucacccuuacugccgcuuuguugcuucuuguagcgcauuacgcaaucaucgguccaggcuuacaagcaaaagcgacaagagaagcacaaaagcgagcugccgcuggcauaaugaaaaauccuaccguugaugguauuacggucaucgaucuagaucccauuccuuacgaucccaaguucgagaaacaacuugggcaaguaaugcuucucguguuguguguaacgcaagugcuaaugaugaggacaacaugggcgcucugugaggcuuuaacuuuagcaacaggacccaucucgacacugugggagggcaacccugggcgauuuuggaacaccacaauagcuguuuccauggcaaauauauuuagaggcucauaucuggcuggagccggauugcuauuuucaauaaugaagaauaccacgaauacucgacgggguacugggaacauuggagagacccuuggagaaaaauggaaaagcagauuaaacgcacuagggaaaagcgaauuucagauauauaagaaaucaggaauccaagaaguggaccgaacuuuagcuaaggagggaauuaaacgaggugaaacggaucaucaugcaguaucacgagggagcgcaaaauuaagaugguuuguagaaagaaauaugguuaccccagaaggaaaagucguagaccuuggguguggcagagguggcuggucauauuauuguggcggauugaaaaacguccgugaaguuaaggguuuaaccaaaggggguccagggcaugaggaaccaauaccaaugagcacuuauggauggaaucuuguaagauuacaaagcggaguagauguauucuuuauacccccagaaaaaugugacacguuacuaugugauaucggagaauggucgccuaauccgacuguugaagccgguagaacucuacgugugcucaaucuuguagagaauugguuaaacaauaacacccaauuuuguauaaagguucugaacccguacaugccaagugucauagagaaaauggaaacguuacaaagaaaauacggaggagccuugguaaggaacccacugagcagaaauucaacucacgaaauguauugggugaguaacgcaucggggaauauuguaagcagcgucaauaugaucucuagaaugcucaucaauagauuuaccaugaggcauaagaaagcaacuuaugaaccagacguagauuuaggaucuggaacaagaaauauuggaaucgaauccgaaacgccaaauuuagauauaauaggaaagcguauugguaagauaaaacaagaacacgaaaccaguuggcacuacgaucaagaccauccauauaaaacgugggccuaucacgguucuuaugaaaccaaacaaacagggucggcaaguaguaugguugauggagucguaagacuacuuacaaagccgugggacgucauaccuauggugacucaaauggcaaugacagauaccacuccuuuugggcaacagagagucuuuaaggaaaagguugacacucgcacacaagagccgaaagagggaacaaagaaauuaaugaaaauuacugcggagugguuguggaaagaacuugguaagaaagagacccccagaauguguacacgggaagaguucacucgaaaaguaaggucuaacgcggcacuaggggcaauauuuacggaugagaauaaauggaaaagugcucgagaagccgucgaggauuccggguuuugggaacuggucgauaaggaaagaaaucuacauuuagaaggcaagugugaaacuuguguuuauaacaugauggggaaaagagagaagaaauugggugaauuugguaaagcaaaagguucgcgagcaauaugguacauguggcuaggagccagguucuuagaauuugaagcucuaggauuuuuaaaugaagaccacugguuuucaagagaaaacagccuaagugggguugaaggagagggucuacacaaacucgguuacauauuacgugaugucucgaagaaggaaggaggagcaauguacgcggaugacacugcuggaugggacacccguauaacauuagaagaucugaaaaaugaggaaaugguaaccaaucauauggaaggagagcauaaaaagcuagcugaagcaauauuuaaauuaacguaccaaaauaaaguuguuagaguccaacggccgccuccgcgcgguacgguaauggauaucauaucacgaagagaucaaagagggucaggacaagucgucacuuauggucuuaauacauuuaccaauauggaagcgcaauuaauaagacagauggaaggagaaggaguuuucaaaaauauucaacaucuuacuguaacagaagagauagccguacaaaauuggcuagcgagagucgguagagaaaggcuaagucgaauggcaauaaguggugaugauugcguaguaaagccacuagaugauagauuugcuagcgcgcucacagcuuuaaaugacgucggaaaaauccgaaaggacauccagcaaugggaacccuccagggggugggaugauuggacgcaagugccauucuguagccaccacagucaugaacugauuaugaaagauggaagaguauuggucguuccaugcagaaaucaggaugaauuaauuggcagagcaagaauaucacaaggugccggauggucguuaagggagacagcaugucuagguaaaaguuacgcccaaauguggucauuaauguacuuucauagacgugaucugcgacuagcagcgaacgcgauauguuccgcaguaccaucccauuggguaccuaccagccgaacaacauggagcauacacgcaaagcaugaauggaugacaacagaggacaugcuuacgguuuggaauagaguuuggauacaagaaaauccauggauggaggacaaaaccccgguagaaagcugggaagaaauccccuacuuaggcaaaagagaaggacaaugguguggaucccugauaggucugacaagcagagcaaccugggccaagaauauccagacggccauuaaucaaguuagaucuuugauaggcaacgaagaauauacagauuauaugccgaguaugaaacgguucagaagagaagaagaagaagcaggcguacucugguga

SEQ ID NO: 22812 - RNA, 9876 nt, Artificial Sequence
  derived and/or modified CDS sequence (opt6) from DENV-2__KC964094__SS-prME
agugcagggaugauaauaauguuaauuccgacaguuauggcauuucaccuuaccacgcgaaauggagaaccgcacaugauaguuucaauacaagaaaaagggaaaagucuguuauuuaaaacugaagauggaguaaacaugugcacgcuaauggcgauggaccuaggugaauuaugugaggacacaauaacguacaaauguccccuacuaagacagaacgaaccggaagauauagauugcuggugcaauucuacaucaaccugggugacguacggaacuuguaccacaacaggagaacacagaagagaaaaacguagcguagcauuagugccacacguggggaugggacuggagacacguacugaaacuuggaugucuuccgagggcgcguggaaacaugcucagcgaauugaaaccuggguacuuagacacccuggauuuacaauaauggcagccauacuugcauauacaauagggaccacuuauuuucaacgaguucuuaucuuuauauuauugacagcaguggcgccaucuaugacgaugagauccauagguaucucuaauagagacuuuguagagggagucucaggugguaguugggucgauguaguucucgagcauggaagcuguguuacaacaauggccaaaaacaaaccuacacuugauuuugaguuaacgaaaacagaagcaaaacauccugcaacuuuacguaaauauuguaucgaagcgaaacuuacuaauacuaccacugcaaguagauguccaacgcaaggcgagccuucgcuaaaugaagaacaggauaaacgcuuugugugcaaacacucuaugguagauagaggcuggggaaaugguuguggauuauuuggaaaaggcgggaucgugacaugugcaauguucacuuguaagaaaaauauggaaggaaaaguaguacagccggaaaaucuugaguauaccauuguaauuacaccucacaguggcgaggagaaugcaguaggcaaugauacugggaaacaugguaaagaaaucaaaguaacuccacaaaguucugugacggaagccgaacuuacgggcuaugggaccguuacaauggaguguucaccacgaacuggacuagauuuuaaugagaugguauuguuacaaaugaaaaauaaagcgugguuaguccauaggcaaugguucuuagaccuaccauuaccaugguuaccgggagccgacacacaggggucaaauuggauccaaaaagaaacccuaguaacauuuaaaaauccccacgcgaagaaacaggacgugguaguguuggggucgcaggaaggagccaugcacacagcauuaacuggagcaaccgaaauccagauguccucaggcaauuuauuguucaccggccaccuuaaauguagauugagaacagauaaauugcaauuaaaaggaaugaguuacaguauguguacaggaaaauuuaaggugguaaaagaaauugcggaaacacaacacggaacuauaguaauacguguccaauaugaaggugacggcaguccuuguaaaauaccuuuugaaauaauggauuuagaaaaacgacacguauugggacgacugauuacgguuaauccgaucgugacagaaaaggauucuccuguuaauauagaagcagaaccaccuuuuggagacucauacauaauaauugguguagaaccaggccagcucaaguuaagcugguuuaagaaagaauccuccauaggucagauguuugaaacuacgaugagaggggcaaaacgaauggcuauacuaggugacaccgcaugggauuucggcucccuuggagggguauucacgucuaucgggaaagcacuacaccaagucuuuggugcuauuuacggggccgcguuuuccgguguuucauggacuaugaaaaucuuaauaggaguuguuauaacauggauaggaaugaacucucgaucgaccaguuugucaguuagccuaguguugguagggguggucacacuauaccuaggcguaaugguacaagccgauucaggaugugucguuaguuggaagaacaaagaauugaaaugcgguuccgggaucuuugugacagacaauguacauacuuggacugaacaguauaaguuucagccagaaagccccucuaaacuugcauccgcaauacaaaaagcgcaugaggaaggaauaugcggaaucaggucgguaacaagauuagaaaacuuaauguggaaacagaucacgccagaguuaaaucauauacuaucugaaaacgaaguuaaauuaacaauaaugacuggagauaucaagggaauuaugcaagcugguaagcgaucuuugagaccccaaccuaccgaguuaaaauauuccuggaaagcguggggaaaagcaaagaugcuuagcacugaauuacacaaccauacuuuucucauugacgggccagagaccgcagaaagaccaaauacaaacagggcuuggaacuccuuagaaguagaagacuaugguuucggcguauucacaaccaauauuuggcuuaaacuaaaagaaagacaagauguuuucugugauucuaaacuaaugucggcggcaauaaaggauaacagggcgguccacgccgacaugggguauuggaucgagagcgcuuuaaacgacacguggaaaauugaaaaagcaucguucaucgaaguuaaaucaugucauuggccaaaaucacacacacuauggucgaaugguguauuagagucagagaugauaauacccaaaaauuuugcugggcccgugagccaacauaacuaccgaccuggauaucauacacaaacugcaggccccuggcaccucggaagguuagaaauggauuuugacuuuugugaagggacuacuguagugguaacagaagacuguggaaauagggggccaucacuccgcacgacuacggcaucaggaaagcugauaaccgaaugguguuguagaucauguacgcugccuccauuacgauacagaggagaagacggauguugguacgggauggagauacguccguugaaggaaaaagaagagaauuuaguaaauagccuaguaacagcaggucaugggcaaauugacaauuuuucgcugggcguuuuaggcauggcguuguuucuagaagaaaugcuacggaccagagucgguacaaagcaugcuauauuacuuguugcgguaucuuuuguaacccugaucacagguaacaugagcuuccgagaucuagguagagucaugguaaugguaggcgcaacgaugaccgaugacauaggaaugggaguaacauaucuugcccuacucgcagcguuuaaaguuaggcccacauucgcagccggucuuuugcuaaggaaacuuacaaguaaggaacucaugaugacuacaauuggaauaguacuacuaagucaaucaacaauaccugaaacaauauuagaauuaaccgacgcuuuagcccucggcaugaugguucucaaaaucgucagaaauauggaaaaauaucagcuagcaguaacaauuauggcaauuuuaugcguucccaaugcagugaucuuacagaaugcuuggaagguaaguugcacuacgcuagcuguagugagugucucaccccugcuucucacaucgucgcaacaaaaagccgauuggauaccacuugcauugacuaucaaaggccuaaauccuacagccaucuucuuaaccacucucucacgaacgaguaagaagagaagcuggccauuaaacgaagcaaucauggcaguuggcauggugaguauucuagccucaaguuuauuaaagaaugacauaccuaugacagguccuuuaguagccggugguuugcuaacagucugcuaugucuuagcagggcggucagcagauuuagaguuagagagggccgcagacguucggugggaagaacaagcagaaauuaguggaucaagcccaauuuuaaguauaacgauaucugaagacggugggauguccauaaagaaugaggaagaagaacaaacguugacgauacuaauaagaacuggucugcuuguuaucucaggacucuuuccuguaagcauaccaauaacagcugcagcaugguaucucugggaaguaaagaaacagcgugcugguguacugugggauguaccaucgccgccgcccguaggcaaagcagagcuagaagacggcgcauauagaauaaagcaaaaaggaaucuugggguacagucaaauaggcgcugguguuuauaaggaagguaccuuccauacaauguggcaugugacaagaggggcaguacuaaugcauaagggaaagcggauagaaccaucuugggcagaugucaagaaagacuuaauauccuacggagggggcuggaaacuugaaggagaauggaaagaaggggaggaaauucaaguucuagcucuagaaccaggaaagaacccuagagcaguccaaacgaaaccagguuuauuuaagacaaacacggggacuauaggagcaguaagucuagauuucucaccaggaacauccgggagcccuauuguagauaaaaaggguaaaguagugggcuuauauggaaauggagugguaacgcgaaguggaaccuauguaagcgcuauugcacaaacagagaaaagcauagaagacaacccugaaauagaagacgacacauuuaggaagaaacgguugacgauaauggacuugcauccaggggccggaaaaaccaagagguaccuaccugcuauagucagagaagcaaucaagagagggcuaagaacucuaauauuggcgccuacacgaguaguagcugcagaaauggaggaggcccugagagguuuaccaaucagauaccaaaccccugcaauaagagcugaacauacgggaagagaaauaguagacuuaaugugccacgcaacguuuacaaugcggcuauugucacccauuagaguucccaacuauaaccugauuauaauggaugaagcacauuucacagauccugcaaguaucgcagcgcguggauacaucucaaccaggguggagaugggggaagcugcagguauauuuaugacggcaacgccucccggauccagagauccguuuccccaaucuaacgcaccuauaauggacgaagaaagagaaauaccugaaagaagcuggaacaguggacacgaauggguaacugauuuuaaggguaaaacugugugguuuguuccuaguauaaaagcaggaaacgauauagcagcguguuugagaaagaauggucgaaaaguaauucaauuaucaaggaaaaccagcgauucugaauauauuaaaacaagaacaaaugacugggauuucguaguuacaaccgauauuagugagaugggcgcgaauuucaaagccgaaagggucauagauccuaggcgaugcaugaaaccgguaauacuaacugacggagaggaaagaguuauacuugcugguccaaugccaguaacccauucaucggcagcucagaggagagguagaguuggcagaaauccgaagaaugaaaacgaucaauauauuuauaugggggaaccgcuagaaaaugaugaggauugcgcccauuggaaggaagcaaaaauguuacuagauaacauaaauacuccugagggaauaauuccaaguauguucgaaccugaaagagaaaaaguugaugccauagauggagaguacagguuaagaggagaagcacgaaagacauuugucgauuuaaugcggaggggagaucuacccguuuggcuugcauacagaguugccgccgaaggaaucaauuacgcagaucguagaugguguuucgaugggguuaaaaauaaccaaauauuggaggagaacguggaaguugaaauuuggacuaaagaaggagaacgcaagaaauugaaaccaagauggcuugacgccagaauauauucagacccguuagcuuuaaaggaguucaaggaauuugcagcaggccgaaaaagucuaaccuuaaaucuaaucacagaaaugggcagauuaccaacuuuuaugacacaaaaagcccgaaaugcauuagauaaccuugcaguccuacacacagcugaggcgggagggagagccuauaaccaugcauuaagugaguuacccgaaaccuuggaaacccuacuuuuguugacacuucuagcaacaguaacgggcggcauuuuccuauucuuaaugucgggaaaagguauaggaaagaugacuuuggggauguguuguauaauuacggccuccauauuauuaugguaugcacaaauacaaccgcauuggaucgcugcuucaaucauauuagaauuuuucuuaauaguuuuauugauuccugaacccgaaaagcaaaggacaccucaagauaaucaauuaacuuauguagucauagcaauccuuaccguuguagcagccacuauggcaaacgaaauggguuuccuugagaaaaccaagaaagacuuuggauuaggcucaauugccacacaacagccagaaaguaauauacuugauauagauuugcggccugcgucagcauggacauuauaugccguagcaacaacuuucaucaccccaauguugagacauaguauugaaaacucuagugugaauguaucccucacugcaauagcuaaccaagcaacaguacuuaugggauuaggaaaaggcuggccccucucaaaaauggacauugguguaccuuuauuagcaaucggauguuauagccaaguaaauccaauuacauugaccgcagcuuuguuacucuuaguggcacacuacgcaaucauugguccgggcuuacaggcuaaagcaacgagagaagcacaaaagagggcugccgcuggaauaaugaaaaauccuacaguugaugguauuacaguuauagauuuagacccuauucccuacgacccaaaauuugaaaaacaacuagggcagguaaugcuacucguccucugcguaacacaaguucuaaugaugagaacgacuugggcauuaugugaagcucuaacuuuagccacagggccaauuagcacacuuugggaagguaauccugggcgauucuggaauacgacgauagcuguaaguauggcuaacauauuucggggaaguuauuuagccggagcagguuuacuuuucaguauuaugaagaacacugcaaauacuagacgcggaacgggaaauaccggagaaacgcugggagaaaaguggaaaaacagacuuaacgcguugggaaaaagugaauuucaaauuuauaagaaaucggguauacaggaaguugauaggacacuagccaaagagggcauuaagagaggcgagacagaucaucaugcagucagucguggaagugcuaaauuacgaugguuuguagaacgaaauuuagugacaccagaggggaagguaguugaucuaggcuguggaagaggcggaugguccuauuacuguggaggacugaaaaauguaaaagaaguuaaagggcucacgaaaggaggcccaggccacgaggagccuauacccauguccacuuacggauggaaucuaguccguuuacaaucaggaguggauguguucuuuacaccaccagaaaaaugugacacauuacuuugcgauauaggagaaucaucaccgaacccaacuguagaagcagggcgaacauuacgaguacugaaucuaguagaaaacugguugaauaacaacacgcaauucuguauaaaaguauuaaauccauacaugcccagcguaauagagaaaauggaggcauugcaaaggaaguacgguggugcauuggucgguaacccuuuaucacgcaacuccacccacgaaauguauugggcgucuaacgcuaguggaaacauaguaucauccgucaauaugauuucaaggaugcuaauuaauagguucacaaugagacauaagaaagcaacauaugagccagauguagaccuagggucggguacaagacacauaggaauagagucugaaaccccuaauuuagauaucauaggaaaacgaauugagaaaauaaaacaggagcaugaaacaucguggcacugcgaccaggaucauccuuacaaaacaugggccuaucauggcagcuaugaagcuaaacagacuggaagcgcgucuuccaugguaaacggcguaguaagacuacucacaaaacccugggaugugauaccaaugguaacccaaauggcuaugacggauacaaccccauucgggcaacaaagaguauuuaaagagaaaguagauacuaggacacaagaaccgaaagaaggaacaaagaaauuaaugaaaauaacugcagaauggcuauggaaagaguuaggcaaaaagaaagcacccaggauguguacgagagaggaauuuacgcgaaaagugagguccaaugcggccuugggcgcuauguuuacggacgaaaauaaguggaaauccgcacgcgaagcagucgaggacucgggauucugggaauuaguggauaaagagaggaaucugcaucuugaagggaaaugcgaaacuugcguuuauaacaugauggggaaaagggagaagaaacugggugaguuuggcaaggcaaaagggucaagagcuauaugguacaugugguuaggggcuagauuuuuggaauuugaagcucucggauuccucaacgaagaccauugguuuucaagagaaaacagcuuaagcggaguggaaggugagggguuacauaaacuagguuauauuuugcgagacguaagcaaaaaggaagguggugcuauguaugcugaugauacugccgguugggacacgcgaaucacacuugaagauuuaaagaacgaggaaaugguuacaaaucacauggagggagaacauaagaaacuggccgaggcaauauucaaacuuacguaccaaaauaaggucgucaggguacaacgaccuacaccccgugguacgguuauggauauuauuucuaggagagaccaacgagguagugggcaaguaguuacauacggccuaaauacuuucacgaauauggaagcgcaacuuauuagacagauggagggagaaggaguguuuaaaaguauacaacaccugacaguaacagaagaaauugcagugaagaauugguuaguacggguggguagagagaggcuaucacgaauggcaaucucgggugaugacugcguaguaaagccguuggaugaucgauucgcuuccgcgcuuacugcucuuaaugacaugggcaaagugcguaaggauauacaacagugggaaccaucacgaggauggaacgauuggacacaaguacccuuuugcucucaucauuuucaugaauuaaucaugaaggacggaaggguccuagugguaccuugcaggaaucaagaugagcucauaggcagggcgagaauaucccaaggugcagguuggaguuuacgagaaacagcgugucuggggaaaagcuaugcucaaauguggagucuaauguacuuccacagacgagaccuucggcuagcugcaaacgcaauuuguucggcggucccgucucauuggguuccgaccucacguacuacauggaguauacacgccacacacgaguggaugacaacagaagacaugcuaacuguuuggaaccgcguuuggauacaagaaaacccuuggauggaggauaaaacaccuguggaauccugggaagagauccccuacuuaggaaaaagagaagaucaauggugugguucccuaauaggauuaacuucacgagccacuugggccaaaaauauacagacagcaauaaaucaaguucgauccuuaauaggcaacgaagaauauacagauuauaugccuagcaugaaaagauuuaggagagaagaagaggaagccgguguacuaugguag

SEQ ID NO: 22813 - RNA, 9876 nt, Artificial Sequence
  derived and/or modified CDS sequence (opt6) from DENV-2__KC964093__SS-prME
acugcaggaguaauuaucaugaugauaccaacuguaguggcauuucaccugacaacccgaaauggcgaaccacacaugauuguuaguagacaagaaaaagguaaaucauuauuguucaaaacagaaaaugggguuaauauguguacccucauggcgauggacuuaggcgaacuuugugaagacacaaucaccuacaauuguccucuucuacgucaaaaugaaccggaagauaucgauugcugguguaauaguacuucaacaugggucacauacggaacauguacugcaacuggugaacaccggcgugagaaaagauccguugcuuuagucccccaugucggaaugggacuggaaacucgaacagaaacguggaugagcagcgaaggagcauggaaacaugcgcaaaggaucgaaacuuggguacuuagacacccuggauucaccauaauggcagcgauccuagcuuauacaauagguacgacauacuuucagaggguguuaauuuucauucugcugacggcaguugcaccaagcaugacaaugcguugcauaggcauauccaaccgcgacuucgucgaagggguaucaggagguuccugggucgacauuguacuugaacauggaucuuguguaacuacaauggccaaaaauaaaccaacacuugauuucgaauugacaaaaacagaagcaaaacauccggcaacuuuacgcaaauacuguauugaagcaaaacucaccaacacaacuacggcuaguagaugcccaacccaaggggagccuucauuaaacgaagaacaggauaaacgauucguauguaaacauucuaugguugaccggggguggggaaauggcugcggcuuauuugggaaagggggcauaguaacuugugcuauguucacguguaagaaaaauauggaaggaaaaguaguacaaccagagaacuuggaguacacuauaguaauaacaccucacagcggagaggaaaacgugguuggcaaugacacuggcaaacauggcaaagaaaucaaagucaccccucaaagcucuauuacagaagcugaacuaacaggauauggaacaguaacaauggaaugcaguccccgaacaggcuuagauuucaaugaaaugguauuguugcaaauggaagauaaagcaugguuaguccauagacagugguuucuagaucuaccguugccauggcuuccaggggccgacacacaagguagcaauuggauacaaaaagaaacucuuguaacauucaaaaauccacaugccaagaaacaagacguuguuguauuaggaagucaggaaggugccaugcauaccgccuugacaggagcuacugaaauacaaaugaguagcggaaaucuucuauuuacaggucaucuuaaauguagauuaagaauggauaaacuucaacugaaagguauguccuauagcauguguacugguaaauuuaaagcuguuaaagagauugcagaaacacaacacgguacaaucguaauuagaguacaauacgaaggugaugggucaccauguaaaauaccauuugagauuauggaccuagaaaaacgccacguucugggccgacuaaucacugugaaucccauaguaacggaaaaagacucaccggugaacauagaagcagaaccaccguuuggugauucauauauaauaauaggaguagagcccggacaacugaaauugaguugguuuaagaaaggaucuucaauaggacagauguuugaaacaacaaugaggggugcaaaacgaauggcaauauuaggagacaccgcuugggauuuugguucucuaggagggguuuuuaccucaauuggaaaagcucugcaucaaguauuuggagccaucuacggugcggcauucaguggagugagcuggacgaugaaaauucuaaucggugucguuauuaccuggaucggcaugaacucuagauccaccucguuaucgguaucccuugucuuagugggcguagucacccucuaucucggugugaugguacaggcugauucuggcugugugguaucauggaaaaauaaagaacucaaaugcggcucggggauuuucauuacugacaacguacauacguggaccgagcaauacaaauuucaaccagaaaguccaucuaaacuggcaagcgcuauucagaaagcacaugaagaaggaaucuguggaauaagaucugugacacgucucgagaaccucauguggaaacagaucaccccagaacuaaaucauauauugagugaaaacgaggucaaacugacuauaaugacaggcgauauaaaaggcauaaugcaagcgggcaaaagaucauugcgcccgcaaccuacggaguugaaguauagcuggaaggcauggggaaaagccaaaaugcugaguacggaguuacacaaccacacuuuccuuauugaugguccugaaacugcggaguguccgaauacuaauagagcauggaacagccuagaaguugaagauuauggguuuggaguauuuaccacaaauaucuggcuaaaacuuaaagaacgacaagacguauuuugugauaguaaacucaugucagcagcaauaaaagauaacagggcaguccaugcagauaugggauauuggauagaaucggcucuuaacgauacuuggaaaauagaaaaggccagcuuuauagaagucaagucgugucauuggccgaagucgcauacucucuggaguaauggagugcuagaaagugagaugaucauacccaaaaauuucgcaggaccaguaucucaacacaauuacagaccaggguaucauacgcagacagcagggccguggcaccuugguaaacuggaaauggauuuugauuucugugaaggaacuaccgucgugguaacugaagacuguggaaaccggggaccuagcuuaaggacaacgacagccucgggaaaauugauuacggaaugguguugcagauccuguacccucccaccacuacgcuaccgaggcgaagauggaugcugguacgggauggagauaagaccacuaaaggaaaaagaggagaaucuaguaaauucccuuguuacugcugggcacgggcaaauugauaauuucucuuuagguguucuaggaauggcauuguuucuugaagaaaugcuuagaacgcguguugguacuaaacaugcaauucucuuaguugcgguaucuuuuguuaccuugaucacuggcaauaugagcucaagagacuuggguagaguuaugguaaugguaggagcaaccaugaccgacgauauugggaugggaguuacauaccuugccuuacuagcggcauucaaaguaaggccaacauuugcugccgggcuauugcucagaaaauuaacaaguaaggaacuaaugaugaccaccauagguauuguauugcuuucccaguccucuauaccagaaaccauacucgaacuaacagaugcucuugcucucggaaugaugguacuaaaaauuguacgaaacauggagaaguaucaauuagcuguuacaauaauggcaauccuguguguuccgaaugcaguaauauugcaaaacgcauggaaaguaucgugcacuacguuggcaguaguaucaguaucaccacuacuccuaacuuccucacaacaaaaggcagauuggauaccccuagcauugacgauaaaaggauuaaaccccacagcuauuuucuugacaacacuauccagaacaaguaaaaagagaucauggccauuaaacgaagcaauaauggcgguaggcaugguaaguauccuagcuucaucgcuucuuaaaaacgauauaccaaugaccggaccccuaguugcuggugggcuauuaacaguaugcuauguccuugcaggccgaucggcugaccuagaacuggaacgggcagcagauguaaggugggaagaacaggcagagauuagugguucaucuccaauauuaucuauaacuauaagugaagauggaggaaugucgaucaaaaaugaagaagaagaacaaacccucacuauacuuauaagaacaggauuauugguaaucaguggacuguuuccagucucuauaccgauaacugcugcagcgugguaccuuugggaggucaagaaacaacgggcgggaguacuuugggaugugcccaguccgcccccgguaggaaaagcagagcuugaagauggugcuuacaggaucaaacaaaagggaaucuuaggauacucucaaaucggagcggguguauauaaagaaggaacauuccauacaauguggcacgucacucggggagcuguuuuaaugcacaaaggcaaaagaaucgaaccaucgugggcugaugugaaaaaggaucuaauaaguuaugguggcggauggaaauuagaaggcgaguggaaagagggagaagaaauacaaguguuagccuuggaaccaggaaagaacccucgagccgugcaaacgaaaccaggccuauuuaaaacgaauacaggaacaauuggggcgguuagcuuggacuuuucgccaggaacaagugguaguccaauagucgauaagaaaggaaaagucguaggauuauacggaaacgguguggugacgagaucaggaacauauguaagugcaauagcgcaaacagagaaaucgaucgaagauaauccagaaauagaagaugauauauuuagaaagaaacgacuuacaaucauggauuugcauccaggagcggggaaaacaaaaagguaucuaccagcuauugugagagaagcuauaaagagggguuuacggacgcugauucuagcuccaacuagagucguugcagcagaaauggaagaagcucuaagaggucucccaauacguuaucaaacuccugccauuagagcagaacauaccgguagagaaauuguugaucucaugugucacgcaaccuucacaaugagguugcuuucaccaauucgcgucccaaacuacaaccuaauaaucauggacgaagcacauuuuacugauccggcgucaauagcugcacgcggcuacauuucaacccguguggaaaugggagaagcagcuggaauuuucaugacggcaaccccuccugggagccgagacccuuucccccaaucaaacgcaccaaucauggaugaagaaagagagauuccugaacgaaguuggaauaguggccaugaauggguaacagacuucaaagguaaaaccguaugguuuguaccaucaauaaaagcagguaacgauaucgcagcguguuuaaggaaaaaugggaagaaagucauacaguuaagccgcaagacuuuugauagcgaguauguaaaaacuagaacaaacgacugggauuuugucgugacaacugacaucagugagaugggagcaaauuuuaaagcggaacguguaaucgacccacggagauguaugaaaccugucauccuuacagacggcgaggagagaguaaucuuagccgguccgaugccgguaacucacucgagcgcagcacaacggcgggggagagucggacggaacccgaagaacgaaaaugaccaauacaucuauaugggagaaccuuuagaaaaugaugaagacugcgcccacuggaaagaagcaaaaauguuauuggauaauauaaauacucccgaaggaauuaucccuaguauguuugaaccugaaagagaaagaguagaugcaauagauggugaauauagacuucgaggugaagcaaggaagacauuuguugauuuaaugagacgaggagaucuuccugucugguuagcauaccguguggcagcugagggcaucaacuacgcagacagacgcuggugcuuugacggagugaagaauaaucaaauacucgaagaaaaugucgaagucgaaauauggacuaaggagggugaacgaaagaaauugaaaccccgguggcuugaugcaagaauuuauucggauccacuugcauuaaaagaauuuaaagaguucgcugcaggaagaaaaucccuuacgcucaauuuaauuaccgagauggguagacuucccacauucaugacgcaaaaggccagaaaugcauuagacgauuuagcuguccuacauaccgccgaagcaggaggucgcgcauauaaucacgcacucucggaguuaccagagacacuagaaacgcuauuguuacuaacacuguuggcuacaguaacgggcgguauauuuuuguucuugaugagcggcaaagggauaggaaaaaugacucugggcauguguuguaucaucacggccucaguucuacuaugguacgcacaaauacaaccucauuggaucgccgcaucgauaauccuggaguucuuucucauaguucuauugauuccugagcccgaaaaacaacgcaccccucaggauaaucaauuaacuuauguagcuauagcuauuuuaacgguuguagcagcuacaauggccaaugaaaugggauuucuagagaaaacuaagaaagacuuuggucuuggaucgaucgcaacucaacaaccagaaucgaauauuuuagauuuggacuugcggccagcaucagccuggacauuauaugccguagcaacaacauuuaucacgcccauguuaagacacuccaucgaaaauaguagcgucaauguaagucuaacugcuauagcaaaccaagcgacugucuuaaugggcuuaggaaagggauggccuuuaucuaaaauggacauuggcgugccacuccuagcaauaggcuguuauucucaagugaacccgaucaccuuaacagcagcauuacuacuuuugguggcacauuacgcaauaauagguccagggcuacaagcaaaagcuacaagagaagcgcagaaacgcgcagcagccgguauaaugaagaaccccacagucgauggaaucacuguaauugauuuagacccgaucccuuaugacccaaaguuugaaaaacaauuaggccaaguaaugcuucucguacuauguguaacucagguacuaaugaugagaacuacaugggcacuaugugaggcgcuuacauuagcuacagguccgauaagcaccuuaugggaagguaauccaggacguuuuuggaauacuacaauugcagugaguauggcaaacauuuucagaggaucauauuuagcuggaguuggacuauuauuuucaauaaugaaaaauacggcaaauacuaggagaggaaccggaaauacaggugaaacuuuaggugaaaaauggaaaaacaggcuaaacgcauuagguaagagcgaauuucaaauauacaagaagucgggcauucaagaaguugauaggacauuggcuaaagaaggaauuaagcguggagaaaccgaucaccacgcaguaucacgugggagcgcaaaacuucgcugguucguagagcgaaauuuagugacucccgagggcaaagucauggaucucggguguggaagagguggguggucuuacuauugcgggggacuaaagaacguaaaagaaguaaaagggcuuacuaaaggggguccaggacaugaagaaccaaucccuaugucaaccuacggcuggaaccuaguacgcuugcagucggguguugauguauucuuugcacccccagaaaaaugcgauacgcucuuaugcgauauaggagaaucuaguccuaaccccaccguggaagcaggcagaaccuugagaguguuaaacuuaguggaaaauugguuaaauaauaacacccaguucuguauaaagguucucaacccauacaugccaagcguuauagagaaaauggaagcgcuccaaagaaaauauggcggagcccuaguucguaacccacuaaguagaaauucaacucaugaaauguauugggucaguaacgcguccgguaauauuguaucuuccguuaauaugauaucacggaugcuuaucaaucgcuuuacuaugagacacaagaaagcuacauaugaaccugacguagacuuggguaguggaacaaggaauauagggauagaaucagaaauuccgaaucuagacauaauuggcaaacgaauugagaagauuaagcaggaacacgaaacuucguggcauuaugaccaagaccaucccuacaaaaccugggcauaucaugguucauacgaaacuaaacaaacaggaagcgcaucgaguauggucaauggaguagugcgucuguuaacuaaacccugggaugugauuccgauggucacucaaauggcaaugacagauacaacaccauuuggccagcaaagaguuuuuaaagagaaaguugauacccguacccaagaaccaaaagagggaacaaagaagcuaaugaaaauuacugcggaaugguuauggaaagaacugggcaagaagaaaaccccacggauguguacuagagaagaguucacaaggaaaguccgaucgaaugcagcguuaggcgcuauauuuacagaugaaaauaaauggaaaagcgccagagaagcuguagaagauagcggguuuugggagcuaguagauaaggaacgaaauuuacaucucgaagggaaaugcgagaccuguguauauaauaugauggguaaacgugagaagaaauugggagaguucggaaaagcaaaaggaucuagggccauaugguauauguggcuaggagcuagauuuuuagaauuugaagcucuaggauuccuaaaugaagaccauugguucucacgcgaaaauucacuaagugggguggaaggggaagguuugcauaaacuaggguauauacuacgugagguaucaaagaaagaaggcggagccauguacgccgaugacacugcuggaugggauacaaggauuacacuagaagaucuaaagaaugaggagauggucacaaaucacauggaaggagaacauaaaaaguuagcggaggcaauauucaaacuaacguaucaaaauaaagucgucagaguacagagaccgacgccacgagggacgguuauggauauaauaagucggagagaucaacgagguucugggcaaguaguaacuuauggauuaaauacuuucacuaacauggaagcgcaauuaauaagacagauggaaggagaaggcguauuuaaaucaauacaacaccucacugucacugaggaaaucgcggucaaaaauuggcuuacaagaguaggacgugagagacuaagcagaauggcgauaucaggcgacgauugcguuguaaaaccucuagaugaucgauuugccagcgcguugacagcacuaaacgauaugggaaaggugagaaaagauauacagcagugggaacccucaaggggauggaaugauuggacccaagucccauuuugcucccaccauuuucacgaacuaaucaugaaagacgggagaguauuaguaguaccuugcagaaaucaagaugaacuaauuggcagggcaagaauaucacaaggugcuggauggagccuccgggaaacagcuugucuagguaagaguuacgcgcaaauguggagccucauguauuuccacaggcgagacuuaagauuagccgcaaacgccauaugcucugcggucccgucucacugggucccaacgagcagaacuacauggucaauacaugcuacccacgaguggaugacaacggaagacaugcuaacaguuuggaaccguguauggauucaagaaaaccccuggauggaagacaaaacaccaguggaaagcugggaagagauaccuuaucuugggaaaagggaggaucaauggugcggaagucuaaucggucuuacuucaagggcaacaugggccaaaaacauucagacggccauaaaccaaguuaggagccucauagggaaugaagaauauacagauuauaugccaucgaugaaacgauuuagacgagaagaaggagaagccggagugcuaugguaa

SEQ ID NO: 22814 - RNA, 9876 nt, Artificial Sequence
  derived and/or modified CDS sequence (opt6) from DENV-2__DQ448231__SS-prME
acagcggguguaauuauaauguuaauuccaacagcaauggcauuucauuugacuacccguaauggugaaccgcauaugaucguuucgagacaagaaaaaggaaaaagucuuuuguuuaaaaccgaagaugguguaaacaugugcacuuuaauggcaauggaccuaggggaauuaugugaagauaccauuaccuauaacuguccacuauuacgacaaaaugaaccugaagacauugauuguugguguaauucgacauccacuuggguaacuuauggaacauguacagcaacaggugaacaucgaagagagaaaagaucgguugcauugguuccacacguaggaauggguuuggaaacgagaacggaaacauggaugucgagugaaggagcauggaaacaugcucaacgcauugaaacauggauacuaagacauccaggauuuacuauaauggcagccauauuggccuauaccauuggcacuacuuauuuucaaagaguccuaauauuuauuuugcugacagcuguggccccauccaugacaaugagguguauaggcauuucuaacagggauuuuguggagggcguaaguggaggcucuuggguggacauagucuuggaacacggaucaugcguuacaacuauggccaaaaauaaaccaacgcuagauuucgaauuaauaaaaaccgaagcgaaacagccagcuacacuaagaaaauauugcauagaggcaaaauuaacgaacacuacgacagcaucucguugucccacgcaaggagagcccucauuaaaugaagaacaagauaaacgauucguaugcaaacacucgaugguggauaggggaugggguaauggaugcggucucuuugguaaagguggaauugucacaugugcgauguucacuuguaagaaaaacauggaagguaaaauaguucaaccagaaaaucuugaauauacuauugucguaacuccacauucaggagaagagaauacgguagggaaugauacaggaaaacacgguaaagaaauuaaaguaacaccacaaucaagcauaacagaggcugaacuuacugguuacggcacggugacaauggaauguucgccgcggaccggguuggauuuuaaugaaauggugcuuuugcaaauggagaauaaagcgugguuaguccaucggcaaugguuccucgaccuaccauugccaugguuaccuggggcggauacucagggcagcaacuggauacaaaaagagacauuaguaacauucaaaaauccccaugcgaagaaacaagauguaguaguucucgguucccaagagggcgccaugcauacugcacuuacaggagcaacagaaauucaaaugucgaguggaaaucuuuuauucaccgggcauuuaaaauguagacuuaggauggauaaacuucaacuaaaaggcaugaguuauuccauguguacuggaaaauucaaagucguaaaagaaauugcagagacccagcacggaaccaucguaguuagaguacaauacgaaggagauggcuccccaugcaaaauuccuuucgaaauuauggacuuggagaaacgccauguuuugggacgacuaauaaccguaaauccgauaguuacagagaaagauucaccaguaaauaucgaggcagaaccuccuuucggagacagcuacauaauuauaggcguagaaccagggcaacuuaaauuaaguugguucaagaaagguucaagcauaggacagauguucgagacuaccaugagaggggcaaaacguauggcuauacuaggggauacagcaugggacuuuggaucacuagguggaguuuuuacaaguauaggaaaagcccuucaucagguauuuggagcgauuuauggugcggcauuuagcgguguaagcuggacaaugaagauacuuauuggggucguaaucacauggauuggaaugaacucuagaucuacuucucuaaguguaucacuugucuuaguugggguugucacacuauaucuugguguaaugguacaagcagauagcggcuguguagucuccuggaagaauaaggaguugaaaugcgggucaggaauuuuuaucacagacaauguacauacguggaccgagcaauauaaauuucaaccagagucacccucaaaguuagcuucagcaauacaaaaggcacaugaggaagguauaugugggauacgcucgguaacaagauuagaaaauuuaauguggaaacaaaucacacccgaauuaaaucauauucucucagaaaaugaaguuaaacugacuauuaugacaggagauauaaaggguaucaugcaagcuggaaaaagaucacuacgaccccaaccaacugaauuaaaauauagcuggaaaacgugggggaaagcaaaaauacugucgaccgaaccacauaaccaaacauuuuuaauugacggcccggaaacagcagaguguccaaauaccaacagggcauggaacucauuagaagucgaggauuauggauuugggguauuuacaaccaauauuuggcuaaaacuuaaagaaaggcaagauguauucugugauuccaaacuaaugucugcagcgauuaaagauaauagagcagugcacgcagacaugggguacuggauagagagugccuugaaugauacuuggaaaauagagaaggcuuccuuuauagaaguuaaaucuugucacuggccaaaaucucacacauuauggaguaacggaguacuagaaagugaaaugauaauaccgaagaauuuugcuggaccaguuagucaacacaacuauagaccuggauaucauacacagacugcgggaccguggcaucuaggaaaauuggaaauggauuuugacuuuugcgaagguacaacaguggucguaacugaagauugugggaauagagggcccaguuugcguacgacgaccgcuucuggcaaacuuaucaccgaaugguguugucggagcuguacuuugccaccccuacguuauagaggcgaagaugggugcugguauggaauggaaauacgaccacuuaaggaaaaagaagaaaaucucgucaauucacucgucacagccggucacgggcaaauagauaacuuuagucuuggaguuuuggguauggcucuauucuuagaagaaauguuaaggacaagaguugguacgaagcaugcaguacuccuaguagcuguuaguuuuaugacuuuaauaacugguaauaugucuuucagggaucugggucgaguuauggucaugguuggcgcagcaaugaccgaugauauuggaaugggugugacauacuuggcgcuucuagcagcguuuaaaguacggccuaccuuugcagcugggcuauuauuacguaaacucacguccaaagaguuaaugaugacuacuauaggaaucguauuauugucgcaaucaacgauuccugaaacaauuuuagaacuaacagacgcacuagcucugggaaugaugauauuaaagaucgugaggaacauggagaaauaccaacuagcaguaaccaucauggcaauucuauguguaccgaacgcagucauacuucaaaacgcguggaaaguuucauguacaauucucgcuguaguuaguguuucgccacuucuacugacaaguagucagcaaaaagcagacuggauaccguuagcauuaacuauaaaaggauugaaucccaccgcuauauuuuuaacaacauuaucaagaacuaacaagaagagaucauggccucuuaaugaggcaaucauggcaguaggaauggucucaauucuugcgagcagcuuacugaaaaaugacauaccaaugacaggaccauuaguggcaggcggauuguuaacgguaugcuacgucuuaaccggaagaucagccgaccuagaacucgaacgagccgccgauguucgaugggaagaucaagcggaaauaucaggcaguucuccuauacugucaauaacaauuucagaagacggguccaugucgaucaaaaaugaagaagaggagcaaacguugaccauacuaauacguaccgguuuauuagugauaagcgggcuauucccaguuaguauaccaauaacagcagcggcaugguaccucugggaaguaaagaaacaaagagccgguguauuaugggacguaccgucaccaccucccguuggaaaagcugaacuagaggacggggcauaccgcaucaaacaaaaagguauauuagguuacucacaaauaggagccgguguuuauaaggagggaacauuucauacuauguggcauguaaccaggggagcaguccucaugcacaagggcaaaaggauagagccuagcugggcagacguucgaaaggaucuuauaucuuaugggggaggauggaaguuagaaggagaguggaaagagggagaagagguccaaguacuagcguuggaaccuggcaagaacccccgcgcaguacaaacaaaaccaggucuauuuaagacuaacacagguacgauaggugcaguaucacuagauuucaguccgggcacuucuggauccccaaucguugacaagaaaggaaaagugguuggauuauauggaaacggagucgucacacggucuggcacauauguaucggcgauagcucaaacagaaaagucuauugaggauaaucccgagauugaagaugacauuuuuagaaagaaacggcuaacaauaauggaucuucauccgggggcgggaaaaacaaaacgauaccucccggcaauaguaagggaagcaauaaaaagggguuuaagaacucuaauauuagcacccacacgagucgucgccgcagaaauggaagaggcuuuacggggacuuccuauucguuaucagacaccagcaauaagggcagaacauacagggcgagagauaguugacuuaaugugucaugcuacauuuacaaugcguuuacuaucucccgucagggucccaaauuauaaucugauaauaauggaugaagcgcauuucacugaucccgcaaguauagcugcccgugguuauauuucaacucgaguagaaaugggagaagcugcugguauuuuuaugacggccacgccaccaggaucuagagaucccuucccacaaagcaaugcuccuaucauggacgaagaacgcgaaauuccagaaagauccuggaauaguggacaugagugggucacggauuuuaaagggaaaacaguaugguucgucccaucuauuaaagcaggaaaugacauagcugccugucuaaggaaaaaugguaagaagguaauucaauuaucaagaaaaacguucgauucggaguauauuaagacaaggacuaacgacugggauuuuguaguaacuacugacauaucagagaugggggcaaacuuuaaagccgaacgaguuauagacccaaggcgcuguaugaaacccguaauacuaacugacggagaagaaaggguaauacuagcaggaccaaugccaguaacacauaguucagccgcacaacgccguggaaggaucggaagaaaucccaaaaaugaaaacgaccaauauauauacaugggagaaccacuugagaaugaugaggauugcgcccauuggaaagaagcuaaaaugcuuuuagacaacaucaacacgcccgaaggaauaauaccuucaauguucgagccagaacgcgaaaaaguugaugcaaucgauggcgaguaccgccuucguggagaagcuagaaaaacauucguagaucuaaugagaagaggugaccuacccguuuggcucgccuacaggguugcugcggaagguaucaacuacgcggaucgacgauggugcuucgacggcauaaagaauaaucagauuuuagaagaaaacguugaaguagaaauuuggacgaaagaaggagagaggaagaaauuaaaacccagaugguuagaugcgagaauauauagugacccacuagcgcuuaaggaauuuaaagaauuugcagcuggacgaaagucucucacauuaaacuuaauaaccgagaugggacgccuuccaacuuucaugacacaaaaagcacgcaaugcccuugauaaccucgcaguacuacauacugcagaagcaggcggacgcgcguacaaccaugccuuaagugaauuaccugaaacacuggaaacgcucuuguuacuaacuuuauuggcaacaguaacgggaggaaucuuuuuauuccuaaugaguggaaaagguauuggaaaaaugacuuuaggcauguguuguauuauaacugcuucaauauuacuuugguacgcucaaauacaaccucauuggauugcagcgagcauaauauuagaauuuuuccuuauagugcuccuaaucccagaaccugaaaaacaaagaacgccucaagauaaccaacuaacauacguaguaauagcuauacuaacaguuguagcugcuaccauggcaaaugaaaugggcuuucucgagaaaaccaagaaagacuuuggauugggaucuaucgcuacgcaacagcccgaaucaaauauauuggauauagaucuacguccugcuagugccuggacuuuauaugcuguggcuacuacuuuuauaacaccaaugcuaagacacaguauugaaaacucauccguaaaugucucguuaacagccauagcgaaccaggcuaccguuuugaugggacugggcaaggguuggccguuaaguaagauggauauaggaguuccccuacuugcuauagguuguuauucacagguaaaucccauaacucuuacagcugcauuacuuuuguuaguagcacauuaugcaauuaucggaccaggacuucaagcgaaggccacuagagaagcacagaaaagagcugcagcagguauaaugaaaaaucccaccguugacgguaucacugucaucgaucucgacccuauaccauacgacccaaaauucgaaaaacaacucggccaagucaugcuauuaguuuuguguguuacucagguacuaaugaugaggacaacgugggcuuuaugcgaagcauuaacucucgcuaccgguccuauaucuacacuaugggaagguaaucccggacgcuuuuggaacacaacgauugcgguaucuauggccaacauuuuuaggggaaguuacuuagcaggggcgggucuacuauuuaguauuaugaaaaacacaacaaacacacgucgugguacagggaacacaggugaaacacuuggggaaaaauggaagaaucgacuaaauagucuugguaagagugaauuucagauauacaaaagaagcgguauucaagaaguagacagaacguuggcuaaggaagguauaaaaagaggggaaacugaccaucaugcaguaucacguggcucagcgaaguuacgaugguucguagagaggaacuuggucacaccugaggggaaggugguagauuuagguugcggucgaggcggcuggaguuacuacugcggcgggcucaaaaaugugagagaaguuaaaggacuaacgaaaggcggaccgggucacgaggagccuauaccuaugaguaccuacggauggaaucuaguaagauuacaaucaggaguugauguguucuuuaccccacccgagaaaugcgacacacuccuaugugauaucggagaaucaaguccuaacccgacaguggaggcaggcagaacacuaagaguguuaaaucuugucgaaaacuggcugaauaauaacacacaauuuugcaucaagguccugaauccauauaugccuucgguaaucgagaaaauggaaacacuucaaagaaaauaugguggggcguuaguccggaacccccuuucgagaaauaguacacacgaaauguacuggguuaguaaugcuaguggaaacauaguaaguucaguuaauaugauaucgaggaugcuaauuaaucgauucaccaugagacacaaaaaggccacuuacgaaccagacguagacuugggaucaggaacgcguaauauagggauugaaagcgagacaccuaaucuagacauaauaggaaaacggauagagaaaauaaaacaagaacacgagacuagcuggcacuacgaucaagaucacccuuauaagacaugggcauaucaugguagcuaugaaacaaaacaaacaggaucggccucguccauggucaacggaguaguaagauuauugaccaaacccugggaugugauaccaaugguaacucaaauggcaaugacggauaccaccccauucggacaacaaaggguguuuaaagaaaagguagauacucggacgcaggaaccaaaggagggaaccaagaaacuuaugaagaucacagcagaauggcuguggaaggaauugggaaagaagaaaacaccgcggaugugcacacgggaagaauuuacccguaaaguacgaucaaaugcugcgcucggggcaauauucacagaugaaaauaaauggaaauccgcgcgcgaagcaguagaagacaguagauuuugggaacuugucgacaaagaacgcaaccuacaucuggaggguaaaugcgaaacuuguguuuauaauaugaugggaaagcgggaaaagaaaauaggcgaguuugguaaagcgaaaggaucucgugcaauaugguacauguggcugggcgcgagguuuuuagaguucgaagcacuaggguuucuaaacgaagaucacugguuuucaagagagaacagucuaagugggguagaaggagaaggacuacauaaauuagguuauauccuaagagaaguauccaagaaagaagggggagcuauguaugcagaugacacggcuggaugggacacaaggauaacauuagaagaucucaaaaaugaagaaauggugacgaaucauauggagggagagcauaagaaacuagcagaagcaauuuuuaaauuaacguaccaaaauaaggugguacgaguccagcguccuacaccucggggaacaguuauggauauaauaucacggcgagaucaacggggaucaggacaaguuggaacguauggauuaaauacguuuacuaacaugggagcacaacuaauuagacaaauggaaggugaagguguuuucaaaggcauucaacauuuaacugcaacugaagaaguagcaguacaagauuggcucgcgcgugucggcagagaaagacucucacgaauggcaauaucuggcgacgauuguguagucaaaccauuagacgaccgcuuugcuagcgcuuuaacagccuuaaaugauaugggaaaaauaagaaaagauauccagcaaugggaaccuagccggggauggaacgacuggacucagguaccauucugcucacaccauuuucaugaauuaauuaugaaagaugggagaguguuaguuguuccuuguagaaaccaagacgaacugauugguagggcuagaauuucccaaggggccgguuggagucuuagggaaacugcuugcuugggaaaaucuuaugcacagauguggucauuaauguauuuucaccguagggauuuacguuuggcagccaaugccaucuguuccgcagucccaucacacugggucccaacgucuaggacaaccuggaguauccaugcgcgacaugaguggaugacgaccgaagauaugcuuacaguauggaaucguguauggauucaagaaaauccguggauggaagacaagacaccggucgaauccugggaagagauaccuuaucuugguaaacgagaagaccaaugguguggaagucuaauaggauugacuucacgagcaacaugggcaaagaacauucaaacagcuaucaaucagguaaggagcuuaaucgguucugaagaguacacggauuacaugccaucaaugaaacgguuuagaagagaagaagaggaggcggguguacugugguaa

SEQ ID NO: 22815 - RNA, 9876 nt, Artificial Sequence
  derived and/or modified CDS sequence (opt6) from DENV-2__JX470186__SS-prME
accgcggguauaauaauaaugaugauacccacgguaauggcauuucacuuaacuacgagaaauggugaaccacacaugauaguuucacgacaagaaaaagguaaauccuuacuguucaaaacggaaaacgggguaaauauguguaccuugauggcuauggauuugggagaguuaugcgaagacaccaucaccuauaacuguccacuccuacgacaaaaugaaccagaagacauagacuguugguguaauucaacaucgacguggguuacauacggaacguguaccgcaacuggcgaacacagaagggagaaaagaucgguugcgcuaguuccucauguagguaugggguuggaaacucgaacagaaacuuggaugucuucagaaggagcauggaaacaugcccagagaaucgaaacauggguauuacgccauccaggauuuacgauuauggcugccaucuuagccuacacuauaggaacaacauacuuccaaagaguguuaauauucauacuuuuaacagcuguagcaccauccaugacaaugagguguaucgguauuucaaaccgagauuuuguggaagggguuagugggggaucauggguagauaucguauuggaacaugguaguugcguuacuacuauggccaaaaauaaaccuacucuagacuuugaguuaauuaagacagaagccaagcaucccgcgaccuuaagaaaguauuguauugaagcaaaacuuacaaacacaacuaccgcaucaagaugcccaacacagggagaacccucacucaacgaagaacaagauaagagauucgucuguaaacacucaaugguugacagaggcuggggaaacggcuguggacuuuuuggaaaggguggaauaguuacuugcgcaauguuuaccuguaaaaagaauauggaagguaaaauuguucaaccagaaaauuuagaauacacuauaguaaucacgccucacagcggagaagaaaaugcagucggaaacgacacgggcaaacacggcaaagaaauaaaaguuaccccacaaucaucuaucacugaagcagaacuaacaggguacggcacuguaaccauggaauguaguccaaggacuggauuagauuuuaacgaaaugguuuuacuacaaauggaaaauaaggccugguuagcacaucgccaaugguuucuagaccuaccacuaccuuggcuacccggagccgauacucaggguucaaauuggauacaaaaggaaaccuuaguuacauucaaaaauccacacgccaagaaacaagaugucguuguacuuggaagccaagagggggcaaugcacaccgcauuaacaggugccaccgaaauucaaaugagcucagggaauuuacuauuuacgggacacuuaaaguguaggcuuaggauggauaaacuucaauugaaagguaugucuuauuccaugugcacugguaaauucaagguaguaaaagagauagcugaaacccaacacgguaccauuguuauaagagugcaauaugaaggagacggaucaccuuguaagauaccuuuugaaauaauggacuuagagaaacgccacguguuaggaagacuaauuacuguaaaucccauaguuacagagaaggauaguccugucaauauagaagcagagccaccauucggggauaguuauauuaucauugggguagaaccaggucagcuaaaauuaaguugguuuaagaaaggcaguucuauaggccaaauguucgaaacaaccaugagaggggcaaaacguauggcuauacucggugacaccgcaugggauuuuggcucguuaggaggcguguucacuagcaucggaaaggcauuacaccagguguucggagcaauauauggagcugccuucuccgguguuuccuggacaaugaaaauccuaauuggagucguuauaacuuggaucggaaugaacuccaggagcacgagucuaucaguuucacucguuuuaguaggaguaguuacucuauaucuggguguaaugguacaagcagauucgggauguguugugucauggaaaaauaaggaguuaaaaugcggaagugguauuuuuauaaccgacaauguacacacauggaccgagcaauacaaauuucagccugaaucgcccucgaaacuggcaucagcgauacagaaagcucacgaggaagguaucugugggauccggucugugacaagauuagaaaauuugauguggaaacaaauaacaccggaacuuaaucacaucuugucugaaaaugaaguuaaacuuacaaucaugaccggagacauaaaagguaucaugcaggcaggaaaacguucacuaagaccgcaaccuacggaacuaaaguauaguuggaaagcaugggggaaagcgaaaauguuaucuacugaauugcacaaucauacguucuugauugauggcccugagacugccgaaugucccaauaccaacagggcuuggaauagccuagaaguugaagauuauggauuuggaguuuucacaacgaacauuugguuaaagaugaaagaaagacaagauguguuuugugacuccaaguugaugucugccgcuauaaaagacucacgagcugugcacgcugauauggguuacuggauagagagugcccugaaugauacuuggaaaaucgaaaaggcauccuucauagaaguaaagaguugucauuggcccaaaagucauacauuauggucaaauggcgugcuagaaucugaaaugauuaucccgaagaauuuugcuggaccuguaagccaacauaacuauagaccaggcuaucacacacaaacagcaggcccuuggcacuuaggacgcuuagaaauggauuucgacuuuugugaaggaacgacggucguugugacggaagauugugguaaccguggacccagucugagaacaaccacugcgaguggaaagcuaaucacagaauggugcuguagaucauguaccuuaccacccuuaagguacagaggcgaagacgggugcugguauggcauggagauuagaccacuuaaggaaaaagaagaaaauuuaguaaauaguuuaguaacugcaggacaugggcagaucgauaauuuuucacugggcguuuuaggaauggcacucuuucuugaagagaugcuacgcaccagaguaggaacaaaacaugcuauucugcuuguagcaguuucauucguuacacucauuacggggaauaugagcuuucgagacuuggguaggguuaugguaaugguuggugccacaaugacagaugauauagguaugggaguaacauaccucgcacuacucgcagcauuuaaaguccgucccacauuugcugcaggguuauugcugagaaaauuaacaucgaaggagcuuaugaugacuaccauaggcauaguuuuauuaucacaagcuacaauuccagagaccauauuagaacugaccgaugcauuggcgcuaggaaugaugguacucaagauuguacgcaacauggaaaaauaucaacuagcaguuacuauuauggcaauuuuaugugugccaaaugccgucauacugcaaaaugcuuggaaaguuagcuguacaacacuggccguaguaagcguguccccacuacuacuuacaaguagucagcaaaaagcagauuggauaccuuuagcguuaacaauuaaaggacuuaaccccacugccauauuccucacuacacuaucacguacuaacaagaaaagaucauggccguuaaaugaagcaauuauggcaguuggaauggucucuauacuugcgucgucauuguuaaagaaugauauaccaaugacaggaccauuaguagccggcggacuccuuacaguauguuacguacuuacgggcagaagcgcagaccuugaauuagaaagggccgcagauguacgcugggaggagcaagcugaaauaagugggucgucuccaauacuuucuauaacuauaucagaagacggaaguaugaguaucaaaaaugaagaggaggagcaaaccuugacaauacuaauaaggacaggacuccuagugguaucaggacuauuuccuguaagcacuccuauaacagcagcagcaugguaucuaugggaggucaagaaacagcgggccggaguacugugggauguccccucgcccccuccggucggaaaagcggaacuggaggauggggcauaucgcauaaaacaaaaaggcauucucggauauucacaaaucggcgccgguguauauaaagaaggcaccuuucacacuauguggcauguaacaagaggugcggugcuaaugcauaaaggcaaaaggaucgaaccaucaugggcugauguaaagaaagacuuaauuaguuaugggggaggauggaaauuggaaggagaauggaaggagggugaagaaguccagguucuagcacuugagccggggaaaaauccacgagcgguccaaacuaaaccgggcuuauucaaaacaaacaccggaacaaucggugcgguaucauuagauuucucacccggcacuucaggaucaccaauuguagauaaaaagggcaaaguugucggacuauacgggaauggaguagucacaagaucuggaacuuacguuuccgcaauugcacaaacggaaaaaucuauagaggauaauccugaaauugaagacgacaucuucaggaagaaacguuuaaccaucauggacuugcauccgggugcugguaaaacaaagcgcuaucuuccugcaauaguacgagaggcgaucaaaaggggcuugagaacuuuaauuuuagccccaacucgcgugguugcugcugaaauggaggaagcacuucguggauuaccuauuagauaucaaacuccagcuauuagggcggaacacacugggagggaaauaguagaccuuaugugccacgcaacauucacaaugagacuuuuaucacccauaagggugccaaacuauaacuuaauuauaauggaugaggcucauuuuacugauccagcaucuauugccgcccgaggauacauaagcacuagaguagagaugggugaggcagcuggcauauuuaugacagccacgcccccgggaucaagggauccguucccucaaagcaaugcucccauuauggacgaggaaagggaaaucccggagagaucauggaacucuggccaugaaugggucaccgauuuuaagggcaaaacaguaugguucguaccuucuauuaaagcuggaaaugacauagcugcuugucuaaggaaaaaugguaagaaaguaauacaacuaagccgaaagacauuugauagcgaauauauaaaaacucgaacaaacgauugggauuuugucguaaccacagauauaagcgagaugggugcuaauuucaaagcagaacguguaauagauccaagacgaugcaugaaaccgguaauauugacagacggugaagaaagaguuaucuuagcaggcccaaugcccguaacccacaguagcgcagcgcagcgacgaggccgcgugggaagaaacccuaaaaaugagaaugaccaguacauuuacaugggagaaccucuagaaaaugacgaagauugcgcucauuggaaagaagcgaaaauguuguuggacaacauuaauacuccagaaggcauaaucccgagcauguucgaaccggaacgagaaaaaguagacgcuauugacggagaguaucgacuacgcggcgaagcgagaaaaaccuucguugaccuuaugaggcguggagauuuacccgugugguuagcuuauagaguagcagcagagggaauaaauuacgcugaccgaagauggugcuuugauggugucaaaaacaaucaaauccuugaagaaaaugucgaagucgagauauggacaaaagagggugaaagaaagaaacucaaaccacgaugguuagacgcaagaauuuacagugacccccuggcgcuuaaagaauuuaaagaguuugcugccggaagaaagagcuuaacauuaaaucuaauuaccgagaugggucgauuaccaacauucaugacucaaaaggcccgcaacgcccuagauaaucuagcgguacuacacacagcagaagcaggagggagagcguacaaucaugcauuaagugaacugccugaaacauuagaaacuuuauuauuacucacucuauuggccacaguaacgggcggaauauuucuuuuccuaaugucaggaaaaggaauagguaaaaugacacuggguaugugcuguaucauaaccgccucuauucugcuaugguacgcccaaauccaaccacauuggaucgcagcaucaauaauauuggaguucuuucuaauuguuuuacugauaccugaacccgaaaagcagaggacaccccaagauaaucaacucacuuauguaguaauagccauuuuaacaguagucgcagcaacaauggccaaugaaaugggcuuuuuagagaaaacuaaaaaggacuucggauuagguaguauaacuacacaacagccugaaaauaacauucucgauauagaucuuagaccggcuuccgcauggacccuuuaugcgguagcaacaacauucauuacaccaauguugagacauagcaucgaaaauaguuccgucaaugucagcuugaccgcaauugcuaaccaagccacagucuuaauggguuuaggcaagggauggccacucagcaaaauggauauagguguccccuugcuggcaaucggguguuauucacaggugaacccaauuacucuaacggcugccuuauuacuauuaguugcgcacuacgcgauuauugguccagguuuacaagcaaaagcaacaagagaagcacagaaaagagcugcagcuggcauaaugaaaaacccgacaguagacgggauuacugugauagaccuagauccgauuccauacgauccgaaguuugaaaaacaacuaggccaaguuauguuauuagucuuguguguuacgcaaguacuaaugaugagaacaacuugggcucuuugugaagcacucacucuagcaacuggaccaauuaguacuuuaugggaaggcaauccaggucgauucuggaacaccacgauugcagucucuauggcuaauauuuuuagagguucauacuuagcgggugccggccugcuguucagcauaaugaaaaacacugccaacacccgaagaggaacagguaauacaggagaaacuuuaggcgagaaauggaaaaacagacuuaacgcucuaggcaaauccgaauuucaaauuuacaaaaagucagguauacaagagguggacagaacauuagcaaaagaaggaaucaaaagaggugaaacagaccaucacgcaguaucacgaggcagugcuaaacuucgcugguuuguagaaagaaacuuaguaacacccgaagguaaaguaguggaccucggcugcggcagaggaggcuggaguuacuauugcgguggguugaaaaacgucaaggaaguaaaaggacuuacaaagggugggcccggucaugaagaacccauuccuauguccacguauggcuggaaccucgucaggcuucagucgggcguagacguauuuuucaccccuccggaaaaaugugauacacuccuuugcgauaucggugaauccucaccuaacccaacggucgaagcggguaggacauuacgcguacucaaucuuguugaaaauuggcuuaauaacaauacacaauucuguauuaaaguccuaaauccuuacaugccaucuguaaucgagaaaauggaagcgcuucagaggaaauacggcggcgcacucgugcguaacccgcuaucgcgaaacucaacacaugaaauguauuggguaagcaaugcauccggcaauauagucucuucugugaacaugaucagucgaaugcucauaaaccguuucaccaugcgacauaagaaagcaacauaugaaccugauguugauuuaggaaguggaacccgaaacaucggaauagaaucggagacucccaaucucgacauaaucggaaaaagaauagagaagauuaaacaagaacaugaaacaaguuggcauuaugaucaggaucauccauauaaaacaugggcauaucacggaaguuaugagacgaaacagaccggaucagccaguaguauggucaacgggguugucagacuacugacgaagcccugggaugugaucccaauggucacgcaaauggcuaugaccgacacuacuccuuucggacaacaaagaguuuuuaaagaaaaggucgacacucguacgcaggaacccaaagaaggaacuaagaaacucaugaaaauuaccgcugaauggcuauggaaagaguuagggaaaaagaaaacaccaagaaugugcaccagagaggaauuuacacgcaaaguaaggagcaaugccgccuuaggggcgauauuuacugaugaaaacaaauggaaaagcgcaagagaagcuguggaggacaguggguuuugggaauuaguugauaaagaaagaaaucuacaucuagaaggaaaaugugaaacaugcgucuauaauaugauggggaagagggagaagaaacuaggagaguuuggaaaagcaaaaggaucaagggccauuugguauaugugguuaggagcacgauuuuuagaguuugaagcgcugggauuccucaacgaggaucauugguucagucgggaaaacucuuugucuggaguugaaggagagggauuacauaaauuaggguauauacuaagagauguaaguaaaaaggaaggcggcgcaauguaugcagaugauacagcuggaugggacacccgaauuacucuggaagaucugaaaaaugaggagauggucacgaaucacauggagggcgaacauaagaaacuagcagaagcaaucuuuaaacuaacuuaccaaaacaaagucguaagaguacaacggccaacgcccagaggcacagucauggauaucauaucacgcagagaucaacgcggcucuggucagguuguuacuuacgggcuuaacaccuuuacaaauauggaggcacaacuuauacgucaaauggaaggugaaggugucuuuaagagcauacaacaacuaacagucacugaagagauagcagucaaaaacuggcuaguacgaguaggacgugaacgccuaagccgaauggcaauuucaggggaugauuguguaguuaaaccccuugacgauagguuugcaucugcucucacugcauuaaaugacaugggaaaagugagaaaagauauacaacagugggaaccaaguaggggauggaacgauuggacacaggucccauuuuguucccaucacuuucacgaacuaauuaugaaggacggacgaguauuagugguaccauguaggaaccaagaugagcuuauaggucgugcaaggaucagccaaggcgccggguggucuuuaagagagacagccuguuuaggcaagucauaugcccagauguggagcuuaauguauuuucaccgacgugaucuucgucuggcugcuaaugcgaucuguucagcaguacccucacauuggguuccgacguccaggaccacuuggucaauacaugcaacucacgaguggaugacuacagaggauaugcuaacuguauggaaccgaguauggauacaagagaauccauggauggaagauaaaacacccguagaaucaugggaagaaauaccauaccuagguaagagggaagaccaguggugcggcaguuuaauuggacuuacgagucgugcaacgugggcuaaaaacauacagacugcaaucaaccaggucagaucgcuaauaggaaaugaagaguauacugauuacaugcccagcaugaaacguuucaggcgagaagaagaagaggccggagucuuaugguga

SEQ ID NO: 22816 - RNA, 9876 nt, Artificial Sequence
  derived and/or modified CDS sequence (opt6) from DENV-2__KU517846__SS-prME
acggcagguauuauaauuaugaugauucccacagugauggcauuucauuuaacuacgcgcaauggagaaccccacaugauugugaguagacaagaaaaagguaaaaguuuauuauuuaaaacugaaaacggaguaaauauguguacacuaauggcaauggauuugggcgaacuuugugaggacacgauaacauauaacugcccgcuuuugagacagaaugaaccugaagauauagauuguugguguaauaguaccaguacauggguaaccuauggaacauguaccgcuaccggugagcaucguagggagaaacgaaguguagcucuaguuccgcauguaggaauggguuuagagacacguacggaaacguggaugucauccgaaggagcguggaaacacgcacaacguaucgagacuuggguucuacggcaucccggauuuaccauaauggcagcaauacuagcguacacuauuggcacgacauauuuucaaagaguauugauauucauccuuuuaacagcgguagcaccuucaaugacaaugagguguauuggcaucaguaaucgugacuucguggagggaguaucuggcgguagcuggguagacaucguacuagagcauggaagcuguguaacgacaauggcuaaaaacaaaccaaccuuggauuucgaguugauaaaaacugaagcaaaacauccagccacauuacgaaaauauuguauagaagcgaaacugacaaauacaacuaccgcaucaagaugcccuacacaaggcgaaccgagucuaaaugaagaacaagauaaaagauuuguauguaaacacaguaugguugauagaggaugggguaaugguugcggacuguuugguaaaggugguaucgugacaugugcaauguucacguguaagaaaaacauggaggguaaaauagugcaaccagaaaaucuagaguauacaauaguaauaaccccacauucuggagaagagaaugcaguuggcaaugauacagguaaacaugggaaagaaauaaaaguaaccccgcaguccagcauaacggaagcggaauuaaccgguuacggaacuguaacgauggaaugcucgccccggacuggcuuagauuuuaaugaaaugguccuuuuacagauggaaaacaaagccugguuaguccauagacaaugguucuuagaccugccacuaccuugguuaccuggagccgauacucaggguuccaacuggauacaaaaagagacucucguaacauucaaaaacccccaugccaagaaacaagacguuguagugcuuggaucacaagagggcgcgaugcacaccgcauuaacgggugcgacagaaauacaaaugucgucaggaaauuuauuauuuacaggccauuuaaaauguagacuuagaauggacaaauuacagcuaaaaggaauguccuacucgaugugcacaggaaaauuuaaagucguuaaagaaauugccgaaacucaacauggaacaauugugauaagaguccaauaugaaggggaugguucaccgugcaaaauaccuuucgagaucauggaucuagagaaaagacaugugcuugguagacuuauuacaguuaauccuauugucacagagaaagauaguccgguuaacauagaagcugaaccacccuuuggggauaguuauauuauaaucggaguugaaccaggccaacucaaacucaguugguucaagaaaggaucaucgauuggccagauguucgaaaccaccaugcgaggugcuaaaaggauggcuauacuuggggacacagcgugggauuucggcucauuaggaggaguauuuaccucaaucggcaaagcacuacaccaaguauucggugcaauauauggcgcugccuuuucugguguuucuuggacaaugaaaauccuaauaggcguaguaauaacuuggauugguaugaauagccgcaguaccucccuaucaguaagccuaguauugguuggcauagucaccuuauaucuuggagucaugguacaagcggacagcggaugugucguuagcuggaaaaacaaagaacucaaaugugggaguggaauauucauaacagacaacguccacacauggacggaacaguacaaauuucaaccagaaagcccgaguaaacuugcuagugcaauccaaaaagcgcacgaagagggaaucugugguauuagaucaguuacgcggcucgaaaaucugauguggaaacaaauuacaccugaguuaaaccacauauuaucugagaaugaaguaaaauuaaccauaaugacaggagauauaaaaggaaucaugcaggcuggaaaaaggucccuucgaccacaacccacggaguugaaauauucguggaaagcguggggcaaagccaaaaugcugagcacagaauugcauaaucacacuuuccuuauagacggcccagaaacagccgaauguccaaacacaaaucgagccuggaacagucuagaaguugaggacuauggauucggagucuuuacuacgaacaucuggcuaaaacugaaagaacggcaagacguauucugcgauaguaaacugaugucagcggccaucaaagauaaucgugccguacacgcugauauggguuauuggaucgaaagugcauuaaaugacacuuggaagaucgagaaagcaaguuucauagaagucaaaucuugccacuggccaaagucgcauacauuaugguccaauggcguguuggaauccgaaaugauuaucccuaaaaacuucgcaggcccugucagucaacauaauuauaggccagguuaucauacacaaacugcagggccuuggcauuugggcagauuggaaauggauuuugauuuuugugaaggaacaacggugguaguuacagaagacugcggaaaucggggaccaaguuuaagaaccaccacggcaagcggaaaguuaaucacggaauggugcuguagaaguuguacauuaccaccguugcgguaucguggagaagacgguugcugguacgggauggaaauucgaccacucaaagagaaagaagaaaaucuaguaaauucccugguaaccgccggccacggccaaauagauaauuuuagcuuagguguuuuagggauggcucuauuucuggaagaaaugcuuaggacccgcgucggaaccaagcacgccauccuccuaguugcaguaucguuuaugacacuaauaacaggaaacaugucuuuccgcgauuuaggaagaguaauggugauggucggagcaacuaugacagacgacauugguaugggaguuacuuacuuggcacuucuagcggcuuuuaaagucagaccaacguuugcggcaggucuucuucuuaggaaauugacaaguaaagagcuaaugaugacaacuauaggcaucguuuuacuuucacagucaacuauaccagaaacuauacuugaauuaacugaugcucuagcauuagggaugaugguucucaaaauaguaagaaacauggagaaauaccaguuagcuguaaccauuauggcuauacuauguguaccaaacgcagugauauugcagaaugccuggaaggucucguguaccauccucgcaguuguuaguguuucaccacucuuauuaaccucaucucaacaaaaagcggacuggauaccacuggcguugaccauaaagggacuuaauccuacugcuauauuucuaaccaccuuaaguagaaccaguaagaaaagaucauggccauuaaacgaagcuauaauggcaguaggaaugguuucaauauuggcuucgagcuuguugaaaaaugacauaccuaugacagguccgcuagucgcugguggucuuuugacagugugcuauguuuugaccggaagaagugcagacuuagaacuugaacgagcagcggauguaagaugggaggagcaggcagaaauuuccggaagcagcccaauccucuccauaacuauuagcgaagacgggucuaugagcaucaaaaaugaggaagaggagcuuacauuaacuauccuaauucgaaccgggcucuugguuauuucaggauuauuccccgugagcauaccgauaacggcugcggcuugguaucucugggaagugaaaaagcaaagagcugggguauuaugggacgugccauccccacccccaguaggaaaagcagaacuagaagacggagcuuaucgaauaaaacaaaaaggcauucuaggcuauucucagauuggagcaggcguauauaaagaggggacauuucacacgauguggcacguuacuaggggagccguguugaugcacaaaggcaaaagaaucgagccaucaugggcagaugugaagaaagaucucauaucguauggaggcggauggaaacuagaaggagaguggaaagaaggagaagaaguucaaguuuuagcccuggaaccagguaaaaacccacgagcgguacaaacaaaaccagguuuauucaaaacuaauaccggaacaauaggcgccgugucccuagauuucucuccgggaacgucagguucuccaaucguagauaagaaagggaagguggucggauuauauggaaacggaguuguuacaaggucaggcacguauguuucagcuauagcgcagacagaaaaguccauagaagauaauccagagauagaagacgauaucuuuagaaagaaacgucugaccauaauggacuugcacccaggagcuggcaaaacaaaacguuaucuaccggcuauaguuagggaagcaauaaaacguggauuacguacucucauacuagcccccacgcgcguaguugcagcagagauggaagaagcauuaagaggacuacccauaagguaucagacgccagcuauaagagcagagcacacgggacgcgaaauuguggaucucaugugucaugccacguucacaaugcgauugcuaagcccaauaaggguccccaauuacaauuuaauuauaauggaugaggcacacuucacugauccugcaucaaucgcggcucguggauacauuucaacaagaguagaaaugggcgaggccgcagguauuuuuaugaccgcaacaccgccggggucgagagauccguuuccacaaagcaaugcgccgauaauggaugaagaacgagaaauaccugagagaucauggaauaguggucacgaguggguuacugacuucaaagguaaaacgguaugguuugugccgaguauaaaggcaggaaaugauauagccgcuugccuaaggaaaaauggcaagaaagugauacaauuaucaagaaaaacuuuugauucagaauacauuaaaacacgcacuaaugauugggauuucguuguaaccacggacauuagugaaaugggcgcaaauuuuaaggcagagagagucauugauccaagaaggugcaugaaaccuguaauacuuacugauggagaagaacgugucauacucgcuggaccaaugccaguuacacauucaucugcggcucaacggagggguagaguuggcagaaauccgaagaaugaaaaugaccaauacauauauaugggugagccuuuggagaaugaugaagacugugcacauuggaaagaagcaaaaaugcuauuagauaauauaaacacaccugaggguauuauacccagcauguucgaaccagagcgagaaaagguugacgcuaucgacggugaguaucgacuaagaggugaggcaaggaagacauuuguggauuuaaugagaagaggugaucuaccuguauggcucgcguaucgcguagcagcagaaggaauaaauuaugcagauagacguugguguuuugauggagucaaaaauaaucaaauucuugaagagaauguagagguagaaauauggacuaaagagggagaacgaaagaaacuaaaaccacgauggcucgacgcccgaauauacucagacccauuagcacucaaagaauuuaaagaauuugcggcuggucggaaaagucuuacauuaaauuuaauaacugaaauggguagauuaccaaccuuuaugacacaaaaagcacgaaacgcucuggauaaccuggcuguacuacacaccgcagaagcgggaggucgcgcauauaaccaugcgcuuagugaauugccugaaacacucgaaacuuuacuacuccucacucucuuagcgacgguuacaggagguauauuuuuauuuuuaauguccgggaaaggaauugguaaaaugacgcuaggcaugugcuguauaauaacagccucaauuuuacuaugguaugcccagauccagccacacuggaucgccgcgagcauaauauuagaauuuuucuuaauaguacuacuaauacccgaaccggaaaagcaacguaccccgcaagauaaucaauugacauacguaguaaucgcaaucuugacgguuguugcugcaacuauggccaacgagaugggguuucuugagaaaaccaagaaagacuuuggccuaggaucaauaacaacacaacagccugagucaaauauacuugacaucgauuugcgaccugccagcgcuuggacacuuuacgccguagccacaacuuuuauaaccccuaugcugagacauucaauagaaaauucgagcguuaauguuuccuuaacagcgauagcaaaucaagcaaccguauuaauggguuuagggaaaggcuggccauuaucgaaaauggacauaggagugccucuucuggcuaucggcuguuacucacaaguaaauccuauaacauuaacagccgcauuguuauuauugguagcacacuaugcuauaauuggaccagggcuacaggcaaaagcaacacgugaagcacaaaagcgagcagcggcgggaauaaugaaaaacccgacgguagaugggauaacuguuaucgauuuggauccaauaccauaugauccgaaauucgaaaaacaauugggacagguaaugcuauugguuuuaugugugacgcaaguacuuaugaugcgaacaacaugggcguuaugcgaggcauuaacauuagcaacaggcccaauauccacuuuaugggaagguaacccaggacgauuuuggaauacaaccaucgcggucagcauggcaaauauuuuccgggguaguuaucuugcuggugcuggacuccuguuuaguauaaugaaaaauaccgcuaauacgagaagagguacuggaaauaccggugagacacuuggugaaaaauggaaaaaucgguuaaacgccuugggaaagagugaguuucaaauuuacaaaaagucaggaauccaggaaguugaccgaacucuggccaaagaaggaauaaaaaggggugagacggaccaucacgcuguaucucgaggaagcgcaaagcuaaggugguucguagaacguaaucuggucacacccgaggguaagguaguagaccuggguuguggcaggggaggauggucauacuacuguggugguuugaagaacgugaaagaagucaaaggucuaacuaaaggcggucccgggcacgaagaaccuauuccgauguccacauaugguuggaauuuagugagauugcaaucaggaguggauguguucuuuacaccuccagaaaaaugugacacuuuguuaugcgauauaggcgagucuaguccaaauccuacuguugaggcuggccgaacccuaagaguauuaaaccuagucgaaaacugguuaaauaacaauacccaauucugcauaaaagucuugucucccuauaugccaucgguaauagagaaaauggaagccuuacaacguaaauacgguggagcucugguucgaaacccacuaucuagaaacagcacccaugaaauguauugggucaguaaugcuaguggaaauaucgugucaaguguaaacaugauaucaagaaugcuuauaaaucgauuuacgaugagacauaagaaagcuacauacgaaccagauguugacuuagguagugguacgcgaaauauugggauugaauccgaaacaccaaauuuggacauuauuggcaaacguauugaaaagauaaaacaggagcaugaaacgaguuggcacuaugaucaggaccauccauauaaaacaugggcguaucacggaagcuacgaaacaaagcaaacagguagugcaucaagcauggugaacggcguaguaaggcuuuuaacgaagccgugggauguuaucccgauggugacgcagauggcgaugacagauacuacaccauuugggcaacagcgagucuuuaaagaaaaaguugauacccgaacucaagaaccaaaagaaggaaccaagaaacuuaugaaaauaaccgcagaauggcuauggaaagaauuaggcaagaagaaaacgccuagaaugugcacgagagaagaguuuacgcgcaaaguaagaagcaaugccgcgcuaggggcgaucuuuacagaugaaaauaaguggaaaagugcacgagaagcgguagaagauucaggcuuuugggaauuaguagacaaagagaggaaccuucaucuugaagguaaaugcgaaaccuguguuuacaacaugauggggaagagagagaagaaauuaggagaauuugggaaagcuaagggaagucgggcaauuugguacauguggcuaggggcaagauuucuugaauuugaagcgcucggauuuuugaaugaagaucauugguucagcagggaaaacagccuaucugguguagagggagaaggauuacauaaacuuggauauauacuccgagauguuaguaagaaagagggaggugcaauguaugcugaugauacagcagguugggacacaagaauuaccuuggaagaucucaaaaacgaagaaaugguuacaaaucauauggagggggaacauaaaaaguuggcagaagcuauauucagacugacguaucaaaacaagguuguacgaguacaaagaccaacaccacgaggcacaguuauggauaucaucucacgacgugaccagcgcggaagcggacaagucguaaccuauggauuaaauacguuuaccaauauggaagcgcaacuaaucaggcagauggaaggagaaggaguuuuuaaaagcauacaacauuugacaguaaccgaagaaauagcagucaaaaacuggcuagaaagagucggcagggagcgacuuaguagaauggcaaucucgggugaugacugcguaguaaaacccuuggacgaucgcuucgcuagcgcacuuaccgcccuaaaugacaugggaaaaauuagaaaagauauacaacaaugggagccuucacgagguuggaaugacuggacgcaagucccauuuugcucccaucauuuucacgaauugaucaugaaggacgguagaguccucguaguuccaugucgaaaccaagaugaacuaauaggucgagcccggauaagucaaggagcuggauggagucucagagaaacagcgugcuuaggaaaaaguuaugcacaaauguggucguuaauguauuuccacagaagagaccucaggcuggcggcaaaugcuauauguucagcugucccuucccacugggucccgacgucgcggacaaccuggucuauccacgcgacucaugaauggaugacgacugaggacaugcuuacgguauggaauagaguauggauucaggaaaauccguggauggaggacaagacuccaguggaaaguugggaagaaauaccauauuuaggcaaacgcgaagaccaguggugcggcucuuugauuggacuuaccucaagggcaacuugggccaagaauauucaaaccgcuauaaaucagguuagaagccuaauuggaaacgaagaauauacggauuacaugccaaguaugaaaagauucagaagagaagaagaagaagcgggaguauuaugguaa

SEQ ID NO: 22817 - RNA, 9876 nt, Artificial Sequence
  derived and/or modified CDS sequence (opt6) from DENV-2__KJ830750__SS-prME
acggcagggguaauaauaauguugauaccgacagcuauggcuuuucaccuaacaacacggaacggugaaccccacaugauaguaaguaagcaagagaagggaaagagccuuuuauucaagaccgaagacggaguaaacaugugcaccuuaauggcaauggaccuaggagaacuaugugaagauacaauaacauauaacuguccuuuacuccgacagaacgaaccagaagacauagauugcugguguaacucaacaucaaccuggguaacguacgguacguguacagcgaccggugaacaccgaagagaaaaacgaucgguagcucucguuccgcauguaggaaugggauuggagacaagaacagaaacauggaugucaagugagggggcauggaaacacgcgcaaagaauagaaaccuggauucuaaggcaucccggauucacaauaauggcugcaauacucgcauauacuaucgguacaacguacuuucaaagaguucuaauauuuauauuauuaacugcaguugcaccaagcaugacuaugcguuguauagggaucucaaacagggauuuugucgaaggaguuagugggggaucuuggguugacauugucuuagaacaugguucuuguguuaccacgauggcaaaaaacaaacccacgcuggauuuugaacuuauuaagacagaagcuaagcaaccagcuacauuaagaaaauauuguauagaagccaaacuaacuaacacgacuacggcaucacgauguccaacacaaggggaaccuucguuaaaugaggagcaagauaagcgguuuguaugcaaacauagcaugguggaucggggaugggguaacgggugcggccuauucgguaaaggagggaucguuacaugugcuauguuuacauguaaaaaaaauauggaaggcaaaauuguacaacccgagaauuuagaauauaccaucguagugaccccucacuccggggaagaaaacgcagugggcaacgacaccggcaaacacggaaaggaaauaaaaguaacaccucaaucuaguauuacugaagcagaacuuacgggauauggaaccguuacaauggaauguagcccacgaacgggacuagacuuuaaugaaaugguacuacuacaaauggaaaauaaagcuugguuaguccaucgacagugguuucuagaucuaccccuaccguggcuaccgggagcggauauacaagguucaaacuggauacaaaaagaaacuuuaguaacauucaaaaauccucaugcaaaaaagcaagacgucguaguuuugggaagucaagaaggggcaaugcauaccgcacuaacaggagcaacagaaauacaaaugaguucaggaaaucuauuauuuacaggacauuuaaaguguaggcucagaauggacaaacuacaauuaaaaggcauguccuauucuauguguacaggaaaguuuaagguugucaaagagauugcagagacacagcacgguacgaucgugguuagaguccaauacgaaggcgacggauccccuuguaaaauaccauuugagauuauggacuuagagaaaagacacguucuuggccgucuaauaaccguaaauccaauagucacaggaaaagacucuccgguaaauauugaagccgaaccgccauucggcgauagcuacaucauaauagggguugaacccggacaacuaaaacuaucaugguucaaaaaagggaguucgauuggccagauguuugaaacuacuaugaggggugcuaaaaggauggcaauacuaggggauacagcuugggauuuugggucccuuggggguguguuuacauccaucgguaaagcucuucaccaaguauucggagcuauauacggagcagcauuuagcggaguauccuggaccaugaaaauucuaaucggaguaguaauaacuuggauaggaaugaacagcaggaguacuucauuaucagugucgcucguacuaguugggguaguuacauuauaccuggggguuaugguccaagccgauagcgguugcguagugaguuggaaaaacaaagaguuaaaauguggaucaggaauuuucaucacggauaacguacacacauggacagaacaauauaaauuccagccugaaaguccaagcaaacuugccagugcgauucaaaaagcccaugaggagggcauauguggaauuaggucaguuacuagacuugaaaaucuaauguggaaacaaauaacccccgaacuaaaucacauccuaucagaaaaugaaguaaaguuaucaauuaugaccggagacauaaaagguauaaugcaggcaggaaaaagaucccuaagaccacagccgaccgaguuaaaguacucauggaaaacauggggcaaagcaaaaaugcuuaguacagaaccucauaaccaaacguucuuaauugauggaccagaaacugccgagugccccaauaccaaucgagcauggaauuccuuagagguugaagacuacgguuucggaguguuuacuacaaauaucuggcuaaaacucaaggaacgccaggacgucucuugcgacaguaaacucaugagcgcagcgauuaaagauaaucgggcgguucacgccgauaugggauauuggauagaaucugcccuuaaugauacuuggaaaauagagaaagcaucauuuauagaagugaagucuugccauuggccgaaaucccacacauuguggaguaacggaguccuagaaagugaaaugauaauaccaaaaaauuuugcuggucccguaagccaacauaacuacagacccggcuaucacacgcaaaccgccgggccauggcaccuagguaaacucgaaauggauuuugauuucugcgagggaacgacggucguagugacggaagauugcggcaauaggggucccagucuucgcaccacaacggccagcgguaagcuaaucacggaaugguguuguagaagcuguacccuacccccuuugagauauagaggugaggauggaugcugguauggaauggaaauaagaccgcuaaaagaaaaggaagaaaaccuuguaaacaguuuaguaacggcagggcauggccaaauagacaacuuuucccuagggguguuaggaauggcgcuuuuccuugaggaaauguuaaggacaagaguugguaccaagcaugcaguucuacuuguagcagucucauucaugacucuuauaacgggaaauaugucauuucgggauuuagggaggguaaugguaaugguaggagcugccaugacagaugacaucggcauggggguaacuuauuuggcauuacucgcugcuuuuaaaguucggccaacuuuugcggccgggcuacuucuacgaaaguuaacgucaaaggaacuuaugaugaccacuaucggcauaguguuacuuucacagucaacgacgcccgaauccauucucgaauuaacugacgcauuggcucuuggaaugaugauccuaaaaauaguaagaaauauggaaaaauaucaacuggcgguaacuauaauggcaaucuuguguguaccuaaugcaguuauucugcagaacgcguggaaagugucuugcacaauuuuagcagcagucagcgugucaccuuuguuacugaccucaagccaacagaaagcugauuggauuccauuagcauuaacgauaaagggccuaaacccaacagcuauauucuugacaacauuaagucggacgaauaaaaaaaggaguuggccguugaaugaagccauaauggcagucggaaugguauccaucuuagcaucuucacuacuuaagaacgacauacccaugacgggacccuuaguagccggcggcuuacuaacgguuuguuaugugcuuacaggacgaucugcugaucuagaguuagaaaaagcagcugacguccgaugggaagaccaagcagagaucucggguucaagccccauucucucuauaaccauaucugaagaugguagcaugucuauuaaaaacgaagaagaagaacaaacgcucacuauccuaauuagaaccggauuauuaguaauaagcgguuuguucccaguaaguaucccaauaacagcggcugccugguaucugugggaagucaaaaaacaacgggccggaguauuaugggauguuccuagcccuccaccugucggaaaagcagaauuagaggauggcgcguacagaaucaagcaaaaaggaauauuaggguauagucaaauaggagcuggaguauauaaagaaggaacauuccauaccauguggcacgugacgagaggggcgguauugaugcacaaggguaagagaaucgaaccuucgugggcggauguucgaaaggacuuaauuucuuauggcggggguuggaaacuagaaggagaauggaaagagggugaagaagugcaggugcucgcuuuggaaccuggcaagaacccuagagcuguacaaacuaaaccaggacucuuuaagaccaacaccggaacaauaggagcuguuagcuuagacuuuagucccggaacaucaggcaguccaauaguugauaaaaaggguaaagugguagggcuauaugggaacggcgugguuacaaggagugggacguauguauccgcaauugcucaaacagaaaaaucaauagaggauaauccggaaaucgaagaugauaucuucagaaaaaaaagacuaacgaucauggacuugcaucccggagcaggcaaaaccaaaagauaccuacccgcaaucguacgugaggcaauuaagaggggucugagaacacucauuuuggcaccaacccguguagucgcagccgaaauggaagaggcacuaagaggauuaccaauacgguaccaaacgccagcuauaagagcagaacauacugguagggaaauaguugacuuaaugugccaugcaacauucaccaugaggcuucuuucuccuguucgugucccuaacuauaaucugauuauuauggaugaagcucauuuuacugacccugcaucuauagcugcacgaggauauauuagcacuagaguagaaaugggagaggcggcaggaaucuucaugaccgccaccccaccuggauccagagauccauuuccgcaaucgaaugcaccgaucauggacgaggagcgagaaauucccgaaagauccuggaacagcggacacgaguggguaacagauuuuaaagggaagacuguaugguuuguaccgucuauaaaagccggaaaugauaucgcugcaugucuacgaaaaaauggaaagaaagugauucagcuaucaagaaaaacuuucgauagcgaauauauaaaaaccagaaccaaugauugggauuuuguagugacaacagauauauccgagaugggcgcaaauuuuaaagcugaacgagucauugauccccgucgauguaugaaaccaguaauauugaccgauggagaagaacgagucaucuuagcaggaccaaugccaguuacgcauaguucggcagcacaaaggaggggucgaaucggacggaauccaaaaaacgaaaaugaccaauacauauauaugggggaaccacuugagaaugaugaagacugugcucacuggaaagaagcgaaaaugcuguuagacaacauaaauacuccagaagguauaauaccaaguauguucgaaccggaaagagaaaaaguugacgcaauagacggagaauauagacuuagaggugaggccaggaagacauucguugaucucaugaggcgaggagauuuaccaguguggcucgcauaucgagucgccgcagaaggcaucaacuaugcagauagaagguggugcuuugaugguaucaagaauaaccaaauacuagaagaaaacgucgaaguugaaauauggacuaaagagggagaacgcaaaaaguugaaacccagauggcuagacgcaagaauuuacuccgacccauuagcguugaaggaauuuaaagaguuugcagccggucgaaaaagucuuacauuaaaccuaauuacugagaugggucgauugccuacguucaugacacaaaaagccagaaaugccuuggauaaucuagcagucuuacauacagcggaggcaggcggacgggccuauaaccacgcacuaagugaauuaccugaaacucuggagacacuacuacuuuugacauuacuugcaacugugacgggaggaauuuuucuauuucuaaugucaggaaaagguauugguaaaaugacguuggguauguguuguauuauuacggcaucaauccuuuuaugguaugcgcaaauucaaccacacuggauagcggcauccaucauauuagaauuuuuucuuauaguauuauugauaccugagcccgaaaaacaacguacgccacaagacaaucaauuaacauauguagugaucgcaauauugaccguuguugcagcaacaauggcuaacgaaaugggauuccuugaaaagaccaaaaaagauuucggacucgggaguauagcaauacaacaaccugagaguaauauauuagacauagaucuacgaccagccuccgcguggacucuauaugcaguugccacaaccuuuauaacaccaaugcuaagacauucgauagaaaauuccuccguaaauguuaguuuaacugcaauagcuaaucaagcaaccguuuuaaugggccuaggcaaaggguggccacugucaaagauggacauagggguaccucuauuagcaauagguugcuacagccaagucaauccaauaaccuugacggcggcauuguuauugcuaguagcccacuaugcaauuauuggaccuggauuacaagcuaaagcaacucgagaggcacaaaaacgagcggcagcggggauuaugaaaaauccgaccguugacggcguaacgguaauagaucuagauccuauccccuacgaucccaaauucgaaaagcaacucggucaaguuauguuacugguacucuguguaacacaaguauuaaugaugaggaccacaugggcucuaugugaagcuuugacucuggcuacaggaccgauuagcacuuugugggaaggaaaucccggaagguucuggaacacaacgauagcuguaagcauggccaacaucuucaggggaucuuaucuggcuggugcaggacuuuuauucucgauaaugaaaaacacuacuaacacaagacgggguacaggaaacacuggagagacacuuggugaaaaauggaagaauagacuaaauucccucgguaaaucagaauuccagaucuauaagagguccgguauucaggaagucgaucgaacucuggcaaaggaggguaucaaacggggcgaaacugaucaccacgcagucaguagaggaagugcaaaacuacgaugguucguugaacguaaucucgucacaccagaaggaaaaguuguagaccuaggauguggcaggggaggguggucuuacuacugcggaggccucaaaaacguaagagaagugaaaggccuaacaaaagguggaccaggucacgaagaaccuauucccaugagcacauauggcuggaaucuaguucggcuacaaagugguguagauguuuuuuuuacuccacccgaaaaaugugauacguuacuuugugacauuggcgaaucaucuccaaaucccacggucgaagcaggccggacauugaggguuuuaaaucuaguagaaaauugguuaaauaacaacacacaguuuugcauaaagguccuuaauccauacaugccuucaguaauagaaaaaauggaaacguuacaacguaaauacggaggugcauuaguacggaauccgcuaagccgaaauaguacacacgaaauguauuggguuagcaaugcaucuggaaacaucguuagcucugugaauaugauaucacggauguuaauaaaucgauuuacuaugcggcacaagaaggcuacauaugaaccugacguggaccugggaucaggcacgagaaacauugggaucgaaucagagacuccgaaucucgauauuaucgguaaacggaucgagaagauaaaacaagaacacgagacuaguuggcauuacgaccaagaucacccauacaaaacaugggcauaccauggaucguacgaaacgaaacagacaggcucagcgaguuccaugguuaauggggucgucagacuauuaaccaaaccaugggauguuauaccgauggucacccaaauggcgaugacagauacaaccccauuuggacaacaaagagucuucaaggagaaaguagauaccagaacacaagaacccaaagaagguacaaaaaaacuaaugaagaucacugcagagugguuauggaaagaauuaggaaagaaaaaaacucccagaaugugcacgagagaagaauuugcacgcaaagugagaaguaacgcagcccuuggcgccauuuucacagacgaaaacaaguggaagagugcuagagaagcuguagaagacucacgauucugggaacuggucgauaaggagagaaauuuacaucucgaaggaaaaugcgaaacgugugucuauaacaugauggggaaacgggaaaaaaaaauaggagaauucgggaaagcaaaggguucacgugcaauuugguacauguggcuuggugcaagauucuuagaguucgaagcauuagguuuuuuaaacgaagaccauugguuuucuagggaaaacaguuuaagcgggguugaaggagagggacuacacaaguuaggguauauucuaagagaagucucaaaaaaagaaggcggagcaauguaugcugaugauacagcagggugggauacacguauaacauuggaagaccugaaaaacgaggagaugguuacaaaucacauggagggagaacacaaaaaacuagcggaagcaauuuucaaacucacauaucaaaacaaagugguuaggguccagagaccgacaccaagagggaccguuauggauauaauaagcagacgcgaccagcgagguucaggacagguaggcacauacggauugaauacauucacaaauaugggugcucaacucauaaggcagauggaaggagaagggguguuuaaaggaauacagcaucuaacggcaacugaggaaguagccguacaagauuggcuagcacgaguaggacgcgaaagguuaucuaggauggcaaucucuggagacgacuguguuguaaagccucuagaugaucgauuugcaucggcacugacugcgcuuaaugauauggguaaaguaaggaaggauauacaacaaugggagccaagucggggguggaaugacuggacacaagucccguucugcucacaucauuuucaugaauuaauaaugaaagauggaagagugcuagucguuccaugcagaaaucaagaugaacuaaucgggcgggcgagaauuagucaaggcgcaggauggucauugcgugaaacagcuugcuugggcaaaaguuaugcacaaauguggucacucauguauuuccaccggagagauuuaaggcuugcugcaaaugcaauauguagcgcaguaccuucgcauugggucccaacuaguagaacuacauggucgauacacgcagggcaugaauggaugaccacugaagauaugcuaacaguguggaauaggguguggauucaggaaaauccauggauggaagacaaaacccccguugaaucgugggaggagauaccguaccuagggaaacgcgaagaucaauggugugguucguuaaucggcuugacaagcagagcuacaugggcacggaauauucaaacugcaauaaaccaggugagaagucucauuggcucugaagaauauacugacuauaugcccucgaugaagagguuccgaagagaggaggaagaagcaggaguguuaugguga

SEQ ID NO: 22818 - RNA, 9876 nt, Artificial Sequence
  derived and/or modified CDS sequence (opt6) from DENV-2__FM210231__SS-prME
agugcugggaugauuauuaugcuuauuccuacaguaauggcuuuucauuugacuacacguaauggagaaccccacaugauaguuggaauacaagaaaaaggcaaaucacuucuguuuaaaacugaagauggcguaaacauguguacucuuauggcaauggaccuaggcgaauuaugugaagacacuauaacauacaaauguccccugcuacgacaaaacgaaccugaagacauugacuguuggugcaauucaacgucuacaugggugaccuacggaaccugcacaaccacuggggaacaucgaagagaaaaacguaguguagccuuaguaccccacguaggaaugggcuuggaaacaagaacugaaacguggaugucuuccgaaggagcauggaaacaugcacaacgaauagaaaccuggauauuaagacauccaggguuuaccauaauggcugcaauauuggcguauacuauaggaacaacgcauuuucaacgcguguuaauauucauucuauuaacugccguagccccgucuaugacaaugaggugcauaggaauuucaaaucgagauuuuguagaagguguaucaggcggcucauggguagacauaguucuagaacauggcaguuguguuaccacaauggccaaaaauaaaccaacucuugacuuugaauuaauuaaaaccgaagcaaaacaacccgccacuuuaagaaaauauugcauugaagcaaaacuaacaaacacaacaacagagucucgaugcccuacacaaggugaaccuucuuuaaaagaagaacaggacaaacgguuuguauguaaacacaguaugguagauagaggauggggaaacggaugcggacuuuuuggaaaaggugggauaguaacaugcgccauguucacaugcaagaaaaauauggaaggaaaaaucgugcagccugaaaacuuagaguacacaauagucguaacaccacauucgggugaagaacacgcggucggaaaugacaccggaaaacaugguaaagaaaucaaagucacuccccaaaguucuauaacugaagccgaauuaaccggguacgguacaguaacuauggaauguaguccacgcaccggccuggacuuuaacgaaaugguccuauuacagauggaaaauaaagcguggcuaguccauagacaaugguucuuagacuugccguuaccguggcugcccggcgccgacaaacaagagucaaacuggauucagaaagaaaccuuaguaacuuuuaaaaauccccaugccaagaaacaagauguaguaguauuaggaucacaagaaggggcgaugcauacugcauugacaggggcuacagaaauacaaaugagcuccgguaauuuauuauucacagggcaucugaaauguagacuacgaauggacaaauugcaauuaaaggggaugucuuauucuauguguacaggcaaauuuaaaguaguuaaagaaauugcggaaacucaacaugggacuauaguaauuagggugcaauaugaaggugacggaucuccuuguaaaaucccauuugagauaauggaccuugagaaaagauacguguuagguagacuaauaaccgugaauccuauugucacggaaaaagauucuccagugaacauugaagcggaaccuccauucggagauucauacauaauuaucggaguugagcccggacaacucaaauuaaacugguucaagaaaggaaguucuauuggucagauguuugaaaccacaaugcggggagccaaacgaauggccauacugggugauacagcuugggauuuugguucucuugguggagucuuuacguccaucgguaaggcauuacaucaggucuuuggugcuauauauggggccgcauuuucgggcguaucguggacuaugaagauacuuauaggaguaauuauaacauggauaggaaugaacuccagaagcacaucucugaguguaucuuugguauugguugggauagucacauuauacuuaggcguuaugguacaagcggauucagguuguguaguaucguggaagaauaaggaacuaaaaugcgguucagggaucuucauaacagacaacgugcacacauggacggaacaguauaaauuucaaccggaaaguccaaguaaguuggcaucggccauacaaaaagcccaagaagaggggauaugcggaauaagaucaguuacuagauuagaaaaucuuauguggaagcaaauuacgccggaauuaaaucauauacuggccgaaaaugagguuaaauuaacuauaaugaccggagauauaaagggaaucaugcaggcaggcaagcgcagucugcgaccacaacccacugaauuaaaauauagcuggaaaacaugggguaaggcgaaaauguuaucuacggaaaguuauaaucaaacuuuccuaauugacggcccugaaaccgcggaguguccaaacacaaauagagcauggaacucguuggaagucgaggauuauggcuuuggaguuuucacaaccaauauuugguuaaaacuuaaagaaaaacaagaugccuucugcgauagcaaauuaaugucugcagcgauaaaagauaauagagcaguucaugcggacauggguuauuggaucgaaagcgcccuuaaugauacauggaaaauagaaaaggcuucauucauagaagucaaaaauugucacuggccgaaaucucacacgcucuggucaaacggaguccuugagucugaaaugauuauaccaaagaacuuggccggaccuguaagucaacacaauuaucgcccagguuaccacacccaaaucgcaggaccauggcaccuuggcaaacuagaaauggauuuugauuuuugcgacggaacuacgguaauuguuacggaagacugcggaaaucgcggaccguccuuacgcacgacuacugcuuccggaaaguuaauaacagaauggugcuguagaucauguacacucccaccgcuaagauaucguggagaagacggaugcugguacggaauggaaauccggccuuugaaggaaaaggaagaaaaucuuguaaacucauugguaacugccgggcacgggcaaguugauaacuucagucugggugugcucggaauggccuuauuccuagaggaaaugcuaagaacgaggguaggaacaaaacaugccauacuuuuaguugcuguaucuuuuguaacuuugauaaccggcaacaugagcuuuaaggaccuuggccguguggucguaaugguuggggcgacuauggcggacgacauuggaauggggguaaccuaucuagcauuacuugccgcuuucaaaguacgccccacauucgccgcaggauuacuacucagaaaacuaacauccaaggaauuaaugaugacgacaauagggauuguacuauuaucacaaucaacuauuccagaaaccguuuuagaacugacagacgcauuagcgcuagggaugaugguccugaaaauuguccgcaauauggaaaaguaccaauuagcagugacaauuauggcaauucucuguguuccgaaugcaguuguacuucaaaaugcauggaagguaucgugcacaauacuagcgguaguaagugucucuccacuucuacugaccaguagucaacagaaaacagauuggauuccguuagcacuuacaauuaaaggacugaacccuaccgcaaucuucuugacaacccuaucgagaacaaacaagaaaagaucguggccgcugaaugaagcaauaauggcaguggggauggugucuauuuuagccuccagucuauuaaagaaugacauacccaugacaggaccucuaguagcugguggauuguuaacaguguguuauguucuuacgggacgcagcgcagauuuagaguuggaaagagcuacagaugucaaaugggaagaccaggccgaaauuuccggaucaucuccaauuuuaucgauaaccauaucagaagaugggagcauguccaucaaaaaugaggaagaggaacagaccuugacaauuuuaauccgaacagggcuauuaguaaucucugggcuauucccuauaucuauaccgauuacugcagcagcaugguaccuaugggagguaaagaaacagagggcugguguacugugggauguaccuucaccgccuccuaugggaaaagcagaacuugaagacggagcuuaccguauuaaacagaaagguauacuaggguacucucaaauaggggcaggcgucuauaaagaagggacuuuucauacuauguggcaugugacaagaggggcaguccuaaugcauaaaggaaaacgaaucgaaccgucuugggcagauguuaagaaggaucucauaagcuacggugguggauggaaacuagaaggagaauggaaagaaggagaagaaguccaaguccuagcuuuagaaccugggaaaaacccucgcgcagugcaaacaaaacccggcuuguucaaaacaaacacaggcacuauaggggcuguaucacuagauuuuaguccaggaacaagcgguucucccauaaucgauaaaaaggguaaggucgugggccuauacggcaacggagucgucacccguagcggagcuuacguuucugcaauagcccaaacggaaaagucuauugaagauaauccagaaaucgaagaugacaucuuucgaaagagaagauugacaauaauggacuuacacccuggugcuggaaaaaccaaaagguacuuacccgcuaucguuagggaggcaauaaaacgaggccucagaacauuaaucuuagcaccgaccagagucguagcugcugagauggaggaagcacuaagaggucuuccaauucguuaucagacucccgcaauaaaagcugaacacacuggcagagagauaguggaucugaugugccacgcaacuuucaccaugcgcuuacuuucucccguacgaguacccaacuacaaucucauaauuauggacgaagcccauuucacggauccggcuaguauagccgcuagaggauacauaucuacgcgcguagaaaugggagaggcggcuggaauuuucaugacugcaacaccaccggggaguagggacccauuuccccagucuaacgccccuauuauugaugaggagagagaaauuccugaacgauccuggaacucggggcacgaauggguaacagacuuuaaaggaaaaacaguuugguuuguuccaagcauuaaagccggaaaugacauagcugcaugccuacggaagaauggcaaaaaggugauacaacucucaagaaaaacauuugauagugaauacguaaaaacgcgcacaaaugauugggauuucguaguuacaacagauaucuccgaaaugggcgcuaauuuuaaagcugagagagugauagauccacgaagauguaugaaacccguaauucuaaccgauggagaagagaggguaauuuuggcgggaccuaugccgguaacccacucuucggccgcucagcguagaggucgaaucggacguaauccgaaaaaugagaacgaccaauauaucuacaugggagaaccacuagagaacgaugaagauugugcacacuggaaagaggcuaaaauguuauuggacaacaucaacaccccagaaggaauaauuccaucaauguuugaaccugaaagggaaaaagucgacgccauugauggagaauauagguugagaggagaggcuaggaagacauuuguagauuuaaugagacgaggcgauuuaccaguuuggcuugcauacaaggucgcugcagaaggaauuaauuaugccgaccgacgaugguguuuugauggaauuaaaaauaaucaaauucuagaagaaaauguggagguagagauauggaccaaagaaggagaacguaaaaagcucaagccucguuggcuugacgcccgcauauauuccgacccauuggcuuuaaaggaauuuaaagaguucgcagcaggcagaaagagccuuacacuuaaccugauuacugaaaugggaagacugccaaccuuuaugacacagaaaacuagagaugcacucgacaauuuagccguuuugcauacagcagaggcuggagggcgggccuacaaucacgcacugagcgaguuaccggaaacacuagaaacacuacuucuucuuacguuauuagcaacugucacgggcgggauauuucuuuuucuaaugucuggaaggggaauaggcaaaaugacacuugggaugugcugcaucauaacggcaucuauauuauugugguacgcacaaauacaaccacauuggauugcggcgucaauaauuuuggaauuuuuccuaaucguucuguuaauaccagaaccagaaaagcaaagaacaccacaagauaaccaauuaacauauguugugauagcaauauuaacuguaguagcugcgacaauggcuaaugaaaugggcuucuuagagaaaaccaagaaagaucuugggcucggaaguauaguaacccaacaaccagagucaaacauacucgacauagaucuaaggcccgcuuccgcauggaccuuauaugcuguagcuacuacuuuuguuacaccuaugcucaggcauuccaucgaaaauucuaguguaaacgucagucuuacagcuauagcuaaccaagccacaguccuuaugggacuaggcaagggauggccucuuucuaagauggacauaggagucccgcuauuggcaauagguugcuauagucaaguuaacccaaucacacuaacugcagcgcuauuauuacuuguggcccauuacgcgauaaucggucccgggcuucaagcuaaagcaacccgagaagcacaaaaacgagcggcagccggaauaaugaaaaaucccaccguagaugggauuaccguuauugaucuggauccgauuccguacgacccuaaauuugaaaaacaacugggccaaguuaugcuuuugauacuaugugugacgcaaguauuaaugaugcgaacaacuugggcucuaugugaagcucuaacccuggcuacuggccccauaucaacacuaugggaaggaaacccugggcguuucuggaacaccaccaucgcgguaucaauggcaaacauauucagggguagcuaucuagcaggagccggucuacuauuuagcauuaugaaaaacacuacgaauacacggagagguacagguaauauaggagaaacuuuaggagaaaaauggaagaguagguuaaacgcauuaggaaagucagaguuccaaauauauaagaaaucaggaauacaagaaguagauagaacauuagccaaagaaggcaucaagaggggcgaaacggaucaccacgcgguuucgcguggcucugcaaaauugagaugguucguugaaaggaauaugguaacgccugaaggaaagguugucgaucuaggauguggccgagguggcugguccuacuacuguggaggguuaaaauccguccgagaaguaaaagggcuaacgaaaggugguccaggacacgaagaacccauaccgaugucuacauacgguuggaaucuggugagacuacagagcgguguagacguuuucuuuauaccacccgaaaagugugauacgcuguuaugugacauaggagagucguccccuaauccgacgguugaggcaggaaggacucuccggguccuuaaucuagucgagaauuggcuuaauaacaacacucaguuuuguauaaaaguacuuaacccauacaugccuuccguaauagagaaaauggaggcuuugcagagaaaauacggaggugcucuagucaggaacccuuuaaguagaaauuccacucaugagauguacugggugagcaacgcaucgggaaauauuguuaguagcgugaauaugauuucacguaugcuuauuaauagguucacaaugagacacaagaaagcgacauacgaaccagacguagaucucgggagugggacucggaauauugguauugaaagcgagauacccaaucucgacauaauagguaaaagaauagagaaaauuaaacaagaacaugaaaccucauggcacuaugaccaagaccauccauauaaaacuugggcauaccauggaucuuaugaaacaaaacaaacuggcuccgcaucuucaauggucaacgguguuguuagguuauuaacuaaaccuugggauguauugccuacugucacacaaauggccaugacagacaccacaccuuucggucaacaaagaguuuuuaaagaaaaaguugauacacgaacccaagaacccaaggaagguacaaagaaacuaaugaagauaacagcugaauggcucuggaaagaacucggcaagaagaaaaccccucgcauguguacuagagaagaauuuacacguaaaguaaggucuaacgcagcucuuggcgccauauuuaccgaugaaaacaaguggaagucugcaagggaagcaguggaagauucgcguuuuugggaauuaguugauaaagaaagaaacuuacaccuagaggggaagugcgaaacguguguuuacaauaugaugggcaaacgggagaagaaacugggggaguucggaaaagcaaaaggauccagagcaauuugguauauguggcuaggcgccagauuucuagaguucgaagcucuuggcuuccuaaaugaagaccauugguucagccgcgaaaauagucuaucuggaguagaaggcgaaggucuucauaaacuuggguacauucuaagggauguaagcaagaaagaagggggcgccauguaugcugaugacacggcugguugggauacccguauuacacuggaggaccucaaaaaugaagaaaugguaacaaaccauauggagggugagcauaagaaauuagcagaagccauauucaaacucacauaccaaaacaagguugucagagugcaacguccaacaccuagaggaacagucauggauauaaucucaagacgugaccaacguggcucgggucaagucggaacuuacggccuuaacacauuuacaaacauggaagcgcagcuuauaagacaaauggaaggugaagggguuuuuaagaacauacaacaucuaaccgucacagaggaaguagcaguucaaaacuggcucgcaagaguugguagagaaagacuuagucgaauggcgauuucaggagacgauugcguaguaaaaccguuagacgauagauuugcuaacgcacucacugcacuaaaugauaugggaaaaauccguaaggauauacagcaaugggaaccaucuaaagguuggaacgacuggacacaagugcccuuuuguucgcaucacuuucacgaacuaauaaugaaggacggcagaguacuuguugugccaugccguaaccaggaugaauuaauaggcagagcucguauuucucaaggggcaggauggucacucagagaaacggcaugucuagguaaaaguuaugcacaaauguggucgcuaauguauuuccauagaagagauuuaagacuagccgcaaaugcaauaugcucugcuguaccaagucauugggucccuacaagcagaacaacauggagcauacaugcgaaacacgaauggaugacuacggaagacaugcuaacgguuuggaaucgggucuggauaagagaaaauccauggauggaagacaaaaccccaguggaaucaugggaagaaauaccauaucugggaaaaagagaagaccaauggugugguagccuuauaggauuaacaucucgggcaacuugggcuaagaauauacaagcagcaauaaaucaggugagaucauuaauaggcaacgaagaauauaccgacuacaugccaagcaugaaacgauucagacgugaagaagaggaagcuggaguauugugguaa

SEQ ID NO: 22819 - RNA, 9876 nt, Artificial Sequence
  derived and/or modified CDS sequence (opt6) from DENV-2__FM210239__SS-prME
acugcugguguaaucaucauguuaauaccuaccgcgauggcauuucaucugacuacuagaaauggggaaccgcauaugauuguggggagacaggaaaaagguaaaucucuacucuuuaaaacugaagacgguguaaacauguguacacucauggcaauagauuuaggagaacucugcgaagauacgauuacauauaaauguccacuauugagacagaaugaacccgaagauauagacugcuggugcaacucaaccaguacuuggguuacguaugggacguguaccacuacuggagaacauagaagagaaaaacguaguguagcccuaguaccacaugugggaaugggauuagaaacgcgcacggaaacguggaugucuagugaaggggcuuggaaacaugcacagagaaucgaaacguggauccuuagacauccagguuucacgauuauggcagcgauucuagcauauacugucgguacgacucacuuucagagagccuuaaucuuuauacugcuggccgcaguggcuccaucuaugacaaugcgauguaucggaauaaguaauagggacuucguagaaggcguaaguggcgguucuuggguggauauaguccuugaacacggaagcugcgugacaacaauggccaaaaauaaaccgacucuagacuucgaauuaauaaaaaccgaagcaaaacagccugcuaccuuaagaaaauauugcauagaagccaaacuuacgaauaccacgacggaauccagaugcccuacucaaggagaaccuucucuaaaugaagaacaagauaaacgguuugucuguaaacacucaaugguugacagagggugggggaacggaugugggcuauuugguaaagguggcauaguaacuugugcuauguuuacuugcaagaaaaauauggaaggcaaaauaguacaaccugaaaaucuggaauacacaauagucauaacuccgcauaguggugaagaacaugcuguaggcaacgauacugguaaacaugggaaagaaauaaaaauuacgccacaaagcccaaucacugaagcagaauugacagguuauggaacaguuacaauggaaugcucgccccgaacagggcuagauuuuaaugaaaugguacuacuacaaauggaagauaaagcauggcuugugcaucgacaaugguuucuggacuuaccacuacccuggcuaccaggagcagacacacagggaaguaauuggauacaaaaagaaacauugguaacauucaaaaauccucaugccaagaaacaagacguuguagucuugggaucgcaagaaggggccaugcauacagcuuuaacuggagcaacugaaauucaaauguccagcggcaaucugcuauuuacuggucaucuaaaauguagauuaagaauggacaaacuucagcuaaaaggaaugagcuauucaauguguacgggcaaauucaaaauagucaaagaaauugccgaaacacaacauggaacuaucgugauacgaguucaauacgagggggacggaucgccaugcaaaauaccuuuugaaauuauggaccuugagaaaagacacguccuagguagguuaauaacaguuaaccccaucgugacggaaaaagauaguccuguuaauauagaagcagaaccaccauuuggggacucuuauauaauuauuggggucgagccaggucaguuaaaacugaacugguuuaagaaagggucuucaauuggacagauguucgagacuacuaugagaggugccaaaagaauggccauauugggggacaccgcgugggacuucgggucucuuggcggagucuucacaucaauaggaaaagccuuacaccaggucuuuggggcaauauacggagccgccuucuccggggugagcuggacuaugaaaauucuaauaggagucauaauaacauggauaggaaugaacuccagaucaacaagucuaucuguuagccugguuuuaguaggugugauaacauuauaucuuggagcaaugguccaggcggacagcggauguguaguaaguuggaagaauaaagagcuuaaauguggcucagguauauuuauuacggauaacgugcauacguggacagagcaguauaaguuccagccagaaucaccaaguaaacuugcgagcgcuauacaaaaagcucaugaggagggaauuugcgguauaagaucugugacaagguuggaaaaccuaauguggaaacaaauuacaccagagcuaaaucacauuuuaucagaaaaugaaguaaaauuaacgauuaugacaggagauauaaaaggaaucaugcaggcaggaaaaagaucgcuucggccucagccgacagaauuaaaauacucauggaaaacaugggguaaagcgaaaauguuaagcaccgaaagucacaaucaaacguuucuuauugauggaccggagacagcggaauguccuaauacaaauagggcauggaacagcuuggaaguagaagauuauggcuucggaguauuuacaacgaauaucugguuaaagcuaagagaaaagcaagacguauuuugcgacucaaaacuaaugucugccgccauaaaagacaacagggccguucacgcagauaugggauacuggauugaaagcgcgcucaaugauacauggaaaauggaaaaggcuucauuuauugaaguuaagucaugucauuggccaaagucacacaccuuguggucgaacgggguccucgaauccgaaaugaucauaccaaaaucauuugcggggccugugucucaacauaauuauaggcccggauauuauacccagaccgccggucccuggcaccucggcaaguuggaaauggauuuugauuuuugcgaaggaacaacugucgucguuacggaagauugcgggaacagaggacccucguugcgcacaacaacugccucagguaaauugauaacagaaugguguugucgaaguuguacccugccaccacuuagauacagaggcgaggacggcugcugguacggaauggaaauaagaccacuuaaggaaaaagaggaaaaucuaguaaauucacucgucacugcagggcauggucaaauagacaauuuuagucuugguguucugggaauggccuuguucuuagaagagauguuaagaaccaggguggguacgaaacacgcuauauuauuaguuaccguaucuuuuguuacacuuauuacgggaaauaugaguuuucgagaucugggaagaguuauggugauggucggcgccgcaaugaccgaugacauaggaaugggaguaacauacuuagcgcucuuagcugcauuuaaaguccgacccacauuugcagcgggauuacuacuuaggaaacuuacaaguaaagaauuaaugauggcaacaauaggcaucgcucuauuaucccaaucuacaauaccugaaacuaucuuagaacucacagaugcccuagcauuagguaugaugguguuaaaaauaguaagaaauauggaaaaauaucaacuugcagugaccauuauggccauaaguuguguacccaaugcuguaaucuugcagaaugcguggaaaguuucauguaccauucuagcugcuguaaguguaucuccauugcuucuaaccucgucacagcaaaaggccgacuggauaccccuggcccucacuauuaaggggcuaaacccaacugcuauuuucuuaacuacauugagcagaacaagcaagaaacgcucguggccuuugaaugaggcaauuauggcaguagggaugguuucuauccucgccucgaguuugcuuaaaaaugauaucccaaugacaggaccacugguugcaggaggacuccuaaccguuuguuacguucugacuggccguagcgcagaucuugaacuagaacgagcuacagaugucaaaugggaagaucaggcugagauuucagggaguucaccuauacuuagcauuacuauagcugaagauggaagcaugaguauuaaaaacgaggaagaagaacaaacuuuaacuauacucauacgaacaggguuauugguaaucucagguuuauuuccgguaaguaucccgauaacggcagccgcaugguaccuuugggaaguuaagaaacagcgugcugggguuuuaugggauguacccucacccccgccggucggaaaagccgaacuagaagauggagcauaucgcauuaaacagaaaggcauucuuggauacucgcaaauuggagcaggaguauauaaagaagguacuuuucauacgauguggcaugugacacgaggcgcuguacuaaugcaucgaggaaaaagaauagagccuagcugggcagauguuaagaaagaccugauuucauauggaggagguuggaaacuugaaggagaauggaaagaaggagaagaaguucaaguguuagcgcucgaaccugggaaaaacccucgagcuguacagaccaagccaggacucuuuaaaacaaauacaggaacgauaggagcaguaucauuagauuucucaccaggcaccagugguucaccaauagucgaccgaaaaggaaaagucguaggucuuuauggcaauggaguaguuacaagaucaggggcauaugugucggcaauugcacagacagagaaaaguaucgaagauaauccggagaucgaagaugauauauuccgaaagaaaagacucacaauaauggaucuccacccaggggcaggcaaaacaaaaagauaucuaccagcgaucgucagagaagcaauaaaaagaggguuaagaacccuaauucuggcuccaacuagaguaguagcagcugaaauggaagaagcacucaggggguuacccauucgauaccaaacaccagccauuagagccgaacauacgggccgggaaauagucgauuuaaugugucaugccacguuuacuaugcguuuguuauccccagugcgugucccgaacuauaacuuaaucauaauggaugaagcucauuuuacagacccagcaagcauugcugcaagagguuacauuucaacacggguagaaaugggagaggcagcugggaucuuuaugaccgcaacgccaccaggaucucgagauccauuuccccaaucaaacgcaccaauuauggacgaagaaagagaaauuccagaaaggaguuggaacuccggacacgaguggguaacagauuuuaaaggaaaaacuguuugguucgugccauccauuaaagcuggaaaugacauagcagcauguuugaggaaaaauggcaagaaaguuauucaauugucgcgaaaaacauuugauuccgaauacguaaaaacgaggacgaaugacugggacuucgucgucacgacugauauaucagaaaugggggccaacuuuaaagcagaaaggguaaucgauccucggagauguaugaaaccgguaauuuuaacugauggagaagaacgagucauauuggcugguccaaugccaguuacgcacuccucagccgcccaaaggagggggcgaauuggacguaauccuaaaaaugaaaaugaccaauauauauauaugggggaaccauuagaaaaugaugaagacugugcucauuggaaagaagcaaagaugcuucuugauaauauaaacacaccagaaggcauaauaccgaguauguucgaaccagagcgggaaaaaguagaugcuauagauggagaguacagauuacggggagaggccagaagaacguucguugauuuaaugagaagaggugaucugccuguaugguuggcauacagaguugcagcugagggaauaaacuaugcugaucggagaugguguuuugacggcgugaagaacaaucaaauccuagaagagaacguugaagucgaaaucuggacaaaagagggugagaggaaaaagcugaaaccaagauggcuugacgccagaauauacagugacccguuagcacugaaagaguucaaagaauuugccgcuggaagaaagucacucacccuaaaucuaaucaccgagaugggacggcuaccaacauucaugacccaaaaagcuagagaugcccuagauaauuuggcuguauugcacacggcugaggcgggugguagagcauacaaccaugcauuaucggaacuccccgaaacauuagaaacguuacuuuuacucacguuacuugccacaguuacuggcggaauauuucuguuccucaugucuggaaaaggaguaggaaaaaugaccuuaggaaugugcuguauaaucacagccaguauacuccucugguaugcucagauacagccccauuggauugcagcaagcauaauauuggaguucuuuuugauuguccuuuugaucccagaaccggaaaagcaaagaaccccacaggauaaucaacuuacguauguagugauugcaauacuuacugugguagcggccacaauggccaacgagauggguuuccuagagaaaacgaagaaggaccugggguuaggaaguauagcaacacaagaaccggaaucaaauauuuuagauauugacuugagacccgcgucugccuggacgcuguacgccguagcaaccacauucguuacgccaauguuaagacauagcauugaaaacaguuccguuaauguaucacuaacugcaaucgcgaaccaggcgacuguuuuaaugggauuaggcaagggcuggccacuuuccaaaauggauauaggggucccacuguuagcuaucggauguuauucucaaguuaacccuauuacuuugacugccgcauuacuacuccuaguagcucacuacgcuauaauaggaccaggucugcaagcuaaagcuacacgagaggcacaaaaacgagcagcagcugggaucaugaaaaaccccacuguagauggcguaacugugauagauuuggaucccauuccuuaugacccuaaauuugaaaaacaacucggucaaguaauguuauuaauucuuugugugacucaaguacugaugaugcggacuaccugggcacuaugcgaggcucuaacccuugcuacaggacccaucucuacgcuaugggaggggaacccagguagguuuuggaacacuacaauagcagucucaauggcgaauauauucagaggaucuuacuuagccggugcuggucuacucuucaguauaaugaagaauacuacuaacacacgucgaggcacugguaauauaggcgaaacauuaggggaaaaauggaaaucuagacuaaaugcauuagguaagucagaauuucaaauauauaagaaaagcggcauccaggaaguugaucgaacauuggcuaaggaaggcauuaaacggggagagacggaccaccaugcagucuccagaggcagcgccaaacuaagaugguuuguagagcguaacaugguaaccccggagggaaagguuguggaccuugguugcggaagagguggauggagcuacuacuguggaggacugaaggauguaagagaagucaaaggauuaaccaaaggaggcccuggacacgaagaaccuauuccgauguccacguacggguggaaccucguacgauuacaaucaggaguagauguauucuuuacaccgccugaaaaaugugauaccuuguuaugugauauaggcgagucuucccccaauccgacaauagaagcgggaagaacauuaagaguacucucuuuaguagagaauuggcucaauaaugauacucaauuuugcauuaaaguauuaaauccuuacaugccuuccguaauagagaaaauggaaacacuacaaagaaaauauggaggugcacugguacgaaauccauuaucgagaaacucaacacaugaaauguauugggucucaaaugcgacuggaaauauuguuucaucaguaaauaugauaagccgaauguuaaucaaccgguuuacaaugaaacacaagaaagcaacauacgaacccgacguagauuuaggaagugguacgagaaauauuggaauagaaagugagauaccuaaucuugauauaauagguaaacguauugagaaaaucaaacaggagcacgaaacaucguggcacuaugaccaagaccauccauacaaaacgugggccuaucaugguucuuaugagacaaaacagaccggaagugcuaguucuauggugaacggagugguccgauuguuaacuaaaccaugggauguaguaccuaugguuacucagauggcaaugaccgauacaaccccuuuuggacagcaaagaguuuuuaaagaaaagguagacacacgaacacaggaaccaaaggagggaacuaaaaaguuaaugaaaauaacagccgaauggcuauggaaggagcuagggaagaagaaaacuccgcgaaugugcacaagggaagaguucacuaggaagguaaggucgaaugcugcucugggugccauauucaccgacgaaaacaaguggaaauccgcacgagaggcaguugaagacucaagauuuugggaguuagucgauaaagaaagaaauuuacaucuugagggaaagugugagacgugcgucuacaacaugaugggcaaaagagagaagaaauuaggagaauuuggcaaagcuaaggguucgagagcaauaugguauauguggcuaggagcaagauuuuuagaguucgaagcauuagguuuucugaacgaagaucauugguucucacgggaaaauuccuuaucaggagucgaaggagaaggacuucauaaauuggguuacauacuacgagacgucuccaagaaagaaggaggggcaauguaugcagacgauacggcagggugggauacgagaauuacauuagaagaucucaaaaaugaggagaugguuacuaaucauauggaaggcgaacauaagaaacuggcugaagcaauauuuaagcuaacauaucaaaauaaaguuguaagaguucaaagaccuacaccaagaggaacggugauggacaucauaaguaggagagaccaacguggcucaggccagguaggcacuuauggucuaaauacauuuacaaauauggaggcccagcuuauaagacaaauggaaggcgaaggcguuuucaaaucaauacaacguuuaacuguaacagaggagauugcgguucaaaauugguuagcucgugucgggcgcgaacgauuaucaaggauggcaauaaguggugaugacugcgucguaaagccuuuagaugaccgauuugcuuccgcucugacugcauuaaacgauaugggcaaagugcguaaggauauucaacaaugggaaccuucuaggggauggaaugacuggacucaaguuccauuuuguucccaucacuuucaugagcuaaucaugaaagacgguagaguauuaguggucccuugccgaaaucaggaugaacucaucggcagggccagaauuagccagggggccgguuggagccuuaaagaaacagcuugcuuggggaaaagcuacgcacaaauguggucauuaauguacuuucaucggagagaucuacggcuagcagcaaacgcuauaugcuccgcggugccaucgcauugggugcccaccagucguacaacuugguccauacacgcaaaacaugaauggaugacaacagaggauauguuaacgguuuggaauagaguguggauacaagaaaacccauggauggaagauaaaacaccaguggaaucaugggaagaaguacccuaucuagguaagagagaggaccaaugguguggaucacuaauagggcuaacgucgcgugccaccugggcaaagaauauacaaaccgccauuaaucaaguacggucgcuuauuggaaaugaagaauauacugauuacaugccaagcaugaaacguuuuagacgagaggaagaagaagccgguguguugugguag

SEQ ID NO: 22820 - RNA, 9876 nt, Artificial Sequence
  derived and/or modified CDS sequence (opt6) from DENV-2__FM210232__SS-prME
acugcagggguaauaauuauguuaauuccuacugcgauggcauuucaccuaaccacucguaauggagaaccacauaugauaguaggaagacaggaaaaagggaaaucauuguuauucaaaaccgaagaugguguuaauauguguacucuuauggcaauagauuugggagaauuaugugaggauacaauaacauauaaauguccucuacuaagacaaaacgaaccagaagauauagacuguugguguaauagcacguccacauggguaacguauggaacgugcacgacgaccggagaacauagacgcgagaaaagaagcguggcucuaguuccacacguugguaugggacuagaaacacguaccgagacauggaugucgucagaaggagcauggaaacaugcacaaagaauugagacauggauucucagacacccgggauuuaccauaauggcagcgauacuugcuuauacaguagguacaacucauuuccaacgggcuuuaauuuuuauauuguuagcagcuguugcuccgucuaugacgaugagguguauagguauaagcaaccgugauuuuguagagggaguuucaggaggaucguggguugauauuguacuugagcacgggagcuguguuaccaccauggcuaaaaacaaaccaacacuagacuuugaauuaauaaaaacugaagcuaaacagccagcaacgcuaagaaaauauugcauagaagcuaaauugacaaauaccacaacggagagcagaugcccgacucaaggagagccauccuuaaacgaagaacaagauaaaagguucguguguaaacauuccaugguggauagaggguggggaaacggauguggauuauucgggaaaggaggaauuguaacuugugcuauguucacaugcaaaaagaauauggaagguaaaaucguacagccagaaaaucuugaauauacgauaguuauaacgccacauagcggagaagaacaugcaguagggaaugauacugggaaacaugguaaagagaucaaaaucacaccacagucuccuaucacugaagcagaacugacaggguauggaaccgugacuauggaguguuccccaagaacaggcuuagauuuuaaugagaugguacuacugcagauggaagauaaggcaugguuaguacaucggcaaugguuuuuggacuuaccacugccaugguugccaggagcggacacacaagggaguaacuggauacaaaaagaaacucuaguuacuuucaaaaauccacaugccaagaaacaagacguaguuguccuaggcucccaggaaggagcaaugcacacagcauuaacaggcgcaacagaaauacagaugaguucgggaaauuuacuauuuacggggcauuuaaaaugucgucucagaauggacaaacugcaauuaaaaggaaugagcuauucaaugugcaccggcaaauucaaaauuguaaaggaaauugcagaaacucaacacgggacuauaguaauuagaguucaguacgaaggagacggaagucccugcaaaaucccguuugagauaauggaucuugagaaaagacauguauuaggacgacuaauaacagugaacccaauuguaacagaaaaagauucgccaguuaacauugaagcagaaccuccauuuggggauagcuacaucauaauaggaguugagcccggacaacuaaagcuaaauugguuuaagaaaggaucuucuauuggucaaauguuugaaacuacaaugagaggagcaaaacgcauggcaauucucggagauacagcuugggacuucgggagucuagggggaguuuuuacuucaaucgggaaggcuuuacaucaaguauucggagcaauuuacggagcagcauuuucuggcguaucauggaccaugaaaauacuaauugguguaauaauaaccuggaucggaaugaacucaagauccacaucguugucaguuaguuuaguauuaguagggguaauuacgcuauaucugggcgcgaugguccaagccgauaguggguguguaguaucuuggaaaaauaaagaguuaaagugugguaguggaauauuuauuacggauaacguacacacauggacggaacaguacaaauuucaacccgagaguccaucuaaacuagcauccgccauucagaaagcacaugaagaagguauaugugggauccgaaguguaaccaggcuugaaaaucuaauguggaaacaaauaacaccggaauugaaucauaucuugucggaaaaugaaguuaaacuuacuauuaugacuggagacauuaaagggauaaugcaggcgggcaaaaggagcuuaagaccgcagcccacggaauuaaaguauucauggaagaccuggggaaaagcgaaaaugcuaaguacggagucacauaaccaaacauuuuuaauugauggcccagagacagccgaaugcccgaauacaaacagagccuggaacaguuuggagguagaagacuauggguucggaguuuuuacaaccaauauuuggcuaaaacugagggaaaaacaggauguauuuugugauaguaaacuaaugucagcugcaauuaaagacaauagggcugugcaugcugacaugggauacuggauagaaagugcucuaaaugacacauggaaaauggaaaaagccucuuuuauagaggugaaaucaugccauuggccuaaaucacacacguuauggagcaauggugucuuagaguccgaaaugaucauacccaaaaguuuugcagguccuguaagccaacacaacuaccguccaggauauuacacccaaacagccgguccauggcauuuggguaaacuugaaauggauuuugauuuuugugaaggcacgacagugguagucacagaggcauguggaaauagaggaccaucacuuagaacaaccacggccucuggaaaacuuauuacugaguggugcugucggaguugcacauuaccgccuuugcgauauagaggggaagaugguugcugguauggaauggaaauuaggccccucaaggaaaaagaagaaaaccuagugaacucuuuagugacggcgggacauggacagauugauaacuuuucgcuaggcguauuaggaauggccuuguuuuuggaagaaaugcuacgaaccagaguaggcacgaaacacgccauacucuugguaacuguaucauucguaacgcuuauuacugguaacaugucuuuccgagaccucggacguguaaugguuauggucggagccgcgaugacugaugauauagguaugggugugacguauuuagcacuucuagcggccuucaaaguacgcccuacauuugcugcaggacuucuacuucggaaacuaacaucaaaggagcucaugauggcgaccauaggaauagcacuacugagucagagcacuauaccagaaaccaucuuagaguuaacagacgcgcucgcuuuaggcaugaugguuuuaaaaauaguacguaauauggagaaauaccaacuggcagugaccaucauggcuauaaguugcguaccaaacgcgguaauccuacaaaaugccuggaaaguaucauguacaauacuagcugcgguuagcguuaguccuuuacuucuaacuucaucccaacaaaaagcggacuggauaccucuagccuuaacaauaaaaggcuuaaauccaacggcaauauuucugacgacauuaagucgaacaaguaaaaagagauccuggccucugaacgaagcuauuauggcgguaggaauggugucaauauuagcaaguaguuuauugaaaaaugauauuccgaugaccggaccguugguagcagggggauuacuuacuguaugcuacguucuuaccggcagaucugcagaucuagaguuagaacgggcaaccgacguaaaaugggaggaccaagcagaaaucaguggaagcucgcccauucugaguauuacuauagccgaggacggaagcaugucuaucaaaaacgaagaagaagaacaaacauuaacgaucuuaauaagaacggggcuccuagugauaaguggucuauucccagugaguauuccuauuacagccgcugcgugguaucucugggaaguuaaaaagcaaagagccggcgucuugugggacguaccuucuccuccaccugucgggaaagccgaacuagaagacggcgccuaucgaauuaaacaaaagggcauauuagguuauucacaaauaggagcuggaguauacaaagaagggacuuuucauacaauguggcacguaacaagaggcgcgguucucaugcaucgagggaaacggaucgaaccaaguugggcggauguuaaaaaggaccuuauaucuuauggcggaggguggaaauuagaaggcgaauggaaagaaggcgaagaaguccaaguauuagcucucgagccuggcaaaaauccaagagcaguacagacaaaaccgggacuguucaagacgaauacaggaacuauaggggccguuucacuugauuuuaguccuggaacuucuggaagcccaauuguagauagaaagggaaaagugguagguuuguacggaaacgggguagucacacgaagcggagcuuaugucucagcaauugcacaaaccgagaaaucaauugaggacaaccccgagauugaggaugauauuuuuaggaagaaaagacuuaccauuauggaucuccaccccggagcugggaaaacuaaacguuaucuaccagccauugugagagaggcuauaaaacguggguuaagaacgcugauucuggcuccuacacgcgugguugcugcagagauggaagaagcauuaaggggccuuccuauacgauaccaaacuccagcaauacgagcagaacauacaggacgggaaauugucgaucuuaugugccaugcaacguuuacaaugagacuucuaucuccuguuagaguaccgaacuauaauuuaaucauaauggacgaggcccauuucacugacccagcuucaauagcagcuagaggcuauauuuccacuagagucgagaugggcgaagcggcuggaaucuucaugacagcaacaccacccggaucaagagauccauucccacagucuaacgcuccaauuauggaugaagagagagagauaccagaaagaagcuggaauagcggacacgaguggguuaccgacuuuaaaggaaaaacggucugguucguuccauccauaaaagcuggaaaugauauagcugcguguuugaggaaaaacgguaagaaaguaauacaguugucacguaaaacguucgacucugaauacgugaaaaccagaaccaacgauugggacuuuguugucacuacugauauauccgaaaugggcgccaauuucaaagcagaaagaguaauagacccacgaagaugcaugaaaccaguaauacucacggacggagaggaacgcgugauuuuggcgggaccaaugccggugacacacucaagugcugcacaacggcguggaaggauaggaagaaaccccaaaaacgaaaaugaccaguauauuuacaugggcgagccccucgagaaugacgaggacugugcacacuggaaagaggcuaaaaugcuacuagauaauauaaacacacccgagggaaucauuccaaguauguucgagccggagcgugaaaaagucgaugcaauugacggugaauacagguuaaggggagaagcgaggaaaacuuuuguagaccuaaugagaagaggcgacuugccgguauggcuggccuacagggucgcugcggaaggaauaaauuaugcugaucgacgaugguguuucgauggggucaaaaauaaucaaauacuagaagaaaauguagagguagaaaucuggacgaaagaaggagaaagaaagaaacuuaaaccgagauggcuagacgcgaggauauacucugacccauuagcguuaaaagaguuuaaggaauuugcagcagguaggaaaucccuaacucuuaaccuuauuacagagauggguagguuaccaacauucaugacacagaaagcgcgagaugcacuugacaauuuggcaguccuacacacagccgaagcaggaggcagagcuuauaaucacgcguuaagugaacuuccagaaacacuugaaacauuauuauuauuaacguugcuugcgacggucacaggaggcauuuuccuuuuccugaugagugggaaaggagugggaaaaaugacauuagguauguguuguaucauaacagcaucaauacuuuugugguaugcgcaaauccagccucauuggauagcugcaaguaucauauuagaguucuuucugauaguuuugcuuaucccggaacccgagaaacaaagaacaccccaggauaaucaguugacauauguaguaauagcaauucuuacaguaguagcagcaacaauggcuaaugaaaugggguucuuagagaaaaccaagaaagacuuagguuuagguuccaucgcuacacaagagccggagucuaacauacucgacauugacuuaagaccugcgagugcauggacauuauaugcaguagcgacuacauuuguaacaccaaugcuaagacauaguauugagaacaguaguguuaacguaaguuuaaccgcaauagcuaaccaagccacaguacugaugggacuuggaaaaggcuggccccuaaguaagauggauaucgguguaccauuauuagcaauaggcuguuacagucaagugaauccuauaacguugaccgcagcuuuacuacuucuaguugcacacuacgcuauaauuggacccggccuucaggcaaaagcuaccagagaggcgcaaaagagagcagcugcuggcauuaugaaaaacccgacgguagacggugugacgguaauugaucuggaccccauaccauacgacccuaaauuugagaaacagcucggucaagugaugcuacuaauucuuuguguaacacagguauugaugaugagaacgacaugggcacuaugugaagcauugacgcuagcaacugguccaauaucaaccuuaugggaaggaaacccuggcagauucuggaauacgacgaucgccgugucgauggcuaauauuuucagaggaucuuauuuggcuggugcuggauuacucuuuaguauaaugaagaacacuacuaacacaagacgagguacaggcaauauaggagaaacucuaggugagaaauggaaaagccggcuaaaugcccuagguaagucggaguuccagauauacaagaaaucuggcauacaagaaguggacagaacuuuggcaaaagaaggcauaaaacgcggcgaaacagaccaccacgcagugucuagggggucugcgaaacugagaugguucguggaacgaaauaugguuacaccugaaggaaaagucgucgauuuaggaugugguagggguggauggucuuauuauugcggaggauuaaaagauguacgggaaguaaaaggauugacgaagggagggccgggacaugaggaaccaauaccaauguccacuuauggauggaaucuuguaagauuacaaucuggaguagacguuuucuucacgccuccugaaaaaugcgacacguuacucugugauauuggugaaagcucuccgaaucccacuauugaagcagguagaacacuuagaguacuaucgcuugucgaaaauugguuaaauaaugauacucaauuuuguauaaaaguccuuaaccccuauaugccaagugugauagagaaaauggaaacacugcaacggaaauacgggggagcuuugguuagaaaucccuuaucgagaaacaguacucaugagauguauugggugucgaacgcaacgggaaauauugucucaucaguuaauaugaucagucgaaugcuaaucaauagauuuacaaugaaacacaagaaagcgacuuaugaaccggaugucgauuuggggucugguacgaggaauauagggaucgaaagugaaauacccaauuuagauauuauagggaaacgaauugagaaaaucaagcaagaacacgaaacauccuggcauuacgaucaagaucacccguacaagacaugggccuaucacggcucauacgagacaaagcaaacuggcucugcaucgucaaugguuaauggaguaguaagauuacugaccaaacccugggauguggugccuauggucacucaaauggcuaugaccgacacaacgccauuuggacaacagagaguauuuaaagagaagguagacacuaggacgcaagaacccaaggaaggaaccaagaaacucaugaaaauaacagccgaaugguuguggaaagaacuaggcaagaagaaaacuccccgcauguguacgcgcgaagaguuuacccgaaagguaagaucaaaugccgcacucggugccauuuuuacugacgagaacaaauggaaaucagcgagagaagccguugaagacucgcgauucugggaauugguagauaaagagagaaacuuacauuuggaagguaagugcgaaacuuguguauacaacaugauggggaagcgcgagaagaaacugggugaguucggaaaagcaaaagguucaagagcaauaugguauaugugguuaggugcucgauuuuuagaauuugaagcgcuaggcuuucuuaacgaagaccacugguuuucaagggaaaauaguuugaguggaguggaaggcgaaggucugcauaaauuaggauauauccuacgagacgucuccaaaaaggaagggggugccauguaugcagacgacacagcgggaugggacacaaggauaacgcuagaagaucugaaaaaugaagaaaugguaacaaaucauauggagggugagcacaagaaauuagccgaagcaauuuuuaaacugacguaccaaaauaagguaguaagaguucaaagaccaacaccucgagguacaguaauggauaucauuucuagaagggaccagagaggaucaggacaagucgggaccuauggauugaacaccuucaccaauauggaagcacaacuaauucgucaaauggaaggagaaggaguuuuuaagucgauacagcaucucacgguuacagaagaaauugcugugcaaaacugguuggcacgcguggggagagagagguugucucgaauggcgaucucaggggaugauuguguagugaaaccauuagaugacagguuugcuagugcguuaaccgccuuaaacgauauggguaaaguacgaaaggauauacagcaaugggaaccaagucguggauggaaugacuggacccagguacccuuuuguucccaccauuuucaugaacucauaaugaaagauggaagaguccuaguagugccauguagaaaucaagacgaauuaaucgguagagcgagaauuagccaaggugcgggcuggucccucaaagaaacugccugucucggaaaaaguuaugcccaaauguggagucuuauguacuuccaccgucgggauuuacgucucgcugcuaaugcgauaugcagcgcaguuccaucacacuggguaccuacuucacgaaccaccuggucgauacaugcuaagcaugaguggaugacaacagaagacaugcugaccguauggaauagaguauggauucaggaaaacccuuggauggaagauaaaacuccaguggaaucaugggaagaaguuccauaccuaggaaaaagagaggaccaauggugcggcaguuuaauuggcuugacgucaagagccacgugggccaaaaacauucaaacagcuauuaaccaaguacguucccuaauaggaaaugaagaauauacagacuauaugccuagcaugaaaagauuccggcgcgaagaggaagaagcagggguacugugguaa

SEQ ID NO: 22821 - RNA, 9876 nt, Artificial Sequence
  derived and/or modified CDS sequence (opt6) from DENV-2__FM210233__SS-prME
ucugcagggaugauaaucauguugauaccgaccguuauggccuuccacuuaacaacaaggaauggcgaaccucauaugauagucggaauacaggagaaaggaaaaagccuguuauuuaaaaccgaggauggaguaaauauguguacacucauggcaauggaucuuggagaacucugcgaggauacaauuacuuacaaaugcccauugcuacgucaaaaugaaccggaagacauugauuguugguguaauagcacuuccacuuggguaacguacgguacaugcacaacgacaggggaacacagaagagaaaaaagaucagucgcauuaguaccccacguggguaugggucuggaaacgcggacugaaacguggaugucuucggaaggggcauggaagcaugcccaaaggauagaaacuuggauccucaggcauccagguuucacaauuauggccgccauauuagcuuauacuauaggaacaacccauuuucagaggguauuaauuuucauucugcugacagcuguggcaccaagcaugacgaugcgauguauaggaauaucaaaccgugacuuuguagaagguguaagugguggaucauggguggacauaguacucgaacauggaagcugcguaacuacaauggccaaaaauaagccuacccuagauuuugaguugauaaagacagaagcaaaacagccagcuacccuaaggaaauauuguauagaagcgaagcuaacuaauacaacaacagaaucucguugcccuacgcaaggugaaccaucauuaaaggaagagcaagauaaacgauuugugugcaaacauucaaugguagaucgcggauggggcaauggauguggguuauucgguaaaggcggaaucguaacaugugcaauguuuacaugcaaaaaaaauauggaaggaaagaucgugcaaccggaaaaccuagaguauaccauagugguaacgccacacaguggagaggaacaugcaguugguaaugacacuggaaagcaugggaaagaaauaaaaguuaccccucagucaagcauaacggaggcagagcugacaggguauggcacagucacuauggaauguagcccaagaacuggacuugauuuuaacgaaauggugcugcugcaaauggagaacaaggcaugguuaguacacagacaaugguuucuggaccugccauuaccauggcugcccggcgccgacaaacaagaaaguaacuggauucagaaagaaacccuugucacuuucaaaaauccccaugcuaaaaagcaagacguugucguacuuggcagucaagagggugcaaugcauacggccuuaacuggagcaacugaaauucaaaugaguagugguaauuuauuauuuacgggucacuuaaagugccgccuucguauggacaaacugcaauuaaaagguaugucguauucuaugugcacggguaaauucaaaguuguaaaagaaauagcagaaacucaacauggaacgauagucauaaggguacaauacgaaggugaugguucaccauguaaaauaccauucgaaauaauggauuuagaaaagagauauguuuuggguaggcugauaacaguaaauccgauagugaccgaaaaagauucaccagugaacauagaggcagaaccucccuuuggggauagcuacauaauuauugggguugaacccgggcaacugaaguuaaauugguuuaagaaagguucuaguauaggccaaauguucgaaacaacgaugaggggggccaaaagaauggcuauacuaggcgauacagcaugggauuucgguagucuaggugggguauucacgucuauuggcaaggcucuucaucaaguguuuggcgcuauauauggagcagcauuuaguggcguaagcuggacuaugaaaaucuuaauagguguaauaauuacuuggauagggaugaauucgcgaucaacgucacuaagcgucucucucguuuuagucgguaucguaacccuauacuuaggagugaugguacaggccgacaguggcuguguaguaucguggaaaaacaaggaguuaaaaugcggaucugggauuuucauaaccgauaauguacauaccuggaccgagcaauauaaauuucagccagagucaccaaguaaacuagccagugcuauacagaaggcacaagaggaagggaucuguggaauucgaucuguaacuagacuagagaacuuaauguggaaacagaucacaccugaacuaaaucauauacuggcagaaaacgaaguuaaacuaacaauaaugacuggugauauacgagguauaaugcaagcugggaaacguagcuuacguccacagccgacagaacuuaaguacucauggaaaaccuggggaaaagcgaagauguuaaguacagaauccuauaaucagacguuuuuaauagaugguccagaaacggcugagugucccaacacaaaccgagcauggaauagcuuagaaguagaagauuacggauuugggguuuuuaccacgaacauuugguuaaaacugaaagagaaacaggaugccuuuugcgauagcaaacuaaugagugcugcgauaaaagauaacagagcuguucaugccgauaugggcuacuggauggaaucagcacuaaaugauacuuggaaaauagaaaaagcgucauuuauagaagugaaaaacugucauuggccaaaaagucauaccuuauggucaaaugggguauuagaaucagaaaugaucauuccgaaaaauuuagcggguccaguaagucaacauaacuaccgaccaggcuaucacacucagaucgccggaccguggcauuuggguaaauuagaaauggauuucgacuuuugugauggaaccaccguuauuguaacugaagacugcggcaaucgagggccuucacuucgcacgacuacagcaucgggcaaacuaauaaccgagugguguugucggagcuguacacugcccccauuaagauaucggggcgaggacgguuguugguacggaauggagauacgcccuuuaaaagaaaaagaggaaaaucuuguaaauucuuuaguuacggcuggccacggacaaguggacaacuuuucauuaggcguacuuggaauggcuuuguucuuagaggaaauguuacgaaccagaguugguacgaaacaugcaauauuacuuguugcaguauccuuugucacauugauaacaggaaauaugagcuuuaaggacuuaggcagaguagugguaaugguuggcgcgaccauggcagaugauauuggaaugggaguuacauauuuagcuuuguuagcugcguuuaaagucagaccaacauuugcugccggucugcugcuaaggaaacuaacaaguaaagaacuaaugaugacgacaaucgggauuguauuacuuucccaaucaaccaucccugaaacuguauuagaacuaaccgaugccuuagcauuagguaugaugguuuuaaaaauaguaagaaauauggaaaaguaucaauuagcaguaacgauaauggccauauuaugcguaccuaacgcggucauacuccagaaugcauggaaaguaucgugcacaauacuagcaguuguaucugugucuccuuugcuacucacuucuucgcaacagaaaacugauuggauaccacuagccuugacgaucaagggccuuaauccgaccgccauauuucuaacaacgcucucaaggacuaauaaaaaaagauccuggccucuuaacgaggcaauaauggcuguuggaaugguuucgauauuagccagcucauuguuaaagaaugacauaccgaugacagguccucuagucgcagggggguuacucaccgucugcuacguacugacagguagaagugcggacuuggagcuugagagagccaccgauguuaaaugggaggaccaagcagaaauaucuggaaguucgccgauauuaucaaucacgauaagugaggaugguagcaugucaauuaaaaaugaagaagaggaacaaacauuaacaaucuuaauaagaacggguuuacuagucauaagcgggcuauucccuauaaguauccccauaacugcagcagcaugguaccucugggaggucaaaaaacagagggccggcguccugugggauguaccgucgccgcccccuaugggaaaagcugaauuggaggauggcgcuuauagaauuaaacagaaagguauccucgguuauucucaaauuggagcgggaguauacaaagaagggacuuuucauaccauguggcacgugacaagaggagcaguucucaugcauaaggguaaacggauagaaccaucuugggcugacguaaaaaaagauuugauuucauauggcggagguuggaaacuagaaggcgaguggaaagaaggagaggaaguccagguauuagcacuugaaccagguaaaaaccccagagcaguucaaacaaaaccgggacucuucaaaacaaauacaggcacaaucggagcaguuuccuuagauuucucaccuggaacguccgggucaccaauuauugauaaaaaaggaaaaguuguuggacuuuaugggaauggggucgugacgcguucaggagcguaugucucagcuauugcucaaacagaaaaaucaauagaagauaauccagagauugaggacgauauauuccgaaaaagacgguuaacaauaauggaccuacauccgggggcuggaaaaacgaagcgauaccuaccagccauaguacgagaagcgauaaaacgaggcuuacgaacuuuaauacuggcgccaacacgugugguagcugcagaaauggaagaagcccucaggggcuuacccauacgcuaucaaacaccagccauacgagcagaacauacuggccgagaaauaguagaucuuaugugucacgcaacauuuacaaugagauugcucucaccugucagagugccgaauuauaaucuuauaauaauggaugaagcacauuucaccgacccagcaucaaucgcugcucggggcuauauaaguacccgaguagaaaugggagaagcagcagggauuuucaugacugcgacuccaccgggaucgagggacccauuuccacaaucaaaugcuccaauuauagaugaagaacgagaaauucccgaacgaucauggaauucgggacaugaauggguaacggauuucaaagguaaaaccgugugguuuguuccaucgauuaaagcagguaacgauauagcugcauguuuaagaaaaaacgggaaaaaagugauucaacucagccggaaaaccuucgauagugaguaugucaagacacguacuaaugacugggauuucguuguaacuaccgacauaagcgagaugggugcaaacuucaaagcugaaagaguaauagauccgagaagauguaugaaaccuguaauucuaacagacggcgaagaacgcguuauccucgcaggcccaaugccaguuacucacucgucagcugcacagcgacgagggcgaauaggaagaaaucccaaaaaugagaacgaccaauacauauauaugggagaaccuuuagaaaaugacgaagauugugcgcacuggaaagaggcaaaaaugcuauuagauaacauuaauaccccggaagguaucaucccgucaauguuugaacccgagcgagaaaagguugacgccauagauggagaauauagauuacgaggugaagcccgcaaaacauuuguugauuugaugagaagaggagaccuaccgguaugguuagcauauaaagucgcugcugaaggaauuaacuaugcggaucgucgauggugcuuugaugggauuaaaaauaaucagauuuuagaagaaaacguugaggucgaaauauggacuaaagagggugagcgaaaaaaguuaaaaccucgaugguuagaugcuagaauauauucagacccauuggcucuuaaagaguuuaaggaauucgcggcggggcgaaagucgcuaacccuuaauuuaaucacggaaauggguagauugcccacauuuaugacacagaaaacgagagacgcucuagacaaucuugccguacuccauacagcagaagcugguggcagggcauacaaucaugcguuaucugaguuaccggaaacacuugaaacccuuuuguuguuaacgcuuuuagcuacaguaacuggaggaauuuuccuguuucucaugaguggcagaggaauugggaaaaugacacuugguaugugcuguauuauuacugcuucaauauuacuaugguacgcucaaauucaaccgcauuggauagcagccuccauuauauuagaguuuuuucugauaguccuacugauuccagaacccgaaaagcaacguacaccacaagauaaccaguuaacguacguaguuauagcuauauugaccguggucgcggccacaauggcgaacgagauggguuuucuagaaaaaacaaaacgcgacuuaggacuagggucgauagcgacacaacagcccgaaagcaauauauuagauaucgaucuuagaccagcauccgcauggacgcuuuacgcaguugcgacuacauuugucaccccaaugcuucgccacaguauagaaaacaguucgguaaauguuucccuaacugccaucgcaaaccaggcuaccgugcuaaugggacuugggaagggcuggccauuaucgaaaauggauauuggcgugccuuuauuggccauaggauguuauucacaaguaaauccaaucaccuuaacugcggcguuauuguuacugguagcucacuacgcaauaaucgggccaggucuucaagcaaaagcuacacgagaggcacaaaagagagcggccgcgggcauuaugaaaaacccaacuguagacggaaucaccguaauagaccucgaucccauaccuuacgacccaaaauuugaaaaacaacucggccaagucauguugcuaaucuuauguguuacucaagucuuaaugaugaggaccacaugggcacuaugcgaagcacuaacgcuggcuacgggacccauuagcacacucugggaaggaaacccaggcagguucuggaacacuaccauugcagugucaauggcuaacauuuucagagguucauauuuggcgggcgcugggcuguuauucaguaucaugaaaaauacaacaaacacucgcagaggaacaggcaauauaggagagacgcuuggcgaaaaauggaagucaagacuaaaugcacuaggcaaaucagaguuucaaaucuauaagaagucaggaauucaagaaguugacagaacgcuagccaaagaaggaauaaaaaggggagagacagaucaccacgcagugagccguggcagugcaaaacuaagaugguuuguagaaaggaacaugguaacaccagaaggcaaaguaguagaucuagggugugguagagguggauggucauauuauugcggaggcuugaagaauguaagggaagugaaaggauuaacuaagggaggaccaggacacgaagaaccuauaccaaugucuacauacggguggaacuuaguaaggcuucaaagugguguugacguauucuucauaccaccugaaaagugcgauacccuauuaugcgacauaggugaaucuucaccaaauccaaccguagaagcgggccguacucuucgaguacucaaucuuguugaaaauuggcucaacaauaacacucaauuuuguauuaaaguccucaacccuuauaugccuucgguuauagaaaagauggaagcccuucaacgaaaauauggcggagcuuuaguaagaaacccauuaucuaggaacucgacacaugaaauguauuggguguccaaugcaucaggaaauauaguaucuucaguuaauaugauaucaagaauguugauaaauagauucacuaugaggcauaaaaaagcgacauacgagccagauguagaccucgguagcggcacgagaaacauaggcauugaaucagaaaucccaaauuuagauauuauuggcaaacguauugaaaagauaaagcaggagcaugaaaccucauggcacuacgaccaagaccacccauauaaaacgugggccuaccaugguagcuacgagaccaagcaaacaggcagcgcaucaucaaugguuaacggagucguacgcuuauuaaccaagccgugggacguauugccgaccguaacucaaauggcuaugacggauacuaccccauuuggucagcagaggguguucaaagaaaaaguugauacacgaacucaagagccgaaagaagggacaaaaaaacuaaugaaaauuaccgcugaauggcucuggaaggaacuaggcaaaaaaaagacaccuagaauguguacgcgagaagaauuuacgcgcaaaguuagaucuaaugcagcucucggggcaauuuuuacagaugaaaauaaguggaaaagcgcgcgagaagcaguugaagacucacgcuuuugggaacucguugauaaagaacgaaauuugcacuuagaaggaaagugcgagacuuguguauauaauaugaugggaaaacgagaaaaaaagcuaggagaauucggaaaggcaaaagguucaagagccauuugguauaugugguuaggcgcucgauuucucgaauuugaagcuuuagguuuccuaaaugaggaucacugguuuucaagagaaaauucccugucaggaguagagggagagggauuacauaaacuaggguauauauugcgcgacgugaguaaaaaagaagguggugccauguacgcagaugauacagcaggaugggauacaagaaucacacuugaagacuuaaaaaacgaagaaaugguaaccaaucauauggaaggugaacacaaaaaacuagcugaagcaauauucaaguuaaccuaucagaacaaagucguaagaguucagcgaccuacaccacgagguacugugauggacauuauuucuaggcgugaucaacgcggaucggggcaaguaggcacauaugggcuaaauacauuuaccaauauggaggcucaauugauucgucagauggaaggugaggguguauucaaaaauauucaacauuuaacugucacagaagagguugcuguacauaacuggcuagcgaggguuggaagagagcgguuaucacgcauggcaaucucaggagacgacugcgugguuaaaccuuuagaugacagauuugcaaaugcuuuaacagcacuaaacgauaugggaaaaauacgcaaagacauccaacagugggaaccaucaaaagguuggaaugacuggacacaaguaccauucugcucacaccacuuucaugaauuaaucaugaaagacggaaggguauuagucgugcccugccgaaaccaggacgaacuaauuggacgggcgagaauuagccagggcgcaggauggucacuuagagaaacugcaugccucggaaaaaguuacgcacaaauguggucguuaauguacuuccauaggagggaucugagacuugcagcuaacgcaauaugcucugcgguuccgucacauuggguuccaaccaguagaacaacauggucaauacaugcaaaacacgaguggaugacaacagaggauaugcuaacaguauggaauagaguauggauacgagaaaaucccuggauggaggacaaaaccccuguugaauccugggaagagauaccauaccuaggaaaaagagaagaucaauggugcggaagccuaauagguuuaacuucaagagcaacuugggcaaaaaauauucaagcagcaauuaaucaaguucgaagucuuaucggaaaugaagaguauacugacuauaugccaagcaugaaaagauucagaagagaagaagaagaagcaggaguacuaugguga

SEQ ID NO: 22822 - RNA, 9876 nt, Artificial Sequence
  derived and/or modified CDS sequence (opt6) from DENV-2__FM210241__SS-prME
acagcaggaguuauuauuauguuaauaccuacagcaauggcauuucaccuuacuacgagaaauggcgaaccccauaugauuguagggagacaagaaaaaggaaaaucgcuacuguuuaaaacggaagauggugugaacaugugcaccuugauggccauagacuuaggagaauuaugcgaagauacaauaacuuauaaaugcccauuauuacgucaaaaugaaccagaagauauagacuguugguguaauucuacaucuacaugggugacguaugggacauguacaacgacaggagaacaccggcgcgagaaaagaaguguagcucuagucccacauguugguauggggcuagaaacaaggacggaaacuuggaugucuucagaaggcgcauggaaacacgcacagaggauugagacauggauucuaagacacccuggauuuacgauaauggcugccauucuagcguacacaauugggacaacacacuuccagagggcacuaauauuuaucuuacuuacugcuguagcucccucaaugacaaugagauguauagguauaucgaacagagacuuuguagagggaguuucagguggaagcuggguugacauaguccuagaacacgguucaugcgugacaacaauggccaaaaacaaaccaacauuagauuucgaacuaauaaaaacagaggcuaaacagccagcaacguugcgaaaauacuguaucgaagcaaaauuaacaaauacaacaacagagucucgaugucccacucagggagaaccgucacuuaacgaagaacaagauaaaagguuugugugcaaacacucuaugguugacaggggauggggcaacggauguggauuauuugggaaagguggaauaguuacuugugccauguuuacguguaagaaaaacauggaaggcaaaauaguacagccagaaaauuuagaauauacuauaguaaucacaccccacucaggagaagaacacgcugucggcaaugacaccgguaaacacggaaaagaaauuaaaaucaccccucaaucaaguauaacagaagcggaacuaacagguuaugggacggucacaauggaauguucaccuaggacgggauuagacuuuaaugaaauggugcuauugcaaauggaggauaaagcauggcuuguacauagacagugguuccuagaccuaccauugcccugguugcccggagcagauacacaaggcaguaacuggauacaaaaagaaacauuagucacuuucaaaaacccacacgccaagaaacaagacguaguuguacuaggaucgcaagaaggggcgaugcauacagcgcucacuggagcgacugaaauacagaugaguucgggcaauuuacuauuuacaggucaccuaaaaugucgacuacgcauggacaaacuacagcuaaaaggaaugucguauucgauguguacugguaaauucaaaauagugaaagagaucgcugaaacacagcaugggacaauagucauaagggugcaguacgagggggauggaucgccaugcaaaauacccuuugagaucauggaucuagaaaagaggcauguacugggucgauuaaucacaguaaaucccauaguaaccgaaaaagauucaccaguuaauauagaagcggaaccgccguuuggagacagcuacaucauaauaggcguugagccaggacaacugaaacuuaacugguucaagaagggaucuuccauuggacaaauguuugaaacaacgaugagaggagcuaagaggauggccauacuaggcgacacugcaugggacuucgggucccugggaggaguuuucacauccauugggaaagcauuacaucaagucuucggugcuaucuauggugccgcguucagcgggguaucguggaccaugaagaucuuaauaggcgcuauaauuacauggauuggcaugaacucaagaucuacgaguuuaagcguaagccucgugcuaguaggaguaauaaccuuauaucuaggcgcgaugguacaggcggauaguggaugcgugguauccuggaaaaacaaagaguuaaaaugcggaucagggauuuuuauaaccgauaacgugcacacauggaccgaacaauacaaguuucaaccagaaagcccgaguaaacuggcaucggcgauacagaaagcucaugaagaaggaauaugcggaauaagaucaguaacaaggcuagaaaaccucauguggaagcaaauaacaccagagcuaaaucauauacuaucugaaaaugaaguaaaacugacaaucaugacuggcgauauaaaaggaaucaugcaggcugggaaaagaucauuacguccucagccaacagaacuaaaauauucuuggaaaacuuggggcaaagcaaaaaugcucagcaccgagucgcauaaccaaacuuuucuaauagacggaccugaaacugcagaauguccaaauacgaaccgcgcuuggaauaguuuagagguggaagauuauggguuuggggucuuuacgacuaauauuuggcucaaauuacgagaaaaacaagaugucuuuugcgacaguaaacuuaugucagcggccauaaaagacaacagagcugugcacgcugacaugggauauuggauugagucggccuugaacgacacauggaaaauggaaaaagcaucauucaucgaaguaaaaaguugccauuggccaaaaucucacacccuguggaguaaugguguauuggaaucggaaaugauuauaccgaaaucauuugcgggaccugucagccaacacaauuaucguccagguuacuauacacaaacagcagguccuuggcacuugggaaaauuagaaauggauuuugacuuuugcgaagguacaacuguugugguuacagaagacugcgggaaccgugguccuagcuuacgaacuacaaccgcauccggaaaauuaauuacggaguggugcugucggagcuguacacuuccacccuuacgauauagaggagaagacgggugcugguaugguauggaaauacggccuuuaaaagaaaaagaggaaaauuuaguaaauagucucguaacagccggacacggccaaaucgauaauuuuucauuagggguacuagguauggcguuauuccuagaagaaaugcuacgaacaagagugggaaccaaacaugcgauucuuuuaguagcaguuagcuuugugacccuuauaacuggaaauauguccuucagagauuuagguaggguaaugguaaugguuggagcuacgaugaccgacgauauagguaugggaguaaccuaucucgcuuuguuggcagcuuucaagguuaggccaacauuugcagcuggauuauugcuacggaaacuuacuuccaaagaauuaaugauggcgacuauagggaucgcauuauuaucucaaucaacaauacccgaaaccauauuggaacuaacagacgcacuagccuuaggaaugauggucuuaaaaauaguacgaaacauggaaaaguaucaacuagcaguuacuauaauggcuauauccugcguuccgaaugcaguuauuuuacaaaaugccuggaaagucuccugcacaauauuggccgcugucucggucucuccacugcuguugacaagcucacagcaaaaagcggacuggauuccacuagccuuaacgauaaaaggucuuaacccaacggcaauauuccuaacaacucuaucaagaacgagcaagaaaaggucguggccgcugaacgaggcgauuauggcuguagguauggucucaauccuggcaaguagucuguugaaaaaugauaucccuaugacgggaccucuugucgcugguggucuacuaacaguuugcuacguauuaacaggacgcucagcagacuuggaguuagaaagagcaaccgaugucaagugggaggaucaagcagaaauuucuggaucuagcccuauucuaaguauuacaaucagugaagauggguccauguccaucaaaaacgaggaagaagaacagacauuaacaauuuuaauacguacugguuuauuagucauaagcggauuguuucccgucagcaucccaauuacugcagcagcaugguaccuuugggaagugaagaaacaacgagcagggguguugugggacgucccauccccaccuccugugggaaaggcugaacuugaagauggcgcuuauaggauaaagcaaaaagggauacugggauauucgcagauaggagcaggaguauauaaagaaggaacuuuccauacuauguggcauguaacacgcggcgcgguacucaugcacagaggaaaaagaauugaaccaaguugggccgacguuaagaaagacuuaauaucuuacggugguggguggaaauuagaaggcgaauggaaggaaggagaagaagugcaaguauuagcucuagagccuggcaaaaacccaagagcaguacaaacaaaaccuggcuuauuuaaaacgaauacagguacuauuggugcgguaagccuagauuucagcccagggacaagcggaucgccaauaguugaucgcaaaggaaaaguggugggcuuauauggcaaugguguggucaccagaucgggggcguacgucagcgcaaucgcccaaacagagaaaagcauagaagauaacccagaaauagaagaugauauauucagaaagaaacgauuaacaauuauggaccuacauccuggugcagguaaaaccaagcgauaucuaccugccaucgugagagaggcgauaaaaagaggucugagaaccuuaauauuagcaccaacaagaguaguugcggccgaaauggaagaagcauuaagaggucuuccaauccgauaccaaacuccugcaauaagagcagaacauacgggaagggagaucguagacuugaugugucaugcaacguuuacuaugcguuuauuaucccccgucaggguaccaaacuacaaccuuaucaucauggaugaagcccauuucacagauccagcguccauagcagcgcgaggauacauuuccacuagaguggagaugggagaagcugcaggaauuuuuaugacggcaacgcccccggguucacgggacccguuuccccaaaguaaugcaccaauaaucgacgaagaacgagagauaccagaacgcagcuggaacucuggccacgaaugggugaccgauuuuaaagggaaaacuguaugguucgugccuucaaucaaggcagguaacgacauagcagcgugucuacguaaaaaugggaagaaagucauccaauugagucgaaagacauucgauucagaauacguuaaaacuaggacaaaugauugggauuuuguuguaacuacagauauuagcgaaaugggcgcuaauuuuaaggccgagcgcguaaucgauccucgccgaugcaugaagccagucauacuuacagauggagaagaaagaguuauccuugcagguccaaugcccguuacucauagcucggcggcccaaagaagagguagaauaggaagaaaucccaaaaaugaaaacgaucaauacaucuauaugggagaaccauuagaaaaugacgaagacugugcacacuggaaagaggcaaagauguuauuagauaauaucaauacaccugaaggcauaauuccuucgauguuugaaccagaacgggaaaaaguagacgccaucgauggagaguaucggcuuaggggagaggcccgcaagaccuuuguagaucuuaugagaagaggagacuuaccuguguggcuagccuaucgcgucgcagcagaaggcauuaauuacgcagacagaagauggugcuuugaugggguuaaaaacaaucaaauacucgaagaaaauguugaaguggaaauauggacuaaagagggagaaaggaagaaauuaaagccuagaugguuggaugcaagaauauauucggauccuuuagcgcugaaggaguucaaagaguucgcggcgggaagaaaaagccucacuuuaaaccugaucacagaaauggggcguuugcccaccuuuaugacacaaaaagcuagggaugcauuagauaaccuagcaguccuccacacagcugaagccggugggagagccuacaaucaugccuugucugaacucccugagacacuagaaacacugcuacuacucacacuauuggccaccguaacaggaggaauauuuuuauuucuuaugucagguaaaggaguaggaaaaaugacccugggcauguguuguauaauuacagcuagcauacuccucugguaugcgcagauucagccucacuggauagcagcgaguauuauuuuggaguucuuucuaauaguauuauugauuccugaaccagaaaagcaacgaacuccucaagacaaccaauuaacuuacguugucauugccauauuaaccguaguugcagcaacgauggccaaugaaaugggauucuuagaaaagaccaagaaagaccuaggauuggggucgauugcaacccaagaaccagagucuaauauacuagauauagauuuacgaccugcaucugccuggacauuguaugcuguagcuacaacauucgucaccccgauguuacgucacucaaucgaaaacuccucuguuaaugugagccuaacggcuauugcaaaccaagcgaccgucuuaaugggcuuagguaaaggcuggccacuuuccaaaauggacauuggggugccacucuuagccauuggcugcuauagucagguuaauccuauaacacuuaccgcagcguuauuaucgcuaauugcacacuacgcuauuauaggacccggacuacaagcgaaagccaccagagaagcacaaaagcgagccgcagccggcauaaugaagaacccaacggucgaugggauuacuguaauugacuuagacccaauaccuuacgaucccaaauucgaaaaacaacucggucaagugaugcuacucauauuaugugugacacaaguccuaaugaugaggacaacaugggccuuaugugaagcacuaacccuagcaacggguccaaucucuacccucugggaggguaaucccggaagguuuuggaauacgacgauugcuguaucgauggcuaauauauuccgaggguccuacuuagcaggggcugggcuccuauuuuccauuaugaaaaauacaacaaauacuagaagaggaaccggaaacauaggagaaacucuuggugaaaaauggaagucuaggcuaaaugcccuuggaaaaagugaauuucaaauuuauaaaaagagugguauacaagaaguagaucggacucuagccaaagaaggaaucaaacgcggagaaacugaccaccacgccguaucucgugggucggcaaagcuaaggugguucgucgagaggaauaugguaacgccugaaggaaaaguaguagacuuaggaugcggucgcgggggauggagcuacuauuguggaggucugaagaacguccgagaaguuaaaggucuuacuaaagguggcccuggacaugaagaaccaauacccaugucgacauauggauggaaccuaguaaggcugcagaguggugucgacguauuuuucacucccccggaaaaaugcgauacucuccuuugcgauauaggagaaaguucuccaaaucccacgaucgaagcaggcagaaccuuaaggguccucagccuaguagagaacuggcugaacaacgauacacaauucuguauaaaaguuuuaaauccauauaugcccagugucauugagaagauggaaacauuacaaagaaaguacggcggagcauuaguuagaaauccucuaagcagaaacagcacccaugaaauguauugggucaguaacgcaacaggaaacaucguuaguucaguuaauaugauuucgagaauguugaucaacagguuuacaaugaaacauaagaaagcuacauaugaaccagauguagacuuaggcagcgguacaagaaauauagguauagaaucggaaauccccaaccucgauauaauuggcaaacgcaucgagaaaauaaaacaagaacaugaaacaaguuggcacuaugaucaagaucauccauauaaaacaugggcauaccaugguucauaugaaaccaaacaaacaggaucugcuaguucaauggucaacggcgucgugagacuauugacaaagccuugggacguagucccaaugguuacgcaaauggcgaugacagauaccacaccguuuggacaacagcgagucuuuaaagagaaggucgacacaagaacacaggagccaaaagaagggaccaaaaaguuaaugaaaaucacagcagaguggcuauggaaagaacuagguaagaagaaaacaccacgaauguguacucgcgaagaauuuaccaggaaaguaaggagcaaugcugcguuaggagcaauuuuuacugaugaaaacaaguggaaaagcgcacgagaagcaguugaagauucacguuucugggaacugguugacaaggagcgaaaccuucaccuugaaggcaaaugugaaacuugcguauacaacaugaugggaaagagagagaagaaacuuggagaguucggaaaggccaagggaucacgagccauaugguacauguggcugggagcacgcuuuuuggaguucgaagcauuaggauuucuuaacgaggaccauugguuuucacgcgaaaauucgcuaucaggaguagaaggagaaggauugcauaaguuaggauauauauuacgugauguuucuaagaaagaagguggggccauguacgcggaugauacugcagguugggacaccagaauaacucuugaagaccucaaaaaugaagagaugguuacaaaucauauggaaggcgaacacaaaagauuggcugaagcaauauuuaaacuuacuuaccaaaauaaaguaguaagaguccaacgaccuacuccacgcggaacagugauggacauuauaucacgccgagaccaaagagggucagggcaaguagguacauacggccuuaauacauucacaaauauggaagcacaauuuauaagacagauggagggcgaaggaauuuucaagagcauacaacaccuaacaguuaccgaggagauugccguccaaaauuggcuugcucgaguaggacgugaaagauuaaguagaauggcaauuagcggugaugacuguguuguaaaaccgcuagacgaucguuucgcuucggcccuuacugcucuaaacgauaugggcaaaguuaggaaggacauacaacaaugggagccuaguaaaggauggaacgauuggacacaagugccauucuguucacaucauuuucacgagcuaauaaugaaagaugggagaguuuuagugguuccuuguaggaaucaggacgaacugauuggaagggcgcgaauaucucaaggcgcgggauggagucuuaaggaaacagcgugccuaggaaaaucguacgcacaaauguggucauuaauguacuuccaccgaagggauuugcggcuugccgcgaacgccaucuguucagcagugcccagccauuggguucccacaagucgaacgacguggucuauucacgcuaaacacgaguggaugaccacagaggacaugcuuacugucuggaauaggguuuggauccaagagaacccauggauggaagauaaaaccccugucgaaucuugggaagaaguaccauaccuaggaaagagagaggaucaaugguguggauccuugauaggacucacaagucgggcuacaugggcuaaaaauauccaaacagcuaucaaucaggugagaagccucaucgggaaugaagaauacacugacuauaugccaucuaugaaaagauucagacgagaagaagaagaggcugggguauugugguaa

SEQ ID NO: 22823 - RNA, 9876 nt, Artificial Sequence
  derived and/or modified CDS sequence (opt6) from DENV-2__FM210242__SS-prME
agcgcggggaugauuauaaugcuaauaccaaccguuauggcuuuucaccugaccacacgaaauggcgaaccgcacaugauuguaggaauacaagaaaaagguaaaucccuuuuauuuaaaacagaagaugguguaaauauguguacgcuaauggcuauggauuugggagaauuaugugaagauacaauaacuuauaaauguccacuauuacgacaaaaugaacccgaagauauagauuguuggugcaauaguacuuccaccuggguuacauacgggacauguacgacuacgggagaacauagacgggagaaaagaucgguugcacuugugccacacguaggaaugggacucgaaacgcgcacugaaaccuggaugaguucagaaggugcauggaaacaugcucagagaauagaaacauggauacuaagacauccuggauuuacaauuauggcggcaauuuuggcuuauacaaucggaacgacucauuuucaaagaguccuuauauuuauacuauuaacggcagucgcgccaagcaugaccaugagauguauuggaauauccaaucgggacuuuguugaaggcguaucuggggguucauggguagacaucguuuuggaacaugguaguuguguaacuaccauggccaaaaauaaacccacacuagauuuugaacuaauuaaaaccgaagcaaaacaaccagcuacccugcgcaaauacuguauugaagcaaagcuaacuaacacuacgacugaaucuagauguccaacccaaggcgagccgagucuaaaagaggagcaagauaagagguucguuuguaaacauagcaugguagacagaggauggggaaacggaugcggacuauuugguaaagggggaauagucacaugcgcaauguucacaugcaagaaaaacauggaaggaaaaaucguucaaccagaaaacuuggaguauacuauaguggucacuccacauucaggcgaggaacacgcaguugguaaugacacgggaaaacauggcaaagaaauaaaagucacuccacaaucaucgauaacagaagcagaacuaaccgguuauggaacugucacaauggaauguucuccgcgaacaggucuagacuucaacgaaaugguccuguuacagauggaaaacaaggcuugguuaguucaucgacaaugguuccucgauuuaccucuccccuggcucccuggcgcugauaaacaggagaguaauuggauacaaaaagaaacacuugugacauuuaagaauccgcaugcaaagaaacaggacguaguagucuuaggaucgcaagagggugcaaugcauacagcgcugacaggcgcgacagaaauacaaaugucaucgggcaaucuucuuuuuacaggacauuugaaaugcagguugcguauggauaaguuacaacuuaaaggaaugucuuauagcauguguacaggaaaauucaaggugguaaaagagauugcugagacacagcauggaacuauuguuauacguguucaguaugagggagauggcaguccauguaaaauaccauucgaaauaauggacuuagaaaaacgauauguacuagguaggcucaucacaguaaauccaaucguaacagagaaagauucuccuguuaacauagaagcggaaccaccauucggagacaguuauauaauaaucggaguagaaccaggucaacuuaaacuuaauugguuuaaaaaggggaguaguauuggucaaauguucgagacuacgaugcggggagcaaaaaggauggcaauccuaggagauacagcaugggauuuugguagucuagguggcguguucacuucaauagguaaagcacugcaccaaguguuuggugcuauauauggagcagcauucaguggaguaaguuggacaaugaaaauacugauaggcgucauaaucaccuggauaggaaugaacucuagaaguaccagccugaguguuagccuugucuuagugggaaucguuacgcuauauuuaggugucaugguacaagcugauucaggaugcguaguguccuggaaaaauaaggaauuaaaguguggaucuggaauuuuuauaacagacaauguacauacguggacagaacaguacaaauuccaaccagaaagcccgaguaaauuggcaucagcgauacaaaaggcccaagaggagggcauaugugguauccguucaguaacaagguuagagaaccugauguggaaacaaaucacaccugaauuaaaccacauccuagcugagaaugaaguuaaacuuacuaucaugacaggagacauaaaaggaaucaugcaagcaggaaaacgaagucuccgaccucaaccaacagaauugaaauauucauggaaaacaugggggaaagcaaagaugcuaaguacagaaucuuacaaccaaacguucuuaaucgauggacccgaaacagcagaauguccaaauacaaacagagccuggaacucacuggaaguagaagacuauggauucggaguuuuuacgacaaauauauggcuaaaauuaaaagaaaaacaagaugcauuuugcgauucaaaacuaaugagcgcagcgaucaaagauaacagggcuguccaugcagauauggguuacuggauagaaucugcacuuaaugauaccuggaaaauugaaaaagccagcuucauagaagugaaaaauugucacuggccaaaaucgcacacgcuguggaguaauggcguacucgaaucggagaugauaauaccgaagaacuuagcugggccggugagucagcauaacuaucguccuggguaucauacucagaucgcgggacccuggcaccucgguaaacuagaaauggauuuugacuucugcgauggaaccacugugauaguaacagaagauuguggaaauaggggaccuucauuacguacuacaaccgcaagcggaaaacuuauaacagaaugguguugccgaaguugcacauuaccaccuuugcguuaucggggugaagacggcugcugguauggaauggaaauaagaccgcucaaagagaaggaagaaaaucucguaaauucuuuaguaaccgcaggucauggacaaguagauaauuuuaguuuaggaguacucggcauggcacuauucuuggaagaaauguuaaggaccaggguuggaacaaaacacgcgaucuugcuaguggcagucucuuuuguuacucuaauaacuggaaauauguccuuuaaggaccuagguaggguaguuguuauggugggugcaacgauggccgaugauauuggaaugggaguuacuuaucuugcauuguuagcugcuuuuaaagugcguccgacauucgcagccggauuguuacuaaggaagcugacaagcaaagaauuaaugaugacaacaaucggaauaguuuuguuaagucaaagcacuauccccgagacgguguuggaauuaaccgaugcgcuagcauuagggaugaugguuuugaaaauuguuagaaacauggaaaaauaucaacuugccguaacaauuauggcuauccuauguguacccaaugcaguagucuuacaaaaugcuuggaaaguauccugcacaauuuuagccguaguaucaguaagcccgcuacuacuuacaaguucccagcagaaaacugacuggauuccgcuagcauuaacuauuaaagguuuaaacccuacugcaauauuucuaacaacacucagcagaacaaauaagaaacguagcuggccucuaaaugaggccauaauggcugucggaaugguauccauccuggcuagcagcuuacugaaaaaugauauuccuaugacaggaccccuaguagcuggagguuuacuaacaguaugcuaugugcugacaggaagaagcgcugaucuagaacuggagagggcgacugacguaaaaugggaagaucaagcagaaaucucagggagcaguccuauccuuucgaucacaauaagcgaagacggaucaaugucgaucaaaaaugaagaagaagaacaaacauuaacaauacuaauuagaacugguuuauuaguaauaaguggacuuuuccccauaaguauuccgaucacugcugccgcuugguaccugugggaaguaaagaaacaacgagcugggguccugugggauguaccgucaccaccaccaaugggcaaagcugagcuagaagacggggcauaccgaaucaaacaaaaagggauacuuggguauucgcaaauuggagcgggaguguacaaggaagguacauuucauacaauguggcacgucacaagaggagccguauugaugcauaaaggaaaaagaauugagccuaguugggcagacgucaagaaagacuugauaaguuacggcggagguuggaaauuggagggagaauggaaggaaggagaagaaguacaggucuuggcucuggaacccggcaagaacccgcgugcaguacaaacaaaaccaggauuauucaagacaaauacagguacaauaggagccguaucucuugauuucucaccaggaaccucaggaaguccaauaauagauaagaaagguaaagugguagguuuauaugguaaugguguagucacuagaaguggagccuaugucucugcaaucgcccagacggaaaaaucaauagaggauaaccccgagaucgaagaugacaucuuuaggaaaagacgucucacaauuauggaucuucauccuggagccggcaagacgaaaagguacuugccugccauuguuagagaagcaauaaaacgcggacuaagaacucuaauauuagcuccuacaagagugguggccgcggagauggaggaggcacuucgaggucuccccauaagauaucaaacaccagcuaucaaggcugaacacaccgguagagaaauuguagacuuaaugugccacgcuacauuuacaaugcgauuacuuaguccaguuaggguuccaaauuauaauuuaauaauaauggacgaagcucauuucaccgaucccgcaucaauagccgcaagagguuacaucaguacacgaguagaaaugggggaggccgcagguaucuucaugacagcuacacccccaggguccagagauccauuuccacaaagcaaugccccaauaauugacgaagaaagagagaucccugaacgaagcuggaacucaggucaugaauggguuacggauuuuaaaggaaaaacggucugguucguccccaguaucaaagccgguaacgacauagcggcaugcuuacguaaaaacggaaagaaaguuauucaacuauccagaaaaacguuugacucagaauacgucaaaacgcgaacgaaugauugggauuucgugguaaccacagacauuagcgaaaugggagcgaauuucaaggcagaacguguuauugauccuagacgauguaugaagccuguaauacuaaccgauggagaagaacgagucauauuggcuggaccuaugccagucacacacucuucagcagcccaaagacgagggcggauugguagaaaccccaaaaaugaaaaugaucaauacaucuauaugggggaaccacuggaaaaugaugaagauugugcucacuggaaagaagcgaagaugcuucuugauaauauaaacacuccggaagggauuaucccgagcauguucgaaccugagagagaaaaaguagacgcgauugauggcgaguauagacuccgcggggaggcacgaaaaacauucguugaccuaaugagaaggggagaccuaccuguauggcuagcguauaagguagcagcugaagggaucaacuaugccgauagacgguggugcuucgacggaaucaaaaauaaccaaauacuagaagaaaauguagaaguagaaauauggacgaaagaaggugaaaggaagaaauuaaaaccacgaugguuagacgcuaggaucuauagugauccucuggcacuaaaagaguuuaaggaguucgccgccggacgcaaaucguugacauuaaaucucauaacagaaaugggaagauuaccaacauuuaugacgcagaaaacuagggacgcgcucgauaaucucgcaguuuuacauaccgccgaggcaggcgggcgagcauauaaucaugcuuugagcgaguugccagagacauuagaaacucuuuuauuguugacucuacuugcaaccgugacgggugggauuuuucuuuucuuaaugucaggcagaggaaucgggaagaugaccuuaggcaugugcuguaucauaacugccagcauuuuguugugguacgcgcaaauacaaccucauuggauugcagcauccauaauacuagaguucuuucuaauuguacuacuaauuccagaaccugagaaacagcggacuccacaagauaaucaauuaacuuaugucguuauagcuauauuaacaguaguagcagcaaccauggcgaaugaaaugggguucuuagagaaaacaaagaaggacuugggccuaggaaguauagcaacacaacaaccagagagcaacauccuggacaucgacuuacgaccggcaucggcauggacccuuuacgcgguggcuacaacuuucguuacaccaaugcugagacacagcauagaaaauucaaguguaaacgucucacuaacggcaauagcgaaccaagcaacuguacuuauggggcugggcaaaggcuggccacugucgaaaauggacauagguguuccuuuauuggcuaucggcuguuauucccaaguaaauccuauaacgcucacugcugcccuauuauuacucguugcgcauuaugcgauaauugggcccggucuacaagcgaaagcuacgagagaagcccagaagagagcggcagccggaauaaugaaaaaucccacaguggaugguauuacgguaauagauuuagaccccaucccauacgacccuaaauuugagaaacaacuaggacagguaaugcuauuaaucuuaugugugacacaaguacucaugaugaggacuaccugggcacucugcgaggcccugacguuagccaccgggccaaucucgacacuuugggaaggaaacccgggucgcuuuuggaauacgacaaucgccguuucaauggcaaauauauuucguggaucguaccucgcuggugcuggccuucuauucagcaucaugaaaaauacaacgaacacgaggcguggaacaggcaauauaggcgaaacgcuaggugagaaguggaaauccagguuaaacgcacugggaaagagugaauuucaaauauauaagaaaucaggaauacaagaaguagauagaacacuagccaaagaagguauaaaaaggggagaaaccgaccaucaugcaguuucucgagggucagcaaaacugcgaugguuuguagagcgaaacaugguuacuccagagggaaaggugguagauuugggaugcgguagaggcggcuggucauauuacugugggggacuaaaaucgguucgagagguaaagggguugacaaaagggggaccgggucaugaagaaccaauaccaaugucaacuuauggguggaaucucguaagauuacagaguggugucgacguuuucuucauaccacccgagaaaugugauacucuauuaugugauaucggagagucaucaccaaauccaacuguagaagcaggccgcaccuuaagaguauuaaauuuagucgaaaauugguuaaacaauaauacccaauuuugcaucaaaguauuaaauccuuacaugcccucagucaucgagaaaauggaagcacuucaacgaaaauauggcggagcguugguaagaaaucccuuaagccgaaauucgacucaugagauguacuggguaucaaacgcgucaggaaauauaguaagcucugucaacaugauaucacgaaugcuaauuaauagauucacaaugaggcacaagaaagcgacauaugaaccagauguagacuuaggcucgggaacgcgaaauauuggcauugaaucggagauucccaacuuagauauuauuggaaagagaaucgagaaaauuaaacaagagcaugaaacgucguggcauuacgaccaggaucacccuuacaagacgugggccuaucauggcuccuacgagacuaagcaaacagguagcgcaucgucaaugguuaauggcguuguaagguuacuaacgaaaccuugggacguacucccaacggucacgcaaauggcaaugacagauacaaccccauuuggacaacagcgaguguuuaaagagaaaguagacacccgaacucaggaaccaaaggaaggcacaaagaaauugaugaaaauaacggcggaauggcuuuggaaggaacuggguaagaagaaaacaccacgaauguguacgcgggaagaguucacaagaaaaguacgaucaaacgcagcucuuggggcaauauucaccgacgaaaauaaauggaaaagugcacgugaagcagucgaagacagccgguuuugggagcuaguugacaaagaaagaaaccuacaucuugaagguaaaugugagacaugcguuuacaauaugaugggcaaacgagagaagaaauuaggagaguucgggaaggcaaaaggaaguagagcaaucugguauaugugguuaggugcacgauuucuggaauuugaggcccugggauuuuuaaaugaggaccauugguucucuagagaaaauucucuaagcggaguagaaggagaagggcuucacaaacugggguacauacuuagggaugugucaaagaaggaagguggggcaauguacgcugaugauacugcugguugggauaccagaauaacauuggaagaucucaaaaaugaggaaaugguaaccaaucacauggagggugagcacaagaagcuagccgaggcaaucuuuaaacuaacauaucaaaauaaaguaguucgagugcaacguccuacgccaaggggaaccguaauggauaucaucucaagacgugaccagcgagguagugggcaaguagggacauauggauuaaauacuuucacaaauauggaagcgcaguuaauaagacaaauggagggagaagggguuuuuaagaacauacagcauuugacaguaacagaagaaguugcugugcaaaacuggcuagcccguguagggagagaacguuuaucuagaauggcuaucaguggugacgauuguguagugaaaccgcuggaugacagauucgcaaaugcacuaacagcacuaaacgacaugggcaagaucaggaaggacauucaacagugggagccuuccaaagguuggaacgauuggacacagguaccauuuuguucucaucacuuucaugaacuaauaaugaaagacgggagaguacucguaguccccugcagaaaucaagaugaauugauagggagggcacguauuagucaaggcgcagguuggucucucagagagacugccugcuuaggaaaaaguuacgcacaaauguggucacuaauguauuuucaucggagagaucuacgacuagcagcaaaugcgauaugcagugcgguaccaagccauuggguaccaaccucacgaacaacuuggagcauacaugcaaaacaugaauggaugacaacugaagacaugcucacaguuuggaauagaguauggauacgagaaaaucccuggauggaagauaagacaccaguggaaaguugggaagaaauaccuuacuuagguaaacgagaagaccaaugguguggaucauuaauaggacuuacuucaagagcaacgugggccaaaaauauacaagcggcaauuaaccaaguccguagcuugauagguaaugaagaauacaccgauuacaugcccucgaugaaacgauuucgucgagaagaagaagaagcugguguucuuugguag

SEQ ID NO: 22824 - RNA, 9876 nt, Artificial Sequence
  derived and/or modified CDS sequence (opt6) from DENV-2__FM210243__SS-prME
acugcaggagucauuauaauguuaauaccuacagcaauggcuuuccaucugaccacacgaaacggcgaaccucacaugauaguaggacgccaagaaaaaggcaaaucauugcuauucaaaacugaagauggggugaacauguguacauuaauggcaauagaccuaggagaauuaugcgaagauacgaucacauacaaauguccgcuacuccggcaaaaugaaccugaagacaucgauuguugguguaacucgacaaguacauggguuacauauggaaccugcacaacgacgggcgaacaucggagagaaaagagaaguguggcgcuaguaccacauguggggauggggcuagaaacuagaacagaaacauggaugaguucagaaggcgcauggaaacaugcacagcguauagaaaccuggauauuaagacauccaggguuuacuauaauggcagcaauuuuggcauauacugucgguacaacacacuuucaaagggcauuaauuuuuauacuguuagcugcaguagcaccauccaugacgaugagaugcauaggcaucaguaaucgagauuuugucgaaggcguuuccgggggaucaugggucgauauuguacuagaacaugggaguuguguuaccacaauggccaaaaauaaaccuacacuugauuuugaacuuauuaaaacagaagcaaaacaaccagcaacuuugcgaaaauacugcauugaagcaaaacuaaccaauacuacgacggaaucgcgaugccccacccagggcgagccaucacuuaacgaggaacaagacaaaagauuugucuguaaacauucaauggucgauagaggaugggguaauggguguggacuuuucgguaaagggggaauuguaacuugugcgauguuuacaugcaagaaaaacauggaaggaaaaauuguucaaccugaaaaucucgaauacacuauaguaauaacuccacauagcggagaggaacaugcugugggcaacgacacuggcaaacacgggaaagagauaaaaauuacaccccaaucaucaauaacugaagcagagcucacagguuacggaacuguaacgauggaguguaguccaaggacgggccuugauuucaaugaaauggucuuacuccaaauggaagacaaagcgugguuaguccaccgccaaugguuucuagacuugccacuaccaugguuaccaggcgcagauacacagggaaguaacuggauucaaaaagaaacccuaguuacauucaaaaauccacaugcgaagaaacaagacguaguuguauuagguucacaagaaggggcaaugcauacugcgcugacaggggcaacggagauucaaauguccucaggcaauuuguuguuuacaggucauuuaaaaugccgcuugagaauggacaaacuccaacugaaaggaaugagcuacaguaugugcacuggaaaauucaaaauuguaaaagagaucgccgaaacucaacauggaacaauuguaauuagaguccaguacgaaggugauggauccccuugcaaaauaccguucgaaauaauggaucuagagaaaaggcauguccucggaagacuaauaacaguaaauccaauugucacggaaaaagacucucccguaaauaucgaagcagaaccuccguucggagauagcuauauuaucauaggcguagaaccaggucagcugaaacuuaauugguucaagaaagguaguucgaucggacagauguuugaaacaacgaugagaggugcgaaacgaauggcuauauuaggggauacggcaugggacuucggaucacucggagguguuuucacuagcauugguaaagccuugcaucaaguauuuggagccauauauggagcugcauucucuggcgucucauggacuaugaaaauauugauugguguaauuaucaccuggauugggaugaacucucguuccaccagccuaucagucaguuuaguucuggugggcauaauaacccuuuaucuuggagcaaugguccaagccgauuccggaugcguuguaagcuggaaaaauaaagaacucaaaugugguucuggaauauucauaacggacaaugugcauacuuggaccgaacaguacaaguuucaaccagaauccccgucaaaauuagcaagcgcaauucaaaaggcacaugaggaagggaucugugggauuagauccgugacacgguuagaaaaccuaauguggaaacaaaucacaccagaacuaaaucacauccuuucagaaaaugagguaaaguuaaccauaaugacaggcgauauaaaagguauuaugcaggcagguaaaagaucauugcgcccgcagccgacagaacuaaaauacucauggaagacauggggaaaagcgaaaauguuaucuacugaaucucauaaccaaacauuuuugaucgacggacccgaaaccgccgaauguccuaauacuaauagagcuuggaacucgcucgaaguugaagacuacggauuuggagucuucacaacaaacauauggcuaaaacucagagaaaaacaagacguauucugcgauuccaaguuaaugagcgcagcaauaaaagacaauagagccguacaugcggauaugggguacuggauugaaucugcuuuaaacgauacauggaaaauggaaaaggcuucauucauugaagugaaaucgugucacuggcccaagucucauacacuauggucaaacggagucuuggaaagugaaaugauaauaccaaaaaguuuugcaggcccgguuagccaacauaacuacaggccggguuacuacacacaaacagcggggccauggcaucuugggaaacuggaaauggauuuugauuucugcgaagguacaacggugguuguaaccgaagauugcggcaauagaggucccucauuaaggacaacuacugcuagcggcaaguugauuaccgaguggugcugucgaucauguacauuaccuccguuacguuaucgaggugaggaugguugcugguaugggauggaaauuaggccauuaaaagaaaaagaggaaaauuuaguaaauucgcucguuacggcuggccauggucaaaucgacaauuucagucugggugugcuaggaauggcccuauuccuagaggaaauguuacggacuagaguagguacgaaacacgccauccuccuagugaccgucagcuuuguaacauugaucacggguaacaugucguuuagagauuuagguagggucauggucaugguuggugcagcgaugacugacgacauagggauggggguaacuuacuuagcauuacuagcggcguucaagguacgacccacuuucgcugcggggcucuuacucagaaaguugaccaguaaagaacugaugauggcuacaauugggauugcccuacuaucgcaaucaacaauaccagagacaauucuagaacucacagacgcgcuagcacuaggaaugaugguauugaaaauuguccgcaacauggaaaaguaccaauuagcuguaacaauaauggcgauuaguugcgugccaaaugccguaauucuucaaaacgcuuggaaagugaguugcaccauccuggcugcaguaucaguuuuuccauuauugcuaacgagcagucagcaaaaagcagacuggauuccccucgcuuuaacaaucaagggacucaauccaacggccauuuuucuaacaacauuaucucgaacgaguaagaaaagaucuuggccacuaaaugaggcaauaauggcaguaggcaugguuucaauucucgcaagcucacuacucaaaaaugacauaccaaugacugggcccuugguagcaggaggacuucuaacgguaugcuacguauuaacuggacggucggcagacuuagagcucgaacgugcuacugacguaaaaugggaagaucaggcugaaauaucaggaucauccccuauauugucuauaacaauagccgaagauggcucaaugucuaucaaaaaugaggaggaagaacaaacauuaacuauucuaauaagaacuggacugcuaguuauauccgggcuguucccaguaucgauaccuauaacagcagccgcgugguaccucugggaggucaagaaacaacgagccggaguauuaugggauguaccuuccccaccacccguuggcaaagcugaacuggaagacggagcauaccggaucaagcagaaggguauccuugguuauucucaaauaggcgcggguguauacaaagaggggacauuccauaccauguggcacguaacucgcggcgcaguauuaaugcaucgggguaaacgaauagaaccuaguugggcagacguaaagaaggauuuaauauccuauggcgguggauggaaauuagagggagaauggaaagaaggugaagagguacaaguauuagcacucgaacccggcaagaacccaagggcaguccaaacgaagccagguuuguucaagacaaacacagguaccauaggugcggugucgcuugauuuuagcccgggaacaaguggaucuccaauuguagacagaaaagggaaaguaguuggucuauacgguaauggugugguaacuagguccggagcauauguaucugcaaucgcacaaacagagaaaaguaucgaagauaauccagaaauagaagaugauauauuuaggaagaaacggcugacaauaauggaccuacauccaggggccggcaaaacgaaaagguaccucccugcaaucguacgagaagcuauuaaacggggacuacgcacucucauauuggcuccaacgagaguaguugcggcugagauggaagaagcccucaggggucugcccauaagauaucagacuccugcaauuagagcagaacacacaggucgagaaauaguugaucuaaugugccaugcuacuuucacaaugcgauuacuuucaccggugagaguaccuaauuacaaccuuauaaucauggacgaagcucacuuuacugauccagcgaguaucgcggcaagggguuauauuaguaccaggguggagaugggggaagcagcaggaauuuuuaugacagcuacgccacccgguagcagggacccguuuccucaaucuaaugcacccauuauggaugaagaaagggaaauuccugaaagaaguuggaauaguggucacgaguggguaaccgauuuuaaaggaaaaacaguuugguucguuccauccauaaaagcagguaacgauaucgccgcgugucuaaggaagaacggcaaaaagguaauccagcuuagcaggaagacauucgacagugaauauguuaaaacaagaacuaacgauugggauuuugucguaacuacggauauaucggagaugggugccaauuucaaagcggaacgcguuauugauccccgacgcugcaugaaaccagucauccucacagauggugaagaacguguuauauuagcgggcccaaugcccguaacgcacaguucggcagcacaacgaagaggucggauagguagaaacccuaagaaugaaaaugaucaauacauuuauaugggggagccccuagaaaaugaugaagacugugcgcacuggaaagaagccaaaauguuauuggauaacauuaauacccccgaaggaauuauacccucaauguucgaacccgaaagggaaaaaguagaugcgauugacggggaguauagauuaagaggagaagcaagaaaaacauucguagaucuuaugagaagaggggauuuacccgucugguuagcauaucgaguugcagcugaagguauaaacuacgcagauagacguuggugcuucgauggaguuaaaaauaaucaaauacuagaggaaaacguagaaguagaaaucuggacaaaggaaggggagaggaagaaauugaaaccacgaugguuagacgccaggauauacucagauccacuugcauuaaaagaguucaaagaauuugcggccggaagaaaaaguuuaacucucaaccuuauaacagaaaugggcagacuaccaacguuuaugacucaaaaggcacgugacgcacuagacaauuuagcaguuuuacauacagcagaagccgguggcagagcuuauaaucacgcguugagcgagcuaccugaaacccucgaaacguuacuucuccuaacuuuauuggccacaguaacugguggaauauuucuauucuuaaugucuggaaaaggugucggcaaaaugacauugggaauguguugcauaauaacugccucaauuuuacuaugguaugcacaaauccagccccauuggauugcagcaaguaucauuuuggaguucuuuuuaauuguacuauuaauuccagaaccagaaaaacaaagaacaccacaagauaaucaauugacuuacgugguaauugcaauuuuaacaguaguagcugcuacuauggcaaaugaaaugggauucuuagagaaaacgaagaaagaccuuggauuagggucaauagcgacccaagagccugaaucaaauauacuagacauagauuuacggccggccagugcuuggacacuguaugcgguugcgaccacguuugugacaccaaugcuacggcauaguaucgagaauagcagugugaauguuucccuuacugcuaucgccaaucaagcuaccguauugaugggucuuggcaaaggcuggccacuauccaaaauggacauuggugugccacuucuugcgauaggcugcuauucccaaguaaacccaauuacgcuaacugcagcauugcugcuauugguagcgcauuaugcuaucauuggucccgggcuucaagcaaaagcaacuagagaagcacaaaagcgagccgcggccggcauaaugaaaaacccaacuguagacggaauaacuguuauagaccucgauccuaucccuuacgauccaaaauuugaaaaacaacuaggacaagugaugcucuuaauacugugcgugacucaaguauuaaugaugaggaccacaugggcauuaugcgaggcucuaacgcucgcaacaggaccaauaaguacucugugggagggaaauccaggaagauuuuggaauaccacgauugcaguauccauggcgaauauauuuagagguagcuaucuagccggugcaggauugcuauucucuauaaugaaaaauaccacuaauacgaggcgcgguacuggaaacauaggagaaacacucggugaaaaauggaagaguagacuaaaugcacugggaaaaagugaguuccaaaucuauaagaaaucuggcauacaagagguggacagaaccuuagcuaaagaagggauaaaaagaggugaaacugaccaucacgccgugagccgagguucugcgaaauuacgaugguuugucgaaagaaauaugguuaccccagaaggaaaaguaguggacuuaggaugugggagaggagguuggucauacuauugcggcggucuuaaaaacguacgcgaaguaaaaggacuuacaaaaggaggccccgggcacgaagaaccuauaccaaugucuacauauggauggaaucuuguuagacuucaaagugggguggauguauuuuucacucccccggaaaaaugugauacacuacucugugacauaggagaaaguucccccaacccuacgauugaggcaggaagaacacugagaguuuuaagccuaguagaaaacugguuaaacaaugacacccaauuuuguaucaagguauuaaauccguauaugccaagcgucauagagaaaauggagacgcuccaaagaaaguacggaggagcacucguuaggaacccacuaucgagaaauucaacucacgaaauguauuggguaucaaaugcaacaggaaauauugucucuagugugaauaugauuucacgaauguuaauuaacagauuuaccaugaagcauaagaaagcuacauaugagccggauguagaucucgguaguggaacacgcaacauugguauagaaagugaaauaccgaauuuggauaucauuggaaagagaauagaaaagaucaagcaagaacacgaaaccagcuggcauuacgaucaggaccacccguauaagacuugggccuaucauggauccuacgaaacaaagcaaacgggcagcgccaguucaaugguuaacggaguaguuagauuacuaacgaaaccgugggauguagucccaaugguaacccaaauggcaaugacugacacaacaccauucggacagcaacgagucuucaaagaaaagguugauacacgcacgcaagaacccaaggaggguaccaagaaacuuaugaagauaaccgcggaguggcuuuggaaagaauugggcaagaagaaaacgccacguaugugcacacgcgaagaauuuacacggaaggucagauccaacgccgcgcuaggcgcgauauucacagaugaaaauaaguggaaaagcgcacgggaagcugucgaagacuccagauucugggaacucguggauaaggaaagaaaucuacaucuggagggcaagugugaaacuuguguauauaauaugauggguaaacgggaaaagaaauugggugaguuugggaaggcgaaagguucucgugccauaugguacaugugguuaggagcacguuucuuggaauuugaggcuuuaggauucuuaaaugaagaucauugguuuucgagagaaaauucacugaguggagucgaaggagaaggacuacacaaacugggauacauauuacgagauguaagcaagaaagaagggggagcaauguacgcagaugauacugcugggugggauacuagaauuaccuuggaagaucugaaaaaugaagaaaugguaacaaaucauauggaaggagaacacaagaaauuagcagaagcaauauucaaauugacuuaucaaaacaaaguuguacgaguacaacggccaacuccaagggguacgguaauggacauuauaucgagaagagaccaacgaggaucaggccagguugguaccuacggguuaaacacauuuacaaauauggaagcucaauuaauucgacagauggagggggaagguauauuuaaaaguauacaacauuugacugugacagaggaaauugcaguacaaaauugguuagcaagaguuggcagggaacgucuuagucggauggcuauauccggggacgauugcguaguaaaaccucuagaugauagauuugcaucagcguuaacggcccuuaaugauaugggaaaaguaaggaaggauauacagcagugggaaccgagcagaggauggaaugauuggacucaggucccauuuuguucccaucauuuucacgaauugauuaugaaagauggaagaguauuaguuguuccguguaggaaucaagaugaacuaauuggcagagcgagaauaucucaaggagccgguuggagcuuaaaggaaacagcgugucuugguaagucuuacgcacaaauguggagcuuaauguauuuucaccgaagggaccucagauuagcagcaaacgcgauaugcucugccguuccaucacauugggucccuacguccagaacaacuuggucaauacaugcuaaacaugaauggaugacuacugaggauaugcugacaguuuggaaccgaguauggauccaagagaacccauggauggaagauaaaacuccaguagagucaugggaggaagucccauaccuagggaaaagggaagaucaauggugcgggucucuaauugggcucacuuccagagcaacgugggccaaaaauauacaaacagcuauaaaucaaguccgaucacuaauaggaaacgaagaguauacggacuauaugccuagcaugaaacgauuuagaagagaagaagaagaagcaggcguauuaugguaa

SEQ ID NO: 22825 - RNA, 9876 nt, Artificial Sequence
  derived and/or modified CDS sequence (opt6) from DENV-2__FM210244__SS-prME
accgcgggagugauaauaauguuaauuccgacggcuauggccuuucaccugacuacuagaaauggggaaccacacaugauaguaggaagacaggaaaaagguaaaucacuacucuucaaaacugaagaugguguuaauaugugcaccuuaauggcaauagacuugggagaauuaugugaagauacgauaacuuauaaauguccguugcuaagacagaacgaaccagaagauaucgacuguugguguaacaguaccagcacauggguuaccuacggaacauguaccacaacaggcgaacauagaagagaaaaacgaaguguugcucuaguaccgcauguuggaaugggacuagaaacgaggaccgaaacuuggaugagcucggagggcgcuuggaaacacgcccaaaggauugaaacauggauucuaagacacccaggauuuacuauaauggcagcaauucuugcauauacaguaggaaccacucacuuucaacgcgccuuaaucuuuauacuccucgccgcuguagccccaaguaugacgaugagaugcaucgguauaucuaaccgggauuuuguagaagggguaucagggggaaguuggguagauauuguauuagaacauggaucaugcguaacgacaauggccaaaaauaaaccuacguuggauuucgaacuaaucaaaacggaggcgaaacaaccugcgacacugagaaaauacuguauagaagcgaaacuuacuaauacuacuaccgagucgagaugcccaacacaaggugaaccuucucugaacgaagaacaagauaaaagauucguauguaaacacaguaugguugaccgaggcuggggaaauggaugcggguuauuuggaaaaggcgggaucgucacgugugccauguuuacauguaagaaaaauauggaaggaaaaaucguccaaccugaaaacuuagaauauacuauaguaauaacuccacacucgggugaagaacacgcgguggguaaugauaccgggaaacacgguaaagaaauaaaaauaacaccacaaaguccaauaacagaagcagaacuuacgggcuauggaaccguaacuauggaaugcagcccaagaacugguuuagauuuuaacgaaauggugcugcuccaaauggaagauaaagcauggcucguacacaggcaaugguuucuagacuuaccccuaccaugguugccgggagcugacacgcaaggaucaaauuggauacaaaaagagacauugguuacauucaaaaauccucaugcuaagaaacaagacguuguuguucuaggaagccaagaaggcgccaugcauacugcacuaacaggggcuacagaaauucaaaugagcagugguaauuuauuguuuacgggucaccuaaaaugccgauuacgaauggauaaauuacaauugaaagguaugucauacaguauguguacagguaaauucaaaaucguaaaagaaauagcagaaacucaacacggaacuaucgugauacguguucaauaugaaggugacggaucgccaugcaaaauuccauucgaaauaauggaccuugaaaaacgacauguucuuggaagacuaauuacaguaaaucccauaguaacagaaaaagauucuccuguuaacauagaagcugagcccccuuucggugacagcuauauaauuauagggguagaaccaggucagcuaaaauugaacugguucaagaaaggaaguuccauaggacagauguuugagacaacaaugcgcggagcaaaacggauggcuauacuuggagauacugcaugggauuucgguucguuagguggagucuuuacaucgauagguaaagcgcugcaucagguauucggagcaauuuauggugcagccuuuucuggagucucguggacaaugaaaauucugauuggcguaauuauaacauggauaggaaugaacucuagaucaacguccuuaucagucaguuugguccuaguagguguuaucacccuuuaccuaggugccaugguccaggcagauucuggcugcguggucucauggaaaaauaaagaacuuaaaugcggcagugguauauuuauaacagacaacguucacaccuggacagaacaauacaaauuccaacccgaaagcccuaguaaauuagcaucugcaauacaaaaagcucaugaagaaggcaucugcgguauuagauccguaacuagauuagaaaaucuaauguggaaacagauaacuccagaguuaaaucauauccuaucugagaaugaagucaaguuaacaauuaugacaggagauauaaaggguauaaugcaagcaggcaagcgaucacuacgaccccaaccaacugaacuaaaauacaguuggaaaacuuggggaaaagcuaagauguuaucaaccgaaucacauaaucagacauuuuugaucgauggacccgaaacagcugagugcccaaacacaaaccgggcauggaacucguuagaaguagaggauuacggauucgguguguucacaacaaauaucuggcuaaagcuaagagaaaagcaagacgucuuuugugauucaaaacuuaugagugcugcaauaaaagacaauagagcuguucaugcugauaugggguacuggaucgagucggcgcuaaaugauacauggaaaauggaaaaggcuucguuuauugaaguaaaaucaugccacuggcccaaaucacauacacuauggagcaacgggguccucgaaagugagaugauaauaccuaagagcuuugcugggccaguaucgcagcauaacuacagaccagguuauuacacacaaacugcgggaccguggcauuuagguaaauuggaaauggauuucgauuuuugugaaggaacaacuguugugguaacugaagacuguggcaacagaggaccgagcuuaaggacuacaaccgcgagcggcaaacuaauaacggaaugguguugccgaucuuguacauuaccucccuuaagguaccgaggagaagaugguugcugguacgguauggaaaucagaccucuuaaggaaaaggaggaaaaccuaguaaauagucuagugacugccggacauggucagauagacaacuucucauuaggaguacugggcauggcuuuguuucuggaggaaauguuaaggacuagggucggaacaaaacaugcaauacuauuaguagccguaaguuuuguaacucucauuacaggaaacaugucauuucgugacuuaggucgcguuauggugauggugggcgcagccaugacggaugacaucggcauuggagugacauacuuagcguuguuagcagcauuuaaaguacgaccuacuuuugcagcaggccuucuauuaaggaaauuaacaucaaaagaguuaaugauggcuacgauagguaucgcacuauuaagucaaagcacgauuccagaaaccauacucgaacuuacagacgcccuugcacucggaaugauggugcuuaaaauugugaggaacauggaaaaauaucaacuagcugucacaauaauggcuauaaguugcguuccaaacgcagugauacuacaaaacgcguggaaaguuuccuguacuauauuagcaacaguauccguaagcccuuuacucuuaacaucaagccaacaaaaagccgauuggaucccgcuagcacuaacaaucaaaggucugaaccccacugccauauuucugacaacgcuaucuagaaccaguaagaaacggucuuggccauuaaaugaagcaauaauggcaguagggaugguaucgauccuugcaaguagccucuuaaagaacgauauaccaaugacgggaccuuuaguggcuggaggguuguuaacaguauguuauguucucacgggccguucagcggacuuggaauuagaaagggcuacagacgucaaaugggaggaucaggcagagauaagcgguucuucuccuauccuuucaauaacaauugcagaagacgguucaaugucgaucaaaaaugaggaagaagaacaaacauuaacaauucugauaaggaccggcuuauugguaauaucgggccuuuucccuguaaguauuccaauaacagcugcagcgugguauuugugggaaguuaaaaagcagagagcaggcguacuuugggauguaccgucuccaccucccgugggaaaagcagaacucgaagauggugcauaccguauaaagcaaaaggguauacuuggauauucccaaaucggcgcaggaguauacaaagaaggcacauuucauacgauguggcacguaacaagaggggcuguguugaugcauagagguaaaaggaucgaaccaucgugggcugacgugaagaaagacuuaauaagcuaugggggaggguggaaauuagaaggugaauggaaagaaggcgaagaagugcaaguacuugcucuugaacccgggaaaaaccccagagcuguccaaacuaaaccaggacuauucaaaacuaacacaggaacaauaggugccgucagcuuagauuucucacccggaacgucaggaucaccuauaguagaucggaaagggaaaguagucggacuguaugguaaugggguuguaaccagaagcggagcguaugucagugccauugcacagacggaaaagucaauugaggauaacccagagauagaagacgauauuuucaggaagaaacgacuaacuauuauggaccuacacccgggcgcaggaaaaacuaaaagauaccuacccgcaaucguucgagaagccauaaagagggguuuaagaacacuaauacuagcaccaacccggguaguugccgcugaaauggaagaggcuuuaaggggauuaccaauucgguaccaaacuccugcaauccgagcagaacacacaggccgagaaauaguagauuuaaugugucacgccacuuucacuaugcgguuacugaguccaguacgcguaccaaauuauaaucuaauuaucauggaugaagcccauuuuacugauccagcuucaauagcagcaagaggguauauaaguacccgaguagagaugggagaagcagcgggaauauucaugacggcgacaccgccugggucgaaagauccauucccacaaucaaaugcaccaauuauggaugaagaaagagaaaucccagaaagaucauggaauagcggccaugaguggguuaccgauuucaaaggcaaaacuguuugguuuguacccucgauaaaagcugggaacgacaucgcugccugucuaaggaaaaauggcaagaaggugauacaacucaguagaaaaacuuuugauucagaauacguaaagacgcgaacuaaugacugggauuucguuguuacaacagauauuagugagaugggcgcuaacuucaaagcagagagaguuauugauccuaggagauguaugaaaccugucauauugacggauggugaagaacggguuauacuagccgguccaaugccuguaacacacagcucugcagcgcaaagacgcggccgaauuggacguaacccuaaaaaugagaaugaucaguauauuuauaugggagaaccccuugaaaaugaugaagauugugcacauuggaaagaagcaaaaauguuacuagacaauauaaacaccccugaagggaucauucccaguauguucgaaccagagcgugaaaaagucgacgcuaucgauggagaguauagguugagaggagaagcgagaaagacauuuguagauuuaaugagacgaggagaucugccagucuggcucgcauaccguguggcagcagaaggaauaaacuacgcggaccgaagaugguguuucgacggcguuaaaaacaaccaaauuuuagaagaaaauguggagguugaaauauggacaaaagaaggagaaaggaaaaagcugaaaccacgcuggcuagaugcacguauauacagugacccucucgcacugaaagaauuuaaagaauuugcagccggacgaaaaagucugacucuuaaucuuauaacagaaauggguagauuaccuacuuucaugacucaaaaggcaagagacgcacuagauaacuuagcaguccuucacacggcugaggcgggcggaaaagccuauaaucaugcacuaucagagcuucccgaaacccuugaaacacuauuacugcucacguuauuggcaacugucacuggcggcauuuuucuauuucuuaugaguggaaaaggugugggcaagaugacucucggcaugugcugcaucaucacagccaguauauugcucuggcaugcacaaauucaaccgcauuggauagcagcuaguauaauacuggaauuuuucuugauuguucuuuuaauaccagaaccagaaaaacaacgcacuccacaggacaaucaacugacuuacguaguuaucgcaauuuugacaguuguugccgcuaccauggcuaacgaaaugggauuucuggagaaaaccaagaaagacuuaggcuuaggaucgauugcaacgcaagaaccagaaucaaauauacuagacauugauuuaagaccugccucagccuggacccucuaugcuguggccacaacguuuguaacuccuauguuaagacacucaauugaaaauucauccguaaaugugagccuaacugcaauagcaaaucaggcaacuguauuaaugggcuugggaaagggguggccauuaucuaagauggauaucgguguuccacuacucgcgauugguuguuacagucaaguaaauccaauaacguuaacagcagcucuauuauuauugguugcacacuaugccauuauagguccuggacuucaagcaaaagcuacgagagaagcgcaaaaacgcgcagcugcuggaauuaugaaaaaucccacaguagauggaauuacaguaauagauuuggauccgauaccuuacgacccgaaauuugaaaaacaauuaggacaaguaaugcuguuaauccuaugcguaacacaaguucuuaugaugcgaacaacaugggcuuugugcgaggcauuaacauuagcuaccgguccuauaagcacacuuugggaggguaauccaggacgauuuuggaauacuacaauagcugucucaauggcaaauaucuucagaggcucuuaccuugccggugcgggucuauuguuuagcaucaugaaaaauaccacuaauacaaggagggguacugguaauauaggugagacgcuaggcgagaaguggaaaagucgauuaaaugcucuggguaaaucagaguuucaaaucuauaagaaaagcggcauacaggaggucgaucgaacucucgcaaaagaaggaauaaaaaggggugaaacagaccaucacgcaguauccagagguucugcuaaguugcgaugguuugucgaacggaauauggucacuccugaaggaaagguaguagaucuugguugcgggaggggaggguggucauacuacuguggcggccucaaaaaugugagagagguaaagggacugaccaagggagggccagggcacgaagaacccaucccuaugaguacauaugguuggaauuuaguccgacuucaaaguggaguugaugucuucuuuacuccacccgaaaaaugugacacguugcucugugauauaggagagagcucaccgaacccuacaauugaagcggguagaacacugagagugcuuagucugguugaaaauuggcuaaauaaugauacacaauucuguauaaagguccuuaauccguauaugccgagcguaauugagaaaauggaaacgcuucaacgcaaguacgguggugcauuaguacggaauccauugucaagaaauucaacccaugaaauguauuggguaagcaacgcgacuggaaacauagucucauccgucaauaugauaaguagaaugcucauuaauagauucacaaugaaacauaagaaagcaacguaugaaccagauguagacuuaggcucugguacaaggaauauaggaauagagagcgagaugccuaacuuggacaucauagguaaacgaaucgagaaaauaaaacaggaacaugaaacgagcuggcauuaugaucaagaucauccuuauaaaacuugggccuaucacggauccuacgaaacuaaacaaaccggaucugcuucuucaauggugaauggugugguacgacuguuaacaaaaccuugggaugucgugccaauggugacacaaauggcaaugacugauacuacgcccuucggacaacaacguguuuucaaagaaaagguagauacuagaacgcaagaaccaaaagaagguaccaagaaauuaaugaaaauaacagcagaauggcuguggaaggaauuaggcaagaagaaaacaccuaggaugugcacuagggaagaauuuacccgcaagguucgaaguaaugcugccuugggugcaauauuuacagaugagaauaaauggaaguccgcaagagaagcgguugaggacaguagauucugggagcuaguugauaaagaacguaacuuacaucuagaaggcaagugcgaaacguguguauauaacaugaugggaaagcgugagaagaaacuaggugaauuugguaaagcgaaaggaagcagagcgauaugguacauguggcuaggagcuagauuccucgaguucgaagcacuuggcuuccuaaacgaagaucacugguucucaagagagaacucacucagugggguagaaggggaaggccuccauaaguugggguacauacuuagagauguaucuaagaaagaagguggagcaauguacgcagacgacacagcaggaugggauacaagaauaacuuuggaagaucuuaaaaaugaagaaauggucaccaaccauauggagggagagcauaagaaauuagcagaggccauauuuaaacuuaccuaccaaaauaagguugugagaguacaacggccuacuccgcgagguacagugauggauauaaucucaagacgagaucagcgugguaguggacaaguuggaacguauggacuaaacacguucacaaacauggaagcucaauuaaucagacaaauggagggcgaaggaauauuuaagaguauacaacaccuuaccguaacugaagaaauagccguacaaaacuggcuugcccgaguaggaagggaacgacugucaagaauggcgaucaguggugacgacuguguuguaaaaccucucgacgaccgauucgcaucagcgcuuacggcacuaaacgacauggguaaggucaggaaagacauacaacaaugggaaccgucccgagguuggaacgauuggacacaaguacccuuuugcucgcaucauuuccacgaacucauuaugaaggauggacguguacucguggugccaugcagaaaucaagaugaauuaauaggcagagcacggaucucacaaggagcaggcuggucguuaaaggagacugcuugucugggaaaaaguuacgcacagauguggagccuuauguacuuucauagaagagaccugcgcuuagccgccaaugcaauauguucugcggugccuagccauugggucccgacaaguagaacaaccuggucgauacacgccaagcaugaguggaugacaacagaagauauguuaacagucuggaacaggguuuggauacaagaaaauccguggauggaggacaaaaccccgguagagucgugggaagaagucccguauuuaggaaagagagaagaccaauggugugguucauuaaucggauugacaucccgcgcaacaugggcuaaaaacauccaaacagcaauaaaccaagugcgaucguuaaucggaaaugaagaguacacugauuacaugccaucaaugaaaagauuuaggcgcgaggaagaagaggcaggcguacugugguag

SEQ ID NO: 22826 - RNA, 9876 nt, Artificial Sequence
  derived and/or modified CDS sequence (opt6) from DENV-2__FM210234__SS-prME
acugcuggaguaauaauuauguugauccccaccgccauggcauuucaucugacuacacgaaauggcgaaccucacaugauuguaggaagacaagaaaaaggcaaaaguuuguuauuuaaaacagaagacggaguuaauaugugcacgcuuauggccauagaucuuggcgaacugugcgaagauacaaucacguauaaaugcccauuguuacgacaaaacgaaccugaagacaucgauugcuggugcaacaguacgucgacuuggguaacguauggaacgugcaccacaacaggcgaacacagaagagagaaaaggucuguagcacuuguaccucauguagggauggggcuugaaacgcgcacagaaacguggaugucaucagaaggagcauggaaacaugcccagagaauugaaaccuggauuuugcgacaccccgguuucacgauuauggcggcgaucuuagcauauacuguaggcacaacucauuuucagagagccuuaauauuuauauuauuagcagcaguugcuccuuccaugacaaugcgcugcauaggcauuuccaacagagauuuuguagaaggagugucaggagggagcuggguggacauuguauuagaacauggauccugugucaccacuauggccaaaaacaaaccuacacuagauuucgaauuaauaaaaacugaggcgaaacaacccgcgaccuuaagaaaauacugcauagaagcgaaauuaacuaacaccacgacggagagcagauguccuacgcaaggugaaccuagucugaacgaggaacaggauaaacgauucgugugcaaacauagcaugguagacagaggauggggaaauggguguggccuauucgguaaagggggaauaguaacgugugcaauguuuacauguaagaaaaacauggagggcaaaauaguccagccggaaaauuuggaauacacaauugugauuacaccgcauucaggagaagaacacgcaguaggaaaugacacuggaaaacacggcaaggagaucaaaauuacaccgcaaucccccauuacugaagcagaacuaacaggauacggaacggugaccauggaauguucaccuagaaccgguuuagauuuuaaugaaauggucuuacuacaaauggaagauaaggcuugguuagugcacagacaaugguuucuggauuuaccucugccauggcucccaggugccgauacacaagggaguaacuggauacaaaaagaaaccuugguuacuuuuaagaacccucaugcgaagaaacaagauguaguugugcuaggaucacaagaaggagcaaugcauacugcacucacuggugcuacagaaauccagaugaguuccggaaaucuucuuuuuacagggcacuuaaaauguagacuucgaauggauaaacuacaacuuaaggguaugaguuacucaaugugcacggguaaguucaaaauagugaaagaaauagcagaaacgcaacacgguacgauaguuauacgaguucaauaugaaggugauggcucaccauguaaaauuccguucgaaaucauggauuuagaaaagcgucacguauuagggagauuaauaacuguaaaucccauagucacggggaaggauucuccgguuaauauugaagccgaaccacccuuuggcgacaguuauaucauaauagguguggaaccaggccaacugaaguugaacugguuuaagaaagguaguuccauaggucaaauguuugaaacaacuaugcgaggugcaaagaggauggcaauauugggcgauacggcgugggacuucggguccuuagguggagucuuuacauccauagguaaggcauuacaccaaguguuuggugcuauauauggugcugcguucuccggcguuaguuggacuaugaaaauuuuaaucggagugauuauuacguggauugggaugaauaguagaagcacaucuuuaaguguaucacuggucuuaguuggaguaauuacacucuaccuaggggcuauggugcaagcagauuccggauguguaguaucguggaagaauaaagaacuaaaguguggaucuggcauuuucauuacagacaacguacauaccuggaccgaacaauacaaauuccaaccagaaucaccaucaaaacuagcgagcgcuauacaaaaagcucaugaagaggguauuugcggcauuagaucaguuacaagacuugaaaaccuaauguggaaacagauaacaccagaauugaaccauaucuugagcgaaaacgaaguuaaguugaccauaaugacaggcgacauuaaaggcauaaugcaagccgguaagcgcucguuacguccacaaccaacggaauuaaaguauagcuggaaaacuugggguaaagccaagaugcuaucaacagagagccauaaucaaaccuuuuuaauagacgguccagaaacagcugaaugcccuaacaccaauagagcguggaauagcuuagagguugaagauuacggauucggaguguuuacuacuaacauauggcugaaauuaagggaaaagcaagaugucuucugugauucaaagcucaugagugcggcaauaaaggacaauagagcgguucaugcagauaugggcuacuggaucgaaucagcccuaaaugacacauggaagauggaaaaagcaucauucaucgaagucaaaagcugucauuggccaaaaucucauacgcuauggaguaacgguguucuggaaucggaaaugauaauacccaaaaguuucgcgggcccaguaucacaacauaauuauaggccagguuacuacacgcagacugcaggaccauggcaucuugggaaauuagaaauggacuuugauuuuugcgaaggaacaaccguaguagugaccgaggauuguggaaauaggggaccaagucugcggacgacaacugcaucuggcaaauuaaucacugagugguguugccgaagcuguacccuaccuccucugagauauagaggggaggacggguguugguacgguauggagauuagacccuuaaaagaaaaggaagaaaaucuaguuaacagucuaguaacagcuggacaugggcaaauagauaacuucucauugggcguucuugguaucgcguuauuccucgaagaaaugcuacgaaccagaguagggaccaaacacgcaauuuuauuaguagcuguaaguuuuguaacccuaauaacggguaauauguccuuuagagaccucggucgaguuaugguuaugguaggagcagcgaugacagaugauauagguauggguguaaccuaucucgcuuuauuagcagcauuuaagguacgacccacauucgcagcaggauuauuauuaagaaaauuaacuucaaaggagcuuaugauggcgacaaucggaauagcgcuauuaagucaauccacuauacccgagaccauccucgagcuaacagaugcccuagcgcuuggcaugaugguccuaaaaauaguacgaaacauggaaaaauaucaacuugcaguuaccauaauggcaauauccugugugccuaaugcuguaauuuugcagaaugcuuggaagguuaguuguacuaucuuagccacgguuagcguaagucccuuacuccucaccaguucacaacaaaaggcagauuggauuccguuggcuuugacgauuaaaggacuaaacccuacagccauauuuuuaacaacacuuucccggaccagcaagaaaaggaguuggccauuaaaugaggcaaucauggcuguggguaugguuaguauuuuggcaucaaguuuguugaaaaaugauauacccaugacagguccucuaguggcuggaggucuauugacaguauguuaugucuuaacuggaaggucagcugaucucgaauuagaaagagcuacagacguuaagugggaagaccaggcagagauuucggguuccaguccgauacuuucgauuacuauagcagaagacggaucgaugucuauaaagaaugaagaagaagaacaaacauuaacuauacucauucgaacuggacucuuagucauuucaggacuauuuccagugagcauaccaauuacagcagcggcaugguaucuaugggagguaaagaaacagagagcaggcguuuugugggauguuccaucaccaccaccugucggaaaagcagaauuagaagauggagcuuaccgcauuaagcaaaaggggauucuagguuacagucaaauaggagccggcguauacaaagagggaaccuuucauacaauguggcauguaacuagaggagcgguguugaugcaucgcgguaagagaaucgagcccucaugggcggacguuaagaaagacuugaucaguuacggggguggauggaaacucgaaggcgaauggaaagagggagaagaaguacagguccuagcccuggaacccggcaaaaauccacgagccguccaaaccaaacccgggcuuuuuaaaacgaauacagggacuauaggcgcuguaagucucgacuucucccccgguacaaguggaucucccauuguggaccguaaaggaaagguugucggauuguacggcaauggaguggugacaagaucaggagcuuauguaucagcuauagcacaaacugagaaaucgauagaagauaaccccgaaauagaagacgacauauucagaaagaaaagauugacuaucauggaucuucauccaggcgcaggaaaaaccaagagauacuuaccagcuauaguuagagaagccauaaaacgaggucuaagaacucucauccuugcaccaacaagagucguggcagcugaaauggaagaagcguuaagaggucuaccgauuagguaccaaacgcccgcuauacgagcagaacauacaggcagagaaauuguagacuuaaugugucaugcaacauuuacaaugcgcuuacuaucuccaguaagaguaccuaacuauaaucuuauaaucauggacgaagcacauuuuacggauccugcuaguauugccgcgaggggcuauaucuccacaagaguggagaugggcgaagcagcggguauauucaugacagcaaccccgccaggaagcagggacccuuucccucagucuaacgcgccaaucauggacgaggaacgagagaucccagaaagaaguuggaacucugggcaugaauggguaacagauuuuaaaggaaagacagugugguucguuccaaguaucaaagcaggcaaugauauugccgcaugucuacggaaaaauggaaagaaaguaauccaauuaucacgaaaaacguuugauucagaauauguuaagacaaggacaaaugacugggauuuugucguaacaacugacauuuccgaaaugggggcuaauuucaaagccgaacgagugauagauccgcgacguuguaugaagccaguuauuuuaacagacggagaagaacgaguuauucuagcagguccaaugcccguaacucauucauccgcagcacaaagaagaggacgaauuggaagaaaccccaagaacgagaaugaccaguacauuuauaugggcgaaccccuagaaaaugaugaagacugugcccacuggaaagaggcgaagauguuauuggauaauauuaauacuccagaaggaauaauaccaagcauguuugaaccugaaagggagaagguagaugcgauagacggagaauacaggcuacgcggugaagcccgaaagacguuuguggaucuaaugagaagaggugaucugccugucugguuagcuuaucguguagcugccgaaggaauaaacuaugcugauaggcgaugguguuuugauggagucaaaaacaaccagauauuagaagaaaauguagagguagaaaucuggaccaaagaaggugaaagaaagaaauuaaaaccucgauggcuugacgcuaggauuuacagugauccacuugcucuaaaagaauuuaaggaguuugcagcgggccguaaaucacucacauugaauuugauuacagagauggguagauuaccgacuuucaugacacaaaaagcaagagacgcacuagauaaucuagcaguccuacacacugccgaagcugguggacgcgcauacaaucaugcuuuaucggaauuacccgaaaccuuagaaacacuguuauuauuaacucuacuugcaacuguaacgggaggaauauuccuauuucuuaugagcggaaaagggguaggaaagaugacacuagguauguguuguauaauaacugccucuauucucuuauggcaugcucaaauccaaccccacuggaucgcagcuucuauuauucuagaguucuuucuuauuguucuacugauuccagagccagaaaagcagcgaacuccacaagauaaucaacuaacauauguaguuaucgcuauucucacaguuguggccgcuacuauggcaaacgaaauggguuuucuagagaaaacuaagaaggaucuaggccuugggucaauagcaacacaagaacccgaaaguaacauucuugauauugaccugagacccgcaucagcuuggacacuuuaugcgguggcaacgacauuuguaacaccuaugcuccggcacucaauugaaaacaguaguguuaauguaucauuaacggcgauugcuaaucaagcuaccguccucaugggguuagggaagggauggccuuuaaguaaaauggauauaggaguucccuuacuggcaauuggcuguuacagucaagugaauccaauaacccuaacugcagcacuacuccuccuuguagcgcauuacgcuaucauuggaccuggauuacaagcuaaagcaacgcgggaagcucagaaaagagccgcagcaggaauaaugaagaauccgacaguagaugguauuacagugauagauuuagauccaauaccauaugauccaaaauuugaaaaacaacuaggccaagucaugcuacucauuuuaugcgugacacagguacuaaugaugaggaccaccugggcacucugcgaagcccuaacacuggcaaccggaccgauaaguaccuugugggaaggaaaucccgguagauucuggaacacaacgauugcagugagcauggcaaauaucuucagaggcucauauuuagcgggggcaggucuacucuuuucuauaaugaagaacacuacaaauacacgccgaggaacugguaauauaggcgaaacacuuggagaaaaauggaaaagccgccugaaugcauuaggcaaauccgaauuucagauuuacaagaaauccgguauccaggaaguggaccggacguuggccaaggaagguauuaaacgcggugaaacggaccaccaugccgugucaagaggauccgcuaaacuucgaugguucguagaaagaaacauggugacgcccgaagguaagguaguugaccugggcugcggaagaggagguuggucuuauuauugcgguggcuugaaaaacguuagagagguuaaaggacuaacuaaaggaggaccaggacaugaagaaccuauuccgaugucaacuuacggauggaaucuaguacgguuacagagcggagucgauguuuucuuuacaccucccgagaaaugugacaccuuacuuugcgacauuggagaaucuaguccuaauccaaccaucgaagcaggcagaacccuuagggucuuaucacuuguugaaaauugguugaauaacgauacacaauuuugcauaaagguauuaaacccauauaugccaucaguuauagagaaaauggaaacacuucaaagaaaauauggaggggcucuuguacggaauccucuuucccgaaacagcacgcacgaaauguacuggguuagcaaugcuacuggaaauauuguuagcagugugaacaugauuaguagaaugcucauaaaccgcuucaccaugaagcauaagaaagccacguaugaaccugauguagaucuuggaucuggaacgaggaacauaggaauagagucugagauaccgaacuuagacaucauaggaaaacgaauagagaaaaucaaacaggaacaugagacaucauggcauuaugaucaagaccacccauauaaaaccugggcauaucauggaagcuacgaaacaaaacaaacgggaagcgcaucaucgaugguaaauggaguugugcgacuccuuacgaaaccgugggacguuguaccaaugguuacacaaauggcaaugaccgauacaacucccuucggucaacaaaggguuuuuaaagaaaaaguugacacaagaacgcaggaaccgaaggaaggaacaaagaaacuaaugaaaauaacugcagaaugguuauggaaagaacuagguaaaaagaaaacaccacgaauguguaccagagaagaauuuaccagaaaaguuagaaguaaugcagcucugggagcaaucuuuacagaugaaaacaaauggaaaucagcccgagaagcuguagaagauagucgauucugggagcuaguugacaaagaaagaaaucuccauuuggaagguaaaugugaaacauguguauauaacaugaugggaaagagggagaagaaacucggugaguuuggaaaagccaaagggucacgggcaauuugguacaugugguuaggugcgcguuuucuagaguucgaagcgcuaggauuccuaaaugaagaucacugguuuagucgugaaaauucuuugucuggaguugagggcgaaggucuacacaaacuugguuauauauuacgggauguauccaagaaagagggaggugccauguacgcggacgacacagcagguugggauacaagaauaaccuuagaagaucuaaagaaugaagaaaugguuaccaaccacauggaaggugaacacaagaaauuggcagaagccauauucaaacuuacauaucagaacaaaguugugcggguucaaagaccgacgccccgaggaacugucauggauaucauuagcagacgcgaccaacggggaucggggcaggucgguacuuaugguuuaaauacuuuuacuaacauggaagcacagcuaauaagacaaauggagggugaagguaucuucaaaaguauacaacacuuaacagucacggaggaaauugcugugcaaaauuggcuggcaaggguuggaagagagagauuaagucggauggccauaucuggagaugacugcguaguaaaaccacuggacgaucgcuuugcuagugcuuuaacagcgcugaacgauaugggcaaaguccguaaggacauacaacagugggaaccuagucgagguuggaaugauuggacacagguucccuucugcucacaucauuuccaugaauuaaucaugaaggacggaagaguacugguagucccaugccgaaaucaagaugaguuaauagggagggcaagaauaucacagggagcugguuggagcuuaaaagaaacagccugucucggaaaaucauacgcucaaauguggagucuuauguauuuucauagacgugauuugagguuagcagcuaaugcuauauguucagccguuccaagucauugggucccuacaucaagaaccacauggaguauccaugcuaaacaugaguggaugacaacagaagauaugcuaacagucuggaacagaguauggauacaagaaaaucccuggauggaagauaagacaccgguagaaagcugggaagagguaccauaccuaggcaaaagagaagaccaauggugugguagccucauaggauuaaccaguagagcuacgugggcaaagaauauacaaacugcuauaaaucaagugcgaucguuaauagggaaugaggaguauacugacuauaugccaucuaugaaaagguucagaagggaagaagaagaagcugguguauuaugguag

SEQ ID NO: 22827 - RNA, 9876 nt, Artificial Sequence
  derived and/or modified CDS sequence (opt6) from DENV-2__FM210213__SS-prME
acugcaggagucauaauaaugcuaauuccuacugcgauggcauuucacuuaacuaccaggaauggagaaccccacaugaucgugggaagacaagaaaaagguaaaucucuucuuuucaaaacggaagauggaguuaacaugugcacccuaauggcuauugaucuaggcgaacugugcgaagacacuauaaccuauaaauguccccuacuacgacaaaaugaaccagaagacauugauugcugguguaacaguacaaguaccuggguaaccuauggaacaugcacuacaacuggagaacaucggcgagagaaaagaaguguagcucuugugccacauguaggcaugggguuggagacgcgaacggaaacguggaugagcagugaaggugcauggaaacaugcccaacgaauagaaacuuggauuuugcgacauccgggauuuacgauaauggcagccauauuggcuuauacaguugguacuacccauuuccaaagagcauuaauauuuauuuugcuagcggcuguggcaccaagcaugacaaugcgcugcauugguauuucaaacagagauuuuguggaaggagugucuggugguagcuggguagauauuguuuuggaacacggaagcuguguaacaacaauggcuaaaaauaaaccaacauuagauuucgaacuaauaaaaacggaagcgaaacagccggcaaccuuaaggaaauacuguauagaggcaaaauuaacaaauacgacaacggagucacgaugucccacgcagggugaacccucacuuaacgaagaacaggacaaacguuuuguaugcaaacacaguaugguagaucgcggauggggcaauggcugcgguuuauuuggcaaaggaggaauaguaaccugcgcgauguuuacaugcaagaaaaauauggaaggaaaaaucguccagccggagaacuuagaauauaccauagugauuacaccgcauaguggagaagaacaugcagucggaaaugacacaggcaaacauggcaaagagaucaaaauuacaccacaaaguccuauaaccgaagcugaauuaacaggguauggaaccgugacuauggaauguucaccgcguacaggauuagauuuuaaugaaauggucuuacuucaaauggaggacaaggcuugguuaguccaucggcaaugguuccuagaccuaccgcucccuuggcuuccgggggccgauacacaaggaucgaauuggauccaaaaagaaacacugguuacauucaaaaauccacaugccaagaaacaagacgucgugguauuaggaagccaagaaggagcaaugcauacagcgcuaaccggugcuacagaaauucagaugaguucgggaaaccuacucuucaccggacauuuaaaaugccgauugcguauggauaaacuucaauuaaaaggaaugaguuauaguaugugcacgggcaaauucaaaauagucaaagagauagcugagacacagcacggaacgauugugaucagagugcaauaugaaggagauggaagcccuuguaaaaucccauuugagauaauggaucuugagaaaagacacgugcucgguagacucauaacagucaacccuauaguaacggaaaaagacaguccaguaaacauugaagcagaaccgccauucggggauagcuauauuauaauaggaguugaaccgggucaacuaaaacuuaacugguucaagaaagguaguaguauuggccaaauguuugaaacgacaaugcgcggugcuaaaagaauggcgauccugggagauacugcaugggauuuuggcucccuggguggaguauuuacaucaauagggaaagcgcuccaccaaguuuucggagcaaucuauggagccgccuuuucaggaguaaguuggacgaugaaaauacuaauuggagucaucauaacauggauaggaaugaauagccgaagcaccaguuuaagugucuccuuaguacuuguggguguaaucacacuauaccugggcgcaaugguucaagcagauaguggauguguagugucuuggaaaaacaaagaauuaaaauguggaucggggaucuuuauaaccgacaauguccauacauggacagagcaguauaaauuucaaccagagagcccuuccaaauuggcaagcgcuauccagaaagcucacgaagaaggaauaugugguauucgcagugucacaagauuagaaaacuugauguggaaacagauuacaccggaacucaaucacauacuaagugagaacgaagugaagcuaacaauaaugacgggcgacauaaaaggaauaaugcaggccggcaagagaucauuacggccucaacccacagaauuaaaguacucauggaagacaugggguaaggcaaaaauguuaagcacggaaagccacaaucaaaccuucuugaucgauggaccagaaacagcggaauguccaaauaccaaucgagcuuggaacucauuagaggucgaagacuaugguuucggaguauucacaacgaauauauggcuaaaauuacgugaaaaacaagauguauucugcgacucaaagcuaaugucugcugccauaaaggacaaccgcgcaguucacgcggauaugggcuauuggauugaauccgcguuaaaugacacuuggaaaauggaaaaggcuucuuuuauugaaguuaagagcugucacuggccaaaaucccauacacucuggucaaauggaguccuggaaagugaaaugauaauacccaaaucauucgcuggcccuguuagucaacacaacuaucgucccggguauuauacccaaacagcagguccauggcaccuaggcaaacuugaaauggacuucgauuucugcgaggggacuacagucgucguuacggaagacugugguaaucguggaccaucauuacgaacgacgacagccucgggaaaacuaauuacagagugguguugccgaaguuguaccuugccuccauuacgguauaggggcgaagacgguuguugguacgguauggagaucaggccacuuaaggaaaaagaagagaaccucgucaauagccuaguaacugcuggacauggacagauagacaauuuuagucuaggaguacuagguauggcacucuucuuagaagagaugcuaagaaccagaguggguacaaaacacgccauucuauuagucgcaguuaguuucgugaccuugauaaccgggaauaugagcuucagagauuuagggagaguuauggugaugguuggugcugcaaugacugacgauaucgguauggggguuacauacuuagcauuauuggcagcuuucaaagugaggccgacuuucgcugcagguuuauuauuacgcaaacuaacuucaaaagagcuaaugauggcuacaauagggauagcacuacuuucccaaucaacgauuccagaaacaauuuuggaauuaacggaugcucuagcccucggaaugaugguguugaaaauaguacgaaauauggaaaaauaccaacuggcggucacgauuauggcaauaagcugcguaccaaacgcuguaauuuuacaaaaugccuggaaaguaucaugcacaaucuuggcaaccgugucagucaguccguuauugcugacuagcucacaacaaaaagcugauuggauaccgcuagcacuaacuaucaaaggcuuaaaccccacugcgauauuccuaacaacacuaucucgcacuucaaagaaaaggaguuggccucuuaaugaagccauaauggcagucgguauggugucaauauuagcuucgagucuccuaaagaaugacaucccaaugacuggaccuuuaguagcaggcggguugcuuacgguuuguuacgucuuaacggggcgaucagcugauuuagaauuagaacgagccacugacgugaaaugggaagaccaggcugaaauaagcgggagcaguccaauacuuucgauuacaauagcugaggaugggucuaugaguaucaaaaaugaggaagaagaacaaacguuaacaauucucauaagaacaggauuauuagugauaucaggacuauuuccgguaucaauucccaucaccgcagcagcaugguaucugugggaggucaagaaacaaagagcggguguuuuaugggauguuccuucacccccaccuguaggaaaagcagaacucgaagacggagcauauaggauaaagcagaaaggaauacuagguuacagucaaauuggggcaggaguguacaaagaagguacauuucauacaauguggcauguuacacguggugcuguucuaaugcacagaggaaagcgaauagaacccucgugggcagauguaaagaaagacuuaaucucguacggaggcggauggaaguuagagggagaauggaaagaaggggaagaaguacaaguacuagcacuugaaccaggcaaaaauccacgggcaguucaaacaaaaccgggguuguucaagacgaauacagguacaauuggagcaguaagccuugacuuuucacccggaaccagcggaucgccaauuguagauagaaaaggaaagguugucggccucuaugggaauggaguagucacaagaagcggagcuuaugucagugcuauagcacaaacugagaaaaguauagaagauaaucccgaaauagaagaugauaucuucaggaagaaaagauuaacaaucauggaucuucacccaggcgcaggaaaaacgaaaagauaucuacccgcaauuguacgugaagcuauaaagcgaggacuaaggacccucauccuagcaccuacaagggugguagcggcagagauggaggaagcauuacgcggacuacccauuagauaccaaacuccagcaauaagggcagaacauacgggacgcgaaauagucgaccuaaugugccaugcaacauuuaccaugaggcuuuugaguccaguaagggucccaaauuacaauuuaauaauaauggacgaagcccacuucacugacccagcaaguauugcagcucgcggcuacauaucuacacgcguagaaaugggagaagcugcuggaauauuuaugacugcuacaccacccgguagucgagacccuuuuccccaauccaaugcaccuauuauggaugaagaaagagagauacccgaaagaaguuggaacucuggacaugaauggguuacagauuuuaaagguaaaacuguuugguuugucccgucuauaaaagcugguaaugacauagcagcaugcuuacggaaaaauggaaagaaggugauacaacuaucuagaaagacguucgacagcgaauacgugaagacucgaacgaaugacugggauuucguugugacuacagauauuuccgaaaugggagcgaauuuuaaagccgaacggguaauagacccaaggagaugcaugaagcccguaauauugacggacggagaggagcgaguuauacuugcuggaccaaugccugucacucacucuagugcggcccaaaggagggggagaauaggaagaaauccuaagaacgagaacgaucaauacauauauaugggugaaccucuagagaacgaugaggacugcgcccauuggaaggaagcgaaaauguuacuagacaacauaaauaccccagaaggaauuauaccaaguauguucgagccggagcgagaaaagguagaugcuaucgauggugaauauagacuaagaggggaagcacguaaaacguuuguagauuuaaugaggcgaggagaucucccaguguggcuggcauauagggucgcagcggaaggaauaaauuaugccgaccgacgaugguguuuugauggcgucaaaaauaaccaaauccuagaagagaauguggagguagagaucuggacaaaagaaggugaaaggaagaaauuaaaaccacgaugguuagaugcaagaaucuacucagauccauuggcgcuuaaagaguuuaaagaauuugccgcaggucgaaaauccuuaacccuuaauuuaaucacagagauggggagacugccgacuuuuaugacucagaaagcacguaacgcccuagauaaucuggcaguucuccauaccgcggaagcuggagggcgagcuuacaaucaugcgcuaucugaacuacccgaaacucuagaaacuuuguuacuacuaacucuucuagccacaguaacuggaggaauauuccuauuuuuaaugaguggaaaagguguugguaaaaugacuuuaggaaugugcuguauuauuaccgcuucaauccuauuauggcaugcucagauacaaccacauuggaucgcugcuucaauaauauuagaauuuuuccuuaucguucuuuuaauuccagaaccugaaaaacagcguacuccacaagauaaucaguugacauaugugguaauagccauauuaacaguuguagcugcaacaauggcaaacgaaaugggauuucuagaaaagacuaagaaagaccuuggcuuaggauccaucgcuacccaagaaccagagucaaacauucucgauauagaucucagaccagcaucagcauggacccucuaugcagucgccacaacguucguuacaccaauguuaagacacucuaucgagaauagcucgguaaauguuucacuaacugccauagcgaaucaagcuacgguacucaugggucuagggaaggguuggccacuguccaaaauggacauugggguaccacuccuagcgauaggaugcuacagucaaguuaauccaauaacccuuaccgcugcccuacuuuuguuaguggcgcauuacgcgauuauuggaccaggccuccaggcaaaagcgacuagggaagcgcagaaaagggcagcagcaggaauaaugaaaaauccaacgguagauggaaucacaguaauugaucucgacccgauaccguaugacccuaaauuugaaaaacaguuaggccagguaaugcuuuuaauacuuugugucacucaaguacuuaugaugcgaaccacuugggcucuaugcgaagcucucacacuagcaacaggcccaaucagcacacuuugggagggcaauccuggacgauuuuggaauaccaccauagcgguaaguauggccaacauauuuagggggucauauuuggcaggcgcuggucuucuauuuucaauaaugaagaauacaacuaauacucguagggggacaggaaauauaggugaaacucuaggggaaaaauggaaaagcaggcucaaugcauuagggaaaucugaguuucaaauauauaagaaaucagggauccaagaaguugauagaacacuagcuaaagaaggaauuaagcgaggagaaacagaucaucaugccgugagcagaggcagugccaaacuuagaugguuuguggaaagaaauaugguaaccccagaagggaaaguaguagauuugggaugcgguagggguggguggagcuauuauugcggaggucuuaaaaacguuagggaaguaaaaggcuuaacaaaaggaggaccaggucacgaagaaccuauaccaaugucuacguauggcuggaaucuugucagauuacaauccgguguagauguauucuuuacaccucccgagaaaugcgauacacuucuuugugauauaggugaaucaucgcccaacccaacuauagaagcagggagaacccucaggguguugagccugguugaaaacuggcuaaauaaugacacgcaauuuuguauaaagguauuaaauccauauaugcccagcgucauugagaaaauggaaacauuacaacgcaaguacggaggagcccuaguaagaaaucccuuaucccgcaauagcacccaugaaauguauuggguuagcaacgcaacuggaaauauugucaguucaguaaauaugauaaguaggauguuaauuaaucgguuuaccaugaagcacaagaaagcgacuuaugaacccgauguugaucuagguuccgggacgcgaaacaucgggauugagucagaaauaccaaaucuagauaucauuggaaaaagaauugaaaagauaaagcaagagcaugagacuucuuggcauuacgaccaggaccaccccuauaaaacaugggcguaccacgguucguaugaaaccaagcaaacagggucugccaguucuaugguuaauggcguaguuagauuacuuacaaagccaugggacgucgugccaauggucacucagauggcaaugacugacaccacacccuuuggacagcaacgugucuucaaggagaaaguggacacacggacacaagagccuaaagaaggcacuaaaaaguuaaugaagauaacugccgaauggcuauggaaagaauuggguaagaagaaaacgccaaggauguguacuagagaagaauuuacgagaaaaguucgcucaaacgcugcgcuaggcgcaauuuucacagacgaaaauaaauggaaaagugcuagggaagcaguagaagauucacgcuuuugggagcuuguugauaaagagagaaaccuacaucucgaaggaaagugugaaacauguguauacaauaugauggggaagcgagaaaagaaguugggcgaguuugggaaagcuaaaggcucucgugcaauuugguacaugugguuaggugcacgauuucuugaauuugaggccuuaggauuuuuaaaugaagaucacugguuuagccgugaaaauagucuuucuggcguagaaggagaaggauuacauaaguuggguuauauucuucgcgacguaagcaagaaagaaggcggugcaauguacgcugacgacacagcaggaugggauacacgaauaacccuagaagaucuuaaaaaugaagaaaugguuacaaaucauauggaaggggaacauaagaaacuggcagaggcuauauucaagcuaacauaucagaauaaaguuguuagaguucaaaggccaacaccuagaggaacugugauggacauaauaucaagaagagaccaaagagggaguggacaagugggaacuuauggccuuaacacauuuacuaauauggaagcucaguuaauaagacaaauggaaggugaaggaaucuuuaagaguauucaacaucugacuguaacagaagagauugcaguacaaaacuggcucgcaagaguuggacgugaaagguuaagcagaauggcaauaaguggagacgauuguguuguaaaaccuuuagaugacagauucgccagcgcccuuacagcacuaaacgacauggguaagguaaggaaagacauacaacaaugggaaccgucacggggauggaacgauuggacucagguacccuuuuguagucaccauuuccacgaguuaauaaugaaggauggacgaguccuugucgugccauguaggaaucaagaugaacuaauagguagggcaagaauaagucagggggcaggaugguccuugaaagaaacggcaugccucgguaaaucauaugcacaaauguggucuuuaauguauuuccaucggcgcgaucuaaggcuagccgcuaaugccauaugcucagccgucccaucccauugggucccuacuuccagaacaaccuggucuauacaugcaaaacaugaauggaugacgacagaagacaugcuuaccguauggaaucgcguauggauacaagagaauccauggauggaggauaaaacaccaguagaaucuugggaggaaguacccuaucuaggaaagagagaggaucaguggugcggaagucuaaucggacuaacaaguagagcaacaugggccaaaaacauccaaacagcaauaaaccaaguuagguccuuaauaggaaaugaagaauauaccgauuauaugccaucgaugaagagguuuagaagggaagaagaagaagcggggguacucugguaa

SEQ ID NO: 22828 - RNA, 9876 nt, Artificial Sequence
  derived and/or modified CDS sequence (opt6) from DENV-2__FM210235__SS-prME
acugcggguguuaucaucaugcucaucccuacggcuauggcauuucaccuaacaacccgcaauggcgagccccacaugauaguugggagacaagaaaagggaaaguccuugcuuuucaaaaccgaagauggugugaacaugugcacacuuauggcuaucgaccuaggagaacucugugaagacacgauaacauauaaauguccguuauuaagacaaaacgaaccggaagacauagauuguuggugcaauaguaccucaacguggguaacauacggaacauguacgacaacaggggaacaucguagagagaaaagaucaguagcacuagugccacacguugggaugggucuugaaacucguacagaaacauggauguccagugaaggcgcauggaaacaugcgcaaagaaucgaaacauggauccuaagacauccgggcuuuacaauuauggcggcgauccuugcauauacggugggaacgacacauuuucaacgagcucuuaucuuuauauuacucgcugcugucgcuccuucgaugacuaugagaugcaucgggauaucaaaccgagauuucgucgaaggcguaucagggggaagcugggucgauauagugcuagagcaugggucgugcgucacgacaauggcaaaaaauaagccaacauuggauuucgaauuaaucaaaacagaagcaaaacagcccgcuacucuaagaaaguauuguaucgaggccaaacuaacgaauaccaccacggaaagucgauguccuacacaaggagagccuucauuaaacgaagaacaggacaaaagauuuguaugucgacauuccauggucgacagaggaugggguaaugguugcggucuauucggaaaagggggaaucguuacuugcgcaauguucacaugcaaaaaaaauauggaaggaaaaauaguccaaccugaaaaccuagaguauacuauaguuauaacuccacauaguggggaggagcaugcaguagguaaugacaccggaaagcaugguaaagaaauaaaaauaacgccccagucuccuauaacagaggcugaacuaacgggauacggaacuguaacuauggaauguagcccuagaacaggccuugauuucaaugaaaugguacuacuucagauggaggacaaagcuugguugguccauaggcaaugguuucuggacuuaccccuaccauggcucccuggagccgauacccagggaucgaauuggauacaaaaagaaacucucgugacauucaaaaacccgcaugcaaaaaaacaagacguggucguucuaggcucacaggaaggagccaugcauacggcauugacuggagcaaccgaaauccaaaugucuaguggaaaccuguuauucacuggacaucuaaaauguagacuucgcauggauaagcugcaacuaaaaggaauguccuacaguauguguacaggaaaauuuaagauagugaaggaaaucgcugaaacacaacacggaacuaucguaauuagaguacaguaugagggugauggaagcccgugcaaaauaccauucgaaauaauggauuuagaaaaaaggcauguguuagggcgacuuaucacaguaaauccaaucgugaccgaaaaggauucaccaguaaauauagaagcugaacccccauucggagauucguauauuaucauaggaguagaaccgggacagcuaaaacucaacugguuuaaaaaaggcucgucaaucggacaaauguuugaaacaacaaugaggggggcaaaaagaauggcaauucuuggagacacagcaugggauuuuggaagcuuaggaggaguguucacauccauaggaaaagcccuucaucaggucuucggagcaauauauggagcggcauuuuccggcguuucuuggacgaugaaaauauuaauaggcguuauuauaaccuggaucgguaugaacucaagauccacuaguuuaaguguuuccuuaguguuaguaggugucaucaccuuauauuugggcgccaugguucaggcagauaguggauguguaguuaguuggaagaauaaagaacuuaaguguggguccggcauauuuaucacagauaacguacacacauggacugagcaauacaaauuccaaccggaaagccccucgaaauuagcauccgcuauacaaaaagcacaugaagaaggaauuugcgggauuagaagcguuaccagacuagaaaacuugauguggaaacaaauaacuccugaauuaaaucacaucuuaagugaaaaugaggugaagcuuacgauaaugacaggcgacauuaaaggaaucaugcaggccggaaaacgaucccuuagaccacaaccgacugaguuaaaauacuccuggaagaccuggggaaaagcaaaaauguuguccaccgaaagucacaaccaaacuuucuuaaucgauggaccugaaacagccgaaugccccaacaccaacagagcguggaacaguuuagaagucgaggauuauggauuugguguauucacgaccaauaucugguuaaagcuacgggaaaaacaagacguauuuugcgacucuaaauuaaugagcgcugcaauaaaggauaaccgggcgguacaugcagacaugggauauuggauagagagugcgcuuaaugauacuuggaaaauggaaaaagcuucguuuaucgaaguuaaaaguugucauuggccaaagucucauacacuuuggucaaauggagugcuagagucugaaaugauaauuccgaaaagcuuugcggguccagugucccagcacaauuaucgcccagguuacuauacccagacagcuggaccguggcaucuggggaaauuggagauggauuucgacuuuugugaagggacaacggugguaguaacugaagauugcgguaauagagguccaucguugagaacaacaaccgcuagcggcaaauuaauaacugaaugguguugcagauccugcacccuaccaccccugcgauacagaggcgaagauggaugcugguauggaauggaaauaagaccauugaaagaaaaagaagaaaaucuaguuaauucucuugucacagcugggcauggccaaauagauaacuuuagucuaggagucuuaggaauggcucuauuucuugaagagauguuaagaacaagaguagguaccaaacacgcaauauuacuggucacagucaguuuuguuacucuaauaacuggaaacaugaguuuucgugacuuagggagaguaaugguaaugguaggugcagccaugaccgacgauauaggaaugggcguaacuuacuuagcuuuauuggcugcuuucaaggugagacccacuuuugcagcugggcuucuauuaaggaaacuaacuaguaaagaacuaaugauggcgacuauagggauagcacuccucagucagaguacuauaccggaaacaaucuuggaauuaacugacgcguuagcauugggaaugaugguauuaaaaauuguacgaaauauggaaaaauaccaacuagcaguuaccauuauggcuauuaguuguguaccuaaugcugugaucuuacaaaacgccuggaaaguaagcuguaccauacuagcugcaguuucaguuucuccacugcuucuaacgaguucacaacaaaaagccgacuggauaccacuggaauggucuaucaaaggacuaaacccaacugcgauauuucuaacuacgcugaguagaacaagcaaaaaaaggaguuggccauugaaugaggcaaucauggcagugggcauggucuccauacucgcgaguagucuacugaaaaaugacauaccaaugaccggaccuuuaguugcgggaggacuguugacugugugcuauguccuuacaggacgaagugccgaccuggagcuagaacgcgcaaccgauguaaaaugggaggaccaagcagaaauuucuggcuccaguccuauauuaucuaucacgaucgccgaagaugguuccaugagcauaaaaaaugaagaggaagaacaaacgcugacuauauuaauucggacaggacuuuuagucaucaguggccuguuuccuguauccaucccaauaaccgcugcggcaugguaccuaugggaaguaaaaaagcaaagggcaggaguguuaugggacgucccaucaccgcccccgguaggaaaggcggaguuagaagauggagccuacagaauuaaacagaaaggaauuuuaggauauucucagaucggagcaggaguauacaaagaaggaacauuccacacuauguggcacguaacccgaggcgcagugcuuaugcacagggguaaaagaauugaaccuucuugggcagaugugaaaaaagauuuaauuucauauggaggaggauggaaauuagaaggagaguggaaagaaggagaagaaguucaggucuuagcacuugaaccugguaaaaauccccgcgcaguucaaacuaaacccggacucuucaaaacaaauacuggaaccaucggugcuguaagccucgacuucucaccggguacaucggguucaccgauaguagaucguaaaggaaaaguaguggguuuauaugggaacgggguuguaacaagaaguggagcguauguuuccgcuauugcucaaacagaaaaaucaauagaggacaacccagaaauagaagacgacauauuucgcaaaaaacgccugacaauaauggauuuacacccuggagcaggaaaaacgaaaagauaucuuccugcaauuguaagagaagcgauaaaaaggggauuaagaacacucauuuuagcaccuacgcgugugguugcugcggaaauggaagaagcuuuacgaggucuucccauacgauaucaaacuccagcaaucagagccgaacacaccgggagagaaauaguggaucucaugugccaugcaacauuuacaaugaggcuccuuucacccguucguguuccgaacuauaaccucauuauaauggaugaggcacacuuuacugauccggcguccaucgcagcacgagguuacauuaguacuaggguugaaaugggugaagcggcaggaauauuuaugacugcaacuccuccuggcaguagagauccauuuccucaaucgaacgcaccuauuauggacgaggaaagagaaauaccggagcgcucauggaacucugggcaugaauggguuacggacuuuaaaggaaaaacagucugguuuguaccaucuaucaaggcggguaaugauauagccgcgugcuugagaaagaauggaaaaaaaguaauacaguuaucaagaaagacguuugauucagaauacgucaaaacacggacaaacgauugggauuucguugucacaacggauauaucagagaugggugccaauuucaaagcggagaggguaauagauccaaggcgaugcaugaaaccgguuauacuuacagauggggaagaacgggucauacuugccggaccaaugcccguaacucauucuagcgccgcacaacgaagaggaagaaucggcaggaacccuaagaacgaaaaugaccaauacaucuacaugggagagccauuagagaacgacgaagacugugcgcauuggaaagaagcaaagaugcuauuagauaauauaaauacgcccgaaggaauaauaccaucaauguucgaaccagaacgggagaaagucgaugcgauagacggagaguauagauuacgcggggaagcacguaaaacuuucguagacuuaaugagaaggggugaucuaccaguaugguuagcguacagagucgcagccgaagggauaaauuacgcagacaggcgaugguguuucgauggagucaagaacaaucagauacuggaagagaauguggagguggaaauauggacaaaggaaggagaacguaaaaaacucaaaccccguuggcuggaugcacgaaucuauagcgaucccuuagcuuugaaagaauuuaaagaauucgcagcagguagaaaaucuuuaacauuaaaucuaaucacggaaaugggacgguuaccuacauuuaugacacaaaaagcccgagacgcguuagauaacuuagcaguguuacacacagcagaggcaggugggagggccuacaaucaugcuuuaagcgaguugcccgaaacccuugaaacacuuuuguugcuaacuuuacuugcgacagucacaggggggauauuccuauucuugauguccgggaagggaguaggcaaaaugacacuaggaauguguuguauaauuacagcuagcauucuauugugguaugcacaaauacaaccacacuggaucgcugcgagcaucauucuugaauuuuuucuaaucgucuuguuaauuccagaaccugaaaaacagagaaccccacaagauaaucaacugacauacguaguuauugccaucuuaacagucguagcugcuacaauggccaacgaaaugggauuucuagaaaagacaaaaaaggaccucggauuagguaguauugcgacgagagagccagaaaguaauaucuuagacauugacuuacgcccagcuagugcauggacucucuacgccguagccacgaccuuuguaacgccuauguugcgucauaguauagaaaauagcucuguaaauguaaguuugacugcaaucgccaaucaagcaaccgugcuaaugggucuggguaaaggguggccuuuaucuaaaauggauauaggcguuccauuguuagcgauaggcugcuacucacaaguaaacccaaucacucuaacggccgcacucuuacuucucguagcgcauuacgcgauaauaggaccaggucuucaagccaaagcaacuagagaagcucaaaaaagagccgcagcuggaauuaugaaaaaccccacaguagacggaguaacugugauagauuuagacccgauuccguacgaccccaaauuugaaaagcaacuuggacaaguaaugcuacuaauccuaugugucacacagguauugaugaugcgaacgacuugggccuuaugcgaagcauuaacacuugcaacugguccgauaucuacauuaugggaggguaauccaggaagauucuggaauacaaccauagcuguaucgauggcgaacauauuccguggauccuauuuagcgggugcaggauuguuauucucaauaaugaaaaauaccacgaacacucgaagaggcacuggaaauauaggugaaacguugggagagaaauggaaaaguagguuaaacgccuuaggaaaaagcgaguuccaaauuuacaaaaaauccgggauacaggaggucgaccggacacuagcuaaggaagggauaaaacggggagaaacugaccaccacgcaguuucacgaggaagcgcuaaauuacgaugguucguagaaagaaauauggucacaccagagggcaaagugguagaucucggauguggucguggaggauggucauauuauuguggcggauugaaaaacgucagggaaguaaaaggauuaacuaaaggcggaccuggacacgaagaaccaauuccgaugagcacauacgguuggaacuuaguaagguugcaaucagguguagauguuuucuuuacgccacccgaaaagugugacaccuuauuaugugacauuggggaaaguaguccaaaucccaccauagaagcagggagaacauuacgaguuuuaucauuaguagagaacugguugaacaaugauacacaauucugcauuaaaguuuugaacccauauaugcccucgguuauugagaaaauggaaacacugcaaagaaaauacggcggcgcacuuguuagaaacccuuuaagccgaaacucgacacaugagauguauuggguuucgaaugcgaccgggaauauaguaaguucaguaaauaugauaagucgaauguugaucaauagauucacaaugaaacauaaaaaggcaacuuaugaaccagaugucgaucuaggcucugggacuagaaauauagguauagaaagugaaauuccuaaucuagauaucauagggaaacgaauagaaaaaauuaaacaggaacacgagacaagcuggcacuacgaucaggaucauccuuauaaaaccugggcauaccauggaucuuaugaaacgaaacaaacagguagugcgucgucaaugguuaacgggguaguccguuuauugacuaaaccaugggaugucguaccaauggucacacaaauggcuaugacagacacuacaccguucggccagcaaaggguguuuaaggagaaaguugauacaagaacccaagaaccuaaagagggaacgaaaaaguuaaugaaaauuacugcugaauggcuauggaaagaguuggguaaaaaaaaaacgccccgaauguguacacgagaggaauuuacccgcaaagugcgaaguaacgcagcacugggagcaauauuuaccgaugagaauaaauggaaaucugcacgugaagcaguagaagacucccgauuuugggagcuaguggauaaggaaagaaaccuucaucuagaagguaagugugaaaccugcguuuauaauaugauggggaaaagggaaaaaaaauuaggugaauucgguaaagcaaagggaucuagggcuauuugguacauguggcucggugcaagauuucuagaauucgaggcauuaggauuccuaaaugaagaccauugguuuuccagagaaaauucauuaucgggaguggaaggagaagguuugcauaaauuaggguacaucuugcgcgauguaagcaaaaaggaggguggagcaauguacgcggacgauacggcugggugggacacucgcauuacauuagaggacuuaaaaaaugaggaaaugguuacaaaccauauggaaggcgaacauaaaaaacuagcugaagcuauuuucaaauuaaccuaccaaaacaagguagugcgugugcaacgaccaacucccagggggacaguaauggauaucauaaguagaagggaucaacgaggaagcggucaaguagggacauauggauuaaacacauucaccaauauggaagcccaguuaauacgacaaauggaaggagaaggcguguucaaaaguauacaaagauuaacaguaacugaggaaauagcaguacaaaauuggcuggcgaggguagggcgggaaaggcuaucacgaauggcuauaaguggggacgacugugucguaaagccacuagacgacagauuugccagcgccuugacagcuuugaacgacauggggaaagucagaaaagauauucaacaaugggaaccaagucguggauggaaugacuggacccaaguuccauuuuguucacaucacuuucaugaauugauuaugaaagauggacgaguguugguaguaccauguagaaaccaagaugaacuaauaggaagagcuagaauaagucaaggagcgggcuggagucuuaaggaaacggcuugucuagguaaaucauacgcucaaauguggucacuaauguauuuccauaggagggaucugcgacuggcggcuaacgcuauuuguucagcgguuccgagucauuggguuccaacuucuagaaccacauggucgauccacgccaaacaugaauggaugacgacugaagauaugcuaacaguauggaauagaguuuggauucaagagaauccuuggauggaagauaaaacaccaguggagaguugggaagaaguaccuuaucuuggaaaacgagaagaccaauggugcggcucacugauuggucuaacuuccagagcuacuugggccaaaaauauacagaccgcuaucaaucaaguacgcucuuuaauaggaaaugaagaguacacagauuauaugccaaguaugaaaagguuucguagggaagaagaagaagcuggaguccuuugguaa

SEQ ID NO: 22829 - RNA, 9876 nt, Artificial Sequence
  derived and/or modified CDS sequence (opt6) from DENV-2__FM210205__SS-prME
ucagcaggaaugauuauuauguuaauaccgaccguaauggcuuuucaucuaacuaccaggaacggagaaccacacaugauaguagguauacaagaaaaaggaaaaucucuacuauucaaaacugaagacggugugaauaugugcacguugauggcaauggaucucggagaacucugugaagauaccauuacuuauaaauguccacuucuccgacaaaacgaaccggaagauauagacugcuggugcaacagcacaaguacuuggguaacauauggaaccugcaccacaacuggugagcacaggcgggagaaacgaucgguugcauuagugccacauguggggaugggacuugaaacacgaacugaaacauggaugaguagugaaggugcuuggaaacacgcucaacggauagaaacauggauauugaggcauccuggauuuacaauuauggcugcaauauuagcauauacuauuggaacgacacacuuccaacgaguacuaauuuuuauucucuuaacagcaguagcaccaagcaugacuaugagauguauugguaucucgaaucgagauuucguagaaggcguuaguggugggucuuggguugacauaguacuggaacacggcaguugcgugacuacuauggccaaaaauaaaccaacauuagauuucgaauuaauuaaaacagaagcgaaacaaccagcaacacuccgcaaauacugcauugaagcaaaacuuacuaauacgacuacagagucgcgaugcccaacucaaggagagccaagucugaaagaggaacaagacaaaagauuugugugcaaacacagcaugguugaucgggggugggguaacgguuguggccuauuuggcaaaggaggcauaguaacuugugcuauguuuacaugcaagaaaaauauggaagggaaaaucguacaaccagaaaaucuugaauacacuauaguaguuacaccucauucaggcgaagaacacgccgucggaaacgacacuggaaaacaugguaaagaaauaaaagugacaccacaaagcucuauaacggaagccgaauuaacagguuauggcacggugacuauggaauguucaccgcgcaccggauuagacuuuaacgagaugguacuucugcaaauggaaaacaaagccugguugguucaucgucaaugguuuuuagaccugccacuuccauggcuuccaggggcugauaaacaggaaagcaauuggauucaaaaagaaacgcucgugacguucaaaaauccacaugccaagaaacaagauguuguaguguuaggcucacaagaaggcgcuaugcauacagcccuaacaggugcuacagaaauacaaaugucuucaggaaauuuacuauucacaggucaucuuaaaugcagguugcgcauggauaagcugcagcucaaaggcaugucuuacucaaugugcacggguaaauucaaaguugucaaagaaauagcagaaacacagcauggaacaauagugauaagaguacaauaugaaggagacgggucuccauguaaaauuccuuucgaaauaauggacuuagagaaacgauacguacuaggaagacuaaucacuguuaaucccauagucacugaaaaagacaguccggucaauaucgaggcggagccucccuuuggcgauagcuauauaauuauagggguagaaccaggacaacuaaaacuaaacugguucaagaaagguaguucuauagggcagauguucgaaacuacgaugagaggagccaaaagaauggcuauacuaggagacaccgcuugggauuucggcucucuaggagguguuuucacgucgauugguaaagcgcuacaccaaguauuuggugccauauauggagcugcuuucagcgguguaucuuggacaaugaaaauucuaauuggagucauaauaacuuggauagguaugaacaguagaucaacgagccuauccguaucucuaguacucguagguauaguaacuuuauaucucggaguaaugguacaggcagauuccggaugcguaguuucuuggaagaauaaagagcucaagugugguucaggaauauucaucaccgauaacguucacacauggacugaacaauauaaauuucaaccagaaaguccauccaaauuagcguccgcuauccaaaaagcacaagaagaggguauaugcggaauaaggucggugacucgacuagagaauuuaauguggaagcaaauuacaccagaauuaaaccacauauuggccgagaaugaaguaaaauuaacuauaaugaccggggacauaaaagguauuaugcaagcagguaaacgaucacucagaccacaaccaacugagcucaaguacaguuggaaaacuuggggaaaagcaaagaugcuuucuacagaaucuuauaaccaaacuuuucuaauagauggacccgaaacagcggaguguccuaacacuaaucgcgccuggaacaguuuagagguugaagauuacgguuuugguguauuuacuacuaacauaugguugaaauugaaggaaaaacaggacgcauuuugcgacucaaaauuaaugagugcagcgauaaaagacaacagagccguccaugcggauauggguuauuggaucgagagcgcauugaacgacacauggaaaauagaaaaggcgucauuuauagaagucaaaaauugccacuggccuaaaagucauacacucuggucaaaugguguacuagagagcgaaaugauuauacccaaaaaccuagcggggcccgucucacaacacaauuauagacccggguaucauacgcaaauagcagggccguggcaucuaggaaaauuagaaauggauuuugacuucugcgaugguacgaccgugauuguuacagaagacuguggcaauagaggaccaucauugcgaaccacaacggcaucuggaaaauuaauaacagaauggugcuguaggucuuguacucuuccgccauuaagguacaggggagaagauggaugcugguauggaauggagauucgaccgcuaaaagaaaaagaagaaaauuuaguuaauucucuaguuacugccggacacggccaggucgacaacuuuucguuaggggugcuaggcauggcccuguuccuagaggaaauguuacgaacuaggguaggaacuaaacaugcaaucuuacugguagcagugaguuucguaacucuuauuaccggaaauaugucauuuaaagacuuagguagaguaguaguuaugguuggugccacaauggcggacgauauaggaauggguguaacauaucuagcacugcucgccgcuuucaagguacgucccaccuucgcagcaggacuucuguuaaagaaacuaacaaguaaagaauugaugaugaccacgauugguauuguguuacuuucacagagcacaauuccugaaacugucuuagaauugacagaugcguuagccuugggaaugaugguucuaaaaauaguccgaaacauggaaaaauaccaauuagcagucacaauuauggcuauacuuugcgugccgaaugcagucaucuugcaaaacgccuggaaaguauccuguaccauccuagcuguaguaagcguauccccacuucuacuuacgaguucccaacagaaaacggauuggauuccccuggcucugacuauaaaggggcuaaaccccaccgcgauauuuuuaacgacauuaucacgcacaaauaaaaagaggaguuggccccuuaaugaagcaaucauggcgguagguaugguuucaauucuugcuuccagucuucucaaaaacgauauuccuaugacaggcccauuaguggcugguggucuccuuaccguauguuacguauugacgggaagaucagcagauuuagaguuagaacgugcaacggacguaaaaugggaagaccaagcggaaauaagcgguucgaguccaauacuauccauaaccauauccgaagaugggucaaugagcaucaaaaacgaagaggaagaacaaacuuuaacaauuuuaauccguacagguuuauuaguuauaagcggucuauuuccuaucaguauaccuauuacagcggcagcaugguaucuaugggaggugaagaaacaaagagcuggaguccuaugggauguaccgucaccacccccaaugggaaaagcggaacuagaggacggugcauauagaauuaaacaaaaaggaauuuuaggauacagccaaauaggugcaggcguuuacaaagaagggacauuccacaccauguggcauguuacacgaggcgcaguuuugaugcacaaaggcaagagaauagagccgucuugggcagacgucaagaaagauuugauaucuuauggaggggguuggaaacuugaaggcgaauggaaggaaggugaagaaguacaaguccuggcacuugaaccgggcaaaaacccuagagcuguccagacaaaaccaggccuuuuuaaaaccaauacgggaacuauaggcgcagugaguuuagauuuuagcccaggcacuucuggcucacccauaauagacaagaaagguaaaguuguuggacuauauggaaacggaguaguuacucgaaguggcgcuuauguaagcgcaaucgcccaaacugagaaaaguauagaggacaacccugaaaucgaggaugauauauuuaggaaacgcagacuuaccauuauggauuuacauccaggagcggguaaaacaaaacguuaucuacccgcuauaguucgagaagcaauaaaaagaggucugagaacauugauccuggcaccgacaagaguuguggccgcugaaauggaagaagcauuaagggggcuaccuauaagauaucaaacuccagccauacgagcggagcacacaggacgugaaauaguagaccuaaugugccaugcuaccuucacaaugagacuguuaagcccuguaaggguaccgaacuauaacuugauuauuauggaugaagcgcauuuuacagacccagcuagcauagcugcgagagguuacauaucgacaagaguggaaaugggagaggcggcuggaauauucaugacagccaccccaccaggaagccgggauccuuuuccucaaucuaaugcucccauaauagaugaggaaagagagauaccggaaagauccuggaacagcggacaugaauggguaaccgauuuuaaaggaaaaacaguaugguuuguuccuagcauaaaagcagggaaugacauagccgcuugcuugcgcaaaaaugggaagaaaguuauacagcuuaguagaaaaacauuugauucggaauacguaaagacgagaacuaaugacugggacuucguuguaacuacggauauaagugagaugggagcaaauuucaaagcggaaagagugauugauccgagacguuguaugaaaccuguaauuuuaacugauggugaagagaggguaauucucgcagguccaaugccaguuacucauaguucggcagcucaacgacguggacgcauagguagaaaccccaaaaaugaaaaugaucaauacauauacaugggugaaccgcucgaaaaugaugaagacugcgcucauuggaaagaggcuaaaauguuacucgacaauaucaacacaccagaaggaauuauccccucaauguucgaaccggagcgugaaaaaguugaugcaauagauggagaauaccgauuacguggcgaggcgagaaaaacauucguugauuuaaugagacguggagauuugccgguuuggcuagcauauaagguagcggccgagggcaucaauuacgcagauaggagaugguguuuugacggaaucaaaaacaaccaaauucuggaagaaaauguggaaguagaaauauggacgaaagaaggugaacgcaagaaacugaagcccagauggcuagaugcuagaauauauucugauccacuugcacugaaggaauuuaaagaguucgcagcaggcaggaaauccuugacccucaauuugauaaccgaaaugggaagauuaccaacauucaugacacagaaaacaagggaugcucuugauaaccuugcaguauugcauacggcagaagccggagggagagcuuauaaccaugcucugagugaguuaccagagacccuugaaacuuuguuguuauugacauuacuugcaacaguuacaggggguauauuucuauucuugaugucggggagggguauagggaaaaugacucuuggcaugugcugcauaaucacggcaucgauacuuuuaugguacgcucaaauccaaccacacuggauugcagcauccaucauacuagaguuuuuccugauaguacuuuuaauaccagaacccgagaaacagaggacaccacaagacaaucaauuaacuuauguagucauugcaauucuaaccgucgucgcagcaacgauggcuaaugaaaugggauuucuugagaagaccaagaaagauuuugggcuagguuccauagcaacccaacaaccagaauccaacauacuagacauugauuugcgacccgcuuccgcauggacauuauacgccguagcuacaacguucguuacgccgaugcuaaggcauucaauagaaaauaguagcgucaacguuagccuaacagcgauugcgaaccaagcaacaguccuaauggggcuagggaagggauggccacucucuaaaauggacauuggaguuccucuacuggcaauagguuguuauucacagguuaaccccauaacacuaacugccgcacuccuguuguugguagcacauuaugcaaucauagguccagggcuccaagccaaggcuacgagagaagcacagaaaagagcagccgcugguauaaugaaaaacccuacaguagacgguauaacaguaauugaucuggacccaauuccguaugacccuaaauucgagaagcaguuagggcaaguaaugcuguugauuuugugcgugacacagguacuuaugaugcgaacaacaugggcgcuuugugaagcauuaacccuugcuacagguccuauaaguacucucugggaggguaauccaggacgguuuuggaauacuacaauagccguuucaauggcaaauauuuuuaggggaaguuacuuagccggcgcaggcuuacuauuuucuaucaugaagaauaccacaaacacgcgccggggcacggguaacauaggagaaacacucggagaaaaauggaaaucaagauuaaaugcgcuagguaaaagugaguuccaaauuuauaagaaaucugguauacaagaaguugaucguacguuagcuaaagaaggcauaaaaagaggagaaaccgaucaucacgccgucucucgcggcuccgcaaaacuccgaugguucguugagaggaacaugguaacaccggaagguaaaguaguggauuuggguugcggaaggggcggauggucauacuauuguggaggacucaaaaacguaagagagguaaaaggauuaacuaaaggagggccuggacacgaagaaccaauuccuaugucgacauauggguggaauuuaguccgucuucaaaguggcguugacguuuucuuuauaccaccagagaaaugugauacccuacuaugcgacaucggagagucauccccaaaccccaccguugaagcggggagaacccuaaggguucucaauuuagucgaaaauuggcuaaacaacaauacucaauuuugcauuaaaguuuuaaauccauauaugccaagugucauagagaaaauggaagccuuacaaaggaaauauggcggagcuuuaguaagaaacccccuuagcaggaauaguacgcaugaaauguauuggguuucaaacgcuaguggaaacauaguaucuuccguuaauaugauuagucggaugcuuauaaaccgauuuacaaugcgucauaagaaagccacuuaugaaccagauguugacuuggguaguggcacacguaauauagggauagaauccgaaauaccaaaccuugauauaauaggaaaaagaaucgagaaaauaaaacaagagcacgaaacaagcuggcauuacgaucaagaucauccguacaaaaccugggcuuaccauggcucuuacgaaacaaaacagacgggcucagcaucaucaaugguuaauggaguagucaggcuauuaacgaaaccgugggacguacuaccgacgguaacgcaaauggcaaugaccgacacuacccccuucggacaacaacggguauuuaaggaaaaaguggauaccagaacacaagaaccaaaagagggaacaaagaaauugaugaaaaucacggcugaaugguuauggaaagaguugggcaagaagaaaaccccaagaauguguacaagggaagaguucacccgcaaaguuagaucaaaugcagcacucggagccauauucaccgacgaaaauaaauggaaauccgcgagagaagcuguagaagacucgagguuuugggaguuaguagauaaggaaagaaaucuccauuuagaagguaaaugugaaacaugcguauauaacaugaugggcaagagagagaagaaacuuggagaguuugguaaagcaaaaggaucuagagcuauaugguauaugugguugggggcaagauuccuagaauuugaggcacucggguuucuaaacgaagaccauugguucagcagagaaaacaguuuauccggcguagaaggugaaggccuccauaaauugggcuauauauuacgagauguaucgaagaaagaaggaggggcaauguaugcagacgacacagcugggugggauacgagaauaaccuuagaagaccuaaagaaugaagaaauggugaccaaccauauggaaggggaacacaagaaacuagcugaagcgauauuuaaacuaaccuaccaaaacaaagugguacgaguacaaaggccgaccccgagggggaccguaauggacauuauuagccgucgggaucagcgagguucuggccagguaggaaccuauggcuuaaauacguucacuaauauggaggcucagcuuauaagacaaauggaaggcgaaggaguauuuaaaaauauccaacauuuaacaguuacugaggaaguugcuguccaaaauuggcuugcacgcguuggacgagaaagauuaagcaggauggccauaucaggugaugacuguguaguuaaaccacuugacgauagauuugcgaaugccuuaaccgcacuuaacgauaugggcaaaauaagaaaagacauacaacaaugggagccgaguaagggauggaaugacuggacacaggucccguucuguagucaccauuuccacgaacuuauuaugaaagauggacgcgucuuaguugugccaugcagaaaucaagaugaauugaucggccgugcuagaauaagucaaggagcuggguggucguugcgagaaaccgcguguuuaggcaagucauaugcucagauguggucuuugauguacuuucauagacgcgacuuacgcuuagcagccaaugcaaucugcagcgcggugccuagccauugggucccaacuucucgaacaacaugguccauacacgcgaaacaugaauggaugacgacagaagacauguuaacuguuuggaaucggguuuggauaagggaaaacccguggauggaagacaaaacuccaguagaaucaugggaagaaaucccauacuuagguaagagagaggaccagugguguggcagcuuaauuggucuaacaaguagggcaacaugggccaagaauauacaagcagccauaaaucaaguacguagucuaauagguaacgaagaauauacugauuauaugcccaguaugaaacguuucagacgugaggaagaagaagcagggguccuaugguaa

SEQ ID NO: 22830 - RNA, 9876 nt, Artificial Sequence
  derived and/or modified CDS sequence (opt6) from DENV-2__FM210206__SS-prME
agugcgggaaugauuauaauguuaauaccuacuguuauggcauuccacuuaacaacuagaaauggugaaccgcauaugauagugggaauccaagaaaaaggaaaaucucugcuguucaaaacagaagaugguguaaauauguguacgcuaauggcgauggauuuaggagaguugugugaggauaccauaacuuacaaauguccccuguugagacaaaacgaaccggaagacauagauugcugguguaauaguacgucgacuuggguaacuuacggaacauguacaacuacaggggaacauagacgggaaaaacguucgguagcucucgugccucacguaggaauggguuuagaaacaagaacggaaacguggaugaguagcgaaggcgcuuggaaacaugcacaaagaauagaaacauggauccuuaggcaucccggauuuacgcugauggcugcaauuuuagcuuauacuauuggaacuacucauuuucagagaguccucauauuuauacuucuuacagcagucgcuccgucaaugaccaugagaugcauaggaaucucaaaccgagauuuuguggaggguguaucgggcggaucuuggguggauauaguauuggagcaugguagcugcgucacgacuauggccaaaaauaaacccacauuagauuuugaacuaauaaaaaccgaagcaaaacaaccugcaacauuaaggaaauacugcauagaggcaaaauugacaaauaccaccacagaaucucgaugcccgacccagggagaaccaagucuuaaagaagaacaggauaaacguuucgugugcaaacauucaaugguugauagaggaugggguaacggaugugguuuauuugggaaaggaggaaucguuacaugugcgauguucacuugcaagaaaaauauggagggaaaaauaguacagccagaaaaucuagaauauacaauaguuguuaccccacauucuggugaagaacaugcaguaggaaacgacacuggaaaacacggaaaagagauuaaaguuacaccucagucgagcaucacugaagccgaacugacaggcuaugguacaguuacaauggaauguucaccgcgcacagguuuagacuuuaaugagaugguacuauugcagauggaaaacaaggcuuggcucguccacagacaaugguuccuagaccugccguuaccguggcuaccuggggcagauaaacaggaaagcaauuggauacaaaaagagacauugguuaccuucaaaaacccacacgcgaagaaacaagauguuguuguucuugggucacaagagggagcuaugcacacagcgcuaacgggugcaacugagauccagaugucaucggggaacuuacuuuucaccggccaccuuaaaugucgccuacgaauggauaaacuucaauuaaaaggaaugucauauaguauguguacagggaaguucaaggucguaaaagaaauugcagaaacgcagcauggcacaaucgugauuaggguacaguacgaaggagacggaucccccuguaaaauaccuuuugaaauaauggauuuagaaaaacgauauguacuuggacgauuaauuacugugaaccccauuguuacagaaaaagauucaccuguaaacaucgaagcggaaccaccauucggugauucauacauaauaauugguguggaaccuggacagcucaaguuaaacugguuuaaaaagggaaguucaauaggucaaauguuugaaacuacaaugagaggagcaaaaagaauggcaauacuuggugauacagcaugggauuuugggucuuuagguggaguauucacaucuauagguaaggccuuacaucaaguauucggugcuauuuacggugcagccuuuagugggguaagcuggacgaugaaaauucuuauaggaguaauaauaaccuggaucggaaugaacucccgauccacaagccugucaguuucgcuaguacuugucgggauaguuaccuuauauuuaggcgugaugguacaagcggacucuggaugcguaguguccuggaaaaauaaagaacucaaaugcggaucugguauauuuauuacggauaacguucauacauggacagaacaauauaaguuucaaccugaaucaccaaguaaguuagccucagcaauccaaaaggcgcaagaagaaggcauaugcggaauacgaagcguuacgcgucuagagaauuuaauguggaaacaaauuacuccagaguugaaccauauuuuagcggaaaaugaggucaaacuaacaauaaugacuggagauauuaaagguaucaugcaagcaggaaagcggucccuuagaccacaaccaacagaauugaaauacucuuggaaaaccuggggaaaagcaaaaauguuauccauugaaucguauaaucaaacauuccugaucgacgggccggagacugcugaaugcccuaauacuaacagagcauggaacuccuuagagguagaagauuacgguuucggggucuuuacuacaaacauuugguuaaaacuuaaagaaaaacaagacgcauucugugacagcaaacucaugagcgcagcuaucaaagacaauagagcaguccaugcugauauggguuauuggauugagagugcucugaacgauacauggaagauagagaaagcaucguuuauagaggucaagaauugccacuggccaaaaucacacacgcuauggucgaauggcguguuggaaucagaaaugauaauuccuaagaaucuagcuggacccguaagucaacauaauuauaggcccggguaccacacacaaauagccgggccguggcaucuagggaaacuagagauggauuucgauuucugugacggaacaacuguaauagugacggaagauugcggaaaucggggucccagccuacgcacgacuacggcaucuggaaaguuaaucacugaguggugcugcaggagcugcacguuacccccguugcguuaucgaggagaagauggguguugguauggcauggagauacgaccacuaaaagaaaaagaagaaaaucucgucaauucauuggucacggcaggccauggacaagucgauaauuuuuccuugggagucuuagguauggcauuauucuuggaggaaaugcucagaaccagagucgggacaaaacaugccauucuuuuaguugcugucaguuuugugacacuaauuacuggcaauaugagcuucaaagaccuagguagagucgucguaaugguuggugcuaccauggcagacgauaucgguaugggaguaaccuaccuagcuuuacuugcugcauucaaaguucgucccacguucgcagccggucuucuacugcgcaaauugacuagcaaagaguugaugaugacaacgaucggaauaguacuucucagccagucaacaauaccagagacaguucuagagcuaacagacgcccuugcucuaggcaugaugguauuaaaaauaguuagaaacauggagaaauaccaacuggcuguaaccaucauggcgauauugugcgugccuaacgcuguuauacuacaaaaugcauggaaaguuagcugcacaauucuagcuguagugaguguaucaccucuacuuuuaacgagcucgcagcagaaaacugauuggauuccauuagcacuuacaaucaaaggcuuaaauccgacagcaauuuuucucacaaccuuaucaaggacaaacaagaaacggaguuggccauuaaaugaggcaaucauggcuguuggaauggucaguauauuagcaucgucccuacugaaaaacgauauaccaaugaccgggcccuuaguagcaggaggauuauugacuguguguuauguucuaacggggcgaucggcugaucuagaacuagaacgagccaccgauguaaaaugggaggaucaagcagagauuaguggcagcagucccauucuaaguaucacaauauccgaagauggcucaaugagcauuaagaacgaagaagaagaacaaacguugacuauuuugauuagaacagguuugcuagucaucuccgguuuauucccuauuuccaucccuauaaccgccgcugcuugguauuuaugggaagucaaaaagcagagagccgguguucugugggauguaccgaguccacccccuaugggaaaagccgaacuagaggacggugcauacagaauaaaacaaaaaggcaucuuggguuacagucagaucggugcgggggucuacaaggaaggaacauuccauacgauguggcauguuacacgaggugcuguccuuaugcauaagggcaagaggauagaacccucaugggcugauguaaagaaagaucuuauauccuacggugguggcuggaaauuagaaggugaguggaaagaaggugaagaaguucaaguuuuggcauuggaaccugggaaaaauccgagagcugugcagacaaaaccuggcuuauucaagacgaauacgggaacuauaggagccgucucauuggacuucaguccuggaacaucgggcagccccauaauagauaagaaaggaaaggucgucggacucuaugggaaugguguagucacgagaucaggagcguacgucucagcaauagcucaaacagaaaagagcauagaagacaauccagaaauagaagaugauauauuccgcaaaaggagauuaacaauuauggaccuacacccuggcgcuggaaagacaaaacgauaccuaccagcuauugucagagaagcaaucaaaagaggacugcgcacucuaauucucgcgccgacgagaguggucgcagcagagauggaagaggcccuacgaggauuaccgaucagauaucaaacaccagcaauacgagccgaacacacgggacgugaaaucguagaccuuaugugucacgcaaccuuuacaaugcgauugcucagcccaguuagaguucccaauuauaaucuaauaauuauggaugaagcgcacuuuacagaucccgccuccauugcagccaggggguauauaagcacuagagucgaaaugggagaagcggcagggauauucaugacagccacucccccgggaucaagagauccauucccacaaaguaaugcuccaauuauagaugaagaacgugaaauuccugaaagauccuggaauaguggacacgaauggguuacugauuucaagggcaaaacagucugguucguaccaaguaucaaagccgguaaugacauugcagcuugucuucggaaaaaugggaagaagguaauccaauuaagccgaaaaaccuuugacucugaguaugucaagacaagaaccaaugauugggauuucguugucacaacggauauuuccgagaugggggcuaauuucaaagcugaaagagucauagacccaagaagauguaugaagccgguaauacucacagacggggaagaaaggguaauauuagcuggaccuaugcccguaacacacucaagugcggcacagaggcgugggcgaauagggagaaacccgaaaaaugagaaugaccaauacauuuauaugggugagccgcuagaaaaugaugaagauugugcacauuggaaagaggcaaaaauguuauuagacaauauaaacacaccagaaggaauaauaccaaguauguuugaacccgaacgagaaaaaguugaugccauagacggagaauacagguuaagaggagaagcaagaaagacauuuguugauuugaugcgcagaggagaccuaccagucugguuagcuuacaaaguagcagcagaagguauaaacuacgcagacagacgguggugcuuugacgguauuaaaaauaaccaaauauuggaagaaaacguagaaguagaaauauggacuaaggaaggugaaaggaaaaaguuaaaaccaagguggcuggacgcgcguaucuacuccgacccacucgcuuuaaaggaauuuaaagaguuugcugcuggcagaaagucacugacccuaaaccuuaucacagagaugggaagguuaccgacauuuaugacucaaaagacgagggaugcauuagauaauuuagcgguguuacauacagcugaagcgggugguagagcauacaaucacgccuugucugaguuaccugaaacucuggaaacguuauuacuuuugacuuugcuagcaacaguaacaggagggauauuucuguuccucaugagugggcgugguauuggaaaaaugacucuugguauguguuguauaauuaccgcaucuaucuuguuaugguaugcccaaauucaaccucauuggauagccgcuucgauaauucuugaguucuuucuaauaguacucuuaaucccagaaccagaaaaacaacggacuccucaggacaaucagcuaacauauguuguuauugcuauccuaacgguaguagcagcaacaauggcaaaugaaaugggauuucucgaaaagacuaagaaagaucuuggccugggcuccaucgcaacgcaacaaccagaaaguaauauccuugauauagaccugaggccagccucugccuggacccucuaugcagucgcaacaacuuucguaacaccgaugcuccgacauucuaucgaaaauuccucaguuaacguaucucuuacugcuauagcuaaccaagcaacaguauuaaugggccugggcaaaggguggccuuuauccaaaauggauauuggagugccacuuuuagcaauaggauguuacagucaagucaauccgaucacgcuuacagcagcccuucuauugcuugucgcacauuaugcaaucauagguccuggacuacaagcaaaagcaacgcgagaagcccagaaaagagcggcugccggaauaaugaaaaacccuacaguagaugggauaaccgucauagaccuugacccaauuccauacgauccaaaguuugaaaagcagcugggacagguuaugcuguuaauuuuauguguaacccagguauuaaugaugcgcacaaccugggccuuaugcgaagcucuaacacuagcuacuggaccuauuucuacacuuugggaagguaauccuggaagguuuuggaacacaacaauugcagucucgauggcaaacauauuucgagguagcuaucuagcgggugcuggacuuuuauucucuauaaugaaaaacacaacuaauacgagaagagggacgggcaacaugggagaaacguugggagaaaaauggaaaaguaggcuaaaugcacugggaaaaucggaauuucagauauacaagaaaucggguauacaagaaguugacaggacacuugcuaaggaagggauaaaacgcggugaaacugaucaucaugcagugucaagagguagugcaaagcuacguugguuuguugaaagaaauauggugacaccugaaggcaaaguaguugaucuagguugcgggcgcggaggcuggucguauuauugugggggcuugaaaaauguaagagaaguuaagggccuaacuaaaggagguccuggccacgaggaaccaauacccaugucaacauauggauggaaccuaguaagauuacaaaguggaguagauguguuuuucauuccaccagaaaaaugcgacacauuauugugcgauauuggugaauccagccccaauccuacgguagaagcgggucguaccuuaagaguauugaauuuagucgagaauuggcuuaauaauaacacucaguucuguauaaagguguuaaacccauacaugccgucuguaauugagaaaauggaagcauuacaaagaaaauacggaggcgcacuuguucgaaacccucuaucacggaauagcacacacgagauguauuggguguccaaugcaagugguaacauaguuaguagugugaauaugauuucgcgaaugcuaauuaacagauucacgaugcgacauaaaaaggcuacguacgaaccugacguggaucuaggcaguggcaccagaaacauaggaauugaaagcgaaauaccaaaccuagauauaauaggcaagcgaauugagaaaauaaaacaagagcaugaaacaucuuggcacuacgaucaagaucacccauauaaaacuugggcguaucaugguagcuacgaaacgaaacaaacaggaucagcuaguaguauggugaaugggguagugaggcuacugaccaaaccaugggacguacuaccaacugugacucagauggccaugaccgauaccacuccguucggucaacaaagaguguuuaaagaaaaagucgacacacggacacaagaaccgaaggagggaaccaagaaacuaaugaagauaacagccgagugguuauggaaggaauuaggcaagaagaaaaccccacgcaugugcacgcgugaagaauuuacaagaaaagucagaucuaaugcggcauuaggagccauauucacagacgaaaauaaauggaaaucagcgcgggaggccguugaagauucaagguuuugggaacucguugauaaagaacgaaaucuccaccuugaagggaaaugugaaacaugcguuuacaauaugauggggaagagagagaagaaacuuggcgaauuuggaaaagcgaaggggagucgcgcaauaugguauaugugguuaggcgccagguucuuagaguucgaggcuuuaggcuuccuaaacgaagaucacugguucagccgagaaaauucacuuaguggaguggaaggcgaaggacugcacaagcuaggauauauauuaagagacguaucuaagaaagagggaggcgccauguacgccgaugacacugcagguugggacacaagaauaacucuagaagauuugaaaaaugaagaaauggucacaaaucauauggaaggagagcacaagaaacuagcugaagcuauuuucaaacuaacauaucaaaacaagguaguccgcguucaacggccaacucccagaggcacaguaauggacauaauaucaaggagagaccaacgagguaguggacaaguugguaccuauggccuuaacacauucacaaauauggaagcccaacucauacgucaaauggagggagaaggagucuuuaaaaacauucagcaucugaccguuacggaggaaguggcuguacaaaauugguuggcuaggguuggaagagaacggcuaucuagaauggcaauaaguggugaugauuguguaguaaaaccccuagaugacagguucgcgaacgcacuaacugcuuuaaaugauaugggaaaaauacgaaaggauauacaacaaugggaaccuagcaaggguuggaacgacuggacacaaguuccauucugcucacaccauuuucaugaacuaauaaugaaagacggcagaguccuagucgucccuugucguaaccaagacgaacugauugggagagcaagaauaucacagggugcuggauggucccuaagagaaacugcaugucugggaaaaaguuacgcacaaauguggucacuaauguauuuucaucggagagacuuacgccuagcugcuaaugcaauuugcagugccguacccucucauuggguaccuacgaguagaacgacguggucaauucacgcaaagcaugaauggaugacuacagaagauauguuaacaguauggaauaggguauggauaagagagaaucccuggauggaagauaaaacaccaguagaaucaugggaagaaauuccguaccuugggaaaagagaggaccaauggugugguucuuuaaucggucuaacaaguagagcaacaugggccaaaaacauacaagcagcaauaaaccagguucguucucuaauaggcaaugaagaauauacugauuauaugccaucaaugaagagauuccgacgggaagaagaagaggccgguguauugugguga

SEQ ID NO: 22831 - RNA, 9876 nt, Artificial Sequence
  derived and/or modified CDS sequence (opt6) from DENV-2__FM210246__SS-prME
agugcugguaugauuauuaugcugauaccaacuguaauggcauuucaccuuacuacaagaaauggagaaccacacaugauaguagggauucaagaaaaagguaaaaguuuacuauuuaaaaccgaagacggaguaaauauguguacccuuauggcaauggacuugggagaauugugcgaggauacaauaacauacaaaugcccucuacugcgccagaaugaaccugaggauauagacugcugguguaauucgacuuccacauggguuaccuauggaaccugcacgacuacaggcgagcaccgucgagagaaacgcuccguggcguuggugccacacguaggaaugggauuggaaacuagaacagagacguggaugaguucugaaggggcauggaaacacgcacaaagaauagaaacauggauacuaagacaucccggauuuaccauuauggcagcuauuuuagcauacacgauugguacgacucauuuucagcgcgugcuaauuuucauacuacuaacagcuguagcgccgucaaugacaaugagguguauaggaaucucaaacagagauuuuguagaaggcgugagcggugguaguuggguugauauuguauuagaacaugggagcugcguaaccacuauggcgaaaaauaaaccaaccuuggauuuugaacucauaaaaacagaagcaaaacaaccggcaacauuaaggaaauacuguauugaggccaaauuaaccaacacuacaacggaaucgcgaugcccaacacaaggggagccuucacuaaaagaagaacaagauaaacgauuuguauguaaacauucaaugguagauaggggauggggcaacggaugugguuuauucggcaaaggagguauaguaacaugcgcuauguuuacuugcaagaaaaauauggaaggaaaaauuguacaaccagagaacuuagaauacacuauuguaguaaccccgcauagcggugaagaacaugcaguugguaacgauacaggaaaacauggaaaagaaauaaaaguaacaccacaaaguucaaucaccgaagccgaguuaacgggauacggaacaguaacuauggaauguagcccaagaaccggucuugauuuuaaugaaauggucuuacuacaaauggaaaauaaggcuuggcuaguucauagacaaugguuccuagaccuuccguugccguggcuuccaggugcagauaaacaagagaguaauuggauacaaaaagagacauuaguaacauucaaaaauccgcaugcuaagaaacaagacguaguuguucuaggaucacaagagggugccaugcacacagcacugacgggugcgacugagauucaaaugucaagcgggaauuuguuguucacuggacacuuaaaaugcagauugagaauggauaaacuucaguuaaaagggaugaguuauagcauguguacaggaaaauucaaaguaguaaaagaaauugcugaaacacaacauggcacuauagugauaagaguacaauaugagggagauggaaguccguguaaaauuccuuuugaaauuauggaucuugaaaaacguuauguauugggucgauugauuacaguuaaucccauagucacagagaaagauagccccguaaauaucgaggcugaacccccauuuggugacucauauauaauuauuggcgucgaacccgggcaauuaaaauuaaauugguucaagaaaggaucaagcauugggcagauguuugaaacaaccaugcgaggugcaaaacgcauggccauccuaggagauacagcuugggacuuuggcagcuuaggaggaguguucacgaguauaggaaaagcauuacaucaaguguucggcgcgaucuacggugcugcuuuuaguggagucucauggacaaugaagauucuuauaggggucauaaucaccuggaucgguaugaacucaagauccaccucgcuaagcguaucacucguauuaguagguauagucacgcuauaucuaggcguaaugguccaagcagauagugggugcguaguaagcuggaaaaauaaagaauuaaagugcggaucaggaauuuucauaacggauaacguacauacauggacugaacaguacaaauuccagccagaauccccgucuaagcucgcgucagcaauucagaaagcacaagaagagggcauaugcgggauacgaucaguaacucggcuagaaaaucuaauguggaaacaaauaacgccggaauuaaaucauauccuagcagaaaaugaaguaaaacuuacaauuaugacaggagauauaaaaggaauaaugcaagcaggaaaacguucauuacgaccccaaccuacugaguuaaaauauagcuggaaaacuugggggaaggcuaaaaugcugagcacagagagcuuuaaccaaacauuccuuauagaugguccggaaacggccgaguguccgaauacuaauagggcauggaauagucuagaaguggaagacuauggauucggaguuuucacaaccaacaucuggcuaaaguugaaagaaaaacaagaugcguucugugauuccaaauugaugucagcggcgauaaaagauaauagggcagugcacgcagauaugggcuauuggaucgagagugccuugaacgacacuuggaaaauagagaaagccucguuuauagaaguuaaaaacugucacuggcccaagucacauacauuauggucgaacggaguauuagaaucagaaaugauaauaccaaagaaccuagcaggaccagucagucaacauaauuacagaccaggauaucacacacaaauugcugggccauggcacuuggguaaacucgaaauggauuucgacuuuugugacggaaccaccguaauaguaacggaagacugcgguaauagaggaccuagccuccgcacuacuacagcuagcgggaaguuaauaacugaauggugcuguagaaguugcacacucccaccauuacgauaccgaggagaagauggauguugguacggaauggaaauacguccacuaaaagaaaaagaagaaaaccucgucaauucgcucguuaccgcaggacauggccagguugacaacuuuucucucggaguacuaggaauggcucuguucuuggaagaaauguugagaacccgaguagguacuaaacaugcgauacuguuaguagccguaucuuucgugacuuugauaaccggaaacaugucauucaaggacuuagggagaguggucguaaugguaggagcuacuauggccgacgauauugguauggggguuacuuaucuagcuuuacuagcagcauucaaaguccgacccacuuucgcagcggggcucuuacucagaaaauuaacaucaaaagaauuaaugaugacaacaauugggaucguucugcuaagccaauccacgauacccgaaacuguacuugaacucacugaugcacuagcccuugguaugaugguccugaaaauagugagaaacauggaaaaauaccaguuggcaguaacaaucauggcaauccuaugcguuccuaaugcgguaauuuuacaaaaugcauggaagguuaguuguacuauccuagcuguuguauccguuucgccucuauuauuaaccucaucucaacagaaaacagacuggaucccauuagcucuuacaauaaaggggcuaaauccaacggccauauucuugaccacauuaaguagaacaaauaagaaacgaucauggccuuuaaacgaagcuauaauggcugugggaaugguaucaauucuagcaagcucucuucucaaaaaugauauuccaaugacugggccucucguagcagggggacugcuuaccgugugcuauguuuuaacaggaagauccgcagauuuggaacucgaaagagcaacagacguuaaaugggaagaucaggcugaaaucagugguuccucgccuauccuaucgauuaccauaagugaagacggcagcaugagcaucaaaaacgaagaagaagaacaaacauugacaauucuaauacgaacuggauugcuaguaauaucgggauuguuccccaucucuauaccuaucacagcugccgcaugguauuuaugggaggucaagaaacaacgcgcugguguacucugggauguaccuucuccaccgcccaugggcaaagcggaacuagaagauggggccuauagaauaaagcaaaaggggauauuaggguacagccaaauaggagcaggcguauauaaagaaggaaccuuucauacgauguggcaugugacccguggagcaguauuaaugcauaaggggaagcgaauugaaccuaguugggcggacgucaagaaagaccuuaucucguaugguggcggauggaaacuugagggagaguggaaagaaggcgaggaaguacaaguacuugccuuagaacccggcaaaaauccuagagcuguacaaacuaaaccuggguuauucaaaacgaacacuggcaccaucggagcaguaucuuuggacuuuucuccagggacgucugguucgccgauaauagacaagaaaggcaaagugguaggacuuuauggaaacggagugguuacacgaucgggagcuuaugucucagcaauagcccaaacagagaaaucuauugaagauaauccggaaauagaagacgacauuuuucguaaaagacgucucacaaucauggacuuacacccaggagccgggaaaacuaaacgguacuuaccugcaauaguacgggaagcgauuaagcgcgguuuaagaacccugauauuagcccccacccgagugguugcggccgagauggaggaagcccuacggggacuuccuauaagauaccaaaccccagccauuagggcugaacacacuggaagagaaaucguagaucuuaugugccaugcuacauuuacaaugcgcuuacuaucaccagucagaguaccaaacuauaaccuaauaaucauggacgaagcucacuucacggacccugccuccauagcagcgcgcggauacauuagcacacgaguugagaugggugaggccgcgggcauuuuuaugaccgcaacgccuccaggcuccagagacccguucccacagucaaacgcaccaauaauagaugaagaaagggaaauaccagaaagaagcuggaacucgggacaugaauggguaacagacuuuaaaggaaagaccguuugguuuguacccucaauaaaagccgguaacgauauagcugcuugccuaaggaaaaauggcaaaaaggucauucaauuaucgagaaaaacauuugauucagaauauguuaaaacuagaacgaaugacugggauuuuguuguuacuacugacauaucugaaaugggugcaaacuucaaagcggaacguguaauagauccuagaagaugcaugaaaccaguuauucucacugacggggaggaacgaguuauuuuggcagguccaaugcccguaacacacucgucugcugcccaaagacguggaagaauuggaagaaaucccaaaaaugaaaacgaccaauauaucuauaugggagaaccucuugaaaacgacgaagauugcgcucacuggaaggaggcuaagauguuguuggacaacauaaacacucccgaaggaauaauaccuucgauguuugaaccagaacgugagaaaguagacgccauugacggcgaauaccguuuaagaggagaagcccguaagaccuuuguugaucuuaugcgaagaggagauuuacccgugugguuggccuacaagguagcugcugaagguaucaacuacgcagauagaagguggugcuuugaugguaucaaaaauaaucaaauauuagaagagaauguagaaguggaaaucuggacaaaagaaggggaaaggaagaaauugaaaccucguuggcucgaugcaagaauuuauucugacccauuagcacuaaaagaauuuaaggaauuugcugcuggaagaaagagcuuaaccuuaaaccuaauaacggaaaugggaagacugccaaccuuuaugacgcagaaaaccagggaugcauuggauaaccuagcaguuuuacauacugcggaagcagggggacgugcguauaaccaugcgcuuagcgaauuaccggaaacuuuagaaacucuuuuguuacuuacguugcuggcaacuguaacaggugguauauuucuauuuuugaugucugggcguggaaucgggaagaugacguuaggcauguguuguauuauuaccgcgagcauacuacuaugguaugcgcagauccaaccccacuggauugcggcauccauaauauuggaguucuuuuugaucguacuauuaauuccagaaccagaaaagcaaagaacaccacaagacaaucaauuaacauauguaguaauagcaauacugacugucguagccgccaccauggcaaacgaaauggguuuucuggagaaaacuaaaaaggaccucggacucgguagcauagcaacacagcagccugaaucuaacauauuggauaucgaucugagaccagcuagcgcauggacucuuuaugcaguagccacuaccuuuguaacaccuauguuaagacauaguauugaaaauucaagugucaaugucagcuugacggcuauagcuaaccaagcgacuguuuuaauggggcuaggaaaagguuggccguugaguaaaauggauauuggagucccuuugcuugcuaucggaugcuacagucagguaaaucccaucacacuaacugcagcucuuuuauugcuuguugcgcauuaugcuauuauaggcccaggauugcaagcaaaggcaacgagagaggcucaaaaacgagcagcugccggaauaaugaaaaauccaacaguagauggaaucacagugauugaucuagauccaaucccuuacgaucccaaauucgaaaaacaguugggacaaguuaugcuucuaauuuuguguguuacccaaguuuuaaugaugaggaccacaugggcucugugugaagcauugacauuagcuacagguccaauaucgacauuaugggaggguaacccaggccgauuuuggaauacuacaauagcuguaucaauggcaaauaucuuucgugguagcuaucuugcaggggcuggucuucuauucagcaucaugaaaaauacaacaaauacgagacgagguacagggaauaugggagaaacuuuaggagaaaaguggaaaucaaggcuaaaugcucucggaaaaagugaauuucaaauauacaaaaaguccggcauucaggagguggaucgaaccuuagcuaaagaagguauuaagcguggcgaaacagaucaucaugcggugagcagagguucggccaaguugcguugguucgucgaacgaaauaugguaacaccagaggguaaagucguagacuugggcugcgggaggggcggguggucguacuauugugggggacucaaaaauguaagagaaguuaaaggguugacuaaagggggucccggacaugaagaaccaaucccuaugucgacauacgguuggaaucugguacgucuccagucugggguugacgucuucuuuauaccgccggaaaagugcgacacguuauugugugauaucggugagagcuccccaaauccgaccgucgaagccggaagaacuuuaaggguauuaaaucuaguagagaauuggcuuaacaacaauacacaauucuguaucaaaguucuaaauccguacaugccgucgguaaucgagaaaauggaagcauuacaaagaaaauauggaggagcgcuuguacgaaacccucuuucucguaauucuacucacgagauguacuggguauccaacgcaucgggaaacauuguaagcucagugaauaugauauccagaauguuaauuaauagauuuacaaugagacacaagaaagcuacauacgaaccugauguugaucucggaucugggacgcgaaauauaggaaucgaauccgaaauaccgaauuuagacauaauaggcaaacgaauagagaaaauaaaacaagagcaugaaacaaguuggcacuaugaucaagaucaucccuacaaaaccugggcguaccaugggucauacgaaacaaaacaaacagguuccgcgucgucaaugguaaaugguguaguccgacuguuaacuaaacccugggauguccuaccuacagucacacaaauggcuaugacggacacuaccccuuuuggacagcaacgagucuucaaggaaaaaguagauaccagaacucaagagcccaaagaagguacgaagaaguugaugaaaauaacagcagaauggcuuuggaaagaacuagguaagaagaagacgccaaggauguguacaagagaagaauuuacaaggaaaguuagaagcaaugcggcauugggcgcuauauucacagaugaaaauaaauggaaaagugcuagagaggcgguagaagacucccgauucugggaauuaguugauaaggaaagaaauuugcaucuagaagguaagugcgaaacauguguauauaauaugauggguaaaagagagaagaaacuaggcgaguucgggaaggcaaaaggaucacgagcaauaugguacaugugguugggugcuagauuuuuggaauuugaggcacuggguuucuugaaugaagaccacugguucucacgagaaaauagcuuaucugguguagaaggggagggacuacacaaacuggguuacauucuaagggauguuagcaagaaagagggcggagcaauguacgcugaugacacagcuggaugggauaccaggauaacacuugaggacuugaaaaaugaagagauggucacuaaucauauggaaggugagcauaagaaacuagccgaagcuauauuuaaacuaacauaucaaaauaaaguaguaagaguacaacguccgacaccccgaggaacagugauggauauaaucagcagacgggaccaaagagguaguggacaaguaggaacauacggccucaauaccuuuacgaauauggaagcgcaauugauaagacaaauggaaggggagggaguuuuuaaaaauauacaacaccuaacagugacagaggaagucgcuguaaagaacuggcuagcucguguggguagggagagacuaagcagaauggcaauuagcggggacgacuguguaguaaaaccacucgaugauagauucgcuaaugcuuugacugcuuuaaaugauauggggaaaaucagaaaggauauacagcaaugggaaccuucgaaagguuggaaugauuggacccaaguuccuuuuuguucgcaccauuuucaugaauuaauaaugaaagaugggagaguccuaguaguccccuguagaaaucaagaugaauuaauaggcagagcacgcauaucacagggugcagguuggaguuugagagaaacugccugccuuggcaaaagcuacgcccagauguggucacuuauguauuuucaucggagggacuuacgccuugcagcuaaugcuauaugcucugcagugccgucucacuggguaccaaccucaagaacuacguggucaauucacgcaaagcacgaauggaugacuacagaggacauguuaacuguauggaaccgaguuuggauaagagagaacccguggauggaagacaagacaccaguagaaagcugggaggaaauaccguaccuugguaaaagagaagaccaauggugcggaucguuaaucggcuuaacuucacgcgccacaugggcgaagaauauacaagccgcuauuaaucagguuagaaguuuaauagguaacgaggaauauacugauuauaugccaucaaugaagagauuuaggcgagaagaggaagaggccgguguacucugguga

SEQ ID NO: 22832 - RNA, 9876 nt, Artificial Sequence
  derived and/or modified CDS sequence (opt6) from DENV-2__FM210207__SS-prME
ucggccggaaugauaauuaugcugauaccgacgguuauggcauuccacuuaacuacaaggaauggagaaccacauaugaucguaggaauacaagagaaaggaaaaucacuucucuucaaaacagaagaugggguaaacaugugcacucuaauggcuauggauuuaggugagcuuugugaggauacaauaaccuauaaauguccuuuauugaggcagaaugaaccagaagacauagacuguugguguaauucaacaucgaccuggguuaccuauggaacauguacaaccacaggggaacauagacgcgaaaaaagaaguguugcauuagucccgcacguagguaugggacuugagacuaggacagaaacuuggaugaguagugaaggugcauggaaacacgcucaaaggaucgagacauggauuuuaagacaucccgguuuuaccaucauggcagcaauauuagcauacacaauaggaacgacucauuuccaaagaguguugaucuuuauacuccuaacagccguugcaccaucuaugacaaugcgguguauugguauauccaauagagauuucguagaggguguaagcggcgggucaugggucgacauaguucuagagcacggcucgugugucacuacaauggcgaagaacaaacccacucuugacuucgaacugauuaagacagaagcgaaacaaccagcaaccuugagaaaauauugcauugaagccaaacuuaccaacacaaccacagaaagcagaugcccgacgcagggagaaccgucucugaaggaagaacaagacaaaagauuugugugcaagcacagcauggucgaccguggauggggcaacggcugcggguuauucggcaaagguggcauuguaacuugcgcaauguuuacgugcaaaaaaaacauggagggaaagauagugcaacccgaaaaccuagaauauacgauaguuguuacgccgcauuccggcgaagaacacgcugugggaaaugacacuggcaaacacgguaaagagauaaaggucacuccacaauccagcauaacugaagcagaacuuacuggcuauggaacgguuacaauggaauguucgccucgcacagggcuagacuuuaacgaaaugguucugcuacaaauggagaauaaagcuugguuagugcauagacaaugguuucuagauuuaccucuaccuugguuaccuggagcagauaagcaagaaagcaauuggauacaaaaggagacauugguuacauuuaaaaauccacacgcgaagaaacaggacgucguuguccuagguucgcaagaaggggccaugcacacagcucucacaggugcuacagaaauucaaauguccagcggcaaucuuuuauucacgggccaucuaaaaugcagauuaagaauggauaaacugcaauuaaaaggaaugucauauagcauguguacaggaaaauuuaaggugguaaaagagauugcagaaacacaacaugggaccauaguuauaagaguacaauaugaaggagaugggucacccuguaagauaccauuugaaauaauggacuuagagaaacgcuacguauuaggaagacuaauaaccguaaacccgauaguaacagagaaagauucgccgguaaauauagaagcagagccuccguuuggcgauucuuacauaauuaucgguguugagccagggcaacuuaaacugaauugguuuaaaaaaggaagcaguauaggccaaauguuugagacuacaaugaggggcgcaaaacggauggccauacuaggagauacggcaugggauuucgggucguuaggcggcguguucacuucgauaggaaaggcuuuacaucagguauucggagccaucuacggagcagcuuuuaguggagucaguuggaccaugaagauucugauaggagugaucaucacauggauaggaaugaacucuagaaguacaagccuuucaguuagccuaguauuagucggaauagugacccuauaucuagguguaaugguucaggcugauucugguugcguaguaucguggaaaaacaaggaauuaaaauguggauccggcauuuuuauaacggauaauguacauacauggacugaacaauauaaauuucagccggaaagcccaucuaagcuagcaucagcuauacaaaaggcacaggaagaaggaauauguggaauaagaucaguaacgaggcuggagaaccuaauguggaaacaaauaacuccagaauuaaaccauauuuuagccgagaaugaaguaaaacuaacgauaaugaccggugacauaaaaggcauuaugcaggcugguaaaaggucacuacggccacaaccgaccgagcugaaguauucauggaaaacguggggcaaggcaaagaugcuuuccacagagucuuauaaccaaaccuucuuaauagaugggccugaaacggcagaauguccaaauacaaauagagcuuggaacagucuggagguagaagacuacgguuuugggguguuuacaacaaacauaugguuaaaguuaaaagaaaaacaggacgcauucugugacagcaaauuaaugucugcugccauaaaggauaauagagcgguucaugcagacaugggcuacuggauagaaagugcacuaaaugacacauggaaaaucgagaaagcaucauucauagaaguuaagaacugccauuggccuaagucacacacauuauggucuaauggcguccuugaaagugaaaugauaauaccaaaaaaucuagcgggcccagucucacaacauaacuaucggccgggauaccacacacagauagcuggaccauggcaccuuggaaaacuagaaauggauuucgauuuuugugauggcacaacgguaauuguaacugaagacugcgggaauagaggaccuagcuuaagaacuacaacggcuuccggaaaauuaauaaccgagugguguugcagaucuugcacacuacccccauugagguaucguggugaggaugguuguugguauggcauggagauuagaccguuaaaagaaaaagaagaaaauuuggucaauucacuaguaacagcaggucacggucaaguugauaauuuuagucuuggaguacucggaauggcccucuucuuagaggagaugcuuagaacuagggucgguacaaaacacgcaauccuuuuaguggcugugucauucgugacacuaaucacgggcaacaugaguuuuaaggaccucggacggguagucguaauggugggcgcuacaauggcggacgacauaggaaugggcguaacguacuuagcucuacuggccgcuuuuaagguaagaccuacuuuugcagcaggccuauuauuaagaaagcucacaaguaaagaacuaaugaugacgacuaucggaauagugcucuuaucccagaguacaauaccugaaacagucuuagaauuaacagacgcguuagcauuaggaaugaugguucugaaaauaguaagaaacauggaaaaauaccaacuggcagugacuauaauggcaauacuauguguaccuaacgcagugauucuacaaaacgcuuggaaaguuuccuguacgauacuggcgguuguauccguauccccacuacuauuaacaucgucucaacaaaagaccgacuggauaccacuugcgcuaacuauaaaaggucuuaauccaaccgcuauuuucuuaacaacacuuucaaggacaaacaaaaaaagaaguuggccucuaaaugaagcuauuauggcggugggaaugguuucaaucuuagcaucuucccuacuaaaaaaugauauuccaaugacaggaccguuagucgcagguggauuauuaacaguuuguuacguauuaacugggagaagugcugaccuggaauuggaaagggcgacggacguaaaaugggaagaucaagcagagauaucugggagcucucccauauuaaguauaacgauuucagaggauggauccaugagcauaaagaacgaagaagaagaacaaacacuaacaauccuuauucgcacagggcuauuaguaaucucaggccuguuuccaauaagcauaccuaucacggcugcagcaugguaucuaugggaaguuaaaaaacaaagagcaggaguuuuaugggauguacccucgccaccaccaaugggaaaagcugaacuagaggacggagcauauagaauuaaacaaaaagguaucuugggauacucacagauaggcgcgggaguguauaaggaaggcacuuuucauacgauguggcauguuaccagaggagccguacuuaugcacaaagguaaaagaauugaacccuccugggcagauguuaaaaaagauuuaauaucuuauggaggcggauggaaauuagaaggagaauggaaggaaggagaggaggugcaaguguuagccuuggagccaggaaaaaacccccgagcaguucaaacaaaaccgggauuguuuaagacaaacacagggacaaucggggccguaagccuagauuuuucaccugguacgagcggaaguccgaucauagauaaaaaggguaaagugguuggacuguauggaaacggaguuguaacccgaucaggugcauaugugucagcaaucgcacaaacugagaaaucuauagaagacaacccagaaauagaagaugacaucuucagaaaaaggagauuaacaauuauggauuuacaccccggagcagguaagacgaagcgauauuuaccagcgauaguaagagaggcgauaaagcguggcuuaaggacauuaauuuuagcuccuacaagaguagucgcagcagaaauggaagaagcguuacgaggacugcccauaagguaccaaacgccggcuauuagggcggaacauacgggacgugaaauuguugaucugaugugucaugcaacguuuacaaugaggcuucuaucgccaguacgcgucccaaauuauaauuuaaucaucauggaugaagcacauuucacagauccugccuccauagcagcaaggggguauauaucaacuagaguugaaaugggugaagccgcugggaucuuuaugacugcaacaccacccgguuccagagacccuuucccacaaucaaaugccccgaucaucgacgaagaaagggagaucccagaacgguccuggaauucaggucacgagugggugaccgacuuuaaaggcaagacuguuugguuuguuccauccauaaaagcuggaaaugacaucgcugccugucuuaggaaaaauggcaaaaagguuauacaacugucuagaaaaacauuugacagcgaauauguaaaaacccgaaccaaugacugggacuuugugguaacuaccgacauaucugaaaugggagcgaauuucaaagcagaacgcguaauugacccucgaagaugcaugaaaccaguuauacuaacugacggcgaggaaagggugauacuggcaggaccuaugccggugacucauuccagcgcagcucaaagaagaggcagaauagguagaaacccuaaaaaugaaaacgaccaauacauauacaugggagaaccucuagagaaugaugaggauugcgcgcacuggaaggaagcaaagaugcuccuggauaacauuaauacaccugaagggauaauucccucaauguucgaaccagaacgagaaaaaguggacgcuauugacggugaguaccggcuaaggggagaggccagaaaaaccuuuguugauuugaugaggcguggugauuuaccagucuggcucgccuauaaaguagcugcggaggguauuaauuaugccgaccggagauggugcuucgauggaaucaaaaacaaucaaauccuagaggagaauguggaagucgaaauauggacuaaagaaggagaaagaaagaaacuaaaaccaagauggcuagacgcacgaauauauucggacccucuggcguugaaggaauuuaaggaauuugcggcugguagaaaaucgcucaccuuaaauuugauaaccgagaugggacgacuaccaacauuuaugacccagaagacucgagacgcgcuugauaaucucgcuguacuacacacugccgaagcugggggaagagcauauaaucaugcauugucagaacuuccggaaacauuggaaaccuugcuacuuuugacuuuacuagccacaguuaccggaggaaucuuucuauuuuuaaugagugggagagguauuggaaaaaugacuuuaggcaugugcuguauaauaacagcaaguauccuguuaugguacgcucaaauacagccucacuggauugcagcaagcauuauccuagaguuuuuucugauaguauuacuaauaccugaacccgaaaagcaaagaacaccccaagauaaccaauuaacauauguuguaauagcgauauuaacaguuguagccgccacaauggcuaaugaaaugggcuuuuuagaaaaaacuaaaaaggacuugggacuagggagcauugcaacccagcagcccgagucaaauauccuggauauagaccuucggccagcuucagcauggaccuuguaugcgguagcaacuaccuucguuacuccaauguuacgacauaguaucgaaaauaguuccguaaauguaucacuaacagcaauagcaaaucaagcaacaguguuaaugggguuaggaaagggauggccguugaguaaaauggauaucggcguaccacuauuagcaaucgguugcuauucucaggucaacccuaucacuuuaacagcagcccuauuguuguuggucgcacacuaugcuauuaucggucccggcuugcaagcaaaagcgacccgagaagcgcaaaaaagagcagccgcgggaaucaugaaaaaucccacgguugacggcauuaccguuaucgaccuugaccccaucccuuaugauccaaaguucgagaagcagcuaggacaaguaauguuacuuauacuaugugucacgcaggugcucaugaugcguacuacgugggcauuaugugaggcacuuacuuuagcgacgggaccgaucucaaccuugugggaaggcaaucccgguagauuuuggaacacgacaauagcaguauccauggcgaauauuuuucgagggucuuauuuggccggggcuggguuauuauucucaauuaugaaaaacacaacgaacacccguagaggaacggguaauaugggggagacuuuaggagaaaaguggaaaagcaggcuuaacgcacuaggaaagaacgaauuucagaucuacaaaaagagugguauacaagaaguugaucgaacccuagccaaggaaggaauuaaaaggggugagacggaucaucaugccguaaguagaggaagugcgaaacuaagaugguuuguggagcgcaacauggucaccccagaaggaaaaguaguggacuuaggcugcgggagagguggcuggagcuauuauuguggaggucuuaaaaacgugcgggaaguaaagggucuaaccaaaggaggacccgggcaugaagagccgauucccaugagcacauacggguggaaucuuguucgcuuacaaaguggaguagacguauuuuuuauuccaccggaaaagugugauacccuguugugugacauuggcgaaagcagccccaauccaacuguugaagcggggaggacauuaagaguacuaaaucuaguggaaaauuggcuaaauaauaacacgcaauuuugcauaaagguuuuaaacccguauaugccuucagugauagaaaagauggaagcauuacaaaggaaauacgguggagcccugguaagaaauccguugucacggaacucgacacaugaaauguacuggguaucgaaugcaagcgguaacauuguaucuucggugaauaugauaagccggaugcugauuaaucgauuuacgaugagacauaaaaaagcuacauaugagccggauguugaccugggcagugguacaagaaacaucggcauugaaucugaaauaccgaacuuagacauaauugggaagcgaauagaaaagauaaagcaagaacaugaaacauccuggcauuaugaccaggaccacccauauaaaacaugggccuaucaugguucauaugagacaaaacaaacagggucagcaagcagcaugguaaaugguguuguacgccuacuaacaaaaccuugggacguuuuacccacuguaacucaaauggcuaugacugauacaaccccauucggacagcaaagaguauuuaaagaaaaaguagacacaagaacucaagagcccaaagagggaacaaaaaaauuaaugaaaauuacagccgaauggcuauggaaagaauugggcaaaaaaaaaacuccccgcauguguacgcgcgaagaauuuacacgaaaagugcgaucuaacgcggcauuaggugcaauauuuaccgaugaaaauaaauggaaauccgcaagagaggcaguagaagacagcagguucugggaauuaguggauaaagaacgaaacuugcaccucgaaggaaagugugaaacuugcguguauaauaugaugggaaaaagagagaagaaacucggagaauuuggaaaagcgaaaggcucucgagccauaugguauauguggcuaggagcgagauuuuuagaauucgaagcuuuaggcuuucuaaaugaggaucauugguuuucgcgagaaaacucacuaucuggggucgagggagaaggauuacacaaauuagguuauauauuacgagauguuaguaaaaaagaagguggugcgauguacgccgacgauacagcagguugggauacuagaauaacccuggaagacuuaaaaaaugaagaaauggucacgaaucacauggaaggugaacacaaaaaauuagccgaagcuauuuuuaaguugacguaccaaaauaaaguagucaggguacagcguccuaccccacgagggacagugauggauauaauaagccguagagaccaacgagggaguggacagguggguacuuaugggcuuaacacuuucaccaacauggaagcacaauuaauaagacaaauggagggagaagguguuuuuaagaauauacaacaucugacaguuacugaagaaguggccguacaaaacuggcuagcaagaguaggucgagaacgccuaucaaggauggcaaucuccggggacgacugcguuguaaaaccuuuagacgauagauucgcgaacgcacuaacugcauuaaacgauauggguaaaauaagaaaagacauucaacagugggaaccaagcaaaggauggaaugacuggacacaaguaccauuuugcagccaucauuuccacgagcuuaucaugaaagauggcagaguuuuaguagugcccuguagaaaucaagaugaacucauuggccgagcgcgcauaagucaaggagcaggguggucgcucagggaaacagcauguuuggguaaaaguuaugcucaaauguggagucuaauguauuuucaucgucgugaccuaagacuagcagccaaugccaucugcagugcgguaccaucacauuggguaccaacaucaagaacaacgugguccaugcaugccaagcaugaguggaugacuacggaggauauguuaacugucuggaaccgagucuggauuagggaaaauccguggauggaagauaagacgccaguagaaucgugggaagaaauuccauaucuaggaaaacgagaggaucaauggugugguagucucauagguuuaacaaguagagcaacuugggcaaaaaacauacaagcggcaaucaaucaaguccgaagucuuauuggaaacgaagaauacacggauuacaugccuucaaugaaacgguucagacgcgaggaagaagaagcggguguuuuaugguag

SEQ ID NO: 22833 - RNA, 9876 nt, Artificial Sequence
  derived and/or modified CDS sequence (opt6) from DENV-2__FM210238__SS-prME
acggcaggaaugauaauaaugcuuauacccacagcgauggcauuucacuugaccacacgcaauggggaaccgcauaugauuguagggcgacaagaaaaaggcaaaagucuguuauuuaaaacagaagauggaguuaauaugugcacauuaauggcaauagacuugggagaacugugugaagacacuauaaccuauaaaugcccacuacuaagacaaaaugaaccagaagauauagacuguugguguaauucaaccucaacgugggugacuuauggcaccuguacgacaaccggugaacaucgaagagagaaaagaagcguugcucuaguuccucauguaggaauggggcuagaaacaagaacagaaacauggaugucaagugaaggagcuuggaaacaugcgcagagaauagaaaccuggauauuacgucacccaggauuuacaauaauggcagccauucuggcauauacaguagguacaacucacuuccaacgggcacucauauuuauuuugcucgcagccgucgcuccauccaugacgaugcguuguauaggaauuucaaauagagacuucguagaaggggugaguggcggaucuuggguagacauagucuuggaacauggaaguugugugacaaccauggcuaaaaacaaaccuacuuuagauuuugaacuaauaaaaacagaagcuaaacaaccugcgacauuacgcaaauacugcauugaagcgaaacuaacgaauacuacgacagaaucaagauguccaacgcaaggagaaccgucacuuaaugaagaacaagauaaaagguuuguguguaaacacucaaugguagauagagguuggggaaacggauguggacuauucgggaaagggggcauuguaacaugugcaauguuuacaugcaagaagaauauggagggaaaaaucguacagccagaaaacuuagaauacacaaucgugauuacaccacauucaggcgaggaacaugcuguuggaaaugacacgggaaaacacgguaaagaaaucaaaauaacaccccaaaguccuauaacagaagcagaauuaacaggguauggcacaguaaccauggaguguucccccaggacuggcuuagauuuuaacgagauggucuuauuacaaauggaagacaaagccuggcuaguccaucggcagugguuuuuagauuuaccucugcccuggcuacccggagcggauacacaaggaaguaacuggauacagaaagaaacauuaguaaccuucaaaaauccacacgccaagaaacaggacgucguaguauuagguagccaggagggcgccaugcauacagcucucacuggagccacagaaauacaaaugucaucaggaaaccuccuauuuacagggcauuugaaaugccgcuugagaauggauaaacuacaacuaaaaggaauguccuauuccauguguacagggaaauuuaaaauugucaaagaaauagcagaaacccaacauggcacgaucguaauccgcguacaauaugaaggugacggaucaccauguaaaauuccauucgaaaucauggauuuagagaaaagacaugugcuaggucguuuaauaacaguaaaccccauaguuacagaaaaagauucccccgucaauaucgaagcugagccuccguuuggggacagcuauauaauuaucggaguagaaccugggcaauuaaaacuaaauugguucaagaaaggaaguaguauuggucagauguucgaaacgacuaugaggggagcaaaaagaauggcaauacugggagauacugcaugggauuuugguagccuugguggcguguuuacuagcauuggcaaggcucugcaucaaguuuucggggcuauauauggagcagcauucagcggcguaagcuggacgaugaaaaucuuaauuggaguuauaauuacauggauaggaaugaacucaagaagcaccagcuuaaguguaagucuuguauugguuggcgucauaacgcuauacuuaggagcaaugguucaagcugacaguggguguguuguaucauggaaaaacaaagaacuuaaauguggcuccggaauuuucaucacagauaacguccauacauggacugagcaauacaaguuucaaccggagucaccaucuaaacuagcaucagcuauccagaaggcccaugaggaagguauaugugguauaagaucugucacacgccuagagaaccugauguggaaacaaauaacucccgagcuaaaucauauacucucugaaaacgaaguaaaacugacuauuaugacaggggauauuaaaggaauuaugcaggcggguaaaaggagcuuaagaccucagcccaccgaacugaaauacucauggaaaacuuggggcaaagcaaaaauguugucgacagaaagccacaaccaaacguuucugaucgaugguccugaaacagcagaauguccaaacacgaauagagcauggaacagcuuagagguagaggacuacggauuuggaguuuuuacuaccaauauuugguuaaaguuaagagagaagcaggaugucuucugcgauucaaaacuuauguccgcggcuauuaaagauaauagagcagugcacgcagacaugggauauuggaucgaaagcgccuuaaacgauacauggaaaauggaaaaagcaucauucauagaagugaaaagcugucauuggccgaaaagucauacccuauggucgaacggcguacucgaaucugagaugaucauaccaaaauccuuugcuggucccgucagucaacacaacuacaggccuggauauuauacacaaacggcaggccccuggcaucuaggcaaacuugaaauggauuucgacuucugugaaggaacuacagugguaguuaccgaagacugcggaaaccgaggaccaagccuucgcacgacaacggccucagggaaauuaauuacagaaugguguuguagaucaugcacccucccaccacuaagauaccggggcgaagauggcugcugguacggaauggagauuaggccauugaaagaaaaagaagaaaauuugguaaacucauuaguaacagcaggacaugggcaaauugauaacuuuucauuagggguuuuaggcauggcuuuguuucuugaagaaaugcuuagaacucgaguaggaacgaaacacgcgauucuccucgucacuguguccuucgucacacuaauaacugggaauauguccuuuagagacuuaggcagaguaaugguuaugguaggagccgcgaugacagacgauauaggaaugggugugacuuacuuagcauuguuagccgcauuuaaaguucgaccaacauuugcugcaggucuauugcuaagaaaauuaacaucaaaagagcuaaugauggcuacaauagguauagcuuuacuaucucaaucaacaauaccggaaaccauacuagaguuaaccgaugcacuagcccuagggaugauggugcuaaaaauaguccggaacauggagaaauaucaauuggccguuaccauuauggcuaucuccugcgugccuaaugcaguuauuuugcaaaaugcguggaaagucucuuguacaauauuagccgcaguuucagugucuccacugcuacuaacauccucacaacaaaaagcggauuggauaccacucgcguuaacaaucaaaggucuaaauccuaccgcgauuuuucuaaccacgcuaucacgaacaaguaagaaacgcucuuggccccugaacgaagccauuauggccguuggcaugguaaguauccuugccucgucgcuacucaaaaaugauauuccaaugacggguccuuuaguugcuggcggauuacuaacuguauguuacguacuaacaggucguagugcagaucuagagcuugaacgugcuacagauguuaaaugggaagaucaagcugagaucucaggcucuagucccauacuuucaauaacaauagcggaagaugguagcaugagcauuaaaaacgaggaggaagaacaaacacuuacuauucuaauaagaacugguuuguuaguuauuuccggacuauucccuguauccaucccaauaacagcugcugcaugguaccucugggaagugaagaaacaacgcgcaggggucuugugggauguucccaguccuccacccguuggcaaagcagaacucgaggacggcgcauauaggauuaaacaaaaggguauauuaggauacucgcaaaucggcgccggaguuuauaaagaagguacauuucacacaauguggcauguaacaagaggcgcugucuuaaugcauagagguaaacguaucgagccgaguugggcagacguuaagaaagacuuaauuagcuauggcggagguuggaaacuugaaggagaauggaaagaaggugaagaaguucaaguuuuagcuuuagagccuggcaaaaacccccgagcaguucaaaccaaaccugggcuauucaaaacaaauacuggaacaauaggcgccguaucguuagacuuuucgccaggcaccucuggaagucccaucguagauagaaaggguaagguaguuggauuauacggaaauggcgucguaacccguaguggggcauaugugucagcuauagcgcaaacggaaaaaucaaucgaagauaaucccgagauagaagaugacauuuuuaggaaaaagcguuuaacuauaauggaucuucaucccggugcaggaaagacaaaacgauaccuucccgcaauuguccgagaagcgauaaaaagaggacuucguaccuuaauauuagcgccaacaagaguugucgccgcagaaauggaagaagcacuuagggguuuaccuauucgauaucaaacgccggcgaucagagcugagcauacugggcgagaaaucguagaccuaaugugccaugcaacguucacuaugagauuacuaaguccugugaggguaccuaauuacaaccugauuauuauggaugaagcccauuucacagauccugcuagcauugcggccagggguuacauaucaacaaggguagaaaugggcgaagcagcaggaauuuuuaugacugccacgccucccgguucacgugacccauuuccgcaaucgaaugcaccaaucauggacgaggagcgugaaauacccgaacgaaguuggaauagcggucaugaauggguaacggacuucaaggggaagacagugugguuuguaccuucaauaaaggcgggaaaugauauugcggcuugccuaaggaaaaacgguaagaaaguaauacaauugucgcguaaaaccuucgacagugaauacguaaagacucguacaaaugauugggauuuuguuguaaccaccgauauuuccgagaugggugcuaauuuuaaagcagaaagaguaauugacccaagacgauguaugaagccaguaauauuaacagauggcgaagaaagaguaauuuuagcaggaccgaugccuguaacacacaguuccgcugcccaacgucgcgguagaaucgggagaaaucccaaaaacgaaaaugaucaauauauauauaugggcgaaccccuugaaaacgacgaagauugcgcacauuggaaggaggcuaaaaugcuccuggauaacauaaauacaccagaggguauuauuccgucuauguuugaaccagagagagaaaaaguugaugccaucgauggugaauacaggcuccgcggcgaggcuagaaaaacauucguggauuuaaugagaagaggggauuuacccguaugguuagcauacagaguagcugcagaagguauuaauuaugcggaucgacggugguguuucgauggugucaaaaaugaccaaauacuagaggaaaacguugaaguagagaucuggacuaaagaaggggaaagaaagaaacugaaaccacggugguuagaugcaaggauuuauucagauccacucgcacucaaagaguucaaagaauuugccgcagggagaaaaagucugacauuaaaucuaauaacggaaaugggccggcuaccgacauuuaugacucaaaaagcgagagaugcuuuggacaaucuagcaguccugcacacugcagaagccggugggagagcauacaaccacgcauuaucggaacuaccugaaacacuugaaacucucuuacuucuuacuuugcuugcgacaguaacgggaggcauauuuuuauuucugaugagcgguaaaggggugggaaaaaugacuuuagggauguguuguaucauuacagcaucaauuuuacucugguacgcucaaauacaaccacauuggauagcugcaucaauuauuuuagaguucuuucuaauaguauuacucauacccgaaccggagaagcaaagaacaccucaggauaaccaauuaacauauguaguaauugcaauauugacagucgucgcagcgacaauggccaaugaaaugggcuucuuagagaaaacuaagaaagauuuaggcuuaggaucaaucgcuacacaagagcccgaaagcaacauacuggacaucgacuuacggccggcuagugcauggacauuauaugccgucgcuacaacauuugugacccccaugcugcgccacucgaucgaaaauaguuccguaaauguuaguuugacugcuauagcaaaccaagcuacugucuugaugggauuagguaagggauggccucuuagcaaaauggacauaggaguuccauuacucgcgaucgguuguuauagccaaguaaauccgauuacuuuaacggccgcccuauugcuacuuguagcucauuacgccauuaucgggccgggauuacaagcuaaggcaacucgggaagcucaaaagagggcugcggcaggaauaaugaaaaaucccacuguagacgguauuacuguaauagaucuugacccgaucccuuacgacccuaaauuugaaaaacaacuaggacaagugaugcuuuuaaucuugugcguuacgcaagugcuuaugaugagaacuaccugggcauuaugcgaagcauuaacauuagccacaggaccaauaucuacacuuugggaagguaauccagguagauuuuggaacacuacuauugcaguaagcauggcgaacaucuucagggggucguauuuagcaggggcgggucuuuuauucaguaucaugaaaaauacuacuaauacccgacgagggacgggaaacauaggagaaacauugggagaaaaauggaaaagcagauugaacgcacucgggaaaucugaauuucaaauauacaaaaaguccgguauccaagaaguggacaggacgcucgcaaaagaaggaauaaaacgcggggagacagaccaucaugcagugucaaggggaucggcaaaauuaagaugguucguugaacguaauaugguaaccccagagggcaaaguuguugaccuuggauguggacguggaggauggucguauuauugugggggacuaaagaaugugagagaaguaaaaggauugacaaaaggaggaccaggacacgaagaaccaauaccgaugucgacuuauggguggaacuuggucaggcuucagucaggcguagacguauucuuuacaccaccagagaagugcgauacccuuuugugugauauaggagaauccucaccgaacccgacaauagaggcgggucgaacccuccgcgucuuaucucuaguugaaaacuggcuaaacaaugacacgcaauucuguauaaagguacuaaacccuuauaugccaaguguaauugagaaaauggaaacuuuacagagaaaauauggaggagcauugguucgaaauccacuaucuaggaauagcacacacgagauguacugggugucuaacgcgacugguaacauaguuagcagugugaauaugauaucacgcaugcuuauaaacagauuuacgaugaaacacaaaaaggcaacauaugagccugauguggaccucgguucagguacacgaaacaucgggauugagucugagauaccaaaccuagauaucaucggaaaaagaauagagaaaauuaaacaagaacaugaaacgaguuggcacuacgaucaagaucauccuuauaaaacaugggcauaucacgguucuuacgaaacaaaacagacagggucugccuccucaaugguaaaugguguuguacgucuuuuaaccaaaccgugggauguagucccaaugguaacucaaauggcuaugacugauacuacuccuuucggucaacaaagagucuucaaggaaaaaguagauacccgcacgcaagagccuaaagaagguacaaagaaacucaugaaaauaacagcggaaugguuauggaaagagcuaggcaaaaagaaaacaccacggauguguacacgugaagaauuuacgcggaaaguacguaguaacgcugcauugggagcaauauuuacagacgaaaauaaauggaaaagcgcacgggaagccgucgaagauagcagauucugggaauuaguugacaaagaacgaaaucuacauuuagaagguaaaugugaaaccugugucuacaauaugaugggaaaacgcgagaagaaacuaggugaguucggaaaggcaaaaggcucccgcgccauaugguauauguggcuaggcgcucgguuccuagaauuugaagcucuaggauuccuaaacgaggaccacugguuuagccgcgaaaauucacucucaggagucgagggagaaggauuacacaaauuggguuacauacuuagggauguuaguaagaaagaagggggcgcaauguaugcagaugauacagcugggugggauacuagaauaacauuagaagaucugaagaaugaggaaaugguuacaaaucacauggaaggagaacauaagaaacuggcugaagcaauauucaaacucacauaccaaaauaaaguagucagaguacaaagaccaacuccaagggggacgguaauggacauaauaaguagacgagaccaaagaggaucaggacaaguuggcacuuacggccucaauaccuuuacaaauauggaggcacaacugauacgacaaauggaaggcgaaggaguauucaaaagcauacaacgauugacuguuacugaagaaauagcgguacaaaauuggcuagcgcguguuggaagagaacgccuuucaagaauggcuauaagcggggaugacugcguuguaaagccuuuggaugacagguuugcgucagcguuaacggcauuaaacgacaugggcaaaguucgaaaggacauacaacaaugggagccaucuaggggauggaaugacuggacucagguaccuuuuuguucacaccauuuucacgaauugauaaugaaagacggaagagugcuuguuguuccaugucgaaaccaagacgaacuuauaggccgagcucguauuagucaaggggcagguuggucccuaaaagaaacagcuugucucggaaagucauaugcgcaaauguggagucuaauguacuuucaucgacgugaucugagacuagcagcaaacgcuauuugcagugcuguucccagucauugggugccuacuagcaggacaacauggagcauucacgcaaagcacgaauggaugacgacagaagauaugcuaacaguuuggaaccgaguguggauucaagaaaaccccuggauggaggauaaaacuccugucgagucgugggaagaaguaccuuacuuagggaagagggaagaucaguggugcgggucacugauuggucuuacgagccgagcuacaugggcuaaaaauauccaaacagcaaucaaccagguuagaagccucaucggaaaugaagaguauacagauuacaugccuuccaugaaaagguuuagacgcgaagaagaggaagcuggugucuugugguaa

SEQ ID NO: 22834 - RNA, 9876 nt, Artificial Sequence
  derived and/or modified CDS sequence (opt6) from DENV-2__FM210224__SS-prME
acggcaggaguuauaauuauguuaaucccuacagcaauggccuuucauuuaacgacaagaaauggagaaccacacaugauaguaggaagacaagaaaaaggcaaaagccugcuuuuuaaaacugaagaugggguuaauaugugcacauuaauggcuaucgaucuuggggaacuuugcgaagacacaauaacuuauaaauguccucuuuugagacaaaaugaaccagaagauaucgacuguugguguaauaguacaucuacaugggugaccuauggcacauguacgacaacaggagaacacaggcgcgagaaaaggaguguggcauuaguuccgcacguaggaaugggccuugagacaagaaccgagacuuggaugucaagugaaggcgcguggaaacacgcgcaaaggauagaaacauggauacuaaggcaucccgguuuuacaauaauggcagccauacuugccuacacuauagguacaacgcacuuucaacgcgcuuugauauucauacuucuuacagcugucgcuccaucaaugacaaugcguuguauaggaauaucuaauagggacuucguagagggaguaucaggggguucauggguagauaucguccuagaacaugggaguuguguuacaacaauggccaaaaauaaacccacacuagacuuugaauuaauaaaaacagaagcgaaacaacccgccaccuugaggaaauacuguaucgaagcaaaauugacgaauacaacuaccgaaucccgaugcccuacacaaggugaaccaucauuaaaugaagaacaagauaaaagauuuguaugcaaacacuccaugguagaucgaggaugggggaauggguguggccuauuuggaaaagggggcaucguuacgugugcaauguuuacguguaagaaaaacauggagggaaaaauaguucaaccagaaaauuuagaauauacaauuguaaucacaccacauucgggcgaagaacacgcuguagguaaugacacaggaaaacaugguaaagagauuaaaauuacgccgcaaagcucuauaaccgaagcagaacuaacaggguacgggacaguaacuauggaauguaguccccgaacaggucuagauuucaacgaaaugguccuuuuacaaauggaagacaaagcaugguuaguacaccgacaaugguucuuagaccuaccacucccuugguugccuggugcagacacucagggaaguaauuggauccaaaaagaaaccuuaguaacguucaaaaauccacacgccaagaaacaagacguaguaguucuugguucgcaagaaggagcaaugcacaccgcgcucaccggagcaacagagauccaaaugucaucagggaaucugcuauuuacuggucauuuaaaaugucgucugagaauggacaaauuacaauugaaaggcaugaguuacaguauguguacggggaaauuuaaaauuguaaaagagauagcagaaacucaacaugguacaaucguaauacgaguacaguaugaaggagauggcaguccaugcaaaaucccauucgagauaauggauuuggaaaaacgccacguucuaggaagauuaauuacgguaaauccuauaguaaccgagaaagauucgccaguuaacauagaagcagaaccacccuuuggagacucauacauuaucauugggguugaaccaggacaacucaaacuuaacugguuuaagaaagggagcaguauuggccaaauguucgaaaccacgaugcgaggagcaaaacggauggcaauucugggagacacggcgugggacuuugguagucuaggaggugucuuuacaucaauuggaaaggcauuacaucaaguuuuuggggccauauauggagcggcuuucucgggugucucuuggacaaugaaaauuuuaaucggcgcgauaauaacuuggauaggaaugaacuccaggucgacgagucuaucuguuagccucguauuagugggcguaauuacauuauaccuuggagcaaugguacaagcugauucagguugugucguaaguuggaagaauaaagagcucaaaugugguucaggcaucuuuaucacggauaauguucauacauggacggaacaguacaaauuucaaccggaaucuccaagcaaauuagccagcgccauucaaaaagcgcaugaggagggaauauguggaauacgaucaguuaccaggcucgaaaaucucauguggaaacaaauaacaccggaguuaaaucauauacuaagcgaaaaugaaguuaaauuaacgauaaugacuggugauauaaaaggcauaaugcaagcaggaaaacggaguuuacguccucaaccaacagaacuaaaguauucuuggaaaacaugggggaaagcaaagauguuaucaacugaaucgcacaaucagaccuuucuaauagauggacccgagacugcggaguguccaaauacaaaccgagcguggaacucguuagaagucgaggacuaugguuuuggcguuuuuacaaccaauauaugguugaaacugagggaaaagcaagauguauuuugugauucgaaauuaaugagcgcagcuauuaaagacaaucgggcugugcacgcagacaugggauauuggauugaaucagcccuaaaugauacauggaaaauggagaaagcaaguuucauagaggucaaaaguugucacuggccgaaaucucauacauuauggucaaacggaguucuugagagugaaaugaucauacccaaaucauuugcaggccccguaagucaacauaauuaccgacccgguuacuacacacaaacagcugggccguggcaccuaggaaaauuagaaauggacuuugacuuuugugaggguacaacagucgucgucacugaagacugcggaaaucgcggccccucuuuaagaacuacaaccgcaucagguaaacuaauaaccgagugguguugucgguccugcacauuaccgccacuaagauacaggggugaagauggauguugguacggaauggagauucgaccacuaaaagaaaaagaagaaaaccuagucaauucacuuguaacggccggccacgggcagauagauaauuucucguuaggaguucuaggaauggcccuguuucuagaagaaauguuaagaacuaggguaggaacuaaacacgcuauacuacuugucgccguauccuuuguuacacuaauuaccggaaauaugagcuuuagagaccucggaagagugauggucaugguuggugcaacaaugacagaugauauagguaugggagugacuuaucucgcuuuacuagccgcuuucaagguucgucccaccuucgccgcuggacucuuauugagaaagcucacuucaaaagaauuaaugauggcuaccaucggaauagcacucuuaagucagucaacaaucccugagacaauacuugaacuaaccgaugcccuagcgcuaggaaugaugguguugaaaaucguuagaaauauggagaaauaccaauuagcagucacaauaauggcgauuagcuguguacccaaugcaguaauauugcaaaacgcuuggaaagugaguuguacgauuuuagcggcuguaucggucucgccacuacuacuaacuuccagucaacagaaggcggacuggaucccccuggcucugaccauuaaaggauuaaaccccacagcaauuuucuuaacaacauuaucaagaacgucuaagaaacguaguuggccauuaaaugaagcuauuauggcaguggggaugguaagcauacuagccucuaguuuguuaaagaacgauauaccgaugacgggaccucucguagcagggggcuuacugaccgugugcuacguccuaacagggagaucagccgaucuugaacucgaacgcgccacagauguaaaaugggaagaccaagccgaaauaaguggaaguucucccauuuuaagcauuacuauaucagaagauggaaguaugucuauuaaaaacgaagaagaagaacaaacgcuaacuauuuuaauucguacgggauugcucguaauaucuggacuuuuuccagugucaaucccuauuacugcagcagcgugguauuuaugggaaguaaagaaacagcgggccggcguucuuugggaugugccaucaccgccaccaguggggaaagcagaauuagaagauggugccuaucguaucaaacaaaagggaauccuugguuauagccaaauuggagcuggaguauauaaggaagggacauuucacacgauguggcauguaacaagaggagccguauuaaugcaucggggcaagagaaucgaaccaaguugggcugaugucaagaaagaccuaauuuccuauggaggagguuggaaacuugaaggggaauggaaggaaggagaagaaguccaaguucuagcguuggagcccggcaaaaauccaagagcaguacaaacaaaaccgggucucuucaaaacaaacacaggaacuauaggggcagugucuuuggacuuuucaccugggacaucaggaucucccaucguagacaggaaagggaagguaguaggacuauauggcaacggagucgucacaagaucaggcgcguacguaucagcgauugcccaaacugaaaaaucaauugaagauaaucccgagauugaagaugauaucuuucgcaagaagagguuaaccauaauggauuugcacccaggugcggguaaaaccaaaagguauuuaccagccauaguuagggaagcaaucaaaaggggccuucgaacgcugauauuagcaccuacacgaguuguagcagccgaaauggaagaggcacuaagagguuuaccaauucgauaccaaacacccgcaauucgagcugagcacacgggcagagaaauagucgacuugaugugccaugcaacuuucacaaugaggcuauuaucuccaguucgaguaccaaauuacaaucuaaucauuauggacgaagcucauuuuacagacccagcuaguauugcugcuaggggcuauauaagcacaagaguagaaaugggagaggcagcagggauuuucaugacggcuacuccaccgggcagcagagaucccuuuccucagaguaaugccccaauaauagacgaagaaagggaaauacccgagagaucauggaacagcgggcacgaaugggugacugauuucaaaggcaagacaguaugguucguccccucgaucaaagcagguaaugacauagcugcguguuuaagaaagaauggcaagaaaguuauccaacuuucccggaaaaccuuugacagcgaauaugucaaaaccaggaccaaugauugggacuuuguuguaaccacugacauaucugagaugggugccaauuuuaaagccgaacgaguuaucgacccucgacgcuguaugaaaccuguuauccuaacggacggugaagaaagaguuauucuugcugguccaaugccagugacacauucuucagcagcacaacgucgagguagaauugguagaaacccaaagaacgagaacgaucaguauauauauaugggugaaccacuugaaaaugacgaagauugugcgcauuggaaagaagcaaagaugcuacucgacaacauuaauacaccagaagguauaauaccgaguauguucgagccggaacgagagaaggucgaugcuauagauggcgaauauagauuacggggagaggcucgcaaaacuuucguggacuuaaugaggagaggugaucuaccgguauggcuagcguauagaguugcugccgaggggauuaauuaugcagaucgacgauggugcuuugacggagccaaaaacaaccagaucuuagaagaaaauguugaagucgagauauggacgaaagagggcgaacguaaaaaguuaaaaccucgauggcuggaugcaaggauauacagcgaucccuuagcauuaaaagaauuuaaagaauuugcggcugggagaaagucgcuuacgcucaauuugauaaccgagauggguagacuucccacuuuuaugacucaaaaagcacgggaugcauuagacaaucuggcaguauuacacacugccgaggcaggagguagagcauauaaucaugcauugagcgaauuaccugaaacucuugaaacccuccuacuccugaccuuacuugcuacaguaacgggaggaauauuucuuuuucugaugucuggaaaggggguagguaagaugacauuaggaauguguugcauaauaacagcuagcauucuucucugguacgcucaaauacaaccacacuggaucgcagcgaguaucauauuagaguucuuuuuaauaguguuauugauaccugaaccagaaaaacaaagaacgccucaagacaaucaacucacauacgucguaauugcaauacugaccgucguagcagcuacaauggcuaaugaaaugggguuucuggagaaaacuaagaaagacuuaggccuugguagcauagcuacgcaagaaccggaauccaauauucuagauauugacuuaagacccgccucagcuuggacguuauaugcggucgccacgacguuuguuacaccuauguuacgucauucaauugaaaacaguagcguuaacgucagucuaacugccauagcaaaccaagcgaccguucugaugggacugggaaaagguuggccuuuaaguaaaauggauauaggugucccauugcuagcgauugguuguuacagucaggucaauccgauaacacuuacagcugcccuacuauuacucauagcacacuaugcaauaauagggccugguuuacaggcaaaggcaacaagagaggcacagaaacgugcagccgcaggaauuaugaagaacccgacuguagacggaaucacagugaucgauuuagacccgaucccauacgacccaaaauucgaaaaacaacugggacaaguuauguugcuaauacucugugucacgcaaguauuaaugaugagaaccacuugggcucuaugugaggcccuuacguuagcaacagguccaauaucaacacugugggaaggaaauccaggccguuucuggaauacaacaauagcaguaagcauggcuaacauauucagaggaucauauuuagcuggagcaggacuacuauuuucaauuaugaagaauacgacuaauacaagaagaggcacggggaauauaggagaaacgcuuggagagaaguggaagaguagacugaacgcauuggggaaaagcgaauuucaaauauacaagaaaucgggcauacaggaaguagaucgaacacuagcaaaagagggcauuaagcgaggagaaacugaucaccacgcgguuagcagaggaagugcgaaauuaaggugguuuguugaacguaacaugguaacaccagaaggaaagguaguagaucucggcuguggucgaggagguuggucauauuauuguggaggucucaaaaaugugagagaaguuaagggacuaacuaaaggcgggccgggacaugaagaaccaaucccgaugucuacuuaugguuggaacuuggucagacuacaaucagguguugauguauucuuuacaccuccagaaaaaugcgauacacuauuaugugauauuggcgaaagcucaccaaauccaaccauugaagccgguagaacguuacgaguauugaguuuaguugagaauuggcuaaacaacgauacccaauucugcauaaaaguacuuaauccauacaugcccucgguaauagagaagauggaaacucuccaacguaaauauggaggggcccuagucagaaauccgcuaucucgaaauucaacacaugaaauguacuggguuucuaaugcuacaggcaauauuguuucuuccgucaacaugaucucuagaauguugauaaauagguuuaccaugaagcacaagaaagcuacuuacgaaccugacgucgauuuagguucagggacuaggaauauugggauagaaucggaaauacccaaucuagacaucauagggaagaggauagagaaaauaaagcaggaacacgagacaucguggcacuacgaucaggaccauccuuauaagaccugggcuuaccauggaucauaugaaacuaaacaaaccggaagcgcuucuucgauggucaauggugucguuaggcuauuaaccaaaccaugggacguagucccaaugguaacacaaauggcgaugacggauacgacuccguucggucagcaaagaguguucaaggaaaagguugauacacgaacacaagaaccgaaagaaggaacuaagaaauuaaugaaaauaacugccgaguggcucuggaaagaacucgggaaaaagaaaacgccacguaugugcacaagagaagaauuuacccgaaaaguacguaguaaugccgcccuaggugcuaucuucacagaugaaaacaaauggaaaagcgcgagagaagccguagaagauagucguuuuugggaauuaguagacaaagaaagaaauuugcacuuagaaggaaagugugaaacuuguguguauaacaugauggguaagcgggaaaagaaacugggcgaauuuggcaaggcuaagggaaguagggcaaucugguauauguggcuaggagcaagauuccucgaauuugaggcuuuagguuucuugaaugaggaucacugguucucaagggagaauagccucucagguguggaaggggaaggacuucauaaauuagguuauauauuacgugauguaaguaagaaagagggcggagcuauguacgcagacgauacugccggcugggacacaagaaucacacuugaggaucucaaaaaugaagaaauggucacuaaucacauggaaggugaacauaagagacuagcagaagcgauuuucaaauuaacauaccaaaauaaaguuguucgaguucaacgacccaccccaagagguaccguuauggacauaaucagccguagagaccagcgaggaaguggacaaguaggaacguacggcuuaaauacuuuuacaaacauggaggcccaauugauaaggcaaauggaaggugagggaauuuuuaaaagcauacaacauuuaaccguaacugaagagauagcuguacagaacugguuagcgcggguuggcagggaaaggcuaucuagaauggccauuucaggagaugauugcguagucaagccguuagacgauagguucgcaagcgcacuaacggcccucaaugacauggguaaaguacgaaaagacauacaacaaugggaaccaagcaagggauggaacgacuggacucaaguuccuuuuuguagucaccauuuccaugaauugaucaugaaagauggcaggguccuagugguaccaugcaggaaucaggacgaauugauaggucgagcuagaauuucccaaggggcgggcuggagccugaaagaaacagcgugccucggaaaaagcuaugcacaaauguggucccuuauguauuuucacaggcgugaccuuagacuagcggcuaaugccauauguagcgcaguaccuucccauuggguuccaaccucccgaacaaccuggucuauucaugcuaagcacgaauggaugacaacagaagacaugcucaccguauggaaucgaguauggauacaggagaauccauggauggaggacaaaacuccagucgaguccugggaagaagucccguaucucggaaaacgggaagaucaguggugcgguagucucauaggcuugacuucacgagcuacaugggcuaaaaauauacagacagcuauaaaucaagugcgaagucuaaucgggaacgaagaauauaccgauuauaugccuucaaugaaacguuuucggagagaggaagaagaggcuggaguguugugguaa

SEQ ID NO: 22835 - RNA, 9876 nt, Artificial Sequence
  derived and/or modified CDS sequence (opt6) from DENV-2__FM210225__SS-prME
acagcugguguuaucauuaugcuaauuccaaccgcgauggcauuccauuuaaccacuagaaauggugaaccucacaugauuguagguagacaagaaaaagguaagagcuuacuuuucaaaacugaagacgguguaaacaugugcacucuaauggcaauagauuuaggugaacugugcgaagauacuauuaccuauaaauguccauuacuacgacaaaacgaaccggaagauauugauugcuggugcaauucgaccucuacuuggguaacuuaugguaccugcaccacuaccggugagcacagaagagaaaaacggaguguagcacucguaccacauguaggcauggggcuugaaaccagaacggaaacguggaugaguagcgaaggggcguggaaacaugcucaacggauagaaacuuggaucuugcgucauccugguuuuacuauaauggcagcaauacuagcauauacaauugguaccacacacuuucaacgugcgcuuauauuuauccuacuaacagcaguggcgcccuccaugacaaugagaugcauaggaauuaguaauagagauuucguagaaggagugaguggcggcagcuggguagacauaguuuuagaacauggaagcuguguuacaacaauggccaaaaauaaaccaacucucgauuuugaacuaauaaaaacagaagcuaaacaacccgcaacacuacguaaauauugcauagaagcaaaacuaaccaauacgacuacugaaagcagauguccaacacagggagaaccaucguuaaaugaggagcaggauaaaagauuuguaugcaaacauucaaugguagacagaggguggggaaacggauguggauuauucgguaaagguggcauaguaacgugugcaauguuuaccugcaagaaaaauauggaggguaaaauagugcagcccgaaaauuuagaguauacuauaguuauuacaccccacucaggcgaagaacaugcaguugggaaugauaccgggaaacacggaaaagagauaaaaauuacaccucaaucuaguauuacagaagcagaacucacaggcuacggaacuguaacuauggaaugcagccccagaaccggacuugacuuuaaugaaaugguauugcuacagauggaagacaaagcauggcuuguacaucgucaaugguuccucgaucuuccuuuaccuuggcuccccggagcagauacucaaggguccaacuggauucaaaaagaaacuuuaguuaccuuuaaaaacccucacgcgaagaaacaagauguagugguauuaggaucacaagaaggagcaaugcauaccgcccuaacaggugcaacagaaauacaaaugucgaguggaaacuuacuuuuuacuggacaccucaaaugucgauuaagaauggacaaacugcagcuuaaagguaugucuuauaguauguguacugguaaauuuaaaaucgugaaggaaauagcugagacacagcacggaacaauaguuauacgaguccaauaugagggggauggaucaccaugcaaaauuccuuucgaaauaauggaucuagagaaaagacaugucuuaggaagauuaauuacugucaaucccaucgugacagaaaaggacaguccaguaaauauugaagccgagcccccauucggggauucauacauaauuaucggaguugaaccgggacaacuuaaacuaaauugguuuaagaagggcucaaguauaggacaaauguuugaaacaacaaugaggggugcuaaaagaauggcaauccucggagacacagcaugggauuuugggagucuagggggcguuuuuacuagcauaggaaaagcauugcaccaaguuuucggagcaauuuauggagcagcuuuuucuggggugagcuggacaaugaaaauacucauuggagcgauuauuacuuggaucgggaugaacucucgauccacuagccuaucugucucacuugucuuaguaggaguuauaaccuuguauuuaggugccauggugcaggcggauucuggguguguugucagcuggaaaaacaaggaguuaaaauguggaucagggauauuuauuaccgauaaugugcauaccuggacggaacaauacaaauuucagccagaaucccccucuaaacucgcaucagcuauccaaaaagcacaugaggaaggaauauguggaauaagaucaguuaccagauuagaaaacuuaauguggaaacaaaucaccccugaacucaaccauauauuauccgaaaacgaaguaaaauugacgauuaugacgggugauauaaagggaauaaugcaagcaggaaagaggagcuuaagaccucaaccuacagaacucaaauauucauggaaaacgugggguaaagcaaagaugcucagcacagaaucccacaaccagacauuccucauagauggaccagaaacagcagaauguccuaauacaaaucgugcguggaacucguuggaagucgaagauuaugguuuugggguauuuaccacaaacauuuggcucaaauuaagagagaaacaagacguguuuugcgauaguaaacugaugucagcagcgaucaaagauaacagagcuguacacgcagauaugggcuacuggauugagucagcacuaaaugauacguggaagauggaaaaagcuaguuuuauagaagugaaguccugucauuggccaaaaagucacacuuuauggucuaacggcguacuagaaucagaaaugauaauaccuaagagcuuugcugggccugucucccagcacaacuaccguccugguuauuacacacaaacagcugguccuuggcaucugggcaaauuggaaauggacuuugacuuuugcgaagguacuacaguaguaguaaccgaagauugcggcaaucgugguccuaguuuacgaacaacuacggccucuggaaaauuaauaacagaguggugcugccgaaguuguacauuaccaccucuaagauacaggggagaagauggcuguugguauggaauggaaauacgcccacuaaaagaaaaggaggaaaauuuaguaaauaguuuggugacugcaggacauggucaaauagacaauuuuucccuuggcguuuuagggauggcacucuuccuggaggaaaugcuaagaacucgcgucggaaccaaacaugcgauacuauuaguugcgguaucauuuguaacccuaauaacaggcaacaugucauucagggaccucggacgugugaugguuauggucggugcaacaaugacagacgauauuggaaugggaguaacauauuuagcuuuauuagcagccuucaaggugagaccgaccuuugcugcagggcucuuguugagaaagcuaacaaguaaagaacuuaugauggccacaauagguauagcacuacuuucacaaucuacaauuccagaaacuauucucgagcuuacggacgccuuagcacugggaaugaugguccuaaaaauaguacgcaacauggaaaaauaucaacucgccgucacaauaauggcuaucucaugcguaccuaacgccgugauacuucagaaugcuuggaaaguuagcugcacaauacuugccgccgugucaguaucuccccuacuacugacaagcucgcaacagaaagcugacuggauaccccuagcguuaacaauaaaaggucugaacccuacagcaauuuuucuaacuaccuuauccaggaccucuaagaaaagaagcuggccauuaaacgaagcuauaauggcaguagggauggucagcaucuuagcuagcaguuuacugaaaaaugauaucccaaugacgggcccauuaguggcaggaggacuacucacugucugcuauguguuaacugggcguagugcagauuuagaauuagagagagcuacggauguuaagugggaggaucaagcagaaauuucuggaucgucuccuauccuuaguauaacaauaucugaagauggcagcaugagcauuaaaaacgaagaggaagaacaaacacuaaccaucuuaauucguacgggacuccuugucauaucugguuuauuucccguuagcauaccaauaacugcggcagcaugguaccuaugggaggucaagaaacagcgagccggaguguugugggauguaccaagcccacccccggugggaaaggcagagcuugaagacggcgcauacagaauaaagcaaaaaggcauucuuggauauucucaaauaggcgcggguguuuacaaagagggaacuuuccacacuauguggcauguuacuagaggcgcgguacucaugcaccgagggaaaagaauagaacccaguugggcggacgucaagaaagacuuaaucucguacgggggaggauggaagcucgagggagaauggaaagagggggaagaaguacaggucuuggcuuuagaaccugggaagaacccgagggcaguccaaacgaaaccuggauuauucaaaacuaacacagguacgauaggugcaguaagccuggacuuuagcccugguacuuccgguucacccaucguagacagaaaagguaaaguuguuggacuuuaugguaauggagucguaacuagaucaggugcuuauguuucagcgauagcacaaacggaaaaaucaaucgaagauaauccggagauagaagaugauauuuuuaggaaaaagcgacugacaauuauggauuuacacccaggagcaggcaagacaaagcgauacuuaccagcgauaguuagagaagccaucaagcgcggauugagaacccuaauauuagcuccuacgagagugguggccgcggaaauggaagaagcucuacgaggacuuccaauuagguaucaaacccccgcgauaagagccgaacacacaggcagggagauaguugacuuaaugugucaugcaacuuucacaaugcgauugcucucaccagugagaguuccgaacuacaaccuaauaaucauggaugaagcccacuuuaccgaucccgcaucaauagcggcccguggguacaucucuacacgugucgagaugggugaggcagcaggaaucuucaugacugccacuccuccugguagccgagauccauuuccacaaucaaaugcucccauaauugaugaagaaagagagauacccgaacggucauggaacucaggucacgaaugggucacagauuuuaaaggaaaaacggugugguucguaccaucaauaaaagcaggaaaugauauugcagcuugucuacgaaagaauggaaagaagguaauucaacucaguagaaaaacuuucgauagugaguauguaaaaacacgaacaaacgacugggacuuuguuguuacaacagacauuucagagaugggagcaaauuuuaaagcagaacgaguaauugacccucggaggugcaugaaaccgguaauuuuaacagauggggaggaacgaguuauacuugcagguccaaugccaguuacgcacuccucugcagcgcagcgacgggguaggaucggacgaaaucccaaaaacgaaaacgaucaauauauuuauaugggggagccguuggaaaaugaugaggauugcgcacauuggaaagaggcaaaaaugcucuuagauaacauaaacaccccggagggaauuauccccuccauguucgaaccugagcgagaaaaagucgaugcuauugauggcgaauaccgucuacgaggagaagcaagaaaaacguuuguagaccucaugcguagaggggacuuaccgguuuggcuugcauauagagucgcggcggaaggaauuaauuacgcagaucgaagauggugcuucgauggcguuaaaaauaaccaaauacucgaagaaaacguugaaguugaaauuuggacuaaagaaggagagagaaagaagcuaaaaccuagguggcuagaugcucguauauauuccgauccauuggcauuaaaggaauuuaaagaauuugcugcggguaggaagucucuaacgcuaaacuuaaucacagaaaugggucggcuacccacuuucaugacgcagaaagcgcgugacgccuuagacaaccuugcuguccugcauacagcagaagcaggcggacgagcauauaaucaugcacuauccgagcucccagagacucuggaaacacuuuuacuuuuaacacuucuagccacuguaacuggagguauuuuucuguucuuaaugagugguaagggcguugguaagaugacuuuggggaugugcugcauaaucaccgcgucuauauuguugugguaugcucagauucagccucauuggauugcagcgucaauuauacuagaguucuuucugauagugcuuuugaucccugaaccggaaaaacaaagaacuccacaggauaaccagcucacauauguaguaauugcuauacuuacagucguagcagcaacgauggcaaaugaaaugggauuuuuagagaaaacaaagaaagauuuaggacuagguucuauagcaacacaagagcccgagaguaacauacuagacauugacuuaaggccugcaucugcauggaccuuguaugcugucgcuacaacguucguaacuccaauguuacgacauaguauugaaaacagcagcguaaaugugucccucacugcaauagcaaaucaagccacaguguuaaugggcuuggguaaagguuggccgcuaucuaaaauggacaucggagucccacuucuggcaauuggcuguuacucacaggucaacccaauaacacucacugcugcacuacugcuacucauagcacacuaugcaauuauuggcccuggcuugcaagccaaggcaacuagagaagcucaaaaacgcgccgccgcuggcauaaugaagaauccuacaguugaugguauaaccgugauugaucuggacccgauaccuuaugaucccaaguuugaaaaacaauuagggcaaguaaugcuuuuaauucuuugugucacccagguacuuaugaugaggacuaccugggcguuaugcgaggcauugacuuuagcgacgggaccaauuucuacucuuugggaggguaacccaggaagauuuuggaauacuacgauugccguaucgauggccaacauauuuagagguucuuaucuugcaggcgcaggucuguuguuuaguauaaugaaaaacacaacuaauacaagacgaggaacagguaacauuggagagacguugggagaaaaauggaaaucucgguuaaaugcucuaggaaaaagugaauuucagaucuauaaaaagucaggaauccaagaaguagaccggacacuagcaaaagaaggaauaaagagaggggaaaccgaucaucaugcuguaagucggggguccgcgaaguuacgaugguucguagaaagaaacaugguuaccccggagggaaaggucguggaucuggguugcggacgcggagguuggucauacuauuguggaggucucaaaaauguuagggaaguaaagggacuaacgaaaggaggcccaggccacgaggaaccuauccccaugaguacuuauggauggaaucuaguacgacuacaaagcggggucgauguauuuuucacgccuccugagaaaugcgacacauugcugugugauaucggcgagucaucaccaaauccgacuauagaggcgggacgcacauugagaguuuugucuuuagucgagaauuggcucaauaacgauacgcaguucuguauaaaagucuuaaauccuuacaugccaucaguaauugagaaaauggaaacgcuacagagaaaauaugguggcgcucuaguuagaaauccccuaagucgaaauagcacucacgaaauguacugggugucaaacgccaccggaaauauaguaucuuccgucaauaugauaucgcggaugcuaauuaauagauucacaaugaaacacaagaaagcuacauaugaaccagacguggaccuagggucaggaacuaggaauauaggaauugaaucugaaauccccaaccucgauauaauaggaaaaagaaucgagaaaauaaaacaggagcaugagacuucuuggcacuaugaccaagaucauccauauaagacgugggcguaccauggaucguacgaaacuaaacaaacuggcagcgcuaguaguaugguuaauggaguaguacgucuacuaacaaaaccuugggauguaguaccaaugguaacacagauggcaaugacagacacaacgccauucggucaacaacgggucuuuaaggaaaaaguugauacccggacccaagaaccaaaagaagguaccaagaaacuaaugaaaauuacagcugaauggcucuggaaggaguuaggaaagaagaaaacaccaaggaugugcacgagggaagaauuuacgcgaaaaguuagaaguaacgcagcuuuaggcgcaauuuuuacagacgagaauaaauggaagucggcacgggaagcuguagaagacucccguuuuugggaguugguugauaaagaacgcaauuuacauuuagagggaaaaugcgaaaccugcgucuauaacaugauggguaagcgggagaagaaacucggagaguucggaaaagcaaaaggaucucgagcgauaugguacauguggcuuggagcaagauuucuugaguucgaggcuuugggauuuuugaacgaagaucauugguuuucaagagaaaauucacuaagcgggguggaaggugaaggucuccauaaguugggcuauauucuacgcgaugucagcaagaaagaaggaggggcuauguacgcagaugacacagcgggcugggauacacgaauuacauuagaagaccuaaagaaugaagaaaugguuaccaaucauauggagggugagcacaaaagauuagcagaagccaucuuuaaacucacauaccaaaacaaaguaguaagaguacaacgaccuacaccaagaggaacuguaauggauaucauaaguaggcgagaccaaaggggaucagggcaaguaggaacauauggauuaaacacauuuacaaauauggaagcucaacucauacgacaaauggaaggcgaaggaauuuuuaaauccauccagcaccuaacaguaacagaagaaauagcggugcaaaauuggcuagcaagaguaggccgugaaagacugaguagaauggccauaaguggcgaugauuguguuguaaaaccacuagaugauagauuugcaucugcauugacugcacuaaacgauaugggcaaaguuaggaaagacauacaacaaugggaacccaguaagggauggaaugacuggacucaaguaccguucuguagccaucacuuccacgaacuaauuaugaaagauggacgagugcuaguugugccauguagaaaccaggaugaauuaauugguagggccaggaucagccaaggagcaggauggucauuaaaagaaacugcaugucugggaaaaagcuacgcacagauguggagucugauguacuuucaucgacgggaccuaagguuggcugccaaugcuauuugcucagcuguaccaagccauuggguuccaacgaguagaaccacuugguccauacaugccaaacaugaauggaugaccacagaagacauguugacaguguggaauagaguauggauacaagaaaauccauggauggaagacaaaacgccuguugaaucaugggaagaaguaccuuaucuaggaaagagggaagaucaaugguguggaucgcucauuggauuaaccagcagagcaacaugggcaaagaauauucaaacagcuaucaaucagguaagaucauugaucggaaaugaagaauauaccgauuauaugccaagcaugaagagguuucgccgggaagaagaagaagcaggaguuuugugguaa

SEQ ID NO: 22836 - RNA, 9876 nt, Artificial Sequence
  derived and/or modified CDS sequence (opt6) from DENV-2__FM210226__SS-prME
acagcaggaguaauaaucaugcuaauuccaacggcaauggcauuucauuugacuacucggaauggggaaccgcauaugauaguuggacgacaagaaaaagguaaaagucuucucuucaaaacggaagaugggguuaacaugugcacuuugauggcaauagaccugggugaauuaugugaagauacuauuacuuacaaauguccgcuauuacgccaaaaugaaccugaagauauagacuguugguguaauucaacguccacgugggucacuuaugguacauguacuacuaccggagaacauaggcgggagaaaaggaguguggcguuaguaccacauguugguaugggacucgaaacaagaacagaaacauggaugaguuccgaaggugcguggaaacacgcucagagaauugaaacauggauauugagacaccccgguuuuaccauuauggcggcgauauuagcauauacaguaggcacaacacauuuccagcgagcuuuaauauuuauauugcucgcugcuguagcuccuaguaugacaaugcgcuguauuggcauuagcaauagagauuucgucgaaggaguaucgggaggaucuuggguugacauaguauuagaacauggcaguuguguuacgaccauggccaaaaacaaaccaacgcuagacuuugaacucauaaaaaccgaagcaaaacaaccugcaaccuuacguaaauauugcauugaagcgaaauugacuaauaccacaacagaaaguaggugcccaacacaaggagaaccgagcuuaaaugaggaacaagacaaacgauucguuugcaaacacagcaugguggauagaggaugggggaacgguuguggacuguucggcaaagggggaauuguuacuugcgcgauguucacaugcaagaaaaauauggagggaaaaauaguucaaccugagaaucuagaauacacaauuguaaucacaccacauucaggugaagaacaugcgguaggaaaugacacaggaaaacauggaaaagaaauaaaaaucacaccacaaucaccuauaaccgaagcggaauuaacuggauacgguacgguaacgauggaaugcucaccacggaccggcuuagacuuuaaugagaugguacugcuccagauggaggauaaggcuuggcugguccauaggcaaugguuccucgaucuuccacucccauggcuuccuggagcagauacucaagguaguaauuggauacagaaagaaacccuuguaacuuuuaaaaacccacaugcaaagaaacaagacgugguuguuuuagggagucaagaaggagcaaugcauaccgcguuaacaggugccacggaaauacagaugucuagcgggaacuuacuuuuuacuggacaucugaaaugucggcuaaggauggacaaauuacaguuaaaaggaaugaguuauucgaugugcacagguaaauuuaaaauugucaaagaaauagcagaaacacaacauggaaccauagucauaagggugcaauacgaaggggacggcuccccauguaaaaucccuuucgagauaauggaccuagaaaagagacauguauuggggagacugauaacaguuaauccuaucguuacagagaaagacagucccguaaauaucgaagcggaacccccauuuggggacaguuacauaaucauagggguagagccaggucaacuaaaacuaaauugguuuaagaaaggaucuaguauaggccaaauguuugagacgacaaugagaggcgccaaacguauggcaauacuuggugacaccgcuugggauuuuggaucucucggaggcguguucacaucaauuggaaaagcguuacaccaaguguuuggugcaaucuacggagcagccuucagcggcguaucguggacaaugaagauccuaauaggagucauaauuacauggaucgggaugaauaguagaucuacaagccugucggucagccuaguacuuguagguguaauaacgcuguaucugggugccaugguucaggcugauucaggcugcguagucucguggaagaacaaggaauuaaaauguggguccggaauauuuaucacugauaacguacauacauggacagaacaauauaaauuccagccagagucucccuccaaguuggcaucugcaauacagaaagcacacgaggaggguauauguggaauuagaucaguuacaagauuggaaaacuuaauguggaaacaaauaacacccgaacuaaaucacauauuaucugagaacgaaguaaaacuaacuaucaugacuggcgauauuaaagggauaaugcaagccgguaagaggucguuaaggccccaaccuaccgagcuaaaauauaguuggaaaaccugggggaaagcuaaaauguuaucaacggagagucauaaucaaacauuucuaaucgauggcccggaaacagcggaguguccaaacacaaaucgagccuggaacuccuuagaaguugaagacuauggauuugggguauucaccacaaauaucugguuaaaacucagggaaaagcaagauguauuuugcgacucuaaguuaaugucggcagcuauuaaagacaacagagcugugcaugcagauauggguuacuggauagaaucagcuuuaaaugauaccuggaaaauggaaaaagcuagcuuuauagaagucaaaucuugucauuggccaaaaagccauacuuuguggaguaacggcgugcuugaaucggagaugauuauaccaaaaaguuucgcagggccaguuagccaacacaauuacagaccaggcuauuacacccaaacugcaggaccauggcaucuaggaaaauuagaaauggacuuugauuucugugaagggacgacuguugucgucacagaggauuguggcaacaggggucccucauuaagaacaacaaccgcaucaggaaaacuaauaacagaaugguguugccgaucaugcaccuugccaccuuuacgguaucgaggagaagacggauguugguauggaauggaaauacgaccacuaaaagaaaaggaagaaaaccuuguuaacuccuuaguaacggcaggacacggacaaaucgauaauuuuaguuuaggcguauuggguauggcauuauuuuuggaagaaaugcugcguacgagaguagggacgaagcacgcaauccuacucguugccguauccuucgugacccuuauaaccggaaacaugagcuuuagagaccugggucgggucaugguaaugguuggcgcugcgaugacagaugacauaggaauaggagugacauaccuagcauuauuggcagcauuuaaggucagaccaacuuucgccgccggucuucuacuaaggaaguuaacaucaaaggaacugaugauggccacgauagguauagcacucuuaucucaaucaacaauucccgaaacgauucuugaauugacagaugcucuagcucuaggaaugaugguauuaaaaauaguccguaauauggagaaauaucaguuagcagucacaauaauggccauaucgugcguuccaaaugcuguuauccuacagaacgccuggaaaguaucauguacgauucuagcaacaguaucaguauccccacuacugcuaacaagcucucaacaaaaggcugauuggauuccauuagcauugacgauaaaaggauugaacccuacugccauauuucuaacaacacuaucacgaacgucuaagaaacgaucauggccacuaaacgaagcuauaauggcuguuggcaugguaucaauacucgcuagcagucuucuuaagaaugacauuccuaugacgggaccauuagucgccggugggcuucuuacuguuuguuacguacugacggggcguagugcggaccuugaauuagaacgagccaccgaugucaaaugggaagaccaagccgaaauuagugguaguucgccuauuuuaucaauuacuaucgcagaggauggaucuaugucaaucaaaaaugaagaagaagaacaaacccuuacaauucuaauucgaacagggcuuuuagugaucucgggccuguucccugugaguauucccaucacagcugccgcuugguaccuuugggaggugaagaaacaaagagccgggguuuuaugggaugugcccucucccccgcccguuggaaaagcagaauuggaagauggcgcguaccgaaucaaacaaaaagguauucuaggauacagucaaauaggugccgguguauauaaagaaggaacuuuccauacaauguggcacguuacaagaggagcaguacuaaugcauagggguaaacgaaucgaaccuucaugggcugaugucaaaaaggauuuaaucucauaugguggagguuggaaauuagagggugaauggaaagaaggagaggaaguacaaguacucgcacuugaaccaggcaaaaauccuagggcaguucaaacuaaacccggacuuuucaaaaccaauacaggaacaauaggcgcuguuagucucgacuuuaguccaggcacuucaggauccccgauaguugacagaaaaggaaaagucguaggucuauauggaaauggaguaguuacuagaucuggcgcuuauguaucagcaauagcacagacagaaaaaucaauugaagauaaucccgagauagaggaugacauuuuucggaagaaaagacuaacuauuauggacuuacauccaggcgcaggcaaaacaaaacgauacuuacccgccaucguaagggaagcuauaaaaaggggauugaggacacuuauauuagcccccacuagggucguggcagcggagauggaggaagcguuaagaggacucccuauccgcuaucaaacgccagcuauacgagcagaacacaccggacgagagauuguagaucuaaugugucacgcuacuuuuaccaugcguuugcuaaguccaguaagggugccuaauuauaacuuaauaauuauggaugaagcgcacuuuaccgauccggcuuccauugcugcacguggauacaucucaacaagaguugaaaugggcgaagcagcagguauuuucaugacggcuacgccaccgggcaguagagauccuuuuccccaaagcaacgccccaauaauggaugaagaaagggaaauacccgaacgaagcuggaauaguggacaugaauggguuacugauuuuaaaggaaaaacaguuugguucguccccagcauaaaagccggaaaugacauagcagccugccuccguaaaaauggcaagaaaguuauucaauuaaguagaaagacauucgauucggaauacguuaaaacccgcacgaaugauugggauuuuguugugaccacggauauaagugaaaugggagcgaacuucaaggcggaacguguuauagacccgagacgauguaugaaaccuguaauucucacagacggugaagaacgcguaauacuagcuggcccaaugccgguaacucauucauccgccgcacagcgcagaggucgcauaggacguaacccgaaaaaugagaacgaccaauauauauauaugggcgaaccauuagaaaaugaugaagacugugcgcauuggaaagaagcaaaaaugcuacuagauaauauuaauacaccugaagggauuauaccuucaauguuugaacccgaaagagaaaagguugaugccauagauggagaauaccgacuaaggggagaagcaagaaaaacauucguggaucuaaugcguagaggggaccugcccguauggcuggcauauagaguagcagcggagggaauaaacuaugcagacagacgcugguguuuugauggaguuaaaaacaaucagauuuuggaagaaaauguagaaguagagauuuggacuaaagaaggcgagagaaagaaacuaaaaccgcgauggcuagacgcccgaauuuauuccgauccacuagcuuugaaagaguucaaagaauuugcagcuggacguaaaucauuaacguuaaacuuaauuacagaaauggguaggcuaccaacuuuuaugacccaaaaagcuagggacgcauuagacaacuuagcaguuuuacauaccgcugaagcugggggacgagcuuacaaccaugcauugagugaacuacccgaaacauuagaaacacuccuucuguugacauuacucgcgacaguaacaggugguauuuuucuuuucuuaaugucagggaaagguguaggaaaaaugacccuaggaaugugcuguauuauuacagcaucaauucuauuauggcaugcgcaaauacagccgcauuggauagccgcaucuauuauauuagaauuuuuccuaaucgugcuacuuaucccugaaccagagaaacaacgcaccccucaagauaaccaauuaaccuacguaguuaucgcgauauuaacaguuguggccgcgaccauggccaacgaaaugggguucuuagagaaaaccaagaaagaucuaggauuggggagcauagcaacacaagaaccagaaucaaauauauuagacauugaucuuagaccagcuucagcauggacccucuaugcaguagcaacaacguuugucacuccaauguuaaggcauuccauugagaauaguagugucaauguaagucuuacagcaaucgcgaaucaagcuacuguccugaugggucuagggaaaggauggccauuauccaaaauggacaucggcgugcccuuguuagcaaucggauguuauagccaggucaaccccauaaccuugacagcugcacuauuacuucuaguugcacacuacgccauaauagguccggguuugcaggccaaggcgacucgggaagcacaaaagagagcugcagcugguauaaugaagaacccgacagucgaugguaucacuguuauagacuuagauccgauacccuacgauccgaaguucgaaaaacaguuaggacaaguaaugcuucuuauauuaugcguaacacaaguacuuaugaugaggaccacuugggcccugugugaagcauugaccuuagcuacaggacccauuuccacguuaugggaaggcaauccuggacgauuuuggaacacuacaauagcuguaagcauggccaauauuuuccgagguucuuauuuagcaggagcaggauuauuguuuuccauaaugaaaaacacuacgaauacgcgaagagguacuggcaauauuggcgaaacauuaggagaaaaauggaagucuagauuaaaugcguuagguaaaagugaauuucagauauacaagaaaucuggaauacaggaaguugaucgcacucuugcaaaagagggaaucaaaagaggggagacugaucaucaugcuguuaguagaggaucagcaaaacuaaggugguuuguagagaggaacauggucaccccagaaggcaaaguaguugaccuaggaugcggacgugggggauggucauacuauugcggaggauugaaaaaugugcgcgaaguuaaagguuugacaaaaggcggaccuggccacgaagaaccaguuccuaugucgacauauggcuggaauuuaguucgauugcaauccggagucgacguauucuuuacaccacccgaaaaaugugauacauugcuuugcgacauaggggaaucaagcccaaacccaaccaucgaagcagguagaacucuuaggguacuauccuugguagaaaacuggcuuaauaacgauacacaauuuuguauuaaaguguuaaauccauacaugcccuccguuauagagaaaauggaaacacuacaacgaaaauacggaggggcccuaguaagaaacccacucucucguaauaguacucaugaaauguauuggguuaguaacgcgacaggaaacaucguuucuucggucaauaugauaucucgaaugcuaauaaacagauucacaaugaaacacaagaaagccacuuacgaacccgauguagaccucggaagugguacuaggaacauuggcaucgaaagcgagaucccgaaucucgauauaauaggaaaaagaauagagaaaauuaagcaagagcaugaaaccagcuggcauuaugaucaggaccauccuuauaaaacuugggcuuaucacgguagcuacgaaacgaaacaaacgggaagugcauccaguaugguaaacgguguuguaagacuucuaacgaaacccugggacguggugccaaugguaacacaaauggcuaugacagacacaacuccauuuggccagcaacgaguauuuaaagagaaaguugacacucggacgcaggagccaaaagaaggaacuaaaaaguuaaugaagaucacagcugaauggcuuuggaaggaacuaggcaagaagaaaacuccccggauguguacacgcgaagaauuuacgcguaaagugagaaguaacgcugcacugggggccauauucaccgaugaaaacaaauggaaaagcgcgagagaggcagucgaagacucaagauucugggaauugguugauaaagaacguaauuugcaucuagaaggcaaaugugagacgugcguauacaauaugaugggcaagagagagaagaaacuuggggaguuuggaaaagcaaaaggcucaagggcuauaugguauauguggcuaggugccagauuuuuagaguuugaggcacuuggauuccugaacgaagaccauugguuuagucgugagaauagccuuucaggaguagaaggggaagguuugcauaaauuaggauacaucuuacgggacgucaguaagaaagaagggggugcuauguaugcugaugauacagcggguugggacacgagaauaacgcucgaggaucucaaaaaugaagagaugguaacgaaucauauggaaggagagcauaagaaacucgcugaagcaauuuuuaaauuaacuuaccagaauaaaguuguuaggguucaacgaccgacuccgcgggggacuguuauggacauaaucagucgaagagaccagagaggaagcgggcaaguugggacauaugggcuaaauaccuucacgaauauggaagcacaauuaauucggcaaauggaaggagaagguaucuuuaaaucaauucaacaucugacgguuaccgaagaaauugcaguacagaauuggcuagcaagaguuggcagagagcgauuaagccgcauggcuauuucuggagaugauugcgucgugaaaccucuagacgaucgauucgcuagcgcgcuuacugcgcugaaugacaugggaaaaguaaggaaagauauacagcaaugggaacccaguagaggguggaaugacuggacacagguaccauuuuguucucaucacuuccaugaauuaauuaugaaggauggacgcguacucguuguaccuuguagaaaucaagacgaacuuauugguagggcuagaauuucucaaggagcuggauggagccuaaaagaaacagcgugccuugggaaaaguuaugcgcaaaugugguccuuaauguacuuucacagaagagacuuacguuuggcugcaaacgcuaucuguagugcaguucccucacauuggguaccuacaaguagaacuacuuggagcauacacgcuaaacaugaguggaugacuacugaggacauguuaaccguauggaaccgaguguggauccaagaaaacccauggauggaagacaaaacgcccguugaaaguugggaagaaguuccuuacuuaggcaaaagagaagaucaauggugugggagccucaucgguuuaacuagccgagcgacuugggcgaaaaauauucaaacagcuauaaaccaaguacgaucacuuauaggaaaugaagaguauacugauuacaugccaaguaugaagagauucaggagagaggaagaggaagccgguguucuuugguag

SEQ ID NO: 22837 - RNA, 9876 nt, Artificial Sequence
  derived and/or modified CDS sequence (opt6) from DENV-2__FM210227__SS-prME
acugcaggagucauuauaauguugauuccuacggcgauggcuuuucacuuaacuacucguaacggugaaccacauaugauuguugggcgucaagaaaaaggaaaauccuuacuauuuaaaacugaagacggaguuaauauguguacccucauggccaucgaucuaggagaauugugcgaagauacaauuacauauaaaugccccuuacuaaggcaaaacgaacccgaagacaucgauugcuggugcaauaguacaaguacaugggugacauaugggacauguacaacaacaggugaacauagaagggagaaaaggaguguggcacuugucccgcacguugguaugggccuggaaaccagaacagaaaccuggaugaguagugaaggugccuggaaacaugcucaaagaauugaaacguggauucuaagacaucccggauuuacuauuauggcagccauacuagccuauacaauugguacuacgcauuuucaaagagcguuaaucuuuauccuacugacagcuguagccccaaguaugacuaugcgguguaucgguauuucaaacagagauuuuguugaaggcguaucaggaggauccugggucgauauaguuuuagaacauggaucauguguuacgacaauggcgaaaaauaaaccgacacuagacuuugaacuaauaaaaacagaagcuaaacagccugcaacucuaagaaaauauuguaucgaggcaaaacugaccaacacaacaacagaaucucgaugccccacacaaggagaaccaaguuuaaaugaagaacaagauaaaagguuugucugcaaacacucaaugguagaucgaggauggggaaaugguuguggacuguucgguaaaggagguauaguaacuugugcgauguuuacaugcaagaaaaauauggaaggcaaaauaguccaaccagagaaucuggaauauacaauagugauuacaccccauucaggagaagaacacgcagucgguaaugauaccggaaaacauggaaaagaaaucaaaauaacaccacaaucuaguguuaccgaggcugaauuaacuggauauggaacuguaacaauggagugcucaccgagaacuggacuagacuuuaaugagaugguuuuacuucaaauggaagauaaagcauggcuaguccaucggcagugguuucuagaucugccccuuccuugguugccaggugcugacacacaagguaguaauuggauacaaaaagagacacucguaacauuuaaaaacccacaugcgaagaaacaagacguagucguuuuggggucgcaagaaggagcuaugcauacagccuuaacaggggcaacugaaauucaaaugucuuccggaaaccugcuguuuaccggucaucuaaaauguagguuaaggauggacaagcuccaacuuaaaggaaugaguuacucaauguguacugguaaauuuaagauuguaaaggaaauugcugaaacacagcauggaacaauaguuauacgaguacaauaugaaggagaugggaguccuuguaagauaccuuuugaaaucauggaccucgaaaagcgccauguauuaggccgacuaauuacaguaaaccccauaguuaccgaaaaagauucuccagucaauauagaggcagagccuccauucggagauucauauauaauuauuggcguagaaccuggacaacuaaaauuaaacugguuuaagaaagguagcuccaucggucaaauguucgagacaacgaugagaggugcgaagagaauggcuauacugggagauacagccugggacuuuggaucacuagguggggucuucacaucuauugguaaagccuuacaccagguuuuuggcgcaauuuauggagcagcauucucagguguaucauggaccaugaaaauacuuaucggagcuauuauaacguggauaggaaugaauaguagaucgacgagcuuaagcgucagcuuaguauuagucgguguaauaacacucuaucucggagcuauggugcaagcggauucugggugcguaguaaguuggaaaaauaaggaauugaaauguggaucuggaauuuuuauaacugauaauguacauacauggacagaacaguacaaguuccagccagaaaguccaucaaaguuggcgucagcgauucaaaaggcucacgaagaaggcauaugugguauuagaucggucacaagauuggaaaaccuaauguggaaacaaauuacacccgaauugaaccacauauuaucagaaaacgaggugaaacuuacgaucaugacaggcgacauaaaagguauuaugcaagcuggaaaacguagccuccguccacaaccaacggaacuaaaauacagcuggaaaacuuggggcaaagcuaaaaugcuauccacagaaucucauaaucagacuuuucuaauagacgggccugagacugcugaguguccaaauaccaaccgagcuuggaacucucuugaaguagaagacuacggauuugguguguuuacgacaaauauuuggcuuaaacugagagagaaacaagauguauuuugugacucuaaacuuaugagugcggcaauuaaagacaaccgagcaguacaugcggauaugggguacuggaucgaguccaccuuaaaugacacauggaaaauggaaaaagccagcuuuauugaggugaagucuugccacuggccaaagucgcauacccucuggaguaauggcgugcuugaaagugaaaugauuauccccaagagcuuugcaggcccaguaucccagcacaacuauagaccaggauaucauacucaaaccgcuggacccuggcaucugggaaaacuagagauggacuuugacuucugugagggaacaacaguuguuguaacagaggauugcgggaauagggggcccagcuuacguacaacaacagcaucugggaaauuaauuaccgaaugguguuguagaagcugcacauuaccuccacuccgguauagaggcgaagauggaugcugguaugguauggaaaucaggccuuuaaaagaaaaggaagaaaauuuaguuaauagucuaguuacagcugggcacggacaaauagauaacuucucucuagguguacuuggaauggcccuauuucuagaggagauguuaagaacuaggguagguaccaagcaugcgauauuacugguagcaguaucguucgugaccuugaucacagguaauaugagcuuuagagacuuaggaagaguuauggugaugguuggcgccacgaugacagacgauaucgggauggggguaacguaccuagcacuguuggcagcauuuaagguaagacccaccuuugcggccgguuuguuacuacguaaacuaaccaguaaagaacuuaugauggcaacaauaggaaucgcuuuauuaagccagucgacaauucccgaaacaauacuagaauugacugaugcccuggcacuaggaaugaugauacucaagauaguacgaaauauggagaaguaucaacuagcuguuaccauuauggcuauaagcugcguaccaaaugcgguuaucuuacaaaacgcauggaaaguuucguguacuauauuggcagcaguuuccguuaguccacuacuacuuacaaguucccaacaaaaagcugauuggaucccauuagcguuaacgauuaaaggguuaaacccgaccgcaauauucuuaaccacacugucaagaacaucuaagaaaagaucauggccccucaacgaggcuauaauggccgugggaauggugaguaucuuagcguccucucuauugaaaaaugacauaccgaugacuggacccuugguagcaggcggguuguuaacuguuugcuauguacuuacugggcguagcgccgaucucgaacuggaaagagcaacagacgucaaaugggaagaucaagcugaaaucucagggucguccccaauacuaaguauaacaauaagugaagauggcucgaugaguaucaaaaacgaagaagaagaacagacacuuacaauucuaauaagaacaggguuauugguuauuucuggacucuuucccguauccauacccaucacagcugcggcuugguaucuuugggaagucaaaaagcaacgugccggaguccuaugggacguaccauccccgccaccuguggggaaagcugaacuggaagauggcgcuuauaggauaaaacaaaaaggcauacuuggcuacucccagauaggugcagggguauauaaagaaggcaccuuucacacaauguggcauguaaccagaggugcaguguuaaugcauagaggaaaaagaauugaacccagcugggcagacgucaagaaagauuugauauccuacgggggagguuggaaacuagagggagaauggaaagaaggcgaagaagugcaaguauuggcacuagaacccggaaagaacccgcgugcugugcagacuaagccgggucuuuuuaaaacaaacacaggaacgaucggagcaguaucauuagacuucucaccggguacaucugggucuccgauaguagacagaaaagguaaaguaguaggacucuacgguaauggcguuguuaccagaucaggagcuuauguuagugcaauagcacagacagagaagaguauagaagauaauccagagauagaagacgauauauucagaaagaaaagauugacaauaauggaucugcaccccggcgcugguaaaacaaaaagauaucucccugcgauuguaagagaagcgauaaagcgaggccucagaaccuuaauacucgcaccaacgcgcguaguagcagcagaaauggaagaggcuuuacggggauuacccaucagguaccaaacaccggccaucagagcggaacacaccgguagggagauaguagauuuaaugugccacgcaacuuuuacuaugcgacuacuuaguccagugagagucccaaacuacaaucucaucauuauggacgaagcucacuuuacagacccugccucaaucgcagcgcgaggcuauauuucaacuaggguagaaaugggggaggccgcagguauauuuaugacugcaacaccaccugggagcagagacccauuuccgcagagcaaugcuccuauaauggacgaagaaagagagauuccggaaagaagcuggaauuucggccacgaauggguaaccgauuuuaagggaaaaacggucugguuugucccaagcauaaaagcaggaaaugauauugccgcaugcuugagaaagaaugggaaaaagguuauacaacuaucuagaaagacuuuugauucagaguauguaaaaacaagaaccaaugauugggacuuuguggucacgacugauaucuccgagaugggagcaaacuuuaaggcagagcgcgugaucgauccaaggagaugcaugaaacccguuauacuaacagauggugaagaaagaguuauucuugcugguccuaugccgguaacacauucaucagcugcgcaacguagggguagaauuggcagaaauccaaagaacgagaaugaccaguauauuuauaugggagagccauuagaaaaugaugaggauugugcccauuggaaagaggcaaagaugcuacuggacaauauuaauacuccagaggggauaauuccaucuauguuugaaccggaacgggaaaaggucgacgcuauugacggggaguauaggcuucgcggagaagcgagaaaaacauuuguugaucucaugcgaagaggugacuuaccugucugguuggcguacaggguugcugccgaaggaauaaauuaugcugacagaagaugguguuucgacggagucaaaaauaaucaaauacuagaagaaaaugucgagguagaaauauggacaaaagagggagaaaggaagaaauugaaaccgcgguggcuugaugcaagaauauacagcgauccccuugcacuuaaagaguuuaaagaauuugcugcgggaagaaaaucacuaacacuaaaccuaauaacagagaugggaagacuuccaacauuuaugacacagaaagcucgggaugcucuagauaaccucgcaguuuuacauacggcagaagccgguggacgagcauauaaccacgcucuaucggaauuaccggaaacucuagaaaccuugcuucuacuaacucuucuggcaacaguaacaggaggaaucuuccucuuccuuaugaguggcaaggguguaggaaaaaugacuuugggaaugugcuguauaauaacggcaucgauucuuuuaugguaugcacaaauucaaccccauuggaucgcagcaucuauaauccuagaguucuuucuuauuguucuuuuaauuccugaacccgaaaaacaaagaacgccucaggauaaccaacuuacauauguaguaauagcuauauugacggucguagcggcuaccauggcaaaugaaaugggauuucuagagaaaaccaagaaggauuuaggucuuggguccgucgcaacucaagagccugaaucaaauauauuagacauagaucugaggccagcuagugcguggacacuguacgcaguggcuacgaccuucgucacgccaaugcuacggcacucaauagagaacaguaguguuaauguaucucuaaccgccauugcuaaucaggccacuguuuugaugggccuugguaaaggcuggcccuuaucaaaaauggacaucgguguacccuuauuggcaauaggaugcuauucacaggucaacccgauaacucuuaccgcagccuuauuacuauugguugcacacuacgcuauuauagggccgggucuacaagcaaaagccacaagagaggcacagaaaagagcugcagcggguauaaugaaaaauccaaccguugacgguauaaccguaauugaccuagacccuauaccauaugaucccaaauuugaaaaacaacuaggccaaguuaugcuuuuaauauuaugcguaacacaaguacucaugaugagaacaaccugggcucuuugcgaggcgcucacucuggcuacaggcccaaucagcacccugugggaaggaaauccugguagauuuuggaauaccacuaucgcaguuagcauggcaaauauuuuuagaggaagcuaccuagcaggagcaggauuauuguucucaaucaugaaaaauacuacaaauacaagaagagguacgggaaauauuggcgaaacccuuggugaaaaauggaaaagucgguuaaaugcauuagggaaaagcgaauuucagauuuauaagaaaucuggaauacaagaaguggaccggacacuagcuaaggaaggaauaaaaagaggcgaaacggaucaccaugcaguaucacguggaagugccaagcuccggugguuugucgaaagaaauaugguaacaccugaagguaagguaguugaucuaggcuguggacguggugguuggaguuauuauuguggcggucuuaaaaaugucagagagguaaaaggguugacuaaggguggccccggacaugaagaaccuauaccgaugucgaccuacggauggaaccuuguaagacugcagagugguguagacguauucuuuacaccuccagaaaaaugcgauacguuacuuugugauauuggagaaagcucaccaaacccaacuauagaggcaggacgaaccuuacguguucugucacucguugaaaauugguuaaauaaugacacacaguuuugcauaaaaguacuaaauccauacaugccuucaguaaucgaaaagauggagacacugcaacgcaaauacggaggggcauuaguacgaaacccguuaagucgcaauucaacccacgaaauguacuggguaucgaacgcuacagguaacauuguuucaaguguuaauaugauuucacgcaugcuaauaaaucgguucaccaugaagcacaagaaagcuacguaugaaccggauguagaucucggcagcgggacccggaauauaggcauagaaucggaaauaccaaauuuagacauaauugggaaaagaaucgaaaagauaaagcaagaacaugaaacauccuggcacuacgaucaagaucaucccuauaagacaugggcauaccaugguagcuacgaaaccaaacaaacaggaucagcaaguagcaugguaaauggaguaguacgauuguuaacaaaaccgugggauguuguuccuauggucacgcaaauggcaaugacagauacaacaccauuuggacagcagagaguguuuaaagaaaaggucgauacuaggacccaggaaccuaaagaagguacuaagaaauuaaugaagaucacugcagaguggcuuuggaaagaacuugggaagaagaaaacuccaagaauguguacacgggaagaauuuacacgaaaaguacggucgaaugcagcuuugggugcaauuuucacugacgaaaacaaauggaagagugcuagagaggcaguugaggacagccgauuuugggaauuaguugacaaagaaagaaaccuucauuuagaaggaaaaugcgaaaccugcguauacaauaugaugggcaaacgagagaagaaacugggcgaguucggaaaggcaaaagguuccagagcgauuugguauauguggcucggugcaagauuccuugaguuugaagcccucgguuucuuaaaugaagaucauugguuuagccgggaaaauagcuugagcggcguagaaggagaagggcuucacaaauuggguuauauuuugcgugauguaaguaagaaagaggguggcgcuauguacgccgaugauaccgcagggugggacacuaggauaacucuagaagauuugaaaaaugaagaaauggucaccaaccacaugggaggagaacacaaacggcuagcagaagccauuuuuaaacuuacauaucaaaauaaagugguacgaguccaacggccaacaccucgagggaccguaauggauaucaucagcagacgagaucaaagagguucgggccaaguaggcacuuacggacuuaacacuuuuacaaauauggaagcacaacucauaagacaaauggaaggugagggaauauuuaaaucuauacaacacuugaccguuacggaggaaauugccguccagaacugguuggcacgcguugguagagaacgguuaagccgcauggcaauuucaggagaugacugcguggugaaaccguuggacgaccgauuugcgagugcccuaacagcguuaaaugauaugggcaaaguuagaaaagacauccaacagugggaaccaaguaaagguuggaacgauuggacucaagugcccuucuguucucaccacuuccacgauuugauaaugaaagacggucgaguccuuguaguaccaugucgaaaucaagaugaacugauaggucgcgcaagaauaucacagggggcuggauggucauugaaagaaacagcaugccugggaaaguccuaugcacagauguggagucuaauguauuuucacagacgugacuugagauuagccgcaaaugcuauauguucagcagugccuagucauugggucccgacgagcagaaccacguggucuauacacgcgaaacaugaauggaugaccacugaagauauguuaacagucuggaacagagucuggauacaggaaaaccccuggauggaagacaaaaccccaguugagucuugggaagaagugccguaccuuggaaaacgcgaagaccaaugguguggcagccuaauuggacuuacaaguagggcaaccugggccaaaaauauccaaacggcaaucaaccaaguaagaucacuuauaggcaaugaagaauauacugacuauaugccuaguaugaagcgauuucgaagagaagaagaagaagcagggguuuuaugguaa

SEQ ID NO: 22838 - RNA, 9876 nt, Artificial Sequence
  derived and/or modified CDS sequence (opt6) from DENV-2__FM210204__SS-prME
accgcgggcguaauaauuauguuaauucccaccgcuauggcauuccaucucacuacuagaaauggggaaccccacaugauagucgguagacaagaaaaaggcaaaagccuuuuguuuaaaacugaagacggcguaaauauguguacacucauggcuauagauuuaggugaauuaugugaagauacgaucacuuauaaaugcccucuacugaggcaaaacgaaccagaagacauagauuguuggugcaauaguacuagcacuuggguaacauacgguacaugcacuacaacuggagagcaccgacgggagaaaagauccgucgcuuuaguaccacauguagggaugggcuuagagaccaggaccgaaacauggaugucaagugaaggagcauggaaacacgcucaacgaauugaaacauggauacuacgacauccaggauucacaauaauggcagcaauacuggcauauaccaucggcacaacucauuuucaaagagcccuuaucuuuauacuucuaacugccguggcuccuagcaugacaaugagauguaucggcauaucaaaucgggauuuuguggaaggugugucaggugguaguuggguugacauuguauuagaacauggcucauguguuaccaccauggcuaaaaauaaaccaaccuuagauuuugaauugauuaaaacagaagcaaaacaaccagccacacuaagaaaauauuguauugaagcgaaacucacaaauaccacaacagaaagccgcugucccacucaaggagaaccaucauugaacgaggagcaagauaaaagguucguauguaaacauucaauggucgacagagguugggguaacgguugcggguuguucggcaaagguggaauaguaacaugcgcuauguuuacuuguaagaaaaacauggaagguaaaaucguccaaccagagaaucuggaauauacgauagucaucacuccccauucaggagaggaacaugcaguugggaaugacaccggaaaacauggcaaagaaauaaaaauuaccccacaaaguaguguaaccgaagcugaauuaacagguuacggaacaguaacaauggaaugcucuccuaggacgggccuagacuucaaugagaugguacugcuucaaauggaagauaaagcaugguugguucauaggcaaugguuccuugacuugccauuaccuuggcucccaggagccgauacgcaagguaguaauuggauacaaaaagaaacauuagucacuuuuaaaaauccucacgccaagaaacaagauguaguaguacuagguucacaagaaggcgcaaugcacacugcuuuaacaggagccacagaaauucaaauguccagcgggaauuuacuuuucacugggcacuuaaaaugcagacucagaauggauaaauugcaacugaaaggcaugucauacucgaugugcacaggcaaauuuaaaauaguaaaagaaauugcugaaacccaacacggaacuauugugauucgaguacaguaugaaggcgauggaagcccauguaaaauaccguucgagauaauggaucuugagaaaaggcacgucuuggggagguuaaucacaguaaacccaauaguaacagagaaagacaguccgguaaauaucgaagcagagccacccuucggcgauucguauauaauaauagguguagaacccggacaguuaaaacucaacugguuuaagaaaggaucaucaauuggacaaauguuugagacgacgaugcguggcgcuaaaagaauggcuauacugggggauacggcgugggauuucggaucauuaggagguguguuuacaucaaucgguaaagcacuacaucaaguauuuggagcuauauauggcgccgcauucucaggagucagcuggacuaugaaaauauuaauaggagcuaucauaacuuggauugguaugaauaguaggagcacaaguuuauccguaucauugguccuagugggcguuauaacacuauacuuaggagccauggugcaggcugauagcggauguguuguaagcuggaaaaacaaagagcugaagugcggaagcggcauuuuuauuacagauaacguacacacauggacagaacaauacaaguuccaacccgaaaguccuucuaaacuggccucugcaauucaaaaagccuaugaagaaggcauauguggcauacgauccgugacucgucuggaaaaucucauguggaaacaaauaacuccugaauuaaaccauauauuauccgaaaaugaagucaaauugaccauaaugacgggagauauaaagggaauuaugcaagcaggaaaaagaucgcuaagaccacaaccaacagaauuaaaguacaguuggaagacuuggggcaaggcuaaaaugcugaguaccgaaucucauaaucaaacuuucuugauugauggcuuagaaacggcugaaugucccaauacaaaucgagcauggaauaguuuagaaguugaggacuaugguuuuggagucuuuacgacaaacaucugguuaaagcuccgcgaaaaacaagaugucuuuugugacucgaaauugaugucagcagcaaucaaagacaaccgggcuguacaugcagauaugggauauuggauugagagugcgcuuaaugacacuuggaaaauggaaaaggcuaguuucauagaagucaaaagcugucauuggccgaaaucacacaccuuauggucaaacggaguuuuggaaucagaaaugauaauuccaaaaaguuuugcaggaccaguaucucagcauaauuaucguccuggauaccauacacaaacugccggcccauggcaccugggaaaacuugaaauggauuuugauuuuugcgaggggacaaccguagugguaacagaagauuguggaaacaggggaccgagcuugcgaacaacgacggcguccggcaaguuaauuacugaaugguguugcagaucguguaccuuaccuccccuaagauaccguggcgaagauggauguugguaugggauggagauacgaccuuuaaaagaaaaagaggaaaaccuaguaaacagcuuaguuaccgcgggucacgggcaaaucgauaacuuuucauuaggcguucuaggaauggcccuauuuuuagaggaaaugcuucgaacacguguaggaacaaagcaugcaauacuauuaguggcaguaucguucgugacucuaauaacgggaaauaugaguuuuaaggaucugggaagaguuauggucaugguuggagcuacaaugacggacgacauaggaaugggaguaaccuacuuagcucuccuagcugcuuuuaagguuagaccuacauucgccgcaggacuguuacuuaggaaacuaacgucgaaagaacugaugauggccaccauugggauagcucuccugucucaaucaacuauuccagaaacaauauuggaacucaccgacgcccuugcacugggaaugaugguuuuaaaaauagugcgcaauauggagaaguaucaauuagcaguuacaauaauggcaaucucaugugucccgaacgccgugauauuacagaaugccuggaaggucuccuguacuauauuagcagcagucucaguaucuccuuuguuauuaacaucaucacaacaaaaggcugauuggaucccccuggcacuaacaauuaaaggguugaauccaaccgcuauauuuuuaacgacccuuuccagaacgagcaagaagagaaguuggccacucaacgaggcuauaauggcagugggcaugguaucaauauuagcgaguagcuuauugaaaaaugauauccccaugacaggcccucuaguugcaggagguuuacugacuguuugcuauguacuaacagggcgaucagccgaucuggagcuagaaagagcaaccgacguaaagugggaagaucaagcggaaauaucaggaucgucaccuauacugagcauaacaauuagcgaagauggaucaaugaguaucaaaaacgaagaagaagaacaaacccuaacaaucuuaauaaggacuggacuucuagucaucucaggauuauuuccgguuucaaucccaaucacggcugcugcaugguaucuaugggaagucaagaaacaacgugcggguguacuaugggacguuccauccccgccuccaguuggaaaggcagaauuggaagacggagcguaucguauaaaacagaaaggaauauuaggcuauucucaaaucggagcuggagucuauaaagaaggaacguuucauacaauguggcacgucacgagaggggcugugcugaugcauaggggcaaaagaaucgaaccgucaugggccgaugucaagaaagaccuaauaaguuacgguggggguuggaaauuggaaggagaauggaaagaaggugaagaaguacaagucuuagccuuagaaccugguaaaaacccuagagcaguacagacaaaaccaggucuauucaagacgaauaccggaacaaucggggcgguuagucuagacuuuuccccaggaacaucgggguccccuauaguagaucgaaaaggaaaagugguaggacucuacgggaacgguguagugacuagauccggugcauauguuagcgcuauagcacagacagagaaaagcaucgaagacaauccagaaauagaagacgacauauuucguaagaaaagacucacuauaauggaucuccacccaggugcaggaaaaacuaaacgcuaucugccagcaauuguuagagaggcaaucaaaagagggcuucguacacuuauacuugcacccacgcgcgucguagcugcugaaauggaagaagcauugcguggauuaccuaucagguaucaaacucccgcuauaagagcagaacauacuggacgugagauaguggacuuaaugugucacgccaccuucacuaugaggcuauuaagcccggugcgaguuccaaauuauaauuuaauuauuauggaugaagcgcacuuuacagacccagccuccaucgcggcacgaggcuauaucaguaccaggguagaaaugggagaagcagcugggauauuuaugacagcgacaccgccagguucacgagauccauucccgcaguccaaugcgccaauaauggaugaggaaagagaaauuccagaaagaagcuggaacucuggucaugaauggguaacagauuucaagggaaaaacuguaugguuuguaccaucgaucaaagcagguaacgauaucgcugcauguuuaaggaaaaaugguaaaaagguuauccagcuaucaagaaagacauuugacucugaauauguuaagacaagaaccaaugauugggauuuuguagugacuaccgauauuucggaaaugggagcaaauuucaaagcugaacgagucauugauccaagacgaugcaugaaaccagugauucuaacggauggugaagaaagaguuauauuagcaggaccaaugccuguuacccacaguagcgcagcccaacguagaggcaggaucgggaggaaccccaaaaaugagaaugaucaauauaucuacaugggagaaccacuagaaaacgacgaagauugcgcgcauuggaaggaagcaaagauguuacuagacaauauaaauacaccggaagggauuauaccaucaauguucgaaccggaacgugagaaaguugaugccaucgacggggaauauagauugcgaggugaggcucguaaaaccuucguggaucuaaugcgaagaggugauuuacccguaugguuagcauacaggguugcugcagaggggauuaauuacgcagaucgacguugguguuucgauggggucaaaaauaaucagauauuagaagaaaauguugaaguugaaauauggacaaaggagggagaacgaaagaaauuaaaaccaagaugguuagaugcaagaauuuauagcgacccacuagcgcuaaaagaauuuaaggaauuugcggcagguagaaaaucacugacacuaaauuuaaucacagaaaugggucgauuaccuaccuuuaugacacagaaggcuagagaugcguuggacaauuuggccgucuuacacacggcagaagcaggagggagggcauauaaucacgcccuuucagaacucccugagacauuagaaacuuugcugcucuuaacauuguuagcuacgguaacgggugggauauuuuuguuccucaugagcgggaaaggugucggaaaaaugacccuagggauguguuguauuauuacagcaucgauccuauuaugguaugcgcaaauccaaccgcacuggauugcagcaucaaucauuuuagaguucuuccuaauaguucuguuaauuccagagccggagaagcaaagaacuccacaggacaaucaacugaccuaugugguuauagcgauacuaacaguuguugccgcaacaauggcaaacgagauggguuuucuagagaaaacuaagaaagauuuagguuuggguaguguagcaacacaagaaccugaaucuaacauucuagauauugaccuaagaccagcaagugcauggacccuguaugccguagcuacuacguucguuaccccgauguuacgucacucuauugaaaacucaucuguuaaugugucucuuacagccaucgcaaaccaagcuacggugcuaaugggccuagguaaggguuggccacuuucgaaaauggauauaggaguaccuuuauuggcuauaggguguuacucucaagucaaucccauuacacucacggcugcucugcuauuauuagucgcacacuaugcaauaaucggacccggucuccaagcaaaggcuacacgggaagcacagaaacgugcugcugcgggaauaaugaaaaaccccacaguugauggcaucacugugauugauuuagauccuauuccuuaugauccuaaauuugaaaaacaacuaggccaaguaauguugcuaaucuuaugcguaacucaaguucuuaugaugcggacgacuugggcauuaugcgaagcguugacuuuagcaaccggccccauuucuacccugugggaggguaacccagggagguuuuggaacacaaccauagcagugaguauggccaauauauuuagaggcaguuaccuagcgggugcuggguuauuguucagcaucaugaagaauacuacaaauacacguagaggaacggguaauaucggugaaacauuaggugaaaaauggaagucuagacuaaacgcguuaggaaaaagcgaauuucagauauacaagaagagugggauacaggagguggaucgaacucuggccaaagaggguauaaagaggggcgaaacggaccaccaugcaguuagcagaggaagugccaaacugcgaugguuuguugagcgaaauaugguuacgccugaggggaaagucguagaucuaggaugugggagagggggaugguccuauuauuguggaggauuaaagaacguuagagaaguaaaaggacuaacaaaagggggaccaggacaugaagaaccgauucccaugaguacguauggauggaaccugguaagguugcaaucagggguugauguauucuucacuccaccugaaaaaugcgauacucuucuaugugacauaggcgagucaagcccgaauccgacgauagaagcggggcguacucuaagaguacugagucuuguagaaaacugguuaaauaaugacacacaguuuuguauaaaaguauuaaauccauauaugccuccgguuauagagaaaauggaaacccuacaaaggaaguacggaggggcuuuaguucgaaauccgcuuucucggaacucaacccaugagauguacugggugagcaaugccacugggaauauaguaucgagcguaaacaugauaagucggauguuaauaaacagauucacaaugaaacauaagaaagcuacauaugaaccagauguggaucuaggaucugguacacgaaauauaggcaucgagucagagaucccgaaucuggacaucauaggcaaacggaucgagaaaauuaaacaagaacaugagacaagcuggcauuaugaucaagaucauccauauaaaaccugggccuaccaugggaguuacgaaacaaagcagaccgguagugcgaguaguaugguaaacgggguagugagauuguuaacaaaacccugggacguaguaccuauggucacccaaauggcaaugacugauacgacuccauuuggucaacaacgcguuuuuaaagagaaaguagauacucgcacccaagaaccgaaggaagggaccaagaaauuaaugaaaaucacagcagaaugguuauggaaagaacuuggcaagaagaaaacuccuagaauguguacaagagaagaguucacaagaaaaguaagaucaaacgccgcuuuaggagcuaucuuuaccgaugaaaacaaauggaaaagcgcaagagaagccguagaagauucucgcuuuugggagcuuguugauaaagagagaaaucugcaccuagaaggaaagugugaaacaugcgucuauaauaugauggguaagagagagaagaaacuuggugaguuuggcaaagcuaaaggcagcagggcaauaugguacauguggcuuggagcgagauuuuuagaguucgaggcacucggauuccuaaacgaagaucauugguucucccgagaaaauucauugucaggaguagaaggagagggacugcauaaacuaggauauauacuaagagaugucucuaagaaagaagggggagccauguaugcggaugauaccgcaggaugggauacaagaaucacguuagaagaucuaaagaaugaggaaaugguaacaaaucauauggaaggcgagcauaaaaggcuggcagaagcaauauucaaguuaacguaucagaauaagguaguuaggguacaaagaccaacgccuaggggaacgguaauggauauaauaucucgaagagaucaaagaggcucuggacaagugggcacauaugguuuaaauacauuuacuaauauggaagcgcaauugauuaggcaaauggaaggagaaggaauauucaaaucaauacaacaucuaaccguaacggaagaaauagcaguacaaaauugguuagcucgcguugggagggaaagauuaucaaggauggcgauauccggagacgacuguguaguaaaaccuuuagaugauagguucgccagugcucuuacugcguuaaacgauaugggcaaagucagaaaagauauucaacagugggagccgucaaaaggcuggaacgacuggacccagguaccauucuguagucaccacuuucacgaucucauaaugaaggauggaagaguauuaguagucccuugucgaaaccaagacgaauuaaucggcagggcuagaauuagucaaggagcuggguggucauugaaagaaacagcaugucuaggcaaaaguuacgcgcagauguggagucuuauguacuuucacaggcgcgaccuuagacuggcagcaaaugccauuugcagugcuguuccaucucacuggguuccaacuucaagaacgacgugguccauacacgcaaagcaugaguggaugacuacugaagacaugcuuacaguuuggaauaggguauggauacaagagaauccuuggauggaagacaaaacucccguagaaucgugggaggaaguaccuuauuugggaaaaagagaagaucagugguguggcucauuaauuggcuugacaagucgugcuacaugggccaaaaauauacaaacagcaauuaaucagguucgcucgcuuauaggaaaugaagaauacacagacuacaugccgaguaugaagagguucagacgggaggaagaagaggccggaguguuaugguag

SEQ ID NO: 22839 - RNA, 9876 nt, Artificial Sequence
  derived and/or modified CDS sequence (opt6) from DENV-2__FM210230__SS-prME
acagcggguguuauuauaauguugauuccuacggcuauggcauuucaucuuacuacgagaaauggagaaccacauaugauuguaggaaggcaagaaaaagguaaaagucucuuguuuaaaacagaagacgguguuaacauguguacgcuuauggcaauagacuuaggcgaacucugcgaagauacuauuacuuacaaauguccacuacucagacagaaugaaccagaagauaucgauuguugguguaacucuacgucaacauggguaacuuauggaacgugcacaacgacaggugaacacagaagagaaaaacgcucaguagcauuggugccacacguaggaaugggacuagaaacgagaacugaaaccuggaugucguccgaaggcgcauggaaacacgcucaacgaaucgaaaccuggauucugagacacccagguuucacaauuauggcagcaauuuuagccuacacagugggaacuacucacuuucaaagagcgcuaauuuuuauauuacuugcagccguugcgccaagcaugacaaugcggugcauaggaauaucuaauagagauuuuguugaaggagugucaggagggucauggguagacauuguucuagaacauggaaguugcguaacaacgauggccaaaaauaaaccgacgcuugauuucgaauugauuaaaacugaagcaaaacaaccugcuacgcuuagaaaauauugcauagaagcaaaauuaacuaacacaacaacggaaaguagauguccaacccaaggagaaccaucauuaaacgaggaacaagauaaacgauucguuuguaaacauucaaugguagauagggggugggguaauggcuguggacuauuugguaaaggugggaucgucaccugugcuauguuuacaugcaagaaaaacauggaaggaaaaauaguccaaccugaaaacuuagaauacacaauaguaauaacuccacauucaggcgaagaacaugcgguagguaaugauacaggaaaacaugggaaagaaauaaaaaucacuccccaaucucccaucacagaagcugaauuaacuggauacggaacaguaacaauggaauguaguccacgcacgggucuagauuuuaacgaaaugguacuucuucaaauggaggauaaggcuuggcucguccauaggcagugguuuuuagaccuacccuuaccuuggcuuccaggugcugauacccaaggaagcaacuggauacaaaaagaaacucuuguaacguuuaaaaacccgcaugccaagaaacaagacguuguuguucucggaucucaagagggcgccaugcauacugcacuaacgggagcaacagagauccaaaugucaaguggaaauuuacuguuuacaggacaucuaaaaugccgacuaaggauggauaaacuucaauuaaaaggaaugaguuauagcauguguacaggcaaauuuaaaauaguuaaagaaauugcggaaacacagcacggaacuauagucauacguguccaauaugagggugacggauccccauguaaaauuccguucgaaaucauggaccuugaaaagagacaugucuuaggacgacuuauaacaguaaacccuaucgugaccgagaaagacucuccagugaauauagaagcugaaccuccuuucggggauaguuacauaauuauaggaguggagccaggucaauuaaaauuaaauugguuuaagaaaggaucauccauaggccaaauguucgaaacaacgaugagaggagcaaaaagaauggcuaucuuaggugacaccgcaugggacuuugggagucuugggggaguauuuacgagcauugggaaggcacuacaccagguauuuggggcaauuuauggcgcagcauuuucuggagucucguggacuaugaaaauauugauagguguaauaauaacauggauagguaugaacucgaggagcacgucacucucuguaucuuugguccuuguugguguaauuacuuuauacuugggagcgauggugcaagcugacucugggugugucguaucguggaaaaauaaagaacuaaaaugcgguagugguauuuuuauaacugacaacgugcauaccuggacagaacaauauaaauuccagccugaaucacccucgaaacuugcaagugcgauucaaaaagcccacgaagaggguauuuguggcauaaggucagucacacgguuagaaaaucuaauguggaaacagauuacuccggaauuaaaucauauacucagugaaaaugaagucaaacuuacaauaaugacuggugauauaaagggaauuaugcaagccggaaaacguucacuaagaccccagccgacagagcugaaguauaguuggaaaaccuggggcaaagcaaaaaugcuaaguacagagucucacaaccaaacauuccuaauugauggaccggaaacggcagaaugcccuaauacaaaucgcgcauggaauagcuuagaggucgaggauuacggcuuuggaguauucacaacaaauauauggcuaaaacuacgugaaaaacaggauguauuuugcgacucaaaacuaauguccgcugcuauuaaagauaauagagccguacaugcugacaugggcuauuggauagaaucagcauugaaugauacuuggaagauggagaaagccucuuuuauagaaguaaaaaguugucauuggccaaagagucacacgcuuuggucaaacggcguguuggaaagcgagaugaucaucccaaaguccuuugcgggcccgguaucucaacauaauuaucgaccagguuauuauacccaaaccgcgggaccauggcaucuugguaaacucgagauggauuuugauuuuugugaaggaacaacagugguagucacggaagauugcgguaacagggguccuuccuuaagaacaacuaccgcgagcggcaaauuaauaacggaaugguguugucggucaugcaccuuaccgccauuacgguacagaggagaagauggaugcugguauggaauggaaauacggccacuaaaagaaaaagaggaaaaccuagugaacagucuagucacggcuggccauggacaaauagacaacuuuucauuagguguucucggcauggcucuauuuuuagaagaaaugcugaggacaagaguagguacuaagcaugcuauauugcuugucacaguuucauuuguaacauuaauaaccgggaacaugucuuuccgcgaucucggacgagugauggugaugguuggagcugcaaugaccgacgacauuggaaugggaguuacauacuuagcccuacuagccgcuuuuaaaguucgaccaaccuuugcagcggguuuacuacucagaaaauuaacuucaaaagagcuaaugauggcaacaaucgggauugcauuacucucgcaaagcacuaucccugagacuauacuagaacuuacugacgcacuugcacucggaaugauggucuuaaagauuguccguaauauggaaaaguaccaacuggcagucacaauuauggccauauccuguguaccuaacgccgucauucuacaaaacgcguggaaagugucuuguacaauauuagcugcgguaaguguaucucccaugcuauugacgucuucacagcaaaaggcagauuggauaccucuggcccucacaaucaaaggucugaauccuacagccauauuuuuaacuacacuuucucgaacuuccaaaaagcgaaguuggccccuuaaugaagcaauaauggccguaggcauggugaguaucuuagcgucuagccuacucaaaaaugauauuccaaugacagguccuuuaguugcuggaggguuauuaacgguauguuauguauuaaccgggcgcucggcggauuuagagcuugaaagagcuacugacgucaaaugggaggaucaagccgagaucucggguucgagcccuauacucucaaucacaaucgccgaggacggcagcaugaguaucaaaaacgaagaggaagaacaaacccuuacgauacugauuagaacgggucuucucguaauaagcggcuuauuuccagugagcauuccaauaacagcugcagcgugguaucuaugggaggucaaaaagcagcgcgcaggaguuuuaugggauguuccaucaccgccaccgguuggaaaagccgaguuagaagacggagcauacagaauaaagcaaaaaggcauacuaggauauucacaaauuggagccggcguauauaaagaaggcaccuuucauacuauguggcacguaacuagaggcgcaguguuaaugcacaggggcaagagaaucgaaccaagcugggccgaugucaagaaagauuuaaucaguuauggaggugguuggaagcucgaaggugaauggaaagaaggagaagaaguacaaguacuagcauuagagcccggcaaaaacccucgugcaguucaaacgaaaccaggacuuuuuaaaacgaauacgggaacuauuggcgcuguaaguuuagauuuuuccccagguacaucaggcucaccaauagucgaccguaaggguaaagugguagguuuauauggaaauggaguaguuaccaggagcggagcuuauguuucagcuauugcgcaaacugagaagucaauagaagauaacccugagauagaagacgacaucuucaggaagaaaagacuuaccaucauggacuugcacccaggagcaggaaaaacuaagagauacuuaccggcaaucgugcgugaagccauuaaaagaggccugcguacuuuaauucuagcgccuacgagaguuguagcugcagaaauggaagaggcauugagaggccuaccgauacgcuaucagacccccgcaaucagggcugaacauaccggcagggaaauuguagacuuaaugugccaugcaacuuuuacuaugcggcuucuaucacccguucgagucccuaauuauaaccuuauuauaauggaugaagcacacuucacagacccugcuucaaucgcagcacggggauacauuagcacgcgaguggaaaugggugaagcagcagguauauucaugacugcuacaccgccaggcagucgagaccccuuuccacaaucaaacgcgcccauaauggaugaagaacgcgaaauacccgagagaucauggaacaguggucaugaauggguuacagacuucaaagguaaaacagugugguuuguuccaucgauuaaagccgguaaugauauugccgcuugucuaaggaaaaauggcaagaaaguuauucaguugagucggaaaacuuuugacucagaauauguuaagacaagaacuaacgacugggauuuuguuguaacuacggauauuucggaaaugggggccaauuucaaagccgagagaguaauugauccaaggagauguaugaagccaguaauacuaacggacggcgaagaaagggucauauuagcagguccaaugccuguaacccauagcagugcagcgcaaagaagaggcagaauagggcguaauccaaagaaugagaaugaucaauauauuuacaugggugagccucuggaaaacgacgaagacugugcucacuggaaggaagcuaaaaugcugcuugacaauauaaacacaccagaaggaauaauaccaagcauguuugaaccagagagagaaaaaguagacgcaauagauggagaauauagacugaggggugaggcucguaaaacauucguggaccucaugagaagaggcgacuuacccguauggcuggccuaucgagucgcagcagaaggaauuaauuaugcagauagacgauggugcuucgacggagucaaaaauaaccaaauauuagaagaaaauguagagguugaaauauggacaaaagaaggcgaacgaaagaaacuuaaaccacguuggcuugacgccaggauauauucggaccccuuagcccucaaagaauuuaaagaauuugcagcaggucgaaaauccuuaacacuuaaucuaauuaccgaaaugggacgccugccuaccuuuaugacacaaaaagcaagagaugcgcuggacaaccuugcuguauugcacacagcagaagccgguggacgggcauacaaccacgcccugagugaacuacccgaaacauuggaaacacuacuucuauuaacuuuauuagcaacgguuacugggggcauauuucucuuucugaugucaggcaaagguguaggcaaaaugacauuggguauguguugcaucauuacagcaucaauauugcucugguacgcacaaauacaaccacauuggaucgcagccagcaucauauuagaguuuuuccuaauaguacuucuuaucccagagccagaaaaacaaagaacgccgcaggacaaucaacuaaccuauguaguaauugcuauucuuacagugguggccgccacuauggccaacgaaaugggcuuucuggaaaagacgaagaaagauuugggcuuaggcagcauagcaacgcaagaaccagaaaguaauauuuuagauauugaccuaagaccugcaucagccuggacguuguacgcagucgcaacaaccuucgugacuccgaugcuacgacauagcaucgaaaauucaucagucaacgucucacucacggcuauagcuaaucaagccaccguauuaauggggcuaggaaaaggauggccacucaguaaaauggacaucggagucccgcuucuugcaauagguuguuauucacagguaaacccaauuacucuaacggccgcgcuauuacuuuugguagcacacuaugcaaucaucgggccaggucuacaagccaaggcaacaagagaagcccagaaaagggcugccgcuggaauuaugaaaaacccuacaguugacggaguuacaguaauagaucuugauccaauuccguaugauccaaaauucgaaaaacagcuuggucaagugauguuguugauucuuugugugacucaaguuuuaaugaugcguacaacaugggcacuuugugaagcccuaacacuugcaaccgggccaauuagcacacuaugggaaggcaauccgggucgauuuuggaacacuacaauagcuguaucaauggcuaauauuuuuagggguuccuaucuugcuggggcaggacuauuauuuucgauuaugaagaauacaacaaauacaagaagggguacuggaaauauaggggaaacacucggcgaaaaguggaagucacgacuaaaugcucuagggaaaagcgaauuucagauauacaagaagucugguauacaagagguagaucgaacauuagcgaaggaaggaauuaaaagaggagaaacugaucaccacgcgguaucgaggggaagcgcuaaacuccguugguuuguagaacgaaauaugguaacaccggaggguaaagugguagaucuaggcugugguaggggagguuggucauauuacugcgguggguuaaaagauguuagggaaguaaagggacuuacaaaaggagguccgggacaugaagaacccauuccgaugagcacauacggauggaaucucguucguuuacaaucggguguugacguauucuuuaccccgccugaaaaaugcgauacucuguugugugacaucggagaaucgucuccaaauccuacuauugaagcgggaagaacauuaagaguauuaagucuaguagaaaacuggcugaauaaugacacgcaauuuugcauuaagguuuuaaauccauauaugccaagcguaauugagaaaauggagacacuacaacgcaaguacgguggcgcauugguaaggaacccacuaucacggaacucgacccacgagauguacuggguaagcaacgcaacagguaauauaguuaguagcgucaacaugauuucacggauguuaauaaaccgguucaccaugaaacauaaaaaggccacauacgagccugacguagaucugggaucgggaacaaggaacauaggaauagaaucugaaauuccaaaccuugauauuaucggcaaacguauagagaagauuaaacaggaacacgagacauccuggcauuacgaucaggaccacccuuacaagacuugggcauaucaugguucguacgaaacuaaacaaacaggaagugcaucuagcauggucaacggaguuguccgguuacuaaccaaaccaugggauguaguuccgaugguaacccaaauggcaaugacagacacgacacccuuuggccaacaacggguauucaaggaaaagguugauacuaggacacaggaaccaaaagaggguaccaagaaacuuaugaagauuacggcugaauggcucuggaaagaauuagggaagaagaaaacuccuagaauaugcacaagagaagaguucacucgaaaaguacguaguaaugccgcauugggagcgauauucaccgaugaaaauaaauggaaaucugcgagagaggcuguggaagauucacgauuuugggaguuagucgauaaagaaagaaauuuacacuuggaagguaaaugcgagacuugcguguacaauaugaugggaaaaagagagaagaaacuaggagaguucgguaaagcaaaaggaagccgagcaauaugguacauguggcuaggugcaagauucuuagaguucgaagcacucggauuuuugaaugaagaucacugguucucccgcgaaaacucucuuucagggguggaaggggaaggacugcauaaauuaggauacauauuaagggacgucucaaagaaagguggaggcgcaauguaugcggacgauacagcggggugggauacgaggauuacacuagaggaucuaaagaaugaagaaauggugacuaaucauauggaaggcgaacacaagaaauuagcagaagcuauauucaaauuaaccuaucagaacaaaguaguacggguccagcgaccgacuccuagaggaacggucauggacauaauuucaagacgugaucagagagguuccggucaaguuggcacauauggacuaaacacauucaccaacauggaggcgcaacuuauacgacagauggaaggcgagggaguuuuuaaaagcauccaacguuuaacaguuacugaagagaucgcggugcaaaauugguuggcaaggguagguagggaaaggcuauccaggauggccaucaguggugacgacugcgucguaaaaccauuagaugacagauuugccagcgcuuugaccgcucuuaaugauaugggaaaaguccgaaaagauauacaacagugggaaccaucucgaggcuggaaugacuggacacagguaccauuuuguagucaccauuuucacgaacuuauaaugaaagauggacgaguccugguuguuccguguagaaaccaggacgaguuaauuggucgugcaagaaucucccagggcgcaggauggagcuuaaaagaaaccgccugucucggaaaaaguuacgcucaaauguggagucuuauguacuuucaccgccgagaucugagacuggcagcaaaugcuauaugcucugcggucccaucacauugggugccaacaagccgaaccacauggaguauacacgcaaaacaugaguggaugacaacugaagacaugcuaaccguguggaaccgcguauggauucaagaaaauccauggauggaagauaaaacccccguugaaucgugggaagaaguuccauauuugggaaaacgagaagaucaauggugugggucgcucauaggucuaacaucaagagcaacaugggcgaaaaacauacaaaccgccaucaaucaaguacggagucuaauuggaaacgaagaauauacugauuacaugccgagcaugaaacgcuuucgaagagaagaggaggaggcuggaguccuuugguga

SEQ ID NO: 22840 - RNA, 9876 nt, Artificial Sequence
  derived and/or modified CDS sequence (opt6) from DENV-2__KC762665__SS-prME
acggccggaauuauuauaaugaugauuccaaccguuauggcauuccaccugacuacuagaaauggugaaccgcauaugauaguuucaagacaggaaaaaggaaaaagucuccuauuuaaaacggaaaauggggucaauaugugcacguuaauggcuauggacuugggagaacuaugugaagauacuaucacuuauaauuguccccuacuaaggcaaaaugaaccagaagacauagacugcuggugcaacagcacaagcacuuggguuacauauggcacgugcacugcaacuggagaacacagaagggagaaaagaagcgucgcacuugucccucacguuggaaugggacuagaaacgaggaccgaaacauggaugucgagugaaggagcguggaaacaugcacaaagaaucgaaacuuggguucuucgucauccaggauuuacuauaauggcugcaauuuuagcauacacaauaggaacaacauauuuccaaaggguccucauauuuauucuauugacagcagucacacccagcaugaccaugagauguauugggaucaguaaccgagauuucgucgaaggaguaucaggaggcaguuggguugauauaguguuggaacacggaucguguguaacaacaauggcgaaaaauaaaccgaccuuagauuuugaacuuauaaaaacggaagcaaaacauccagcuacccuucggaaauauugcauagaagcgaaauugacuaacacuacaacagcuucuagaugucccacucaaggagaaccaucccugaaugaagaacaagauaaacgauuuguaugcaaacacucaaugguugacagaggauggggaaaugguugugguuuauuuggaaaaggagguauugucacaugcgcgauguuuacauguaagaaaaauauggaagguaaaauaguacagcccgaaaauuuagaauacacaauaguaauaacaccacacucuggagaagaaaaugcaguaggaaaugacacagggaaacauggcaaagaaauaaaagugaccccucaaaguuccauaacugaagcagaacucacgggguauggcacagugacaauggaauguucgccuagaacagguuuagacuuuaaugaaaugguacuacuacagauggagaacaaagcauggcucgugcauagacaaugguuucuugacuugccacuaccuuggcuacccggagcagacacucaaggcaguaauuggauccaaaaagagacauugguaacguucaaaaacccacacgcaaagaaacaagauguaguaguucugggcagccaggaaggagccaugcauaccgcgcucacaggagcuacagagauacaaaugaguuccgguaaccuccuguuuacaggucauuuaaaauguagacuacgaauggauaaacuacaacucaaagggaugucguauucaaugugcacugggaaauucaaaguggugaaagaaauugcagaaacccaacacgguacaaucgugauaagaguucaguacgagggugacgguucaccuugcaaaauccccuuugaaauuauggaucuugaaaaacgacaugucuuagggcgucuuauuaccguuaacccuauaguaacggaaaaagacaguccaguaaauaucgaagcagaaccgccauuuggcgauuccuacauuauaauaggcguagaaccaggucaguuaaaacuaucaugguucaagaaagguuccagcauaggucaaauguuugagaccacuaugcggggcgccaaaagaauggcgaucuuaggagauaccgcaugggauuucggaagucuaggaggcguuuucacaucuaucggaaaagcauugcaccaaguuuuuggugcuauuuauggagcagcauucucgggagugucuuggacuaugaaaauucuaauaggaguagucauuacguggauaggaaugaacucacguucuacaucgcuaucgguuucacuugucuuagugggggugguaacacuauauuuaggcguuaugguccaagcagauagugggugcguuguaucauggaagaacaaagaacuaaaaugcggaagcggcaucuuuaucacggacaacguccauaccuggacagaacaguacaaauuccaaccagaaagcccaaguaaauuggcuuccgcaauccaaaaggcucaugaagaggguaucuguggaauccgaagcgucacaagguuagaaaauuugauguggaaacaaaucacaccugaacugaaccauauucuaucggagaacgaagugaaacuaacaauaaugaccggagauauaaaggguaucaugcaagcugggaaacguucucuucgcccacaaccaacugaauuaaaauacucuuggaaaacauggggaaaagccaaaauguuaucgacagaauuacacaaucauacguucuugauagacggcccugaaaccgcagaauguccaaaugcaaauagggcauggaauagcuuagaaguagaagauuauggguuuggaguuuuuacaacaaacauaugguuaaaguuaaaagaacgccaagaugcauucugcgauaguaagcuaaugucagcggccauaaaagacaaucgagcaguccaugcggauaugggguacuggauagaaagcgcucuaaacgauacauggaaaauugagaaagcaucauuuauugagguaaaaagcugccauuggccuaaaucccauacacucugguccaacgggguccucgaaagcgagaugaucauacccaaaaacuuugccgguccggugagucaacauaauuaccgaccuggauaucauacacaaacagcagguccguggcaccugggaagauuagaaauggacuuugacuucugcgagggaacaacaguggucgugacggaggacuguggcaauagaggcccaucuuuaagaacaacaacggccucagguaaauuaauaaccgaaugguguugcagaucaugcacacuaccgccacugcgguaccgaggagaggaugggugcugguacggaauggaaauacgaccacuaaaggaaaaagaggaaaaucucguuaauagccucguuacggcuggccacggacaaauagacaauuucucguuagguguuuuggguauggcuuuguuucuagaggaaauguuaaggacgaggguuggcacgaaacacgcuauauuacuuguugccguaaguuuugugacacuuauaacugguaacaugaguuucagagauuuggguagagugaugguaaugguaggcgcuacaaugacagaugacauagggaugggaguaaccuauuuagcguuauuggcagcuuuuaagguuagaccgacguuugcagcuggacucuuauuaaggaagcuaacgucuaaagaacucaugaugaccacuauuggcauaacauuacuuucacaaucaaccauaccggaaacuauacuagaacucacagaugcucuggcacuagggaugaugguucuuaaaauaguuagaaacauggaaaaauaccaauuagcaguaacgauaauggcgauauuaugcguuccgaacgcuguuauucuacaaaaugcguggaagguaucuuguacaacacuagcagucguaucaguaucgccucuauuauugaccucaagccaacaaaaagcagacuggauuccucuggccuuaaccauaaaaggauuaaaucccacugcuauuuucuugacaacauuaagucgaacuagcaagaaaagaucauggccacuuaaugaagcaaucauggcagucgguaugguguccauauuagcaucaucauuauugaagaacgauauaccgaugacaggcccacuuguggcaggcggauuauuaacggucugcuauguacuuacagggcgcagcgccgaccucgaauuagaaagggcagcagauguucgcugggaagaacaagcagaaauauccgguucuagcccuauauuaaguauaaccauuagugaagacgguagcaugucaauuaaaaacgaagaagaggaacaaacccuaacuauacucauaaggacagggcuauuggugauuucaggccuauucccugucaguauuccaauaaccgccgcagcaugguaccuuugggaagucaagaaacaacgcgcaggagugcugugggacguuccuaguccacccccugucggcaaagcagaacuagaagacggcgcauauagaauuaaacagaaaggaauuuuagguuauucacaaauaggggcagggguauauaaagaagguacguuccacacaauguggcaugucacucgcggcgcuguauugaugcauaaagggaaaagaauugaaccaagcugggcagacgucaagaaggaucucauaucauacggaggugguuggaagcucgaaggugaguggaaggagggagaagaaguacaagugcuagccuuagaaccagggaaaaauccaagggcaguucaaacuaaaccggggcuguuuaaaacaaguacaggaacaauuggagcuguuucacuggacuucagcccgggaaccagugguucuccaauaguagauaaaaagggcaaggugguaggacuuuacgguaauggcguuguuaccagaagcgggacguacguaagcgcaaucgcgcagacugagaaaagcauugaagauaacccagaaauagaggaugacauuuucagaaagaaacgacuuacuauuauggauuuacauccaggagcuggaaaaacaaaaagguauuugcccgcgauaguaagagaagcaauuaaacgggguuuaagaaccuuaauuuuggcaccuacacgaguugucgcugcagagauggaggaggcacugcguggacuaccuauaagauaucaaacaccagcuauaagggccgaacacacggggagagagauaguggaccuuaugugucaugcaacguuuacuaugagguuguuauccccaauacgaguacccaacuauaacuuaauuaucauggacgaggcacacuuuacagacccugcuucuauagcagcaagagguuauauuucuacgcgaguagagaugggugaagcagcggggauauucaugacagcgacaccacccggaucuagagauccguucccccagucaaaugcuccuauaauggacgaagagagggaaaucccugagaggucauggaacucaggacacgaaugggugacagacuucaagggaaagacaguuugguuuguuccaucgauaaaggcagggaaugacaucgcggccugcuuaaggaagaacggcaagaaaguaauucagcuaucuaggaagacuuuugacuuugaauacauaaaaacaagaacaaacgauugggauuucgugguaaccaccgauauuuccgaaaugggcgcaaauuuuaaggcagaaagaguaauagaucccagacgauguaugaaaccaguaauucucacagacggcgaagaaagagucauacuagcuggacccaugcccgucacacauucaucagccgcgcaaagaaggggaagaguuggccgcaauccuaaaaacgaaaacgaccaguauauauauaugggugaaccccuagaaaaugaugaagauugcgcacacuggaaagaagcuaaaaugcuauuagauaauauaaauacaccagaagggauaauaccaucaauguucgagccagagcgcgaaaagguugacgcuaucgacggagaauacagauugcgcggagaagccagaaaaacauuuguggaccuaaugagacguggugaccuuccgguauggcuagccuaucgaguagcugcugaagggaucaauuaugccgacaggcgaugguguuucgaugguguuaagaacaaucaaauauuggaagaaaauguugaaguugaaauauggacaaaagaaggugaacgaaagaagcucaaaccuaggugguuggaugcgagaauuuauucagauccuuuagcccuuaaagaguucaaagaauuugcagcggggaggaaaucccugacauuaaacuugauuacggaaaugggucgacuaccuacauucaugacacagaaagcuagaaacgcucuagacaauuuagcaguauuacacacagcagaagcaggcggaagggcauauaaucaugcccuuucugaauugccugaaaccuuagaaacauuacucuugcugacucuacuggcaacgguaaccggugggauauuucuuuuccuaaugucaggcaaagguauaggcaaaaugacauuaggaauguguugcauaauaacugcaagcauccucuugugguaugcucaaauucaaccucauuggauagcggcaucaaucauacucgaauuuuuccuaaucguucuacucauaccagaaccggaaaaacagcggacaccacaggacaaucaguugacuuacgucgucauagcuauucuaacaguaguagcagcaaccauggcgaacgaaaugggauuuuuagagaaaaccaaaaaggacuuuggauuaggcucaaucacaacgcaacaaccggaaucgaauauauuggauauugaucugcguccggccucggcauggacguuguaugcaguugcuacgaccuuuauaacccccauguuaagacacuccauagaaaauagcucaguaaacgucucuuuaacggcuaucgccaaccaagcaaccguucuaaugggucuuggaaaaggcuggccacugucuaaaauggauauagguguuccauuauuagcgauuggcugcuauagucaaguaaauccuauaacguugacugcugcucuacuauugcugguugcccauuaugcaauuauuggaccgggcuugcaagcaaaggcaacgcgugaagcacagaaaagggcagcugcaggaauuaugaaaaaucccacaguugacggaaucacgguaauagauuuagaucccauaccguaugacccaaaauucgagaaacaacugggacagguaauguuacuuguccuguguguaacacaaguacuaaugaugcgcacuacaugggcgcucugcgaggcuuugacacuagcaacgggaccgaucucaacgcuaugggagggaaacccaggccguuuuuggaacacgacaauagcaguuucgauggcgaacauauucagagguaguuaccuagcaggagcaggucuccuauuuucuauuaugaaaaauacagcuaacacacgacgugggacggguaauacaggagaaacuuuaggugaaaaauggaaaaaucgucuaaaugcacuaggaaaaagugaguuccagauuuauaagaaaucuggaauacaagaaguagacaggacacuggcuaaagaggguauuaaacguggggagaccgaucaucacgccguaucucgagguucagcgaaauuaagaugguuuguugagcgaaauuuaguugccccagagggcaagguuguagaucugggaugcgguagagguggguggagcuauuauuguggaggauugaaaaauguaaaagaaguuaagggucuaacaaaagggggacccggucaugaagaaccaaucccgaugucaaccuaugguuggaauuugguacgguugcaaucagggguggauguauucuuuacuccgccggagaaaugugauacauuacuuugugauauuggugaaucaucaccuaacccaaccguugaggccgguagaacuuuacgaguacucaaucuaguggagaacuggcuuaauaauaauacgcaguucugcauaaaaguuuuaaaucccuacaugccaucugugauagagaaaauggaggcuuuacagcgcaaguaugguggugcucuggucaggaauccgcuaagucggaauaguacucacgaaauguacuggguaagcaacgcuucagguaauaucguaaguuccguuaacaugauaucaagaaugcugauaaauagauucacuaugcgacacaagaaggcgacauaugaaccugacguagacuuagguuccgguacgaggaauauagggauagaaucagaaacaccgaacuuagauauaaucggaaaaaggaucgagaaaauaaaacaagaacacgaaaccucguggcacuaugaccaagaucacccauauaaaaccugggccuaucauggaagcuacgagacgaaacaaaccggaagugcuucgaguaugguaaacggaguuguaagguuacuaacgaagcccugggacgucauuccaaugguuacacaaauggcgaugacagacacuacccccuucggacaacaacgaguauucaaagagaagguugauaccaggacacaagaaccaaaagagggaacaaagaaauuaaugaaaauuacggcagagugguuauggaaagaauugggcaagaagaaaacuccaagaauguguacgagggaagaguucacaagaaaaguaaggaguaacgcugcacuaggcgcaauauucacugaugaaaauaaauggaagagugcacgagaggcgguugaagacagugguuuuugggagcuaguagauaaggagcggaaccuucaccuggaggggaagugugagaccuguguauauaacaugaugggaaaaagagagaagaaacugggcgaauuugguaaagcgaaaggaagcagagcuauaugguacaugugguuaggugcgcgauuccucgaguucgaagcacuaggauucuugaacgaggaccauugguucaguagagaaaacucgcuuaguggaguagagggcgaaggccuccacaaauuaggauauauacugcgagacguuagcaagaaagagggaggggccauguaugcagaugacacagcagguugggacacacguauaacguuagaagaucuuaaaaacgaagaaaugguaacaaaucauauggagggcgaacauaagaaauuagccgaagcgauauucaaacucaccuaucaaaauaaaguugucaggguacaacgaccuacuccgcgaggaacaguuauggauauuauuucucgcagagaucaaagagggucgggccaaguaguaacauauggccuaaacacauucaccaacauggaagcacaauuaauucgacagauggaaggagaaggugucuuuaagaguauccaacaguuaacgguaacggaagaaauagcagucaagaauuggcuaguuagaguaggacgagaaagauuaucaaggauggcuauaagcggcgaugacugugucguaaagccauuggacgaucguuucgcaagugcuuuaacagcauuaaaugauauggggaagguaagaaaagacauccaacagugggaaccgaguaggggauggaaugacuggacacagguaccuuucugcagucaucauuuucaugaacuuauuaugaaagauggcagggucuuagucguuccaugccgcaaccaagaugaacuaaucgguagagcacguaucucucaaggcgcgggguggucacugagggagacggccuguuuagguaaaucuuacgcgcagauguggucacucauguacuuucacaggcgcgaccuaagacuagccgcaaaugcuauaugcucggcgguuccaucgcacugggugccaacuucccgaacuacauggucaauacaugcaacucacgaauggaugaccacagaagacaugcuaaccguauggaacagaguauggauccaagagaacccuuggauggaagauaaaacgcccguugaaaguugggaggaaauuccauaucuagguaaaagggaagaucaaugguguggaucucuaauuggguuaacaaguagagcaaccugggcuaagaauauacaaacagcgauaaaucaagucaggucacucauugguaacgaagaauauacagacuacaugccuaguaugaagcgauucaggagagaagaggaagaagcuggaguauuaugguaa

SEQ ID NO: 22841 - RNA, 9876 nt, Artificial Sequence
  derived and/or modified CDS sequence (opt6) from DENV-2__KC762669__SS-prME
acugcuggaauuauaaucaugguaauccccacuguaauggcauuucaucuuaccacuagaaacggagaaccucacaugauugugagucggcaagaaaaaggcaaaucuuuauuauuuaaaacggaaaauggaguaaauauguguacauuaauggcgauggaccuaggagaauuaugugaagauacaauuacauacaauugcccguuauugaggcaaaaugaacccgaagauauugacuguugguguaauaguacaaguacguggguaacguacggaacauguaccgcaacaggggaacauaggagggagaaaagaaguguagcucugguaccccauguuggaaugggacucgaaacaagaaccgaaacuuggaugucaucagaaggcgcauggaaacacgcacaacgaauagaaacuuggguauuaagacauccagguuucaccauaauggcagcaauacuagcauauacaauagguacaacauacuuccaaagaguacuaaucuucauauuauugacagcgguggcccccucgaugacaaugcgaugcauaggcauaagcaacagggauuucguggaaggagucaguggaggcucuuggguggauauuguauuagaacauggcucguguguaacaacaauggccaaaaauaaaccaaccuuggacuuugaacugauaaaaacagaagcgaaacacccugcaacccugcgaaaauauuguauugaagcuaaauuaacaaauaccacuacagcaagucgauguccuacacaaggagaaccuucauuaaacgaagaacaagauaaaagauuuguguguaaacacuccaugguugacagggggugggguaauggcuguggccuguucgguaaaggcggaaucguuacuugugcuauguuuacuuguaagaaaaauauggaagguaaaauuguucaaccagaaaaccuggaauacacgauagugauaacuccucauucuggcgaggaaaaugcagucggcaaugacacagguaaacacggaaaagaaauaaaaguaacaccacaaaguucgaucacagaggcagaacucacaggcuauggaacgguuaccauggagugcucuccaaggacaggauuagauuuuaacgaaaugguccugcuacaaauggaaaauaaagcaugguuaguucaucgccaaugguuucuugauuuaccccuacccuggcuaccaggagcagauacacaggguagcaauuggauacaaaaagagacauuagucaccuucaaaaauccucacgcuaagaaacaagaugucguagucuuagggucccaggaaggggcaaugcauacagcacugacgggugcaacugaaauucaaauguccaguggaaaccuacuguucacgggacaccuuaaaugcaggcucagaauggauaaacuacagcucaaggggauguccuacucuauguguacagguaaauuuaaaguggugaaggaaauugcagagacacaacacgggacaauagugaucagaguacaguacgaaggcgauggaucacccuguaaaauuccuuucgaaauuauggauuuggagaaaagacauguccuagggagacuuaucacaguuaacccgauagugacugagaaagauucacccguaaauauugaagcagaaccaccguuuggugauaguuacauaauaauaggaguugaaccaggccaauuaaaacuaagcugguuuaagaaagggucgucaauuggucaaauguuugaaacaacaaugcgcggcgcgaaaaggauggcuauauugggagauacagcaugggauuuugggagucugggugguguguucacauccaucggcaaggcacuucaccagguauuuggugcaauuuacggcgcagccuucucaggaguuagcuggacuaugaagauauuaaucggagugguaauaacauggauuggcaugaauagcagaucaacaaguuuauccguaucucuagucuuagugggaguaguaacauuauacuuaggcguaaugguucaggcagauucgggcugugucguuucguggaaaaauaaggaacuaaaaugcggaagugggaucuuuauuaccgauaacguacauacuuggacggaacaguacaaauuucagccugaaaguccaaguaaacucgccagugcuauacaaaaggcccaugaggagggaaucugugguauacguuccguaaccaggcuggaaaaucuaauguggaaacaaauuacacccgaauuaaaucauauucucagugaaaaugaaguaaaauuaacaauaaugacuggcgacauaaagggcauaaugcaagcuggaaaaagaucacuuagaccacaaccuacugaacuaaaauacucuuggaaagcaugggguaaagcaaaaauguuguccacugaauugcauaaucacacauuuuuaaucgaugguccagaaacagcugaauguccuaacaccaaucgagcuuggaacucccuggaaguugaggauuauggauuuggggucuuuacuacgaacaucuggcuuaagcugaaagaacgacaagauguauuuugugauuccaagcucaugagugcggcaauaaaagauaaccgagcugugcaugcagauaugggguacuggauugagucugcgcuuaacgacaccuggaagauagaaaaggccaguuuuauugaagucaaaucaugucauuggccuaaaagucauacuuuguggaguaauggaguucuugaauccgagaugaucaucccaaagaauuuugcuggaccggugagccagcacaauuaucggcccggcuaucauacccaaacagcaggccccuggcaucucgggagguuagagauggauuucgacuucugugaaggaaccacugucguaguuacggaagacugcggaaauagagguccuagccuaagaacgaccacagcgucugggaaauuaauaacagaaugguguuguagaucauguacacuaccacccuuacguuauagaggcgaggaugguugcugguaugguauggagauuagaccacuaaaagaaaaggaagagaaucuaguaaauucucucguaaccgcugggcauggucaaaucgacaacuucucuuuagguguuuuaggaauggcguuauuccuugaggaaauguugaggacacgggugggaacaaaacacgcaauauuacugguagcuguaaguuuuguaacucucauaacugguaauaugucuuuucgcgauuuaggacggguuauggucaugguuggagccacaaugacugaugauauaggaaugggagugaccuauuuggcucugcuugccgcauuuaaaguaagaccaacauuugccgcaggccugcugcuacgcaaguugacauccaaagaauuaaugaugacaacaauugguauugugcuuuuaucgcaaagcacuauucccgagacaauacucgaauuaaccgacgcuuuagcuuugggcaugaugguacuaaaaaucguaagaaacauggaaaaguaccaguuagcuguaacaauaauggcaauccuaugcguaccuaaugcuguaauuuuacaaaacgcauggaaaguuuccuguacaacucuugcuguagugucuguauccccucuguuauuaacgucuucacagcaaaaagccgauuggauaccacucgcacuaacaaucaaaggucuaaacccaaccgcaauauuuuugacuacccuauccagaaccaguaagaaacgaucauggcccuugaacgaagcuauaauggcaguagguaugguaucaauauuagcaucaagccugcuaaagaacgauauuccuaugacuggaccauuaguugcaggaggucuucugacaguauguuacguucugacaggcagaucagcggaccuggaguuagaaagagcagcagauguacgaugggaagaacaagcagagauauccggaaguucaccuauauuaucgauuacuauaagugaagaugggaguaugucuauuaaaaaugaagaagaagaacagacccuuacuauucuaauucgaacaggauuauugguuauuucuggauuguuuccagugagcauuccuauuacagccgcagccugguaccucugggaagucaagaaacagagagcgggcguauuaugggaugugccaucaccuccaccggucggaaaagcagaacuggaagacggagcauauagaauaaaacaaaaaggaauauuagguuacucacagauaggagccgguguuuauaaggaagguacauuccauacuauguggcauguaacucguggagccguucuaaugcacaaagguaaaaggauugaaccaucaugggccgacgucaagaaagauuuaauaucuuacggcggaggauggaaacucgagggggaguggaaagagggugaagagguacaagugcuugccuuagaaccaggcaaaaaccccagggcuguucaaacgaaaccagguuuauucaaaacaaauaccggaauaauaggagcaguuucuuuggauuuuucaccaggcacaucaggaucaccaauuguugacaagaaaggaaagguaguaggacuuuauggcaauggggucgugacgcgaaguggaacuuauguaucugcaauagcacagacagaaaagaguaucgaggauaaccccgaaauagaagacgauaucuucagaaagaagcgauuaacaaucauggaccuucacccaggcgcaggaaaaacaaaaagauauuuaccagcgauuguuagagaagcgauaaagcgugguuuacggacccucauauuagcaccaacucgaguuguggcugcagaaauggaagaagcacuucgaggauuaccgaucagguaucaaaccccagcaauacgagcugaacauacuggccgggaaaucgucgacuuaaugugccaugcaaccuuuacaaugagacuauugucaccuauaaggguucccaauuauaauuuaauaauaauggacgaggcccauuuuacugacccagcaaguauagcagcuagaggauacauuucgacaagaguugagaugggagaagcggcugguauuuucaugacagcaacuccaccaggcagucgugauccuuuuccucagucaaacgcaccuaucauggaugaggaacgagaaauaccugaacguagcuggaacucgggacacgaaugggucacagacuuuaaagguaagaccgugugguuugugccguccauaaaagcugguaacgacauugccgcgugcuuaaggaaaaaugguaaaaagguuauccaauuaagucggaaaacguuugacuucgaguacaucaaaacaaggacuaaugauugggauuuuguugugaccacggauauuucagagaugggggccaauuuuaaagcggaaaggguaaucgacccuagacguuguaugaagccgguuauacucacugauggcgaagaaaggguaauauuagccggaccaaugccaguuacacauucgucggcugcacaaaggcgcggucgaguaggaagaaacccuaaaaacgaaaaugaccaauacauauacaugggagagcccuuagaaaacgaugaagacugcgcucauuggaaggaagcgaaaaugcuacuugacaauauaaauacacccgaaggaauaauaccgaguauguucgaaccugaacgagaaaaaguugacgcuauagauggcgaauaccguuugcgcggugaggcuagaaaaacuuuugucgauuugaugcgacguggggaucugccggucuggcuagcuuacagaguugccgccgaagggauuaauuacgcugaucgacguugguguuucgauggugucaagaauaaucaaauccuagaagagaaugucgaaguggaaauauggacgaaagaaggcgaaaggaagaaacuuaaaccacgauggcuagaugcacgaauauauucagauccucuugcacuuaaggaauuuaaggaauuugcugcuggaagaaagucccuuacacuaaacuuaaucacagaaauggguaggcuccccaccuuuaugacucagaaagcgagaaaugccuuagauaacuuggcuguucugcauacagccgaagcaggaggaagggcauacaaucaugcucuuucagaacugccggaaacucuagaaacacugcuguugcucacucuucuugcaacaguaacaggugggauauuucuuuuucuaaugucuggaaaaggaauaggcaaaaugacccuaggcauguguuguauuaucaccgccaguauauuauuaugguaugcccaaauccaaccccauuggauagcagccucaauaauucuggaguucuuucuuauaguucuucucaucccugaaccagaaaaacaaagaacaccacaagauaaucaauuaacuuauguaguaauagcuauacuaacaguuguagccgcuacaauggcuaacgaaaugggauuuuuagaaaagaccaagaaagauuuuggacuaggaaguaucacaacacaacaacuagaaaguaauaucuuagacauagaccuaagaccggcuagugccuggacacuuuaugcgguggcaacaaccuucaucaccccaaugcuuagacauucaauugaaaauuccagcgugaacgucucguugacugccauagcaaaucaagcuacuguuuugaugggacuuggcaagggcuggccucucucaaaaauggacauaggagucccacuacuggcgauaggaugcuauucacaaguuaauccuaucacauuaaccgcagcauuacuuuugcucguggcgcacuaugcaauaaucggaccuggccuacaagcaaaggcuacaagggaagcacagaaaagagccgcugcgggcaucaugaagaacccaacagucgacgguauaacgguaaucgaccuagacccaauuccauacgauccgaaguucgagaaacaguuggggcaaguuaugcugcuggugcuaugugucacacaaguuuuaaugaugaggaccacaugggcuuuaugcgaagcauuaacgcuagcgaccgguccaauauccacucuaugggaaggaaauccuggacgguucuggaacacgacgaucgcaguaaguauggccaauauauuccgaggcucguaccuggcuggagcagguuuauuguuuucaaucaugaagaauacagccaacacacgccgagggacuggaaacacaggcgaaacacuaggugaaaaguggaaaaacagauugaacgcuuuaggcaagagugaguuccaaaucuacaaaaagaguggcauacaagaaguugaucgcaccuuagcaaaagagggaauaaaaagaggugaaacagaccaccacgcuguuaguagaggcuccgcuaagcuacgcugguucguagaacgcaauuuaguaacucccgaaggcaaaguggucgauuuagguuguggucguggugguuggucauacuauuguggugggcuuaaaaaugugaaagaagucaaagggcuaacgaaagggggcccgggucacgaagaacccauucccaugucaacauauggauggaacuuaguaaggcuacagucaggaguagacguauucuuuaccccuccugaaaaaugcgauacuuuauugugugacauaggcgaaucaucuccaaaucccacaguagaggcuggucguacacugcggguacuaaauuuaguagaaaacugguuaaauaauaacacccaauuuuguauuaaagucuuaaauccguacaugccuucaguuauagagaaaauggaagcacugcagcggaaguacgguggagcauuaguaaggaaccccuuaucgcguaauucgacucacgaaauguauuggguuaguaacgcaucuggaaauaucguaucaucuguaaacaugauaucaagaauguuaauaaacagguucacuaugagacauaaaaaggccacguacgaaccugauguugaucucggcucugguacaaggaacauagguauugaaucugaaacacccaaucuagacaucauaggaaaaagaauugagaaaauuaaacaagaacacgaaaccucuuggcauuaugaucaagaucauccauacaagacaugggcauaucacggaucuuacgaaacaaagcaaacagggagugcaaguucaaugguaaacggcgugguccgucuuuugacgaagccaugggacguaauuccaaugguaacacaaauggcaaugacagacacaacuccuuuuggacaacaaagaguuuuuaaagaaaagguggauacgaggacgcaagagccaaaagaggguacuaagaagcuaaugaaaauuacagcagaauggcuauggaaggaauuaggcaagaagaaaacucccaggauguguacaagagaagaauuuacaaggaaaguaagaagcaaugcggccuugggugcaauauucacggaugaaaauaaguggaaaagcgcucgcgaagcugucgaagacagcggauuuugggagcuaguugauaaggaaagaaacuuacaucuagagggaaaaugugagacaugcguuuacaacaugauggggaaaagagagaagaaauugggugaguuuggcaaagcuaaagguuccagagcaauuugguacauguggcugggagccagguuuuuagaguucgaggcuuugggauuccuuaacgaagaucauugguucucccgugaaaacaguuuaucagguguggaaggugaagggcuccauaaauugggauacauuuuaagagacgugucgaagaaagaagguggggcgauguacgcagacgacacagcaggcugggauacacgaauuacacucgaggaucugaaaaaugaagaaaugguaacaaaccacauggagggugagcacaaaaggcuagcagaagcuaucuucagauuaacuuaucaaaacaaaguugugaggguucaaagacccacuccgcgcggaacagugauggacaucauaucacgacgcgaucaacgcggaucagggcaaguaguuacuuauggcuuaaauacuuuuacgaacauggaagcucaacucauuaggcagauggaaggugaaggaguuuuuaaaaguauacaacaucuuacugucaccgaggagauugcaguuaaaaauuggcuugcaagaguagguagggaaagacuaucucguauggcgauuuccggagacgauugcguagugaagccacuagaugaucgauuugcaagugcauuaacagcauuaaacgauaugggaaagguacgcaaagacauacaacagugggaaccuucgagaggcuggaaugauuggacccaaguaccauucuguucgcaucauuuccaugaauuaauuaugaaagauggacguguauugguugucccauguagaaaccaggacgaacuuauaggccgagcacgcauaagccagggugcaggguggucauuacgagaaacagcaugccuuggaaaaaguuacgcgcagauguggagcuugauguauuuucauagaagagacuuaagacuagcagcuaaugcaauaugcagcgcuguuccgagucauuggguaccaacuucuaggacgacuuggaguauccacgcaacacaugaguggaugacaacggaagacaugcucacagucuggaacaggguauggauucaagaaaacccguggauggaagacaagacgccaguugaaucgugggaagaaauuccguaucuagguaaaagagaagaccaguggugugguucucuuaucggacugacaagcagagcuacaugggccaaaaauauacaaaccgcgauaaaccaaguaagauccuugauuggcaaugaagaguauacugauuauaugccaucaaugaaaagauuuaggcgcgaagaagaagaggcaggaguacuaugguag

SEQ ID NO: 22842 - RNA, 9876 nt, Artificial Sequence
  derived and/or modified CDS sequence (opt6) from DENV-2__KC762658__SS-prME
acggcagggauuauuauuaugaugauuccaacaguaauggcuuuccauuuaaccacccguaauggcgaaccacauaugauagucagcaggcaagaaaaaggaaaaucguuauuguucaaaaccgaaaauggaguaaacaugugcacccucauggcuauggauuuaggagaacucugugaagacacaauuacuuauaacugcccguuacuuaggcaaaaugaaccugaagacauagauuguugguguaauucuacgaguacauggguaacauacgguacauguacugcuccuggugaacauagaagagagaaaaggucaguugcuuuaguaccucauguagguaugggacuagaaacuagaacagagacauggaugaguucagagggggccggaaaacacgcucaacgcauugagacuuggguacuccgacauccaggauuuaccauaauggccgccauauuagcauauacaauagguaccacauauuuccaacgugugcuaauuuuuauucuucuaacugcuguaacgcccucuaugaccaugaggugcauuggaauuaguaaucgggauuucguggaaggagucucuggagggaguuggguagauauuguuuuagagcaugguucuugugucacaacgauggcuaaaaauaaacccaccuuggauuuugagcuaauaaaaacagaagcaaaauuacccgcgacacucagaaaauauuguauagaggcaaaacuaacgaacaccacaacugcuucucgaugcccuacccagggcgaaccgucauuaaaugaggagcaggacaaacgauuugucugcaaacauuccaugguagacagaggcugggggaauggguguggacucuucggcaaaggcgggauaguuacuugugcuauguuuacaugcaagaaaaacauggaagguaaaauuguucaaccagaaaauuuagaauacacuauuguaaucacaccucacuccggagaagaaaaugcgguagguaacgacacuggaaaacauggcaaagaaauaaaaguaacuccccaauccuccauaacugaagcagaauuaacaggauauggaacugugaccauggaauguucaccacgcacuggccuagauuuuaaugagauggucuuacugcaaauggaaaacaaagccuggcuaguacacaggcaaugguuucuggaucuaccucuuccguggcugccuggggcugacacgcaaggaagcaauuggauucaaaaagagacuuuaguaacauuuaaaaacccgcacgcuaagaaacaagacguggugguauuagguagucaggaaggagcaaugcacacagcgcugaccggagcaacugaaauacaaaugagcucuggaaaccuauuauuuacgggacaccuaaaauguagacugagaauggauaaauuacaauugaaagguaugaguuacagcaugugcaccggaaaauuuaaagugguaaaagaaauugccgaaacccaacacggaacuaucguaauccgaguucaauacgagggagauggaagcccaugcaaaauaccauucgaaauaauggaucuugagaaaagacauguacuuggaaggcuuauaaccguuaauccgauagucacugaaaaagauucgccgguaaacauugaagcagagccuccuuuuggagacucguacauaaucauuggggucgagccaggccaacuaaaacuaucaugguuuaagaaagggaguaguaucggucagauguucgaaaccacaaugcgaggagcaaaacgcauggcaauacucggagacacggcaugggauuuugggagcuuaggagguguauucacaucaauuggcaaagcacuucaucaaguguucggugcgauuuauggugccgcuuuuagcgggguuaguuggacaaugaaaaucuuaauuggaguaguuaucacguggauaggaaugaacucucgaagcacaaguuuaagcguuagccucguauuaguaggugugguuacacuauacuugggcguaaugguacaagcagacucuggcuguguaguaaguuggaaaaauaaagaauuaaaaugcgggucgggaaucuuuaucacggauaauguacacacguggacagagcaguacaaauuccaaccagaaucaccaaguaaacuggcuucugcgauccaaaaagcacaugaagaagggauuugcggaauuagaucugugacaaggcuugagaauuuaauguggaaacagauaacuccagaacuaaaucauauuuuaagugaaaaugaaguaaaacucacaauuaugacuggcgacauaaaaggaauuaugcaggcaggcaaacgcagcuugcguccacagccuacagaguugaaauauuccuggaaaaccuggggcaaagcuaaaauguuaucaacggaacugcacaaucacacuuucuuaauugaugguccagaaacugcggagugcccuaacacuaaucgggcauggaacucguuggaaguagaggacuauggguucggaguauucacaacuaacauauggcuaaaauugaaagagcgacaagacguguuuugugacucaaaacuuaugagcgcugcaauuaaagauaauagagcgguacaugcagauaugggguacuggauagaaucagcccucaaugacacauggaaaauagaaaaggcgucguuuauagaagugaaauccugucauuggccuaagucccauacguuauggucaaauggaguccucgaaagugaaaugauuauacccaaaaacuuugcagguccuguaucacagcauaacuacagaccgggauaccauacucagacugcugguccauggcaccuaggacgauuggaaauggauuucgauuuuugugaaggaacaacaguagucguuaccgaagauuguggaaaccgugguccaucgcugaggacgacuaccgcaagugguaaauuaauuaccgaaugguguuguagauccugcacauuaccaccacugagauauagaggagaagacggaugcugguauggaauggaaauaagacccuuaaaggaaaaagaggaaaaucucgucaacagcuuaguuacagcugggcaugggcaaauagacaauuucucuuugggaguacuaggaauggcauuauuuuuagaagaaauguuacguaccagaguggguacgaaacacgcuauucugcucgucgcgguaucauucgugacacugaucacagguaacaugagcuucagggauuuggguagaguaaugguuauggugggugcuacaaugacggacgauauaggaauggggguuacguaccuagcacuacucgcagcguuuaagguaagacccacauucgcagcgggauugcuguugagaaaauuaaccucgaaagaauugaugaugacgacuaucggaaucguacuucuaucacaaucgacuauuccggaaacuauucuggaauuaacugacgcgcuugcccucggaaugaugguacuuaaaauagucagaaacauggaaaaauaccaauuagcaguaacgauuauggccauauuaugugugcccaacgcaguuaucuuacagaacgccuggaaaguuucuuguacaacacuggcgguugucagcguuucgccucuauuacuaaccucgagccaacagaaggcugauuggauaccccuagcauuaacgaucaaaggauuaaacccuaccgccaucuuucugacgacccuuagcagaaccucuaagaaacggucauggccgcuuaacgaagcuaucauggcgguggguaugguuucuauacuagcuucuucacuucuuaagaaugauauuccaaugacagguccgcucguugcugggggauuauuaacaguauguuacguucuuacgggacgcagugcugaccuggagcucgaaagagcagcagacgugcgaugggaagaacaagcggagauuagugguaguucaccaauucuuucaauaacaauaagugaagaugguaguaugagcaucaaaaaugaggaggaggaacaaaccuuaacaauacugauucgaacuggacuccuaguaauuaguggauuauuuccaguuucgauuccaauaacugcagccgccugguauuugugggagguuaagaaacaaagggccggaguacuaugggacguaccuaguccgccuccagucggaaaagcagaacuagaagacggagcauauaggauaaaacaaaaagguauauuagguuacucacaaauaggugcaggcgucuauaaagaaggaaccuuucauaccauguggcaugucacgcgaggggcaguacuuaugcacaagggaaagcgcauagaaccuagcugggcagacguuaagaaagauuugauaagcuauggaggagguuggaaacuagagggagaauggaaagaaggggaggaagugcaaguuuuagcauuggaaccaggcaaaaacccaagagcuguucaaacaaaaccgggcuuauuuaaaacuaacaccggcacaaucggagcuguuagcuuagauuuuucaccaggcacgaguggcucuccaauuguagacaagaaaggcaagguaguaggucuauaugggaauggcguaguuacgcgaucaggaacuuauguaagcgcaauagcacaaacagagaaaagcauugaagauaauccagaaauugaggaugacauauucaggaagaaaagacuaacaauaauggacuuacaccccggggcuggaaaaaccaaacgcuaccuacccgcuauuguacgagaggcaauaaaacgaggacugagaacacuuauucucgcgccuacgagagugguggccgcugaaauggaagaagcacuaagaggucugccgauuagauaucaaaccccagcuauccgugcggaacauacaggcagagaaauaguugacuuaaugugucacgccacuuucacgaugcgauuacuaucccccauuaggguaccuaauuauaaccucauuauaauggaugaagcccacuuuacggaccccgcgaguauagcggccagaggauacaucagcacucgcguugaaaugggggaagcggccggaauuuucaugacagcuacacccccaggaucccgagauccuuucccacaauccaacgcaccaauaauggacgaagaaagggagauaccugagcgcucuuggaacagcgggcacgaauggguaacagacuuuaaaggaaaaacggugugguucgugccgucaaucaaagcugggaacgauauagcagcgugucugagaaagaacggcaagaaaguaauacaguuaucucguaagacauuugacuuugaauauauaaaaacaaggacgaaugacugggauuucguaguuacuacagauauaagugaaaugggagcaaacuuuaaggcugagagaguaaucgacccgagacgaugcaugaagccaguaauauuaacagauggagaagaacgaguuauacuugcaggcccuaugccgguuacccacucaagcgccgcgcaaagaagaggacggguaggucgcaacccuaaaaacgaaaacgaccaauauauuuacaugggagaaccuuuagagaacgacgaggauugcgcucauuggaaggaggcuaaaauguuacuggauaacaucaauaccccagaagguaucauaccuuccauguuugaaccagaacgagaaaaaguagaugcgaucgacggagaauaucgauugagaggcgaggcgagaaaaacauucguagaauuaaugaggcguggagaccuaccggugugguuggcguauagaguugcagcugaagggauuaacuaugcugauagaagaugguguuuugauggcgugaagaauaaucaaaucuuagaagaaaacguagaaguagaaauuuggacaaaggagggcgaaagaaagaaacuaaaaccaagguggcuugacgcgagaauuuauucggacccuuuggcgcugaaagaguucaaggaauuugcugccggucgaaaaucauuaacauugaauuuaauaacugagaugggacgacugccaacauucaugacccaaaaagcaagaaacgcucuagauaaccucgcaguacuacacaccgcugaagcuggagguagggcauauaaucacgccuuaucagagcuuccugaaacuuuagaaacgcuacuuuuauuaacucuucucgcuacagucacaggugguauauuuuuguuccuaaugucuggcaaaggaauagguaaaaugacacuagggauguguugcauaauuacagcaagcauucuacuaugguaugcccaaauucagccacauuggaucgcagcauccauaauauuggaguucuuucucauaguucuuuuaauaccagagccagaaaaacaaagaacaccgcaagacaaccaacugacauacguuguaauugcaauauuaacaguuguagccgcgacuauggccaacgaaaugggauucuuagaaaagacgaagaaagacuuuggacucggcucgauuacaacccaacaaccagaaucaaauauauuagacauugauuuacgaccagccagugcguggacgcuuuaugcuguugcaacuacuuuuauaacaccuauguuacgacacucaauugaaaauucaucuguaaacguuaguuuaaccgcaaucgcaaaucaagcgaccguucuuaugggucuagggaaggguuggccauuaagcaaaauggauaucggcguaccgcucuuagcuauaggauguuauucgcagguuaauccuauaacucuuacagcagcauuguuauuguuaguagcccauuaugcaauuauaggaccaggacugcaagcgaaggcuacgagagaagcucagaaaagggccgcugccggaaucaugaagaacccuacaguagacggaauuacggugauagaucuagacccuauuccauacgacccaaaauuugagaaacagcuuggacaagucaugcuccuaguauuauguguuacucaagucuugaugaugcguacaacuugggcacuuugcgaggccuugacgcuugcaacugguccaauuucgacauugugggaaggcaauccaggaagauucuggaauacaaccaucgcugucagcauggcaaauauauucagaggaagcuaccuugcaggcgcaggccuuuuauuuaguauaaugaagaauaccgccaauacaaggagaggcacuggaaacacaggggaaacucucggcgagaaauggaaaaaucgcuugaaugcacuaggaaaaucugaauuucaaauauacaagaaaagugggauacaagaaguugaucgaacuuuagccaaagaagguaucaagagaggggaaacagaucaccacgcgguuagccgagggucggcaaaacuacguugguuugucgaaagaaaccugguaacaccagaaggcaaagucguagaucuaggaugcgguagaggaggguggucauacuacugcggaggguugaaaaauguuaaagaaguaaaggggcuaacgaaaggaggaccaggucaugaagaaccgauacccaugaguacguacggauggaauuuaguucgauuacagucagguguagacguguuuuucacaccaccggaaaaaugugacacacuucuaugugauauaggagaaucgucgccuaauccuacgguggaagcuggcaggacgcuccgcguccugaaccuaguggaaaacuggcuaaacaauaacacucaauuuugcauaaaaguauuaaacccauauaugccaucaguaauugagaaaauggaagcacuucaacgaaaauacgguggggcguuagugcguaacccucuuagccguaacaguacacacgagauguauuggguaaguaacgccucuggaaacauagugagcagugucaauaugauuaguagaaugcuaauaaaucguuuuacuaugcgucacaagaaagcgacuuaugagccugauguugaucuaggaucaggaacaagaaacauagggauagaauccgaaacuccuaacuuggauaucauagguaaacgcaucgagaaaauaaaacaagaacaugaaacauccuggcacuaugaccaagaucaucccuauaaaacaugggcauaucacggcaguuacgaaacaaaacaaacgggaucagcgucgaguaugguaaacggaguuguacguuuauuaaccaaaccuugggauguaauaccgauggugacgcaaauggcaaugacagauacaacccccuuuggacaacaacgcguguucaaagaaaaaguagacacccguacgcaagagccaaaagaaggcacuaagaaacucaugaaaauuacggccgaauggcuuuggaaagaguuagguaaaaagaaaacaccgcggauguguacaagggaggaauuuacaagaaagguacguucaaaugcagcuuugggagcaauauuuaccgaugaaaauaaguggaaaagugcccgcgaagcuguggaagauucuggcuuuugggaacucguggauaaagagcgcaaccuacaucuugaaggaaaaugugaaaccuguguguauaauaugauggguaaaagagagaagaaauuaggagaauuuggaaaggcaaaaggaucaagagcuauaugguacaugugguuaggagcuagguuccuggaauuugaagcucuaggauuucuuaacgaagaccacugguuuucgagagaaaacaguuuaucgggaguugagggagaggggcuucauaaauuaggcuauauacuccgugacguaagcaagaaagagggcggcgcaauguaugcggaugacaccgcaggcugggacacucgaaucacuuuagaagauuuaaagaaugaagaaaugguuacuaaucauauggagggagaacauaagaaauuggcagaggcuauuuucaaguuaaccuaucaaaacaaagugguaaggguccaaagacccacaccaagaggaaccgucauggacaucauaucccgaagggaccaacgcggaaguggacagguuguuacguaugguuuaaacacauucacaaauauggaagcacaauuaauacgccaaauggaaggagaagguguauuuaaguccauucaacagcugacggugacggaggaaauagcagucaaaaauugguuaguuagaguuggaagagaaagguuaucacgaauggcaauuaguggcgacgacuguguagugaagcccuuggacgauagauuugccagcgcuuuaacggcucuuaaugauauggguaaaguuagaaaagacauucaacagugggagccaucacgcggauggaaugacuggacucaaguuccauuuugcucacaucauuuucaugaacuaauaaugaaagauggaaggguauuaguuguaccgugcagaaaccaggacgaauugaucgggagagcgagaauaucucaaggugcgggauggucacuacgagaaaccgcaugccucgguaaauccuacgcucagauguggucacuaauguauuuucacagaagagauuugagguuggcagcuaaugcuauuuguucggcaguuccuucacauuggguaccgacaucacguacaacauggagcauccacgcaacacaugaguggaugacaacugaggacauguuaaccgucuggaauagagucuggauacaagaaaacccuuggauggaagacaaaacuccggucgaaucaugggaagagauaccuuaccuuggaaaaagagaagaucaauggugcggcucucucaucggacuuacaucuagagcaacgugggccaaaaauauccaaacggcaauaaaucaaguccguagucucaucggaaaugagaaauacacugacuauaugcccagcaugaaacgauucagaagagaggaggaagaagcgggaguucucugguag

SEQ ID NO: 22843 - RNA, 9876 nt, Artificial Sequence
  derived and/or modified CDS sequence (opt6) from DENV-2__KC762660__SS-prME
acagcaggaauuauaaucaugaugauaccaacagucauggcauuccacuugacaacaaggaacggcgaaccacauaugauaguuucaagacaagaaaaagguaaaagucuacuuuuuaaaacugaaaauggagucaauauguguacuuugauggcaauggaccugggugaauugugcgaagauacuaucacuuacaauugcccacuauugagacaaaaugaaccggaagauauugauugcuggugcaauucaacaucgaccuggguaacuuacggaaccugcacagcaacgggugaacauagaagagagaaaaggucaguagcuuuagucccucauguagggauggggcuagaaacucgaacggaaacauggaugaguucagaaggggcguggaaacacgcacaacgcauugaaacaugggucuugcgccauccuggauucacgaucauggcagcgauauuagcauauacaauaggcaccaccuacuuccaaagggucuuaauuuucauuuuacuaaccgcagugaccccgucaaugacaaugagauguauaggaauaucgaaucgagauuucguugaagggguuagcgggggaagcuggguugacauaguauuagaacaugguucgugcguaacaacuauggcuaaaaacaaaccgacccuugacuuugaacuaaucaaaacugaagcgaaacacccagcaacuuuaaggaaauacugcauagaagccaaacuaacgaauacaacuacggcgucacggugccccacacaaggagaaccuucucuaaacgaagaacaagauaaaagguucgucugcaagcacuccaugguugacagagguuggggaaacggaugcggacuuuucggaaaaggugguaucgucacaugugcaauguuuacuuguaagaaaaauauggaagggaaaguuguccaaccagaaaauuuggaauauaccauuguaauaacaccccauagcggugaagaaaaugcgguagggaaugauacaggaaaacacggaaaagaaauuaaaguaacgccgcaaucaucgauuacggaagcagaacucacaggcuaugguacuguaacaauggaaugcucgccaagaacggguuuagauuuuaaugaaaugguacuucuacaaauggaaaacaaggccugguuaguccauaggcaaugguucuuggacuuaccauuaccauggcuaccuggggcagauacucaaggaagcaacuggauacaaaaggagacgcucguuacuuuuaaaaacccacaugcuaagaaacaagaugugguugugcucggaucacaagagggugcaaugcacacggcauuaaccggggcaacugagauucagauguccucuggaaaucuacuauuuacgggccauuuaaagugcagauuaagaauggauaagcuacagcuaaaagguaugucuuacucuauguguacugguaaguuuaaaguuguaaaagaaauagcagaaacucaacauggcacuauaguuauuagggugcaauaugaaggagauggaagccccugcaagaucccauuugaaaucauggaucuagaaaagcgucacgugcugggaagauuaauuacaguuaacccaauaguaacagaaaaggacaguccagucaacauagaagcugagccaccauucggcgacaguuacauaauaaucggugucgaaccagggcaacuuaaauuaucaugguucaagaaagggaguucaauaggucaaauguucgaaaccacaaugcgcggagcaaaaagaauggcuauauugggagauacugcaugggauuuuggcagcuuagguggaguauucacuucuaucggaaaagcucugcaucaagucuuuggcgcgaucuacggcgcagcauucucaggagucucauggacuaugaagauacuuaucggaguggugauuacuuggauaggcaugaacagucgaucuacuagccugucgguaucacucguacugguggggguaguaacacuauaucuagggguuaugguacaagcugauuccgguuguguugugucauggaaaaauaaagaacuaaaaugcggaaguggaauuuucaucacggauaauguacacacauggacugaacaauacaaauuucaaccagaaagcccuagcaaacuagccucagcaauacaaaaagcacacgaagaagguaucugcgggauacguagugugacacgcuuagagaaccuuauguggaaacaaauaacaccggagcucaaccauauauuaagugagaaugaaguuaaacucacaauaaugacgggcgacauaaaaggaaucaugcaggcgggaaaacggucauugcgaccccagccgacugaguuaaaauacucauggaagacauggggaaaagcuaagaugcuaucaacagaauuacacaaucacacguuuuuaauagacggaccagagacugcagaauguccuaacaccaauagggcauggaauagcuuagaagucgaggacuacgguuuuggcguuuucacaaccaauauaugguuaaaguuaaaagagcgacaagauguauucugugacaguaagcuaaugucagcggccaucaaggauaaccgugcaguacaugcggauauggguuauuggauagaaagcgcauugaaugauacuuggaaaauagagaaggcgucauuuauagaaguaaagagcugccauuggccgaaaucacauacgcuuuggucaaacggagugcucgaaagugaaaugaucauacccaaaaacuucgcagguccagucagccagcauaauuaucgacccgguuaucacacccaaacugcaggacccuggcaucucggccgacuggagauggacuuugacuuuugugaaggaacaacaguugugguaacugaagauuguggaaaccguggaccaucgcuacgaacaacuacagcuagugggaaguugauuacagaaugguguugccgaagcugcaccuuaccuccucugcgauacagaggugaggauggaugcugguacgguauggagauacggccacuuaaggaaaaagaggaaaacuuaguaaauaguuugguaacagccggccacggucagauugauaauuucucuuuaggaguguuaggaauggcacucuucuuagaagaaaugcugaggacccgaguaggcacuaaacaugcuauauuacuugucgccguaucuuuuguaacuuuaaucacaggcaauaugucuuuccgagaucuagggagggucaugguaaugguaggggcuacaaugacggaugauauuggaauggguguaacauacuuagcuuuguuagcagcuuucaaaguaaggccaacuuuugcugcaggucuuuuacuucggaaguugacaucuaaagaacuaaugaugacuaccauaggaauuguacuucugagucaauccacuaucccagaaucuaucuuagaauugacggaugcacucgcccugggaaugaugguuuuaaagaucguccgaaauauggagaaauaucagcuagcuguaacaaucauggcaauccuuuguguccccaacgcaguaaucuuacaaaaugcauggaaggucucaugcacgacauuagccguuguauccguuucuccuuuguuauuaaccuccagccaacagaaagcagauuggauccccuuagcccuaacgaucaaaggguuaaaucccacagcgaucuucuugacuacacucucucgaacgaguaagaaacgauccuggcccuugaaugaagccauaauggcaguuggcaugguaaguauccuugcuucaucauuacugaagaaugauauaccuaugacuggcccgcuaguagccgggggauuauugacuguaugcuauguucucacgggaaggucugcagacuuagaacuggaacgagcugcagacguaaggugggaagaacaagcugaaauaagcggaucuucaccaauacuauccauuacaauuucugaagacgguagcaugucuauuaagaaugaagaggaagaacaaacgcugacgauccuuaucagaacaggguuacuugucauaagcggacucuuuccaguuuccauaccaaucaccgccgcagcuugguacuugugggaaguuaaaaagcaacgagcugguguccuaugggauguuccgucaccgcccccaguuggcaaagcagaacucgaggauggugcauaucgaaucaaacaaaaaggaauacugggauauagccaaauaggcgcagggguauacaaagaaggaacauuucacacuauguggcaugucacaagaggagcaguuuuaaugcauaagggaaagagaauagaacccucuugggcagauguuaaaaaggaucugaucaguuacgguggagguuggaaguuagaaggugaauggaaagaaggggaagagguacaagugcuagcacucgaaccgggcaaaaacccgagagcgguccagaccaaaccuggacuauucaaaacaaauacggggacuauuggagccgucagcuuagauuucuccccgggcacaagcggaagccccauaguggauaagaaagguaaaguaguuggccucuaugguaacgggguaguaacucgcuccggaacauacguuagcgcaauagcccaaacugagaaaagcauagaagauaacccagaaauagaggaugauauuuuuaggaagaagagacuaaccauaauggaccugcauccuggagcaggaaaaacuaagagauaucuaccugcaauagucagagaagcgauuaaacggggcuuacguacccuuauauuggcgccuacuagaguuguagcagccgaaauggaagaggcacuucggggauugccaauacgauaucaaacgccggcgauacgagcagagcauacggguagggaaauagucgaccuuaugugucaugcaacauuuacaaugcgauuacuaaguccgaucagaguacccaacuacaauuuaauaauaauggaugaagcccacuuuauugauccugcauccauagcagcucgcgguuauauuucaacaaggguggaaaugggggaagccgcugguaucuuuaugaccgcaacaccaccggggagccgagauccuuuuccgcagucaaaugcuccgauaauggacgaagaaagagaaaucccugaaagaucauggaacucuggacaugaguggguaaccgacuucaaggguaaaacugucugguucgugccaaguauaaaagcugguaaugacauagcugcgugucuacgaaagaaugggaagaagguaauacaauuaucacguaagacuuucgauuucgaauauauuaaaaccagaacaaacgacugggauuucguuguuacgaccgauauaucugaaaugggggcaaacuuuaaagcagaacgaguuauagauccacgaagauguaugaagccaguuaucuuaacggacggagaagaacgagucauucuagcagggccgaugccgguaacucacagcucagccgcucagcggcgaggaagagucggaagaaacccuaagaacgaaaaugaucaguauauauauaugggcgagccuuuggaaaaugaugaagauugcgcgcacuggaaggaagcaaaaauguugcuagauaauauaaacacaccagaagggauaauaccuaguauguuugagccugagcgagagaaagucgacgcuauagauggagaauacagauuaagaggagaagcaagaaaaacauuuguagaccucaugagacguggggaucuuccuguaugguuagcguauagaguagcagccgagggaauuaauuaugcggacagaaggugguguuuugaugggguuaaaaauaaccagauccuugaagagaacguggaaguugaaauauggaccaaggaaggagaacguaagaaauuaaaaccaagauggcuagaugcucgaauauauucggacccgcucgcauuaaaagaauuuaaagaguucgcagcggggagaaagaguuugaccuuaaacuuaauaacagaaauggguagauuacccacguucaugacacagaaagccaaaaaugcgcucgauaauuuagcuguucuacauaccgcugaagcaggcgggcgggcauauaaccacgcguuaagugagcugccugaaacucuugagacacuccuuuuacucacgcuacuugcaacuguuacuggaggcauauucuuauuuuuaaugucagguaaggguauagguaagaugacucuuggaauguguuguauaauaacugcgaguauacuucugugguaugcacagauccagccacauuggauagcggcaucaaucauauuagaguucuuuuuaauaguucuauuaauuccagagccagagaagcaaagaaccccucaagauaaucaauuaacuuaugucguaauagcaauacuuaccguuguugcugcuacaauggcuaaugaaaugggguuucuagagaaaaccaagaaagauuucggauuagguaguauuacuacucaacaaccugaaucaaauauuuuagauaucgaucuaaggccugcuagugccuggaccuuguaugcuguagcaacaacauucauaacaccaaugcugagacacaguaucgagaauagcucuguaaacguuucacuaacagcaauagcgaaccaggcuaccguucuuauggguuuagggaaaggauggccacucucaaaaauggacauaggcguaccccuuuuggccauuggauguuauagucaagugaauccgauuacgcuaacagcagcucuauugcuauuaguugcccauuaugcaauaauugguccugggcuacaggccaaagcgacucgagaggcucagaaacgcgccgcagcggggauaaugaaaaauccgacuguggauggcauaaccguaauagauuuggacccaauaccuuacgaucccaaauucgaaaaacaguuagggcaaguaaugcugcuaguucucuguguaacucaaguacuuaugaugcggacuacgugggcccucugugaagcguuaacauuagcuaccgggccuauaaguacccuuugggaggggaacccagggcgauuuuggaacacaacaauagcaguaaguauggccaauauuuuuagagguucauauuuagcaggagccggacuacuuuucucuauaaugaaaaacacugcaaauacgcgaaggggaacaggaaauacuggugaaacgcuaggagaaaaguggaagaaucgauuaaaugcccucgggaaaucugaguuccaaauauauaagaagucaggcauucaagaagucgauaggacauuagcuaaagaagguaucaaacggggcgaaacagaccaucaugcagucucucgcgguagugcuaaacuacgcugguuuguggaaagaaacuuagugacgccagaagguaaagucguugaucuuggcugcgguagagguggauggucauauuacugcggggguuugaaaaauguaaaagaaguaaaaggccuaacaaaaggcgguccaggucaugaagaaccgauaccuaugaguacguauggauggaauuuaguuagacuacagucuggcguagacguauucuuuacaccaccugaaaaaugugauacuuugcuaugugauaucggugaaucgagcccaaauccaaccguggaagccggccgaacuuuaagaguacugaaccugguagaaaauugguuaaacaauaacacacaauuuuguauaaagguuuugaauccguacaugccaagcgugauagagaaaauggaagcgcuccaacgaaaauacgguggggcgcucguccggaacccccuaucaagaaauucuacacaugagauguauuggguuagcaaugcaagugguaacauaguuaguaguguaaauaugauuagcagaauguugauuaaccgauuuacuaugagacacaagaaagcaaccuacgagccagacguagaucuaggaucaggaacaagaaauauaggaauagaauccgaaacuccaaaccuugauaucauagguaaacgaauugagaaaaucaaacaggagcaugaaacaucuuggcauuaugaucaagaucacccauauaaaacaugggcauaucaugguaguuaugaaacuaaacaaacuggaucagcaagcuccauggugaaugguguggucagacuauuaacaaaacccugggaugugaucccuaugguuacacaaauggcaaugacagauacaacaccuuucggucaacaaagaguuuucaaagagaaagucgauacgagaacgcaagaaccaaaggaagguacgaaaaagcuaaugaaaauuacagcugaaugguuauggaaggaauuaggcaagaagaaaacaccacguaugugcacaagagaagaauuuacaaggaaaguaagaagcaaugcugcacuaggagcaauauucacagaugaaaacaaauggaaaucagcucgggaggcuguagaagauaguggauucugggagcuuguggacaaagaaagaaaucuacaucuugaaggaaaaugugaaacuugugucuauaacaugaugggaaaacgggaaaagaaauuaggagaguucggcaaggcaaaaggaagccgugccauaugguauaugugguuaggagcgagauuccuggaauuugaagcgcuaggauuucuuaaugaggaccauugguucucaagggaaaauagucucaguggaguugaaggcgaagggcuacacaaacugggcuauaucuuaagagacguaaguaaaaaggaaggaggggcaauguacgcagaugauacugcugguugggauacgcgcaucacuuuagaagaucucaaaaaugaggaaauggugacaaaccauauggaaggugaacacaagaaacuugccgaagcaauauuuaaauuaacauaccagaacaagguaguacguguacaaagaccuacuccucgaggcacuguuauggauaucaucucacggagagaccaaagggggucaggucaggucgugacauacggucuaaauacguucacaaauauggaagcccaauugauuagacaaauggagggagagggaguauuuaagaguauccaacagcucacuguaacugaagaaauugcugucaaaaacuggcuggugagaguuggacgggaaaggcugucaagaauggcaaucuccggugaugacugugucgucaaacccuuagacgaucguuuugcuagugcccuaaccgcgcuaaaugacaugggaaaaguaagaaaagacauacaacagugggaaccaucuaggggguggaaugauuggacccaaguuccuuucuguucccaccacuuucaugaauuaauuaugaaagauggccgaguauuaguaguaccuuguagaaaccaagaugaacuuaucggacgugcccggauuucacaaggggcagggugguccuuacaggaaacagcuuguuuagggaaauccuaugcacaaauguggucguuaauguauuuccacagaagagaucuaagacuggcagcaaacgcuauuugcucugccguaccuucacauuggguuccaaccagcagaaccacauggucaauucacgcgacucaugaauggaugacuacagaggacaugcucacaguauggaauagaguauggauacaagagaauccguggauggaagacaaaacuccugucgagucgugggaggaaaucccauaccuuggaaagcgugaagaucagugguguggcuccuugaucggucuaacgaguagagcaaccugggcgaaaaacauccaaacugccaucaaucaggugagaucuuuaauuggcaaugaagaguauacggauuauaugccaucaaugaagcgauucaggagagaagaagaagaagccgguguacucugguaa

SEQ ID NO: 22844 - RNA, 9876 nt, Artificial Sequence
  derived and/or modified CDS sequence (opt6) from DENV-2__KC762676__SS-prME
acugcaggcauaaucauuaugaugaucccuacgguaauggcuuuucauuuaacuacgcguaauggugaaccgcauaugauuguaucgcgacaagaaaaaggcaaaaguuuauuauucaaaacagaaaaugguguuaauauguguacccugauggcaauggauuuaggcgaguuaugcgaagauacgauuacauacaauuguccuuuguugagacagaaugaaccggaagacauugauugcugguguaauucuacaucaacauggguaacguacggaaccugcaccgcaaccggggaacauagaagagagaaaagaucaguagccuuaguaccacaugucgguaugggacuagaaacgagaacagaaacauggauguccagcgagggagcauggaaacaugcacagcguaucgagacauggguacuccggcacccaggguuuacaauaauggcagcaauacuagcuuauacaauagggacuacacauuuccagcggguacugauuuucauacucuugacagcaguugcuccaucuaugacgaugcgauguaucgguaucucaaauagagauuuuguagagggaguuuccggaggcucauggguagauauagucuuagaacacgguucuugcguaacaacgauggcgaaaaauaaaccgacguuggacuuugagcuaauaaaaaccgaagcgaaacacccagccacacugagaaaauacugcaucgaagcaaaauuaacaaacacgacuacugcaucaagauguccuacacaaggagagccaucauuaaaugaagaacaagauaaaagauucguuuguaagcacucuaugguagaucguggauggggcaauggcugcgguuuauuuggcaaaggggguaucguuacaugugcgauguuuacauguaagaaaaacauggaaggaaaaauuguccagccagaaaaucuagaauauacgaucguaauuacaccucauucaggugaagaaaacgcuguugguaacgauacagguaaacauggaaaagagauaaagguaaccccgcagaguagcauaacagaggcugaauugacaggauacggcacugugaccauggaaugcuccccgcgaacaggacuagacuuuaacgaaaugguucuauuacaaauggagaauaaagcaugguuaguacauagacaaugguuucucgaucuaccguuaccuuggcuuccuggggccgacacacagggauccaacuggauacaaaaagaaaccuuggugacauucaaaaauccacaugcuaagaaacaggacgugguaguacuuggcucccaggaaggcgccaugcauacagcacucacuggggcuacugagauucaaaugucaucagggaaucuuuuauucaccggccaucuaaaaugccggcuaagaauggacaaauuacagcuaaaagggaugagcuauucgaugugcaccgguaaguuuaagguaguaaaagaaauagcagaaacacagcaugguacgaucguaauacgcguucaguacgagggcgacgguagcccuuguaagauuccauuugaaaucauggauuuagaaaaacgucauguuuuaggucgacugauaacaguaaacccaaucgucacagagaaggacaguccaguaaacauagaagccgaaccaccguucggagacucguauaucauuauuggaguugaaccagggcaacuaaaguugucuugguuuaaaaaggggucgucgauaggacaaauguuugagacaacaaugcgaggagcgaaacgcauggcuauuuuaggagauacugcaugggauuuugggucccuugggggaguauuuacaucaaucgggaaagcguuacaucaaguauucggagcaauauacggagcagcuuucagcggcguaucguggaccaugaaaauucucauaggaguaguuauaacauggaucggcaugaacucaagaucaacuucacuuucuguaagucuaguacuugucggaguaguaacucuuuaccucggugucaugguacaagcugauagcgguuguguugugucuuggaaaaauaaagaauuaaaauguggaucaggaauauucauuacagauaauguacauacuuggacugaacaauacaaauuccaaccagaguccccuuccaaauuagcuagugcgauucaaaaagcccaugaggaaggcauaugcgggauccguuccguaacccgauuagagaauuugauguggaaacaaauuaccccugagcugaaucacauucuaagugagaaugaagucaaguuaacaauuaugacaggagauauuaaagggauaaugcaggcaggaaaaagaucuuuaagaccucaacccacugaacuaaaauacucauggaagacuugggguaaagcaaaaaugcucagcacagaacuacacaaccacacauuuuugauagauggcccugaaacagccgaauguccaaauacaaaccgugcauggaacucacuagaaguagaagacuaugguuucgggguuuuuacaacaaacaucuggcuuaaguuaaaagaacgucaagauguguauugugacucaaaauuaaugagugcggccauaaaagacaacagagcuguucacgcugauaugggguauuggaucgaaucggcucuuaaugacaccuggaaaauagagaaggcuucauuuauugaaguuaagucauguuacuggcccaaaucgcauacacuguggucaaacggaguuuuagaaucggaaaugaucauacccaaaaauuucgcaggucccguaucacaacauaauuauagaccuggcuaucacacucagaccgcaggacccuggcaccuagggagauuggaaauggacuuugauuucugugaaggcacaacuguaguagucacugaagauugcgguaacagggguccaucuuuaagaacgacgacagcuucaggaaaacuaauaacagaaugguguugccgaagcuguacucuuccaccacuacgauaucgcggugaagaugguugcugguacggaauggagauuagacccuuaaaagaaaaggaagaaaaccuagucaauucucuaguuacggccggacauggucagauugacaauuuuucuuuagggguccuaggaauggcacuuuuccucgaagaaauguuacgaacuagaguuggaacgaaacaugcuauucuucuagucgcuguuucauucguuacgcuaauaacugguaauaugaguuuucgcgaucuugggagagugaugguaaugguaggcgcgacaaugacggacgacauaggcauggggguaacuuacuuagcacuccucgcagcguucaagguuaggcccacguucgcagcagguuuacuauuacgaaaauuaacaucaaaagaauuaaugaugaccacuauugguauaguauuauugucacaaucaaccauuccugaaacaauucuagaacugacugaugcuuuggcccuagguaugauggcucuuaaaauuguuaggaauauggagaaauaucaguuagcagugacaauuauggcaauacuuugugucccaaaugccguaauucuacaaaaugcuuggaagguaucauguacaacguuagcaguugugagcgucucgcccuugcuuuuaacuagcucucaacagaaggcugauuggauaccguuggcacuuacgauaaaaggucuuaauccuacugcaauauuccuaacaacuuuaucgagaacuucaaagaagagaucuuggccuuugaaugaagcuaucauggcaguaggaaugguaucaauccuagcuaguagucugcuuaaaaacgauauaccaaugacaggaccacucguagccgggggauuacuaacgguaugcuacguauuaacagggagaagcgcggacuuagaacuugaaagggcagcugacguucguugggaagaacaagcggagaucaguggaucuucaccaauauuguccauaacaauuagugaggaugggucuaugaguaucaagaaugaagaggaagaacaaacuuuaacgauacuuauucguacaggacuauugguaauuucagggcuauucccaguaucaaucccuauaacugcagcggcaugguaucuaugggaggugaagaaacaacgagcuggagucuuaugggacguuccgucacccccucccguagguaaagcagagcuugaggauggagcguaccggauaaaacaaaaagguaucuugggcuacagucaaauaggggccggcguauauaaagaagguacuuuccacacaauguggcacguaacaaggggagccguacuaaugcauaaagggaagagaauagagccuaguugggcggauguuaagaaagaccuaauaucauauggaggagguuggaaacucgaaggcgaauggaaagaaggugaggaagugcaggucuuggccuuagagccaggcaaaaauccaagagcaguucaaacaaaaccaggcuuguucaagacaaauacuggcacuauuggagcaguaucacuagauuuuucuccagggacuucugguucaccaauaguggauaagaaagguaaagucguagguuuauauggaaacgguguaguaacacgaagcgguacauacguuuccgcuaucgcucaaaccgagaaaucaauugaagacaaucccgagauugaagacgacauauuccgcaaaaagagguuaaccauaauggaucuacacccuggcgcagguaaaacaaaaagauaccuaccugcuaucguaagggaagccauuaaaagaggcuuacgcacacucauucuugcaccuacucgaguaguagcggcggaaauggaggaggcccuuagaggccugccaauuagauaucaaacuccagcuauacgcgccgaacauacuggaagagaaaucguagaucucaugugucaugcaaccuucacaaugcgacugcugucaccaauaagaguacccaacuacaaucuuauaaucauggacgaggcacacuucacugauccugcaucgauagcggcacgagguuauauuucaacgaggguggagaugggagaagcggcuggaauuuuuaugacagcuaccccaccaggaaguagagaucccuucccucaaucgaacgcucccauaauggaugaagaacgugaaauuccugaaaggagcuggaacucuggacaugaguggguaacagacuucaaaggaaagacagugugguuuguuccgucaauaaaagcagguaaugauauugcagccugccuuaggaaaaaugguaagaaaguaauucaguuaucccggaaaacuuuugacuucgaauacauuaagacucggacaaaugauugggacuucguugucacgacagauauaucagagaugggagcuaauuuuaaggcagaaagaguaauugauccaagaagauguaugaaaccagucauacuaacugauggcgaagagaggguuauacuagcuggaccaaugccagugacacacucaagcgcagcacaaaggcgaggcagaguuggaagaaaccccaaaaaugaaaaugaccaauauaucuauaugggugagccuuuggaaaacgaugaagauugugcacauuggaaggaagcuaaaaugcuuuuggauaauauaaacacaccugaagguauuauucccuccauguuugaaccugaacgggagaaagucgaugcgaucgauggugaguauagacuacgcggugaggcacgaaaaacguuuguugaccuaaugcgucguggagaucuaccaguuugguuagcauacagaguugcugcugaagggauaaauuacgcagaccgaagaugguguuuugauggugucaaaaacaaccaaauauuggaagaaaauguagagguagaaauuuggaccaaagaaggcgaaaggaaaaaguuaaaaccccgaugguuagacgcccgaaucuauagugauccucuugcauuaaaagaauuuaaagaauuugcggccgguaggaaaucauuaacacuaaacuuaauaacagaaaugggaagauuaccaacguuuaugacccaaaaagcacggaaugcucuagauaacuuagcugugcuucauacggcugaggccggugggagagcauauaaucaugcgcucagugaguuaccugaaacacucgaaacuuuacuacuccugacccuguuagccacagucacagguggcauuuuucucuuucuaaugagcgggaagggaaucgguaaaaugaccuuaggaauguguuguaucauuaccgcuuccauccuauuaugguacgcacagauucagccucacuggaucgcugcaucaaucauauuagaauuuuuccucaucguccuccugauaccugaacccgaaaaacaacguaccccacaggacaaucagcugacguacgucguaauugccauuuuaacggugguugccgcgacuauggcgaaugaaaugggauuuuuggagaaaacgaaaaaggacuuuggcuuggguucaaucacuacucagcaaccugaaucgaacaucuuagauaucgaccuuaggccagcaagugcauggacguuauaugcggucgcaacuacauuuauaacaccaaugcuuagacacucaauagagaauagcucuguaaacguuagcuuaacagcaauagcaaaucaagcaacgguccugaugggacuugguaaaggguggccguuguccaaaauggacauaggaguaagucuccuggcaauaggauguuacagccaggucaacccgauaacauuaacugccgcacuuuuauuauuagucgcucauuaugccauaauaggcccuggauugcaggcaaaggccacacgugaagcgcagaaacgagcagcagcugguauaaugaaaaauccgacaguugauggaauaacagucauagauuuagacccuauaccauaugacccaaaauuugagaaacaauuagggcaaguaaugcucuuaguauuauguguaacccaaguucugaugaugagaacgacaugggcuuuaugugaagcauugacacucgccacugguccuauaucaacucuaugggaaggcaacccagguagauucuggaacaccacaauugcuguaucuauggcaaauauauucagggguucauaucuagccggagcaggacuauuauuuucaauaaugaaaaauacagcaaacacuagaagaggaaccggcaacacaggugaaacacuuggugaaaaauggaaaaaccggcugaaugcucuugguaaaagcgaguuucaaauauacaagaagucagguauucaagaaguagacagaacacuugcaaaggaaggaauaaagagaggugagacagaucaucacgcgguaucgcgcggguccgcaaaacuaagaugguuuguagagcgcaauuugguaacaccagaaggcaaggugguggaucuagguugugguagaggaggauggucuuacuacugcggcggucuaaagaaugugaaagaagucaaaggcuuaacaaaaggugguccaggucacgaagaaccaauaccgaugaguacauacgguuggaacuuaguuagacuacaaaguggaguggauguauucuuuaccccacccgaaaaaugcgacacucuuuugugugauauaggggaaucuucuccaaacccaacaguugaagcuggccgcacacugaggguucugaaccugguugaaaauugguuaaauaauaacacucaauuuuguauaaaaguacuuaauccauauaugccaucuguuauugaaaagauggaagcucuacagagaaaauaugggggagcguuaguaagaaauccuuuaucacgcaauaguacacaugaaauguacuggguaucuaacgcaaguggaaauauaguuucgaguguaaauaugauaucgcgaaugcuaaucaacagguuuacaaugagacacaagaaagcaacuuaugaaccggacguugauuuaggaucaggaacccgaaauauuggaauugaauccgaaaucccuaaccucgacauaauaggaaaacgaauugagaaaauuaaacaagagcaugaaacaaguuggcacuaugaccaggaucacccuuaucguaccugggcguaccauggaagcuacgagacaaagcaaacuggcagugcaucauccauggucaauggagucgucaggcugcuaacaaagccuugggauguaauucccaugguaacucaaauggcuaugacagauacaacaccauuuggucagcaacgaguuuuuaaagagaaaguagauacaagaacgcaagaaccaaaagaaggaacaaagaaauuaaugaaaauaacugcagaauggcucuggaaagaacuaggcaaaaagaaaacgccuaggauguguacacgagaagaauuuacgagaaaagucagaaguaacgccgcguuaggagcgauuuuuacagaugagaacaaauggaagucggccagagaggcaguagaagacuccggauuuugggaguuaguggacaaagaacgaaaucuucaccuggaggguaaaugcgaaaccuguguuuacaauaugauggggaagcgugagaagaaacuuggagaauuuggaaaagccaaaggaagcagagccauaugguacauguggcuuggagccagauuucuggaauuugaagcucuuggauuuuuaaaugaggaucauugguucucacgugaaaauucgcucucaggcguggaaggggaaggacuccacaaauuggguuauauacuacgggacguuagcaagaaagaaggaggagcuauguaugcggaugauacagcagguugggacacaagaaucacucuugaagaccugaaaaaugaagagaugguaacuaaucacauggaaggcgaacauaagaaauuagcagaagcuauauuuaaauuaacuuaccaaaacaaagucguaagaguacagagaccgacaccucgaggaacggugauggacaucauaucuaggcgagaucaacgcggauccggacagguagucacuuauggcuuaaauacguucacgaacauggaagcgcaacucauacggcaaauggaaggggaagguguuuuuaaaucaauucaacaacuaacaguuacagaggagauugccgugaaaaacuggcugguaagaguaggaagagaaagauuaucgcguauggcuaucucaggagaugacuguguaguuaaaccccuagacgaccgauucgcgaacgcguugacugcccucaaugauauggguaagguacgaaaggauauacaacagugggaaccgucccguggguggaaugauuggacacaaguccccuuuuguagccaucauuuucaugaauugaucaugaaggauggcaggguccuaguaguaccuugcaggaaucaggaugaacuaauugggcgagccagaauaucccagggugcuggauggucacuuagggaaacagcaugucuagguaaaucauaugcacagauguggagcuugauguauuuucaccgcagggaucugagacuugcagcuaaugccauuugcagcgcugucccaagucacugggugcccaccucuagaaccaccuggagcauacacgcaacccaugaauggaugacaaccgaggauaugcuaacaguuuggaaccguguuuggauucaagaaaauccauggauggaagauaaaacacccguugaaucuugggaagaaaucccuuaucuaggaaaaagggaggaucaauggugcggguccuuaaucggauuaacaucgagagcuacaugggcuaaaaauauucaaacggcaaucaaccaaguacgaucguuaauuggaaacgaagaauauacagacuauaugccaagcaugaagagauucagacgugaagaagaggaagcuggaguauugugguaa

SEQ ID NO: 22845 - RNA, 9876 nt, Artificial Sequence
  derived and/or modified CDS sequence (opt6) from DENV-2__KC762662__SS-prME
acagcagguauaauaauaaugaugauaccgacagugauggcauuucacuuaacuacaagaaauggggaaccacacaugauagugaguaggcaagaaaaaggaaaaucucuuuuguuuaaaacagaaaaugguguaaacauguguacacuuauggcuauggaucuaggagaauuaugugaagauacaauuacuuacaauuguccacuucuuagacagaacgaaccagaagauauagauugcugguguaauucaacaaguacauggguuacuuacggcacguguacagcuaccggugaacaucgucgagaaaaacgaaguguugcacucguuccacaugugggaaugggucucgaaacuagaacagaaacuuggaugagcagcgaaggggcauggaaacaugcucaaagaaucgaaacuuggguauugcgccauccaggcuuuacaauaauggcagcaauucuugcuuacacuauugguacaacauauuuucagagaguacuaaucuucauccuacucacggcuguaacgccuucuaugacaaugagguguauuggaauaucaaacagggauuuuguagaaggaguaucuggagguaguuggguagauaucguuuuagaacauggcucgugcguuacuacaauggccaaaaauaaaccaaccuuggauuuugaacuaauaaaaacagaagcaaaacacccggcuacguuacguaaauacugcauugaagcgaaacucaccaacacgacgacggcuucaagauguccuacacaaggcgagccuucucugaacgaagaacaagauaaaagauucguaugcaaacacucaaugguugaucgaggauggggaaauggaugcggauuguucgguaagggcggaauuguaacaugugcaauguuuaccugcaagaaaaacauggaagguaagaucguccagccagaaaaccuagaguauaccauaguaauaacaccacauuccggggaagaaaacgcagucgggaacgauaccggcaaacaugguaaagaaauuaaggucacgccccaaucaagcaucacagaagcagaauuaaccggauaugguacuguaaccauggaauguucuccaaggacugguuuagacuuuaaugaaaugguauugcuacaaauggaaaacaaagccugguuaguacauagacaaugguucuuagauuuaccucugccuugguugccaggagcugacacgcaaggauccaauuggauacaaaaagaaaccuuagugacauuuaaaaacccucaugcuaaaaagcaagauguaguggugcuuggaagccaagaaggugcaaugcauacugcucuaacuggagcgacagaaauucagauguccaguggaaacuuacuauuuacuggacacuuaaaaugucgcuuacggauggauaaacuucagcuuaaaggaaugucauacucaaugugcaccgguaaauuuaaagugguuaaagagaucgcagaaacacaacauggaacaauaguuauaaggguccaauacgagggggauggcagcccuuguaaaaucccguuugaaauaauggaucuugagaaaaggcacguucuaggaagacuuauuaccguaaauccaauaguaacugagaaggauaguccagugaacaucgaggcggaacccccauucggcgacucuuauauuauaauugguguagaaccuggucaacuaaaacuauccugguuuaaaaaggggucgagcaucggccaaauguuugagacuacuaugagaggugcaaagcgaauggcaauauuaggggauacagcaugggacuuugguucacuaggagggguuuuuacaaguauagguaaagcgcuccaccaaguauucggugcaaucuauggugcagcuuuuucuggagugaguuggacaaugaaaauauuaaucggaguuguaauaaccuggauagggaugaacucucgaucaacgucguuaagugucagucugguucuaguaggugucgucacgcuguaucuggguguuaugguacaagcagacucgggaugcgugguaaguuggaagaacaaagaacuaaaguguggcucagggauuuuuauaacagacaauguacacacauggacugaacaauauaaauuucaaccugaaucuccuucaaaacuagcaucggccauucagaaagcucaugaagaaggaauuugcgguauaagguccgucacaagacucgaaaaucuaauguggaaacagaucaccccugaacugaaucauauccuaagugagaaugagguuaaauugacuauuaugaccggugauauuaaaggaauaaugcaagcagguaaacgcagcuuacguccccagccaaccgaauuaaaauacucauggaaaacauggggaaaggcaaaaauguuaucuacagaauuacauaaccacacauuuuuaauugacgggcccgaaacugcugagugcccuaacgcaaauagagcuuggaauagccuagaaguagaagauuauggguuugguguuuucacaacuaacauaugguuaaaacugaaagaacggcaggaugcauucugugacuccaaauuaaugagcgcagcaauaaaggauaaucgugcgguccacgcagauauggguuacuggauugaaucggcacugaaugacacauggaaaaucgaaaaggcuucguucaucgaaguaaaaaguugucauuggccaaaaucacauacacuauggucaaacgggguucucgaaagugaaaugauaauucccaaaaauuuugccggcccuguaucccaacacaauuaccgacccgguuaccacacacaaacagcagggccauggcaucugggacgccuugaaauggauuuugacuuuugcgagggcacaacaguaguagugacggaggauugcggaaaccggggaccuucccuuagaacgacgacggcaagcgggaaauuaauaaccgaaugguguuguagauccuguacucucccaccacucagauaccgaggcgaggauggcugcugguacggcauggaaauccgcccuuuaaaggaaaaagaagaaaacuuagugaacagcuuaguaacggcaggacacggacaaaucgauaauuucucuuugggaguacuaggaauggcacuauuccuagaggaaaugcugaggacuaggguggguacgaagcacgcaauacuuuuaguagcaguuucauuuguaacguuaauaacaggaaacaugucauuuagggaucuuggaagggugaugguuaugguaggcgcaacgaugacggacgauaucgguauggguguuacuuacuuagccuugcucgcagcauucaaagugcguccgacauuugcagccggauuauuauuacggaaguuaacgucuaaagaacuuaugaugacaaccaucggcauaacuuugcucucgcaaucgacuauccccgaaacaauacucgaacuuacggacgcccuugcucuagguaugauggucuuaaaaauaguaaggaauauggaaaaauaucaacuagcaguaacgauaauggcuauauuaugcguuccaaaugcaguaauacuacagaacgcuuggaaagugucuugcacaacgcucgcaguggugucaguaucuccguuauuauuaaccagcagucaacagaaagcugauuggauuccccuagcucugacaauuaaaggucugaaccccacagcaauauucuuaacgacacucucaagaacaucuaagaagagaucuuggccccuaaacgaagcaaucauggcuguagguaugguaagcauuuuagcgucuuccuuacucaaaaaugauaucccgaugacagguccccuuguagcugguggacuauuaaccguuuguuacguauuaaccgguagaucagccgauuuagaauuagaacgcgcggcagacgugagaugggaagaacaagcugaaauaagcggaaguucaccgauacucaguauuacuauaucagaggacgggucaaugucgauaaagaaugaagaggaagaacaaacguuaacuauauuaauuagaacgggacuacucguaauuucagguuuauucccuguuucuauaccuauaacagccgcagcuugguauuuaugggaagucaagaaacagcgagcaggaguacuaugggauguaccgaguccuccgccaguaggaaaagcugagcuagaggauggagcguauagaaucaaacaaaaaggaauuuuaggauauucgcagaucggcgcgggaguauauaaagagggcacauuucauacgauguggcaugucacacgcggggcuguauuaaugcacaaagggaaaagaauagaaccaaguugggcagaugucaagaaagaccuuauaagcuacggaggagguuggaaacuagagggagaauggaaagaaggagaagaagugcaagucuuagccuuagagccagggaaaaacccuagagcgguacaaacuaaacccggcuuguucaaaacuucuacagggacuauuggugcuguaucacuugauuuuucuccagguacuagcggaucgcccaucgucgacaagaagggaaaaguaguaggcuuauacgguaacgggguuguuacuagaucugguacauauguaucugcaauagcacaaacugagaagucaauugaagacaaucccgaaauagaagacgacauauuuaggaagaaaaggcuuacaauuauggacuuacauccaggggcaggaaaaacaaaacgauaccuaccagcuaucgucagagaagcuaucaaacgaggauugaggacuuuaauauuagcaccuacacgagucguagcggcagagauggaagaagcacucagaggacugccuauuagauaccaaacuccagcaauacgggccgaacauacaggaagagagaucguagaccuaaugugccaugcuaccuuuacuaugaggcuucucaguccaauaagaguucccaacuauaauuuaaucauuauggaugaggcgcacuuuacggaccccgcuagcaucgcugcaagaggauauauuaguacuaggguggaaaugggcgaagcggcaggaauuuucaugacagcaacuccaccaggauccagagacccauuuccacaaucaaaugcaccaauaauggaugaagaaagagaaaucccggagcggagcuggaacucagggcaugaguggguaacggauuuuaagggaaagaccguaugguucguccccucuauaaaagcgggcaacgauauagcagcgugcuuacggaaaaauggaaagaaagucauucaauugagccgaaaaacguucgacuuugaauacauaaagacaagaacaaaugauugggauuucguagugacaacagauauauccgagaugggggccaacuucaaagcagaaaggguaaucgauccgagacgauguaugaaaccaguaauauuaaccgacggggaggaaagaguaauuuuagccggacccaugcccguaacucacucuagugcggcacaaagacgcggccgugucgggagaaaccccaaaaaugaaaacgaccaauauauauauaugggagaaccucuggaaaacgaugaagacugcgcacacuggaaagaagcaaaaauguuacuugacaauauaaauacaccagaagguauaauuccaucuauguucgagccagagagggagaagguugaugcaauagacggagaguacagguuacgaggagaagcgagaaaaacguucguagacuuaaugcgaagaggggauuuaccaguuuggcuugcauacagaguugccgccgagggaauuaacuaugcugacaggagauggugcuuugauggggugaaaaacaaccagauucuugaagaaaacguagaaguagaaaucuggaccaaagaaggugagcggaagaaacuuaaaccaagauggcuggacgcucgaauauacuccgacccauuagcacuaaaagaguucaaagaguucgccgcugggcgaaaaucucuuaccuugaacuuaauaacugaaauggggcgauuaccaacauuuaugacucagaaagccagaaaugcauuagauaacuuagcaguauugcauacagcugaagccggaggucgagcuuauaaucacgcguugagcgaauuacccgaaacacucgaaacauuauuacuauuaacccuauuggcuacuguaacggguggaauauuccuauuuuugaugagugguaaagguguagguaagaugacucuugggauguguuguauaauuacugcuucaaucuuacugugguacgcucaaauacaaccacacuggauugcagcaucuauuauucuagaauuuuuccuaauuguauuauuaauuccugagcccgaaaagcagcgaacuccgcaagauaaucaauuaacguaugucguuauagccauucuuaccguaguugcagcaacaauggcaaaugagauggguuuccuagagaaaacuaagaaagacuuuggacuugggucgauaaccacacaacaaccagaaucuaacauucucgauauagaccuccguccagcgagugcauggacauuauaugcuguagcaacgacauucaucacaccgaugcuacgucauucuauagaaaauucaagcgucaacguuucgcuaacggcgauugcuaaucaagccacuguucuaaugggguugggaaaaggauggccauuaagcaagauggacaucggaguaccuuuacucgcaauagggugcuauucccaaguuaacccaauaacauuaacagcugcacuucuauuguugguagcacauuaugcuaucauugguccgggguuacaagcgaaagcaacacgggaagcccagaaacgggccgcugcagguauuaugaaaaacccuacgguugacggaauaacugucaucgauuuagacccgaucccuuacgaucccaaauuugagaagcaacuaggucaagugaugcugcuaguucuauguguaacucaaguuuugaugaugagaacaacaugggcucuuugugaagcguuaacauuggcgacagggccuauaucuacauuaugggaaggcaauccuggacgauucuggaacacuacaauugcgguuagcauggcgaauauauucagaggaagcuauuuggcaggagcgggucuacuauuuagcauuaugaaaaauacggcgaauacaaggagaggaacggggaauacaggugaaacgcuuggagaaaaauggaaaaacagacuuaaugccuuaggaaagucagaguuccagauuuauaagaaaucaggaauccaagagguagacagaacucuagcaaaggagggaauaaaaagaggagagacugaucaccaugcagucagcagaggaucagcaaaauuaagaugguucgucgaacguaauuuagugacuccagaaggcaaagugguugaucuaggcuguggaaggggagggugguccuacuauugcggcgguuuaaagaauguuaaggagguaaaagguuuaacaaaaggcggaccaggccaugaagaaccaauaccaaugaguacauacggauggaaucuugucagguuacaaucaggaguagacgucuucuuuaccccgccugagaaaugcgacacgcuccuaugcgauauuggcgaauccagccccaauccgacgguggaagcaggacgcacgcucaggguacuuaaucuaguugagaauugguugaauaacaauacacaauuuugcauaaaaguacuuaauccguauaugccaucggucaucgagaaaauggaagccuuacaaagaaaauacgggggagcauuaguuagaaacccauuaagccggaacuccacacacgaaauguacuggguuucgaaugcaagcggaaauauuguuucuagcguuaauaugauaagcagaaugcucauuaaucgcuuuacuaugagacacaagaaagcgacauaugaaccagacguugauuuggguucagguacacguaacauaggcauugaaagugaaacaccuaaucuagacauaauugguaaaagaauugagaaaauuaaacaggaacaugaaacaaguuggcauuaugaccaagaccacccguauaaaacuugggcuuaccauggcucuuacgaaacgaagcaaaccggauccgcaucguccaugguuaauggagucguaagguugcuuaccaaaccaugggacguaaucccuaugguaacucagauggcaaugacagacacaaccccguucggacaacaaaggguauuuaaagagaaaguagauacccguacucaagagccuaaagaaggcaccaaaaagcuaaugaaaaucacagcggagugguuguggaaagaauugggcaagaagaaaacaccuaggauguguacucgugaagaauuuacacgcaaagugaggucuaacgcagcucuaggugcgauuuucacugaugagaacaaguggaaaagcgcaagggaggcagucgaggacucaggauucugggagcuagucgauaaggaaagaaauuuacauuuagaaggaaaaugugaaacaugcguauacaacaugaugggcaaaagagagaagaaacugggugaauuugggaaagcaaaaggaagccgcgcuaucugguacauguggcuaggagcacgcuuccuggaauuugaagcacuaggcuuuuuaaacgaggaccauugguucagccgcgaaaauucccucagcggaguagaaggugaaggccuacauaaacuagguuauauauuaagggauguaaguaagaaagaagggggcgcgauguacgcagacgacacagcagguugggacaccaggauuacccuggaagaucucaaaaaugaagaaauggugaccaaucauauggagggagagcauaagaaacuagcugaagcaaucuucaaacuaacauaccagaauaaagugguaaggguacaacguccuacaccgagaggaacaguaauggacauuauuucaagaagagaucagcgaggaucgggccaagucguaacauauggguuaaacacuuuuacaaacauggaagcucaauuaauaagacaaauggagggggaagguguuuuuaaaaguauacagcaacugacaguaaccgaagagauugcaguuaagaauuggcucguaacaguaggucgagagcgacuuagcagaauggcaauaaguggagaugauugcgucguuaaacccuuggaugauagauuugcaucugcauuaacagcccuaaaugacaugggaaaagucaggaaggacauccaacaaugggaaccaucuagagguuggaaugacuggacgcaaguaccuuuuugcucacaucauuuccacgaauuaauaaugaaagacggccggguacucguugugccaugccgcaaccaagaugaacuaaucggcagggcgagaauaagucaaggugcaggcuggagucugagggaaacggcuugucuugguaaaucauaugcucaaauguggucacuuauguauuuucaucgacgagaccugagacuugcugcaaacgcaauuuguucggcggucccuucgcauuggguacccacaucacguacgacuuggucuauacacgcaacgcacgaauggaugacaaccgaagacaugcuuacagucuggaauaggguuuggauacaggaaaacccauggauggaagauaaaacuccaguagaauccugggaagagauacccuauuuagggaagagagaagaucaauggugugggucuuuaauuggacuaaccagcagagcaaccugggcuaagaacauccaaacagcaauaaaucagguuaggaguuuaaucggcaaugaagaguacacagauuacaugccgagcaugaaaagauuucgacgugaggaggaagaggccgguguacuuugguag

SEQ ID NO: 22846 - RNA, 9876 nt, Artificial Sequence
  derived and/or modified CDS sequence (opt6) from DENV-2__KC762661__SS-prME
acagcagggauaauuauuaugaugaucccaacgguaauggcauuccaucuaacaacaagaaacggggaaccccacaugauagucucacgccaggaaaaaggaaaaucuuuguuauucaaaacagaaaauggaguaaauaugugcacacugauggcaauggauuuaggugaacuuugcgaagauacaauaaccuacaauugcccauuauuacgucaaaaugaaccagaagauauagauuguuggugcaacucuacuucaacaugggucacuuauggcacaugcacagcaacaggggaacacagacgugaaaaacggaguguugcacugguaccucaugucggaaugggacuagaaacaaggacggagacguggaugucaucggagggcgcauggaaacacgcacaacguauugagacaugggucuuaagacaucccggauucaccauuauggcggcaauauuggcguauacaauagguacuacauacuuucaacgaguacuaauuuuuauacuauuaaccgcagucacccccagcaugacaaugcgauguauagguauaaguaaccgggauuuuguagagggugugucaggugguucgugggucgauauaguccuugagcauggcaguuguguuaccacgauggccaaaaauaaaccaacucuagacuuugaauuaauaaaaacugaagcaaaacauccagcaacuuugagaaaauauuguauagaagcaaaauuaacaaacacuaccacagcaucaagaugucccacucagggggaaccuucuuuaaaugaggaacaagauaaacgauucguuuguaaacauaguaugguggauagggguuggggcaauggcugcggucuuuuuggaaaaggggguaucguaacaugugcaauguucacgugcaagaaaaacauggaggguaaaauuguacagccggaaaaccucgaauauacuaucguaauaacaccucauaguggagaagagaaugcugucggcaaugauacaggaaaacacggaaaagaaauaaaagucaccccacagagcucgauuacggaggcagaguuaacugguuacgguacggugacaauggaaugcucuccaaggacuggacucgauuuuaaugaaaugguucuacuacagauggaaaauaaagcaugguuaguccaucggcagugguucuuagauuuaccauugccauggcuuccgggugcggauacacagggaaguaauuggauacaaaaagaaacuuuagucacuuuuaaaaauccacaugcgaagaaacaagacgugguugucuuagggagccaagagggugcaaugcauacagcuuuaacaggugcuacugaaauacaaaugucuuccgguaauuuacuuuuuacaggacacuuaaaaugccgucucagaauggacaaacuacaacugaaagguaugucuuauucuauguguacagggaaauucaaagucguaaaagaaauugcugaaacucaacacggaaccauaguaauacgaguacaauaugaaggggacggcucaccuuguaaaauaccuuuugagauuauggauuuagagaaacgacacgucuuaggaagguugauaacggugaaucccauaguaaccgaaaaagacucaccgguuaacauagaagcagaaccacccuucggcgacucuuauauuauaauuggcguugaaccaggucaauuaaaacuuucaugguucaagaagggaagcuccauuggccaaauguucgaaacaacaaugcgaggugcaaaaagaauggccauauuaggugacaccgcaugggacuucggguccuugggaggugucuucacgucuaucggaaaagccuugcaccaaguuuucggggcgaucuacggugcagcuuucucgggagucagcuggacaaugaaaauuuuaauaggaguggugauaacauggauagguaugaacucccggaguaccagucucucuguaucauuaguccuagugggggucguuacauuauauuuaggagugauggugcaagccgauagcggaugcgucguuaguuggaaaaauaaggaauuaaaauguggauccgguauauucauaaccgauaauguacauacauggacagaacaguauaaguuccaaccagaaucaccaucgaaacuagccucagcuauucaaaaagcccaugaagaaggaauaugcgguauacggucaguuacgagauuagaaaaccucauguggaaacaaauaacuccagaacuaaaucauauauugagugagaaugaaguaaaacuaacuauuaugacaggagauauaaaaggaauaaugcaagccggcaagcggucucuucggccacaaccaacugaacuuaaguauucauggaaaaccugggguaaagcuaaaauguuaucaacggaacugcauaaccauacguucuugauagaugguccggaaacagcggaaugcccuaaugcaaaucgagccuggaacaguuuagaaguugaagacuauggcuuugggguuuuuacaacgaauaucugguuaaaacuuaaggaacgacaagaugcauucugcgacucgaaacucaugagugcagccauaaaggauaacagagcuguucaugcagacaugggauacuggauugaaucugcacugaacgacacuuggaaaauugaaaaggcuuccuuuauagaagugaaaucuugccauuggccuaagucacacacgcuauggucuaauggcguguuagaaucugagaugaucauaccgaaaaacuucgcuggaccaguuagucaacacaauuaccgcccaggguaucaaacgcaaacugccggaccauggcauuuaggacggcuagaaauggauuuugauuuuugugaaggcaccaccguagucguaacagaagauugugggaaucgugguccaucgcuaaggacuacuacagcgucuggaaaauugaucacagaaugguguugccgaucguguaccuuaccuccguugcguuaucgaggagaggacggaugcugguacgguauggagauaaggccgcuuaaagaaaaggaagagaaccuaguaaauucccuggugacugcgggccauggucaaauagacaauuuuucucuaggagucuuagguauggcacucuuuuuggaagaaauguuaagaacgaggguagggacaaaacaugcaaucuuguugguagcagugucuuuuguuacgcugauuacuggaaacaugaguuuucgagauuuagguagggucauggucaugguaggugccacaaugacagacgauaucggcauggguguaacauauuuagcucuauuagcugcuuucaaaguucgaccuacuuuugccgcuggcuuacuccuacgaaaacuaacaucaaaagagcugaugaugacaacaaucggcaucacacuauugucgcagucaaccauccccgaaacaauacucgagcuuacagaugcauuggcccucgguaugaugguauuaaaaauuguucguaauauggaaaaguaccaauuagcuguuacaauaauggcuauacuaugcguaccuaacgcaguaauucugcaaaaugcauggaaaguaagcuguacaacauuagcaguaguaaguguuaguccgcuucuacuuacaagcucccagcaaaaagccgauuggaucccauuggcgcuaacaauaaagggauuaaacccaaccgcuaucuuccuaacaacuuuaagcagaacaagcaaaaagcgaucauggccuuugaaugaagcuauuauggcaguaggaauggucucuauccuagcuucgucgcuccucaaaaacgauauacccaugacagguccacucgucgcaggcggguuauuaacagugugcuacguauugacuggucguuccgcagaccuagaguuggagcgcgcggcagauguaagaugggaggaacaagcagaaauauccgguucaucgccuauauuaucgauaacuauuucagaggacggaucaaugucuauuaagaaugaagaagaagaacaaacacuaacgauacuuauacggacaggacuguuaguuauuaguggcuuauucccuguaaguauuccaauaacugccgcagcuugguauuuaugggaagugaaaaagcagcgugcugguguuuuaugggacguaccuuccccucccccaguaggaaaagcagaacuagaagacggagcguauaggauuaaacaaaaggggauacuaggauacagucaaaucggcgcuggcguuuacaaagaagguaccuuccauacuauguggcacguaacuagaggugcagugcuuaugcacaaggggaaaagaauagaaccaucuugggcugacgucaagaaagaucucauaucauacggcgguggauggaaacuagaaggcgaauggaaagagggcgaagaaguucagguccuugcuuuagaaccaggcaaaaaucccagagcugugcaaacuaaacccgggcucuuuaagacaucgaccggaaccauaggcgccguaucuuuggacuuuucuccaggaacguccgguucucccauaguagauaagaaaggaaaagucgugggauuauauggcaauggcguagugacuaggaguggaacauauguaucggcaauagcucaaacggaaaagaguauagaagauaaucccgaaauugaagaugauaucuucagaaagaaaaggcuaacaaucauggacuuacaccccggugcugguaagacgaaacgauaucuaccagcaaucguuagagaagccauuaagaggggauugagaacacucauccuugcaccaacgagaguuguagcagcagagauggaggaggcacugagagguuuacccauucgauaccaaacuccugcgauaagagcagagcacacugggagagaaaucguugaucuuaugugucaugccacauucacaaugcgauuauuaaguccaauccgagucccaaauuauaaccuaauaauaauggaugaagcucacuuuaccgauccagcuagcaucgcggcgcguggauacauaaguaccaggguggaaaugggggaagcugcuggaaucuucaugacggcuacaccacccgggagucgcgaucccuuuccgcaaucuaacgccccaauaauggaugaagaacgcgaaauaccggaaaggucauggaauagcggacaugaaugggugacggauuuuaaaggaaaaacaguaugguucguaccaaguauaaaagccggcaacgauauugcugccugucugcgcaagaauggaaagaaagucauacagcuaucucguaaaaccuuugauuuugaauauauuaaaacucgcacuaaugauugggauuucguuguaacuacggacauuucagaaaugggugcaaauuuuaaagcagaaagaguuaucgacccacgccgaugcaugaaaccuguuauucugaccgauggagaggagcgaguaauauuagcuggacccaugccagucacccauucgagugcagcccagagaaggggaagagucggaagaaauccuaaaaaugaaaaugaucaguacauuuauaugggcgaaccauuggaaaaugaugaggacugcgcucauuggaaagaagcgaaaaugcucuuagacaauaucaacacaccagaggguauaauuccaucuauguuugaaccagagcgugaaaaagucgaugcaauagauggugaauauagauugcgaggagaagcaagaaaaacuuuuguagaucuuaugagacggggcgaucuuccagugugguuagcauaucgaguugcggccgaaggcauaaacuaugcugacagaaggugguguuuugacggaguuaaaaacaaccagaucuuggaagaaaauguggaaguagaaauauggacgaaagaaggagaaaggaagaaauuaaaaccgagauggcuagacgcacgcauuuauuccgacccauuggccuuaaaagaguucaaagaauuugccgcaggaagaaaauccuugacucugaauuuaauaacagaaaugggucgacuaccgacauuuaugacucagaaagcaagaaaugcacuggauaacuuagccgucuugcauacggcagaagccggagggcgagcauacaaccaugcauuaagcgagcuuccggaaacauuagagacguuauuauuacuuacguuguuggcuacuguuaccggaggcauuuuccucuuuuugaugagcggaaaaggcauaggaaaaaugaccuugggaauguguuguauaauaacugccucaauauuacuuugguaugcacagauucaaccccauuggauugcggcaaguauuauacuagaguucuucuuaauaguacuacuaauuccugaaccugaaaaacagcguacaccacaagauaaucaacuuacauauguaguuauagcuauucucacagugguagcugcaacaauggccaaugaaaugggauuccucgagaaaaccaagaaagacuuuggacuggguaguaucacaacucaacaaccugaaucaaacauucuagacauugauuuaaggccugccucagcuuggacccuguaugcaguugcgacaacauuuaucacaccaaugcuacggcauagcaucgaaaauagcucaguaaauguaucacuuacugcaauagcuaaucaagcaacagugcuaaugggccuugggaaaggauggccauugaguaaaauggacauagguguaccuuugcuugcuaucggcuguuauucacagguaaacccgaucacucuaacagccgcauugcuccuuuuaguugcgcauuacgcuauuauaggcccgggacuacaagccaaagcaacucgggaagcucaaaaacgugcggcagccgggauaaugaaaaauccaacggucgaugguauuacuguuauugauuuagacccaauuccauaugauccgaaauucgaaaaacaacuuggccaaguuaugcuccuagucuugugcguuacucaaguacuuaugaugcguacaacaugggcacuuugugaggcgcuaacucuagcuacuggaccaauaucaacauuaugggaaggaaacccaggacgauucuggaacacgacuauagcgguaagcauggcaaacauauuucguggcagcuauuuagccggugcaggacuccuguuuagcauaaugaaaaauacagcaaauacucgucgaggaaccggaaauacaggagagacccuuggugagaaauggaaaaacagauuaaaugcccugggcaaaagugaauuucaaauauauaaaaagucugguauucaagagguagacagaacucuagcuaaggaaggaauaaaaagaggugaaacagaccaucaugcugucagcagaggaagugcuaaacuucguugguuuguugagaggaauuuaguuacaccugagggaaaaguagucgaccuaggguguggccguggaggguggaguuauuauugcggaggucucaagaauguaaaagaaguaaaaggacugacuaaaggagggcccgggcacgaagaaccaauaccuaugucuaccuaugguuggaauuuaguuagacugcaauccggugucgauguauucuuuacgccgccagaaaaaugcgacacucuuuuaugugauaucggagaaucaucgccaaaccccacugucgaggcaggucgaacuuuaagaguucucaacuuggucgaaaauuggcucaauaauaacacccaauuuuguauuaaaguacucaacccuuacaugccaucugugauagaaaagauggaagccuuacaacgcaaauacggcggagcucugguaagaaacccccuaucucgcaauaguacccacgaaauguauugggucagcaacgcuaguggcaauaucgucucuagcguuaauaugauuagucgaaugcucauaaaccgcuucacaaugcggcauaagaaagcaacuuaugaaccugauguagaucucggaaguggaaccagaaacauaggaauugagucagaaacacccaaccuggauauaauaggcaagcguauugagaaaaucaaacaggaacaugaaacaucuuggcacuaugaccaagaucacccauacaaaacuugggcauaucauggcaguuaugaaacaaaacaaacuggaagugcuucaagcaugguaaaugggguuguacgccucuugacaaagccaugggacgucaucccaaugguuacacaaauggcgaugacugacaccacgccauucggucaacaacgaguuuucaaagagaaaguagauaccagaacacaagaaccaaaagaaggaaccaagaaacucaugaaaaucaccgcugaauggcuuuggaaagaguuaggaaagaagaaaacaccgaggaugugcacuagggaagaauuuacgaggaaaguaagaagcaacgcagcauuaggagccauauucacagacgaaaacaaguggaaaucagccagagaagcgguggaagauucaggcuuuugggagcuuguggacaaagaaagaaauuuacauuuagaagguaagugugagacauguguuuacaacaugaugggaaaacgggaaaagaaacuuggugaguucgguaaagcaaaaggaagucgagcaauuugguauauguggcuaggagcgcgauuuuuggaguucgaagcucuggguuuucucaacgaagaucauugguuuagccgugaaaauucauugucaggaguagaaggggaagguuugcauaaauuaggguacauacuccgcgauguaucaaagaaagaaggaggggcgauguacgcugacgauacagcaggcugggacacucgcauuacucuugaggaucucaaaaaugaagagauggugaccaaccacauggaaggagaacacaagaaacuagcugaagcgaucuucaagcuaaccuaucaaaacaagguaguaagaguacaacgaccaaccccuagagggacaguaauggacauuauaagcagacgggaccaaagagguucuggucaagugguaaccuacggccuaaauacuuuuaccaauauggaagcucagcuaauacgucaaauggagggugaagggguuuucaaaaguauucagcaacucacaguuacagaagaaauagcugucaaaaauugguugguacgcgucgggagagaacgccugucucgcauggcgauaagcggagacgauugcguaguuaaaccucucgacgacagauucgcgucggcccugacagcauuaaacgauaugggaaaaguccguaaagacauacaacagugggagccaucuagaggauggaacgauuggacgcaaguaccauuuuguagucaucauuuccacgagcuaauaaugaaagacgguagaguuuuagucgucccuugccguaaccaagacgaauugaucgggagagcgaggauuagucaaggcgcugguuggaguuugagagaaacugccugcuuagguaagucauaugcucagauguggagucuaauguacuuccauaggagagaucugcgcuuagccgcuaaugcgauuugcagugcaguuccaagccauugggugccgacaucaagaacaacuuggaguauucaugcaacacacgaauggaugacaacugaagacaugcuuacaguauggaacaggguuuggauccaggaaaauccauggauggaagauaaaacacccguagagaguugggaggagauacccuaccuuggcaaacgagaggaucaauggugcggauccuuaauugggcuaacaagucgagcgacaugggcaaagaauauucaaacugccauaaaucaagucagaucuuugauaggaaaugaggaauauaccgauuauaugccaagcaugaaacgauucagaagagaggaagaagaagcaggagucuuaugguga

SEQ ID NO: 22847 - RNA, 9876 nt, Artificial Sequence
  derived and/or modified CDS sequence (opt6) from DENV-2__KC762655__SS-prME
acugcuggaauaaucauuaugaugauaccaacugugauggcuuuccaucucacuacacgaaauggcgaaccacacaugauuguuagccgucaagaaaaaggaaaaagccuucuuuucaaaacagaaaacggugugaauauguguacacuuauggcgauggaucuaggagaauuaugugaagauaccauaacauacaacuguccacuucuaagacaaaacgaaccagaagacauugauugcuggugcaacagcaccucaacuuggguaacuuauggcacguguacugcaacaggagaacaccgaagagagaaaagguccguugcauuaguaccacauguaggaaugggguuagaaacuaggacagaaacguggaugucaagcgaaggagcauggaaacaugcacagcgaauagaaacauggguguuacgucauccgggauucacuauuauggcugcuauuuuagcauacacaaucggaacaacauauuuccaaagaguacucauauuuauuuuacugacugcaguuacgccuagcaugacuaugcgcuguauagggaucucgaaucgugauuuuguugaagggguuucuggaggcaguuggguugauauaguauuagaacauggcucgugcguaacaacgauggccaaaaauaaacccacucuagauuuugaauuaaucaaaaccgaagcuaaacauccagcaacauugagaaaauauuguauugaagcaaaauugacuaacacuaccacagcaaguaggugcccgacacaaggugaacccucuuugaaugaagaacaagauaaaagauuuguuuguaaacacagcaugguagaccgugguuggggcaauggcugcggacuuuucgguaaaggcggcauaguaaccugugcgauguuuaccugcaagaaaaauauggaagguaaaguaguacaaccugaaaaucuggaauauacaauaguaauaacaccacauaguggagaagaaaacgcaguaggcaaugacacagguaaacaugguaaagaaaucaaaguaacaccgcaaucuucaauaacggaagcagaacugacaggauauggaaccguaaccauggaauguagcccccguacgggacucgacuuuaacgagaugguauuauuacaaauggaaaacaaagcguggcugguacauagacagugguucuuagacuuaccacugccuuggcuuccuggugcagacacacaggguucaaauuggauacaaaaagaaacguuaguaacauuuaaaaacccccaugccaagaaacaagauguaguuguauuaggaucccaagagggagccaugcauacugcccuuacuggugccacagagauacaaaugagcucuggaaaucuucuauucacuggacaucucaaaugucgccuccgaauggauaaacuccaacuaaaaggaaugucguauucaauguguacgggaaaauuuaaaguaguaaaggaaauagcggaaacgcaacauggaacuauaguaauccgaguacaauaugaaggugacgggucaccaugcaaaauaccuuuugaaauuauggaccuggagaaacgacacguauuaggaagauugauaacaguuaauccaauaguaacagagaaggacucacccgugaacauagaggcggaaccaccuuucggagauucuuauauaauaaucggaguggaaccaggacaacucaaauugaguugguucaagaaaggaaguucaauaggucaaauguucgaaacaacaaugcguggagcuaagagaauggcuauacuaggggauacugccugggacuuuggauccuugggaggaguauuuacaaguauaggaaaagcacuucaucaaguguuuggugcaguuuauggugcugcauuuucaggcguaucauggacuaugaaaauauuaauaggggugguaauaacauggauugguaugaauaguagaucuacaagucucagcgucagcuuagucuuagucggugugguaacccuuuauuugggugugaugguacaagcugacaguggcugcguuguaucauggaaaaacaaggaauuaaagugcggaucgggcauuuucaucacggauaacguacauaccuggacagaacaguacaaauuucaaccagagagcccaagcaaacuugcuagugcaauucaaaaagcacaugaagaaggaauaugcggcaucagaucgguuaccagauuggaaaauuuaauguggaagcaaauuacaccugaauuaaaccauaucuuauccgaaaacgagguuaaauuaacaauaaugacgggcgacauuaaaggaauaaugcaggcuggaaaaagaucacuacguccacaaccaacagaauugaaguauucuuggaaggcgugggggaaagcaaaaaugcucagcacugaacuucacaaucauacauuuuuaaucgacggccccgaaacagcagaauguccaaauacuaaucgcgcauggaacucccuggaaguagaggauuauggauuugguguuuucacuacaaacauuugguugaaacuaaaagagcgacaagauguguuuugugauucaaaguugaugagcgcagccauuaaagauaauaaggcuguacaugcugacaugggguauuggauagagagugcgcuuaaugacacguggaagaucgaaaaagccucguucauugaaguuaagucgugucauuggccaaaaagucacacccuguggaguaacgguguucuugaaagugaaaugauaaucccuaaaaacuucgcagguccagucagccaacauaauuaucgacccggauaucauacccagaccgcaggcccguggcaucugggacgacuugaaauggacuuugauuuuugcgaaggaacaacuguaguaguaacggaggauugugggaaucgaggaccgucauuaagaaccacgacggcuagcgguaaacuuauaacagaauggugcugccggaguugcacacuaccuccacucagauacagaggggaagaugggugcugguauggaauggaaauaaggccacugaaagaaaaggaggaaaaccugguuaauucucugguaacagccggccaugggcaaaucgacaacuuuucauuaggagucuuaggcauggcgcuauuuuuggaggagaugcuaaggacgcguguaggaacgaagcaugccauacuauuaguagcaguaucuuuugugacgcuuauuacugguaauaugucauuuagagaucuagguagaguaaugguaauggugggugcuacaaugacugaugauauaggcauggggguaacguacuuggcauuacuagcagcauucaaaguuaggccuaccuucgcugcagggcugcucuugcgcaaacuuacaucuaaagaacucaugaugacuaccauaggaauaguacuccucagucaaucgacgaucccagagaccauacuugagcugacugacgcgcuagcuuuagggaugaugguucuuaaaauuguacgcaauauggagaaauaucaacuagcaguaacgauaauggcgauccuaugcguacccaacgccguuauuuuacaaaacgcuuggaaagucuccugcaccacauuagccguagugucaguaucgccacuauuguuaacuucuagccaacaaaaagcagauuggauaccucuagcacuuacaauuaagggucugaauccaacggcaauuuuucuuacuacauuaucuaggacaaguaagaaaagaucguggccauuaaacgaagcuauuauggcagucgguauggucagcaucuuagcaaguucccuacuaaagaacgauauaccgaugacggguccucuaguagcaggaggcuuacuuacggucuguuacgucuuaacaggucggagugcagaucuggaauuagaacgugcagcagacguuaggugggaggaacaagcagaaauuaguggaagcagcccaauucuaaguauuacaauaucugaagacggaucaaugaguaucaaaaacgaagaagaagaacagacucucacaauauugauuagaaccgguuuauuaguaauuaguggucuauuuccagucucgauaccgauaaccgcaacagccugguaucuaugggaagucaagaaacaaagagcuggaguacuaugggauguaccuaguccgcccccagucgguaaagccgaauuagaagacggagccuaucguauuaagcaaaaagguauucuaggauacucgcagauuggagcggggguuuauaaagaaggaaccuuucacacuauguggcauguuacacgaggggcuguguuaaugcauaagggaaagcguauugagccaagcugggcugacgucaagaaagaccugaucucguauggaggaggauggaaauuagagggagaauggaaggagggagaagaaguacaaguauuagcccuagaacccggaaagaauccucgggccguccagaccaaaccagggcuauuuaaaacaaacacagguacaaucggggcagugucuuuagauuucucacccgguacaucuggcucgccaauuguugauaagaagggaaaaguaguaggauuauaugguaaugguguaguaacaaggucagguacauacgucucugcaauugcacagacagagaaaagcauugaggauaauccugaaauagaggaugacauauuucguaagaagaggcugaccauaauggaccuacacccaggugccggaaaaaccaagagauacuuaccugcaauuguacgagaggcaauaaaacguggacuacgaaccuuaauuuuagcuccuacgagaguaguagcagcggaaauggaagaagcauuaagaggacuuccuauaagauaccagacuccagcaauaagggcugaacauacaggccgugaaauuguagaccucaugugccaugcaacuuucaccaugcgacuguuaagcccaauacgaguuccuaauuacaacuuaauuaucauggacgaagcgcauuuuaccgauccggcguccauagcagcccgaggauauauuucuacgcgaguagaaaugggagaagcagcaggaaucuuuaugacagcuacgccaccggguucuagagaccccuucccccaaaguaaugcaccaauuauggaugaagaaagagaaauacccgaaagaucauggaauagcggucacgaauggguaacugacuuuaaaggaaagacaguaugguucguaccauccaucaaagcugguaaugauaucgcagcuuguuuacggaaaaacgguaagaaaguuauccaguuaucccgaaaaacguuugauuucgaguauaucaagacucggacaaaugauugggacuuuguuguuacgacagacaucagugaaaugggagcaaauuuuaaggcugaacgagucauagauccaagaagguguaugaaaccaguuauauuaacugauggcgaagagagggucauauuggcgggaccgaugccagucacucacucaucagcggcacaaagaagaggacgaguaggcagaaacccuaaaaacgaaaaugaccaauauauuuacaugggcgaaccacucgaaaacgaugaggauugcgcgcauuggaaagaggcgaagauguugcuagacaauauuaauacaccugagggaauuauaccaaguauguuugaacccgaacgggaaaaagucgaugcgauagacggggaauauagacuacgaggggaggcuaggaaaacuuuuguagaucuaaugcgacgcggagacuuaccaguauggcuugcauacaggguagccgcagagggcaucaauuaugcugauagacgauggugcuucgacggagucaaaaacaaucaaauauuggaagaaaauguagagguugaaauuuggacuaaagaaggagaaagaaagaaauugaaaccacgaugguuagacgcaagaaucuacuccgauccauuagcuuugaaagaguuuaaagaauuugcagcaggacguaagucacugacacuuaauuuaauaacagaaaugggacgucugccuacauucaugacacaaaaggcaaggaacgcuuuggacaauuuggcuguucuacauacagcugaagcaggaggccgcgccuauaaccacgcacuuucggaacuaccagagacgcucgaaaccuuacuauuauugacacuguuggcuaccguuacggguggaaucuucuuguuccugaugucggguaaagggauagguaaaaugacacuaggaaugugcuguauaauaacggcuucgauauugcuuugguacgcacaaauacaaccccacuggauugcagcaucgaucauacuggaguucuuucuaauaguauuguuaauaccggaacccgaaaaacagcgcacuccucaagacaaccaacuuacauacgugguaauugcaauacucacagucguggcggcuacuauggccaaugaaaugggguuuuuggagaaaacgaagaaagauuucggucuggggucaauugccacacaacaaccggagagcaauauuuuagacauugaucuuagaccagcuucggcuuggacucuuuaugcgguagcuacgacauuuauaacuccuaugcuucgccauucuauagaaaacucaagcguaaauguuucauuaacagcuauagcuaaucaagcgacaguucuaaugggcuuagggaaaggauggccacuguccaaaauggacaucggaguaccucuacuugccaucggcuguuauagucaaguuaauccaauaacccugacugcagcacuauuacuacugguugcacauuaugcgaucauaggaccuggucuacaagcgaaagccacucgugaggcgcagaaacgagccgcagccggaauaaugaaaaauccuacggucgauggaaucacugugauagaucuggaucccauaccauaugauccuaaguucgaaaagcaacuuggacaagugaugcuccucguacuuugcgugacacagguauuaaugaugagaaccacaugggcacuaugugaagcacucacguuagcaacaggucccauaaguacacuuugggaaggaaacccaggccgguuuuggaauacaacuauagcuguuucaauggcgaacauauucagaggcucauacuuagcaggagcggggcuacuauuuucaauuaugaaaaauacagcuaauacucggagaggaaccgguaauacuggugaaacccuaggagagaaguggaagaacagguugaacgcucugggcaagagcgaguuccaaauauauaagaagucagguauccaagaaguagaucggacgcuagcgaaagaagguauaaaacgaggagaaacugaucaucaugcugucucgcgaggaagcgcaaaauuacgaugguucguggaaagaaaccugguuacuccagaaggaaaagucguagauuuagggugcggucgaggagguuggucauauuacuguggcggauugaagaacguaaaagaagugaaaggauugaccaaaggugguccaggucacgaagaaccuaucccaaugucgaccuacggauggaauuuaguacggcuccaaagcgguguagacgucuucuuuacucccccugaaaaaugcgauacacuacuuugcgauaucggcgaaucgucucccaauccgaccgucgaggcagggcgaacacuacgagugcuaaauuugguagaaaauugguuaaacaacaauacacaguuuugcauaaaggugcuaaaucccuacaugccaagcguaauugagaaaauggaagcgcuacaacgaaaguaugggggagcucuaguacguaauccauugucucgaaauaguacacaugaaauguacugggugucuaacgcuuccgggaacauaguaaguuccguaaauaugauaagcaggaugcuaauaaaucgauuuacgaugcgacacaagaaagcaacauaugaacccgauguugaucuugggucagggacucguaauauaggaauagaaucagaaacaccuaacuuggauauuauagggaaaagaauagaaaagauaaaacaggaacacgaaacaucauggcauuacgaccaggaucacccguauaaaacaugggcauaccaugguucuuaugagacaaaacaaaccggaagcgcuagcuccauggucaaugggguaguccgcuugcugacgaaaccaugggaugugauucccauggugacgcaaauggcuaugacggauacaacaccauucggacaacagcgugucuucaaagagaaaguugacacaaggacacaagaacccaaggaagggacaaagaaacuaaugaaaauaacugcagaauggcuuuggaaggaauugggcaagaagaaaaccccucgcauguguacacgugaggaguuuacacguaaaguaagaaguaaugcggcgcuuggcgccaucuucaccgacgagaauaaauggaaaucggcucgcgaggcaguggaagauucaggcuuuugggaauugguagacaaagagagaagccuacaucuugaaggaaagugugaaacaugcguguauaacaugaugggcaaaagagagaagaagcuaggugaguucggaaaggccaaaggaucucgagcuauaugguauaugugguugggagcacgcuuuuuagaguucgaagcucuaggcuuucuuaaugaagaucauugguucucuagagagaauagccuaucaggaguggaaggcgaagguuuacauaaacuagguuacaucuuacgggacguaucaaagaaagagggaggagcuauguacgcagaugauaccgcugggugggauacgaggauuacacuagaagaccuuaaaaaugaagagaugguuacaaaucacauggaaggugaacacaagaaauuagcugaggcaauauuuaaauugacauaucaaaauaaaguagugagaguacaacggccuaccccacgcggcaucguaauggauauuauuucuagacgagaucagagaggcagugggcaaguugugacauacggacucaauacauucacaaacauggaagcacaguuaauaagacaaauggaaggggaagguguauuuaaaagcauucaacaauuaacuguaaccgaggaaauagcagugaaaaauugguuagcaagaguaggacgagagagguuaucaaggauggcgauaucuggagacgacuguguaguaaagcccuuagacgaccgcuucgcuagugccuuaaccgcccucaacgacaugggaaaggucagaaaagauauacaacaaugggagccuucaagaggcuggaaugauuggacacagguaccguuuuguucacaccauuuucaugaacuaaucaugaaagauggccggguccuugucgucccgugcaggaaccaagaugaacuaauaggaagggcaagaaucagccaaggugcaggcuggagccuaagggagacagcgugucuaggaaaaucguaugcucaaauguggagcuugauguauuuccacagaagagauuuaagauuagccgcaaaugcaauuuguagugcaguuccuucacacuggguaccaacaucaaggacaacauggaguauacacgccacacaugaauggaugacaacagaagacaugcuaacaguauggaauagaguguggauacaagaaaacccguggauggaagacaaaacacccguagaaucuugggaggaaauuccauauuuagguaagcgugaagaccaauggugcggaucucuuauaggccuaacuucgagggcuacuugggcacguaauauccaaacagcaauaaaccagguuagaagucucauaggcaaugaagaguauacugacuauaugccgaguaugaaaagguucaggagagaagaagaagaagcugguguauuaugguaa

SEQ ID NO: 22848 - RNA, 9876 nt, Artificial Sequence
  derived and/or modified CDS sequence (opt6) from DENV-2__KC762656__SS-prME
accgcuggcauaauaauaaugaugaucccaacuguaauggcauuucauuuaaccacucguaacggcgaaccacauaugaucgugucccgacaagaaaaaggaaaaagucuauuauucaaaacugaaaacggaguaaauaugugcacauuaauggcuauggauuuaggugaacuaugugaagauacgauuacauauaacuguccccuauuacgucaaaacgaaccggaagauauagauuguugguguaacaguacuucaacauggguaaccuacgguacuuguacagcaacgggggaacauagacgggagaaacgauccguggcgcuuguuccucacguaggaaugggacuagaaacuagagcggaaacauggauguccagcgaaggcgcauggaaacacgcgcagagaauugaaacauggguauuacgccacccaggauucacaaucauggcagcaauccuggcauauacgauaggaacuacauauuuccaaagaguacuaauuuucauacuucugacagcaguaacaccgucuaugacaaugagauguauugguauuaguaacagagacuucguugaaggcguauccggugguaguuggguagacauuguacuugaacacgggucuugcguuaccacaauggcuaaaaauaaaccuacccuagacuuugaacuaauaaaaacugaagcuaaacauccugcaacuuuacgcaaauacugcaucgaagcaaaacuuacuaacacaacaacagcaucaagaugucccacucagggugaacccagcuuaaaugaagaacaggauaaacgcuuuguaugcaaacauaguauggucgauagggguuggggaaauggcuguggucuauucggaaaaggaggaauuguaacaugugcgauguuuacgugcaaaaagaacauggaagggaaaguggugcaaccugagaaucuugaauauacuaucgugaucacaccacacucuggugaagaaaacgcuguugguaacgauacagguaaacaugguaaagaaauaaaaguaacuccgcaaucuagcauaacagaggcugaguuaacaggauaugguacggucacaauggaguguagcccuagaacggggcuugauuuuaacgaaaugguuuuauuacagauggaaaauaaagcauggcuuguacaucgacagugguuucuugauuuaccacugccgugguuacccggugcagacacucaggguucuaauuggauccaaaaagaaacccuuguaaccuuuaaaaauccacacgcuaagaaacaagaugucgucguccuugggagucaagaaggggcuaugcacacagcacuaacaggagcaaccgaaauccaaaugucauccgggaauuugcuauuuaccggacaucugaaaugccgacuucgaauggacaaacuucaauuaaagggcaugucauauucaaugugcacagggaaguuuaaaguaguuaaagagaucgcugaaacacaacaugguacuauaguaauccguguucaauacgaaggugauggauccccguguaagauuccuuucgaaauaauggacuuagaaaaacgucauguguuaggaagacuaaucaccguaaauccaaucgugaccgaaaaagauuccccaguuaauaucgaggcugaacccccuuucggggauucauacauaauuauaggugucgaacccggucaauuaaaacugagcugguucaagaaagggagcuccaucggucaaauguuugagacaacuaugagaggagcaaaacguauggcaauccucggagauacugcaugggacuuuggcucuuuaggugggguuuuuacauccaucgguaaagcauuacaccaaguguuugguaccaucuauggagcagcauuuucaggaguauccuggaccaugaaaaucuuaauuggaguaguaauuacuuggaucggcaugaacagccguagcacaagucuuaguguuaguuuaguguugguaggugugguaacucuauaccuagguguaaugguucaagcagacagugggugcguagucaguuggaaaaacaaagaauuaaaaugcgguucuggaauauuuauaaccgacaacguacacacguggacagaacaguacaaauuucaaccggaaucucccagcaaauuggcuuccgcgauucaaaaagcacaugaagaggggauaugugggauccgcucggucacucgucuggaaaauuugauguggaaacaaauaacaccugaacuuaaccauauauuaucagaaaaugaaguuaaacuaacuauaaugacgggugauauuaaagguauaaugcaagcaggcaaacguagccuaagaccccaacccacagaguugaaauauagcuggaaggccugggguaaagccaagauguuaaguacagaauuacauaaccauacuuuucuuaucgacgggccagaaacugcugaaugcccuaacacgaacagagcauggaauagucuugaaguugaagacuacgguuucggagucuuuaccacgaacauuugguuaaaguuaaaggaacgucaagacguguuuugugauuccaaauuaaugucagcggcuauuaaagauaacagagcagugcaugcugacauggguuauuggauugaaagugcacugaacgauacuuggaagauagaaaaggcaucauuuauugaaguaaaaaguugccaauggccuaaaucacauacacuauggucaaauggaguuuuagaaucugaaaugauaauacccaaaaauuuugcggguccagucucacaacauaauuacagaccggguuaucauacacaaacugcuggcccuuggcacuugggaaggcuugaaauggauuucgauuuuugcgaagguacuacaguuguaguuacggaagacugcggaaaccgaggcccaagucuaaggacgacaacggccaguggaaaguuaauaacagagugguguuguaggucuugcacuuuaccgccguugcgauauaggggagaggacggaugcugguauggaauggaaauacgaccccucaaagaaaaggaagaaaauuuagugaacagucugguuacagcggggcacggacaaauagacaauuucaguuuggguguucuaggaauggcucuguuuuuggaggaaaugcuccggaccagaguaggcacuaaacacgcaauuuuacucgucgcggucucauucgugaccuuaauaacgggaaauaugucauuuagagaucuagggaggguuauggugauggucggagcuacuaugaccgaugauauuggaauggggguuacguaccuagcacuccuugcugcauucaaagugcgaccuacauuugcagcuggucuauuauuacggaaacuaaccucaaaagaacugaugaugacuacuaucggaaucguauuauuaucacaaaguacgauacccgagacuauacuugaauuaacagacgcgcuagcacuaggaaugaugguuuuaaagaucguucgcaacauggaaaaguaucaauuagcaguaacuauuauggcaauacuuuguguuccuaacgccguaauucuucaaaaugcauggaaaguaagcuguacuacacuagcagucguaagugugucaccgcucuuacuaacgucgagucaacaaaaagccgauuggauuccacuagcacuaacuauaaaaggauugaauccaacagcaauauuccuaacuaccuuaagucgcacaucaaagaaaaggaguuggccuuuaaaugaagccauuauggcagucgguaugguuucuauauuagcuucaagccuucuuaaaaacgauauaccaaugacgggaccauuaguggcgggaggucugcuuacuguauguuauguguuaacaggccgcuccgcagacuuagaauuagaaagggcagcagauguccguugggaggaacaagcagaaauaucagggaguuccccaauucuauccauaaccaucagcgaagacggaaguaugaguauuaaaaacgaggaagaggaacaaacuuuaacaauacuuauacgaacaggucuacuugucgucucaggguuauuuccaguaagcaucccgauuacagcagcagcuugguaucucugggaagucaagaaacagcgcgcaggcgucuuaugggacgucccaucaccgccgccugucgggaaagccgaauuagaagauggcgcuuacagaauaaaacaaaaagguauauuaggauacagccaaauuggagcuggcgucuacaaggaaggaacuuuccacacaauguggcauguaacucgaggcgcuguauugaugcacaaggguaaaaggauagaaccuucgugggcagaugugaaaaaggaccugauuucauauggagguggguggaaauuagaaggugaguggaaggaaggggaagagguacaaguacucgcguuggaaccugggaaaaacccaagagccgugcaaacgaagccagguuuauuuaaaaccaauacgggcacaauaggcgcuguaagccuagauuuuaguccagguacgucaggaaguccaauuguagacaagaaaggcaagguuguaggauuauacggaaacggaguaguaacacguaguggcaccuauguaucagccauugcccagacugagaaaaguauagaggacaacccugaaauagaagaugacauauucagaaagaagcgauuaacuauaauggauuuacauccaggagccgguaaaaccaaacgauaccuaccugcgaucguaagggaagcaauaaaaagaggacuacgaacacugauucuagcgccaacucgaguggucgcagcagaaauggaagaagcacugagaggauuaccaauacgauaucaaacgccugccauaagagcugaacauacaggccgggaaaucguagaccucaugugccacgccaccuuuacuaugcgccugcucucaccuauaagaguacccaauuacaacuuaauuauuauggacgaggcacacuuuacagaucccgcaucaauugccgcaaggggguauauuucuacucgaguagaaaugggagaggccgcgggaauauucaugacagcaacaccaccagguagccgagaucccuuuccccagaguaaugcaccgauuauggaugaggaacgagaaaucccggagagaucauggaacucaggucaugaauggguaacagauuuuaaagguaaaacugugugguuuguuccauccauuaaagcggggaaugauauagcggccuguuugaggaaaaaugguaagaaagucauucagcuaagcaggaaaacuuuugacuucgaguauauaaaaacacgcacaaaugacugggacuuugucguuacuaccgauauuucugaaaugggagcuaauuucaaagcggaacgcgucaucgauccuaggaggugcaugaaaccuguaauauuaacggauggcgaagaaagagugauucuggcugggcccaugccaguuacucacaguagugcggcccagagaaggggcagaguggguaggaaucccaaaaaugagaacgaucaauacaucuacaugggggaaccuuuggaaaaugacgaggacugcgcucauuggaaagaagcgaaaauguuguuggauaauauuaauacuccagaagguauuaucccuagcauguucgaaccugaaagagaaaagguggacgcuauagauggagaauaccguuugaggggugaagcacguaaaacauucgucgauuugaugaggcgcggagacuuaccgguauggcuagcuuaccgaguagcggcggaagggauuaacuacgcugacagaagauggugcuuugaugguguaaagaacaaccaaauauuagaagaaaacguggaaguugaaauauggacuaaggaaggggaaagaaagaaacuaaaaccuagaugguuagaugcuagaauuuauuccgacccacuagcguuaaaggaauuuaaagaauuugcugcggggagaaaaagucuaacauuaaacuuaaucacggaaaugggacguuuaccgacguucaugacacaaaaagcuagaaacgcgcuagauaaccuagcaguacuacauacggccgaagcuggcggaagggccuauaaccaugcacucucagaacuaccagaaacccuugagaccuuacuacuauuaacuuuacuggcuacuguaacaggagggauuuuucuauuucugaugaguggcaaggggauuggaaagaugaccuuggggauguguugcauuauuacagcaucaauucuacucugguaugcccaaauacaaccccauuggauagcggcguccauaauacuagaauuuuucuuaauaguacuacucaucccugaaccagaaaaacaaagaaccccacaagauaaucaauugacauacgucgucauagcuauacuaacgguugucgcugcuacuauggcaaaugaaauggguuuucuagagaaaaccaagaaagacuuuggacuggggagcauagcgacccaacaaccugaaucaaacauucuugauauagaccuacgaccagcgagcgcauggacacuuuaugcgguagcaaccacguucauuacaccuauguugagacauuccauagaaaauucaucgguuaacguaagccuuacugcaauagccaaucaagcgacagugcugauggggcuggguaaggguuggccauuaucgaaaauggauaucggcgucccgcuauuagcuaucggcuguuauucucaaguaaauccgauaacuuugacugcugcucuacuacuauuaguugcacauuaugcuauuauugggccggggcuccaagcuaaggccacgcgagaagcucagaaaagggcagcagcggguauaaugaaaaacccgaccguagaugggauaacuguuauagaucuagauccuaucccauacgauccaaaauuugaaaagcaacuaggacaaguaaugcuccucguucuaugcguuacacaaguuuugaugaugcgcacuacuugggcguuaugugaagcccuuacuuuagcaacaggaccuauaucuacucuaugggaaggaaaccccggucgcuuuuggaauacgacuauugccgugaguauggcuaacauuuuuagaggaucauaucuagcaggcgcaggacuauuauucagcaucaugaaaaacacggcgaacaccagacgaggcacugguaacaccggagaaacccuaggggaaaaauggaaaaaccgcuuaaaugcgcucggcaaaucagaauuucaaauauauaagaaaagcgggauacaagaaguagauagaacacuugcgaaagaggguauaaaaagaggagagacggaucaucaugcaguaagucgugguucagcaaaguuacggugguucguagaaagaaacuuaguaacuccugaagguaaaguuguagaucuaggauguggaaggggcggcuggucguauuauugugguggacucaaaaauguaaaggaaguaaaggguuuaaccaaaggugggccaggacaugaagaaccaauucccauguccacuuauggcuggaaucuaguaagacugcaaucggguguugacguguucuuuacaccaccagagaaaugugauacauuacuuugugacauaggagagucaagucccaauccaacggucgaagcugguagaacucuaagggugcugaacuugguggagaacuggcugaacaauaacacacaauucugcauaaaaguacugaauccuuauaugccuuccgugaucgagaaaauggaggcacuucaaagaaaauauggaggggcucuaguaagaaauccauuaucuagaaauaguacucacgagauguauugggucagcaaugcuagcggaaacauaguaucgagugucaacaugauaucccguauguuaauuaaccguuucacaaugagacauaagaaagcaacuuacgaacccgacguagaccucgguucuggcacaaggaauauaggaaucgaauccgaaacaccaaaucuugacauaauaggaaagaggauagagaaaauaaaacaagagcacgaaacaucauggcauuaugaccaggaucacccuuauaaaacgugggccuaucauggcaguuaugagacaaagcaaacaggaucugcuagcaguauggugaacggcguaguacgguuauuaacaaaacccugggacgugauccccaugguaacccagauggcaaugacagauacaacuccguucggucaacaacgaguauucaaggaaaagguagauacgcguacucaagaaccaaaggaaggaacgaaaaaguugaugaaaauaacugcugaaugguuauggaaagaacuugguaaaaagaaaacuccuagaaugugcacacgugaggaguucacgaggaaggucaggucaaacgcagcacuuggagcaauauucacugacgaaaacaaauggaaaucagcuagagaagccguugaggauuccgguuuuugggagcuaguagacaaggagaggaaucuucaucuggaaggaaaaugugaaacuuguguauacaauaugaugggcaaaagagagaagaaacuaggugaauuuggaaaagcuaaaggaucaagagcuauuugguauaugugguuaggagcacguuuccuugaauuugaagcgcuaggauuucuuaaugaagaccacugguucaguagagaaaacucgcuuagcggagucgaaggcgaagguuuacauaaacuuggauacauacuaagggaugugucgaagaaagaagguggugccauguaugcugaugauacagcggguugggauacacgcauaacauuagaagaccucaaaaacgaagaaaugguuaccaaccauauggaaggggaacacaagaaacucgcagaagcaauuuuuaaacuaacguaucaaaauaaaguuguucgaguacaaagacccacaccucgaggaacgguaauggauauuaucucuagacgcgaucagagaggaucuggacaaguggugacuuauggauuaaauacauucacuaacauggaagcccaacuaauaagacaaauggaaggagaaggcguuuuuaaaucaauccaacagcuaacagugacggaggagauugcggucaaaaacuggcuaguccggguuggccgagaaagauuaagccguauggcaauauccggggaugauuguguaguuaaaccauuagaugauagauuugccagugcgcuuacugcguuaaaugauaugggcaaaguuagaaaagauauucaacaaugggagccgucaagggguuggaacgacuggacacaaguaccauuuuguagucaccacuuucaugaacuuaucaugaaagauggacgaguauuaguaguaccgugucgcaaucaagacgaauugaucggucgcgcaagaauaagccaaggagcaggauggucgcuuagagaaacugcauguuuaggaaaaucuuacgcucaaauguggucauugauguacuuccaucguagggauuuacgacuggcagcuaaugcaauaugcucugcaguaccaucgcacugggucccaacaucucgaacaaccuggaguauacacgcuacacacgaguggaugaccaccgaagacauguuaacaguuuggaaccgagucuggauccaagaaaaucccuggauggaagauaaaacccccguugaaucgugggaggaaauuccauaucuagguaaaagagaagaucaauggugcgguucacuaauugggcuuaccucuagagcgacuugggccaaaaauauucaaacggcgauaaaucaaguacgaucacuaaucgguaaugaagaauacacggacuauaugccgucaaugaaaagauuucgaagggaagaagaggaagccggaguacucugguga

SEQ ID NO: 22849 - RNA, 9876 nt, Artificial Sequence
  derived and/or modified CDS sequence (opt6) from DENV-2__KC762673__SS-prME
acagcagggauaaucauuaugaugaucccaacaguaauggcauuucauuugacaacuagaaacggagaaccgcacaugauuguaagucgucaagaaaaagggaaaagucuccuauuuaaaacagaaaacggaguuaauauguguacacuuauggcaauggauuuaggagaauuaugugaagacacgauuacuuauaacugcccguuauuaaggcaaaaugaaccggaagacauugauuguuggugcaacaguacgucaacaugggucacauauggaacuugcacugcaacgggggaacauagacgggagaaaagauccgucgcuuuagugccacaugucgggaugggacucgaaacuagaacggaaacauggaugaguucggaaggagcauggaaacaugcucaaaggauugaaacguggguauuacgacacccaggauuuacuauaauggcugcaauccuugcguauaccauaggaacaacccacuuccaaagaguauugauauucaucuuacuaacagcaguggcgccgucgaugacaaugagguguauaggaauaucgaaucgcgauuucguggaaggaguaucaggagggaguuggguugacauuguauuagaacauggaaguugcguuacaacuauggccaaaaauaaaccuacgcuagacuuugaacuaauaaaaacugaagcaaaacacccagcgacgcuucggaaauacuguauagaagcaaaacuuacaaauacgacaacagcuagcagaugcccgacacaaggagaaccgucuuuaaacgaagaacaagacaaaagauuuguuugcaaacauucuaugguagaucgcgguuggggaaaugguuguggguuguuuggaaaaggugggauugucaccugugcuauguuuacauguaaaaagaauauggagggaaagauaguccaaccagaaaaccuagaauauaccaucgucauaacaccacacaguggagaagaaaaugcaguaggaaaugacacugguaaacaugguaaagaaaucaaaguuacgccccaaagcucuauaacggaagcagagcucacuggguacggaacggucacaauggaaugcagcccgcgcacaggucuagauuuuaacgaaaugguguuauuacagauggaaaacaaagcaugguuagugcaccgccagugguuuuuagacuuaccauuaccuuggcuaccaggugcggauacgcaaggaagcaauuggauccaaaaagagacccugguaaccuucaaaaauccacaugcuaagaaacaagacguagucgugcucggaagucaggagggcgcaaugcacaccgcguuaacaggcgcgacagaaauucagaugucaucgggaaacuuauuguuuaccggacauuugaaaugcagguuaagaauggacaaauuacaauuaaaagguaugucauauucaaugugcacaggcaaauucaaagucguuaaagaaauagcugaaacccaacacgggacuaucguaauucgaguacaguaugaaggggauggaucaccuugcaaaauaccguucgaaaucauggaucuagaaaagaggcauguucuuggaagacugauuacagucaauccaauagucacagaaaaggauagucccguuaacauagaggcagaaccacccuucggugauaguuacaucauaauaggaguagaacccggucaacucaaacuauccugguuuaagaaaggcucaagcaucggacagauguuugaaacaacuaugcguggugcgaagagaauggcaauauuaggagauacagcgugggauuuugggagucuggguggaguauuuaccaguauaggaaaagcacuacaccaaguauuuggagcgauauacggagcggcauucucaggaguaaguuggacgaugaaaauuuugauagggguuguuauaacauggauaggcaugaacagcaggagcacaccgcucuccguaagccuaguucuaguaggugugguaacacuauacuuaggaguaaugguucaagcugauucaggcugcguggugagcuggaaaaacaaagaacucaaauguggcaguggaauauucaucacagacaacguccacacguggacugaacaauacaaguuucaaccugaaucgccaaguaaacuggccagugcuauacagaaggcccaugaagaagggauauguggcaucagaagugucacacgguuagagaauuuaauguggaagcaaauaacuccagaacuaaaucacauauuaucggagaaugaaguuaaauugacaauaaugaccggagauaucaaaggcauuaugcaagcugguaagcguucucuucguccgcaaccaacugaacuuaaguauaguuggaaaacguggggcaaggccaagauguugucuaccgaauugcacaaccauacuuucuuaauagacggaccagaaacugcugaaugcccaaacacgaaccgggccuggaacucuuuagaagucgaagauuacggauucggugucuucacaacaaacaucuggcuaaaauuaaaagagcgucaggacguguacugcgauagcaagcugaugagugcugcuauuaaagacaaucgagcaguacacgcagacaugggauacuggauagaaagcgcgcuaaacgauacguggaaaauugaaaaggcuucauuuauagagguaaaaucauguuacuggccaaaaucacauacucucuggucaaauggaguucuagaaagugaaaugaucauaccaaagaauuuugcugguccaguaagucagcauaacuauagaccagguuaucacacacaaaccgcaggaccauggcauuuagguagguuggaaauggauuucgacuuuugcgaagguacgacgguaguagugacugaagacugugguaacagagguccaaguuugcgcaccacaacugcaucaggaaaauuaaucacagaaugguguuguagaagcuguacgcuaccaccucuucgguaucgcggagaagauggcuguugguauggaauggaaauucgaccauuaaaagaaaaggaagaaaaucugguuaacaguuuggucaccgcgggacacggacaaauagauaauuucucacuaggaguacugggcauggcauuauuucucgaagaaauguugcguacaagaguagguacaaaacaugcuauucucuuaguugcaguaaguuuuguuacucuuauaacugguaauaugucuuucagagacuugggucgcguaauggucauggucggugcuacaaugacagacgacaucggaaugggaguuacauaccuugcuuuauuagcggccuuuaaaguuagaccaacauucgccgcuggccugcuauuaagaaaauuaaccaguaaagaauuaaugaugacaacaauaggaaucguccuacucucccagaguacgauucccgaaacaauauuagaauuaacagacgccuuagcccuaggaaugauggcuuuaaaaauagugaggaacauggaaaaguaucagcuugcaguuacgauaauggcaauauugugugugccaaacgcaguuauuuuacaaaacgcguggaaaguaucaugcacuacacuagccguugucucaguuaguccuuuauuauuaaccucaagccaacaaaaggccgauuggauuccccuggcguugacaauaaaaggguugaauccuacagcuauauuuuuaacuacguugagucguaccucaaagaagagaucauggccauuaaacgaggcgaucauggccguggguauggugucuauucuagcuucaucgcuauugaagaaugacauaccaaugaccggaccuuuagucgcgggaggacuacucacgguauguuacgucuuaacagggcgcagugcagacuuagaauuagaaagggcagcggauguaagaugggaagaacaagccgaaauuucaggaaguucgcccaucuuaucaauaacuauuagcgaagauggauccauguccaucaaaaaugaggaagaagaacagacacucacuauacuuauccgcacuggcuugcuagucauaucaggccuauucccaguguccauccccauaacagcagcagccugguaccuuugggaggugaagaaacagcgugccggaguuuuaugggacguuccgagucccccuccaguuggaaaggcagaauuagaagacggagcguacagaauuaaacagaaaggaauauuaggguauagucaaauuggugcgggaguguauaaagagggcacuuuucacacuauguggcaugucacacgcggcgcuguauuaaugcacaaagguaagcgaauagaacccaguugggcagaugucaaaaaggaucugauuucuuauggaggcggcuggaaacuggaaggagaauggaaagaaggagaagagguccaaguucucgcucuagaaccaggcaaaaauccuagggcaguacagacaaagccagguuuauuuaagaccaauacugggacuauaggugcggucaguuuggacuucaguccggguacaucagggagccccauuguagauaaaaagggaaagguuguugggcucuauggcaauggaguugucacuagaaguggaacauauguaagugcgauugcccaaacagagaaaucuauugaagacaacccagaaaucgaagaugacauauuucgcaagaaaagacuaacgaucauggaucugcauccaggugcggguaaaacaaagagguaccucccugcaauuguuagagaagcaauaaaaagaggacugcgcacucuuauauuagcucccaccagagucguggccgcagagauggaggaagcacuaagagggcuaccaauacgguaucagacuccugcuauaaaagcggaacacacuggcagagagauuguggaccucaugugccacgcgacguuuacaaugagacuauuaagcccaauucgaguuccaaauuacaaucucauuauuauggaugaggcacauuuuacugauccagcuucaauagcagcaagaggcuauaucucaaccagaguugagaugggagaagcagcuggcauauucaugaccgcaacacccccuggauccagagacccguucccucaaucaaacgcccccauuauggaugaagaacgagaaauaccugaaaggucauggaauaguggacacgaauggguuaccgacuuuaaagguaaaacuguuugguucguuccuaguauuaaggcugggaaugacaucgcagcgugccugaggaaaaacgguaagaaaguaauacaauugagucguaaaacguucgacuucgaauauauaaaaacaagaacaaaugauugggauuucgucguuacaacugauaucucagaaaugggagccaauuuuaaagccgaaaggguaaucgauccucgccguuguaugaaaccgguaauuuuaacagauggugaagaacgaguaauucuggcaggaccuaugcccguaacgcacucuucugccgcacaacgucgaggacgagugggaaggaauccuaagaaugaaaacgaccaauauauauauaugggcgaaccuuuagaaaacgaugaagacugcgcucacuggaaagaggcaaaaauguuacuagauaauaucaauaccccggaggguauaaucccgaguauguuugaaccugaaagggaaaaaguugaugccauugauggcgaauaucgucuaagaggugaagccagaaaaacauuuguagacuugaugaggcguggcgauuuaccuguauggcuugcguauagagucgccgcagaagggauuaacuacgccgauagacgauggugcuucgauggagugaaaaauaaucaaauacuagaagaaaaugucgaaguagaaauauggacaaaggaaggagaaaggaagaaacugaaaccuagaugguuagacgcgcggauauacucagacccuuuagcacuuaaagaauuuaaagaauuugccgccggaagaaagucgcuaaccuuaaauuugaucacagaaaugggucgauugcccacauuuaugacccaaaaagcuagaaaugcauuagauaaucuagcgguccuucacaccgcagaagcugguggcagagccuauaaucaugcguuaagcgaacuuccagagacccuagaaacgcuacuucuauuaacuuuauuagcgacaguaacuggaggaauauuuuuguucuuaaugucaggcaaaggcauagguaaaaugacucucggaauguguuguauuauaacggccagcauacuuuuaugguaugcgcaaauacaaccacauuggauagcugcaaguauaauauuagaguucuuuuuaauaguccuauuaaucccagaaccagaaaagcaacguacuccacaagacaaucagcugacauaugucgucauugcaaucuugacgguaguugcugcaacgauggcaaacgaaaugggauucuuagagaaaaccaagaaagauuuugguuuggggucgaucaccacgcagcaaccagaaagcaauauauuagauauugauuugagaccagcuucggcauggacauuauacgcgguggcuacgacauucauuacaccaauguugagacauagcauagaaaauucaucgguuaauguuucauuaaccgcuaucgcaaaucaagcuacuguccuuaugggccucggcaaaggcuggccccuaucuaaaauggacauagggguaccguuacuagccauugguugcuauucacaaguuaauccaauuacacuaacggcugcauuacuuuuacuuguagcacauuacgccauaauuggacccggacugcaagcgaaagcaacaagagaagcucagaaaagagcagcugcagguauaaugaagaacccaacaguugacggaaucacaguaauagauuuagacccuauucccuaugaucccaaauucgaaaaacaacuagggcaagugauguuacuuguacuuuguguuacacagguucucaugaugagaacgacaugggcauugugugaagcauuaacucuggccaccggaccaauaagcacauuaugggagggaaacccuggaagguuuuggaacacuacaauagcgguaagcauggcgaauauauuucgaggaucuuaccuagccggagccggguuguuauuuagcauaaugaaaaacacagcgaacacucgucgaggcacagggaauacgggcgaaacauuaggagaaaaauggaaaaaucgcuuaaaugcacuagguaaaucugaauuucagauauacaagaaaucaggaauacaagagguugacaggacauuagcuaaagagggcauuaagaggggcgaaacggaucaccaugcggucucacgaggcuccgcaaaacuaagaugguucguagaaagaaaucuagucacuccugaaggaaaagucguggacuuagguuguggcagagggggcuggucauauuacugcggaggguuaaagaaugugaaagaggucaaaggccugacgaaaggaggaccgggccacgaggaaccuauuccuaugucuacauacgguuggaauuugguaagguuacaaucgggaguugauguguucuuuacaccuccggaaaaaugcgacacgcuccucugugacauuggagaauccaguccgaacccaacaguugaagcaggccgaacacuucgaguucuaaauuuaguagaaaacugguuaaauaauaacacucaauucuguauaaaaguacuaaacccauacaugccuucaguuauagagaaaauggaagcacuucaaagaaaauacggcggugcccuaguaagaaacccacuaagccgaaacucaacccaugaaauguauuggguauccaacgcauccggcaacauaguaagcucaguuaauaugauaucgcguauguuaaucaaucgauucacuaugcgacauaagaaagccacauaugaaccugacguagauuugggaucaggcacucguaauauuggaaucgagucugaaauuccgaauuuagauauaauugguaaacgaauagaaaagauuaaacaagagcacgaaacaagcuggcacuaugaucaagaucacccuuaucguacuugggccuaccauggaaguuaugagaccaagcagacagggucagcaucaagcaugguuaacggaguagugcgauuacucaccaagccgugggacgucauuccgauggucacucaaauggcuaugaccgauacaacgccauuuggacaacaaaggguguuuaaagaaaaaguagauacacgaacccaagaaccaaaagaaggaacuaagaaacuaaugaagauaacagccgaauggcucuggaaagaacucggcaagaagaaaacaccgcgaauguguacaagggaagaauuuacacguaagguaaggucuaacgcagcauugggagccaucuuuacagacgagaacaaauggaaaagcgcucgagaagcagucgaagauucgggguuuugggaauuaguugacaaggaacgaaauuuacaucuagagggaaaaugcgaaacaugcguuuacaauaugauggguaaaagggagaagaaacucggggaauuuggaaaagcuaaaggaagccgagcgauuugguacaugugguuaggagcuagguuucuagaauuugaggcguuagguuuucugaacgaagaccacugguuuucccgggaaaacagucuaagugggguugaaggagaaggauuacacaaacuuggauauauucucagagauguaucuaaaaaggaaggaggggcaauguacgcugaugacacugcaggaugggacacaagaauaacucucgaagaccuuaaaaacgaagaaaugguuacaaaccauauggaaggggaacauaaaaagcuggcugaggcuauauuuaaauugacuuaucaaaacaaggucguaagaguacaaagaccgacuccucgaggcaccguaauggauauaauaucuagacgcgaucaacgcgggucaggacagguaguaacuuauggacugaacacauucacaaauauggaagcacaauuaauucgacagauggaaggcgaaggcguauuuaaauccauacagcaacuaaccguuacggaagaaaucgccgucaaaaacuggcuuguaagagucggaagagaacgacuaaguagaauggccauuucaggggacgauuguguugucaaaccauuagacgaccguuucgcuuccgcauugacugcuuuaaacgauaugggaaagguccgaaaagacauucaacaaugggaaccaagcagaggguggaaugauuggacucaaguuccguuuuguagucaucauuuucaugaauuaauuaugaaagauggcagaguacucguugucccaugcagaaaucaagaugaacuaauugggagggcucgcaucagccaaggcgccggcuggagucuccgagaaacagcgugucuaggaaaaagcuaugcacaaauguggagcuuaauguauuuucaccggagagaucugagguuagccgcaaacgcaauaugcagcgccguuccuucgcacuggguacccacaucacggacuacauggucaauucaugccacucacgaauggaugacuaccgaagacaugcugacaguauggaacagaguuuggauccaagaaaacccauggauggaagauaaaacaccuguagaaagcugggaagaaaucccauauuugggcaaacgagaagaucaauggugcgguucacuaauaggacuaaccaguagagcgacuugggccaaaaacauucaaacagcgauaaaucaaguacgcucgcugaucggcaaugaggaauauacggauuacaugccgagcaugaagagauuucgcagagaagaagaagaagcuggaguucuaugguag

SEQ ID NO: 22850 - RNA, 9876 nt, Artificial Sequence
  derived and/or modified CDS sequence (opt6) from DENV-2__KC762663__SS-prME
acggcugggauuauaaucaugaugauaccgacuguaauggcauuucauuuaacuacgagaaauggggaaccacacaugaucguaagucgucaagaaaaaggaaaaucuuuguuguuuaaaaccgaaaauggaguaaacaugugcaccuugauggcaauggauuugggagaguuaugugaggauaccauuacuuauaacuguccauuacucagacaaaaugaaccugaagacauugauuguugguguaacagcaccucuacauggguuacauacggaacuugcacugcuacaggagagcauagaagagagaaacguucaguggcuuuaguaccacauguuggaaugggauuagaaacacgaacugagacauggaugucuagugaaggggcauggaaacacgcacagcgcauugagacauggguauuacgacacccaggauucaccauaauggcugcaaucuuagcauauacaauagguacuaccuauuuucaaagaguguugauauuuauacugcuuacggcaguaacaccaucaaugacuaugagauguauagggauuagcaacagggacuuuguugaaggcguaucaggcggcucauggguagacauaguucuagagcacgguagcugcguuacgacaauggccaaaaacaaaccuaccuuagacuucgaauuaauuaaaacggaagcaaaacacccagccacuuuacgaaaauacuguauugaggcuaaacuaacaaacacuacaacagcaucuagaugcccaacccaaggagaacccucauuaaaugaggaacaagauaaaagguuuguauguaaacacaguauggucgacagaggauggggaaauggcuguggacuauucggaaaaggugguaucgugacaugcgcuauguuuacguguaagaaaaauauggaggggaaaauaguucaaccggaaaaucuagaauauacaauuguuauaacaccccacucaggggaggagaaugcgguugguaaugauacaggcaaacauggaaaagaaauuaaaguaacaccgcaaucgucaaucaccgaagcagaacuuacaggauauggaacagucacuauggaaugcucuccccguaccggucuagacuucaacgagaugguuuuacuacagauggagaacaaagccuggcuggugcauagacaaugguuccuugauuuaccccucccauggcuuccaggagcugauacucaaggaucuaauuggauucaaaaagaaacucuggugaccuuuaaaaauccucacgccaagaaacaagauguaguaguauugggaucucaagagggggccaugcacacagcccugacaggagcaacggagauucagaugaguucggguaacuuauuauucaccgggcaucugaaaugccggcugagaauggacaaacuucagcugaaggguauguccuauucaaugugcacggguaaguuuaaaguggucaaagaaauagcagaaacacaacacggaacaauagucauacgcguucaauaugaaggagaugguuccccauguaaaauaccguuugaaauaacggaucuugaaaaacgacauguucuaggaagauuaauaacaguuaacccgauagucaccgaaaaggauuccccaguaaauauagaagcagaaccaccguucggagauaguuauaucauuauagggguagagccaggacagcuaaaacuaagcugguuuaagaaaggaaguucaauuggucaaauguucgaaacuacuaugagaggggcaaaaaggauggcgauccugggcgauacagcgugggacuucggaagccucggugguguauucacaaguauaggaaaagcgcuucaucaaguauucggugcuauuuauggagccgcauuuaguggagugucauggacuaugaaaauucucauugguguugugauuacuuggaucgggaugaacagccguucaacaucccucucgguaucacugguccuaguagggguggugacuuuauaccuuggagugaugguucaggcugacagcggauguguggucucauggaaaaauaaggaauuaaaaugugggucugguauuuuuauuacugauaauguccacacguggaccgaacaauauaaguuucagccagagagccccucuaaauuggcaucugcgauccaaaaagcacaugaagaaggaaucuguggaauaagaucagucacacgcuuggaaaauuuaauguggaaacaaauuacuccggagcuaaaucacauccucagcgagaacgaaguaaaguuaacuauaaugacaggugauauaaaagggaucaugcaagcugguaaacgcucacuaagaccacagccuacagaacuuaaauacucauggaaaacuugggguaaggccaaaaugcuaagcacagaauuacauaaccacacauuuuuaauagacggccccgaaacagcagaguguccaaaugcuaacagagcauggaauagccuagaaguagaagacuauggguucggaguauucacaaccaauauaugguuaaaauuaaaggaaaggcaagaugcauuuugugacaguaaauugaugagcgcagccauaaaagauaaucgagccguucaugcugauaugggauauuggauagagucagcacuaaacgacaccuggaaaauugaaaaagcgagcuuuauagaaguuaaaucaugucacuggccaaagucucauacacuauggaguaaugggguacuggaaucagagaugauaauucccaaaaauuuugccgggccgguuucucaacauaacuaccggccggguuaucauacacagacggcagguccauggcauuuaggacggcuagaaauggauuuugauuuuugcgaagguacuacaguagucgugacugaagacugcgguaaccgaggaccaucacugagaacaacaacagcgucaggaaaacuaauuacagaauggugcugcagauccugcacauuaccaccgcuaagauaucgcggagaagauggaugcugguacggaauggaaauuaggccacugaaggaaaaagaagagaaucuuguaaauaguuuaguaacugccggccacggucaaauugauaauuucucguuagguguuuuaggaauggcacuuuuucuugaagagauguuacguacaaggguagggacuaaacaugcgauauuauuaguugcagucagcuuuguuacucuuaucacugguaacaugaguuuucgagaccuugggcgaguaauggucauggugggugcaacuaugacagacgauaucggaauggguguaacguaucuagcacuacucgccgcuuuuaagguaaggcccacauuugccgcaggauuguugcuaaggaaacugacaaguaaagaauuaaugaugacaacuauagggauaacacuacuaagucaaagcacuauaccagaaacgauacuugaauuaacagaugcucucgcccucggaaugaugguccuaaaaaucguucgaaauauggaaaaauaucaguuagcuguuacaauaauggcaauauuaugcgugccaaaugccguaauacuucaaaaugcguggaagguaucauguacgacauuagccguaguaaguguaucaccacuauuauugacguccucccaacaaaaagcugacuggaucccccuagcacuuacgauuaaaggucuaaauccgacggcaaucuuucuaacaacacucucaaggacaaguaagaaacgcucguggccccuaaaugaggcaauuauggcaguagguaugguaucaauacuugcuuccucuuuguuaaagaaugauauuccuaugacaggaccuuuaguggccggaggauuacuaacaguguguuauguccuaaccggccggagugcagaccuagaacucgaacgagccgcugacgucagaugggaagaacaggcugaaauuagcggaucuaguccuaucuuaagcauaacaauaucagaagacggaucaaugucaaucaaaaaugaagaggaagaacaaacacucacuauacugauuagaacuggguuauugguaauaucagggcuauuucccguuagcaucccgauaacagcagcagccugguacuuaugggaagucaagaaacaaagagccgguguguuaugggauguaccuucaccuccuccaguggagaaagcagagcuugaagauggagcuuaucgcauaaaacaaaaaggaauuuuaggauacagucagauaggagcaggaguuuauaaggaagguacuuuucauacaauguggcaugugacacgaggugcuguacuuaugcauaaggguaaaagaauagaaccuucaugggcugaugugaagaaggaucuuauaagcuauggagguggcuggaaauuagaaggagaauggaaagaaggagaagaggugcaaguacuagcguuggagccuggcaaaaauccaagggcaguucagacgaaaccuggacuguuuaaaacaucuacugguacgauuggagcuguaucauuagauuuuucacccgguacaagugggagcccgauugucgacaagaaaggaaagguaguuggucuguauggaaacggaguggugacaaggagcgggacguacgucuccgcgauagcccagacagaaaaaucaauagaagauaauccagaaaucgaggacgacauuuuuagaaagaaaaggcucacgauuauggacuuacauccuggagcagggaaaacaaaacgauaucuaccagccauaguucgagaagcaauuaagagaggcuuacgaacacuaauauuagcuccaacgcgaguaguagcugcagaaauggaagaagcgcugagaggacuaccaauccgcuaucagacgccagccaucagagcugaacacacaggaagagaaauagucgaucugaugugccaugcaacguuuacaaugcgguuacuuagcccuauucguguaccaaauuauaaucugauuauaauggacgaagcacacuucacugacccugcauccauagccgccaggggauacauauccacucgaguggaaaugggagaagcagcuggaaucuuuaugacugcaacaccacccgggucccgagacccauuuccacaguccaacgcaccuauuauggaugaagaaagagagauaccagaaagauccuggaacucuggccaugaaugggugacugauuuuaaaggaaaaacaguaugguuugucccaucuauaaaagcaggcaacgauauagcagcguguuuacguaaaaauggcaagaaagugauacaacuuucaaggaaaacuuuugacuuugaauauauaaagacaagaaccaaugauugggauuucgucgugacgacggauauuagugaaaugggagcgaauuuuaaggcagagagaguuaucgauccuaggagguguaugaaaccaguuauccuaacagacggugaagaacgaguaauacucgcuggccccaugccgguaacccacuccagugcggcgcaacguagaggacgaguaggcagaaauccaaagaacgaaaaugaucaauauauuuauaugggugaaccauuagaaaaugaugaggauugcgcccacuggaaggaagccaagaugcucuuagacaacauuaacacgccagagggcaucauuccaucuauguucgaaccggagagggagaaaguagacgcaauagacggagaauaucgauuacggggagaagcccgcaagacuuuuguagaccuaaugaggagaggggaccugccaguauggcuagcuuauagaguugcugcagaagguauuaauuaugcugaucgcagauggugcuuugacggaguuaaaaauaaccagauauuagaagagaauguagagguggaaauauggacuaaagaaggagagcguaagaaacuuaaacccaggugguuagacgcgagaaucuauuccgacccauuagcgcuuaaagaauuuaaagaguucgcugcugggcgaaaaaguuuaacauugaaucuuauuaccgaaauggguagguuaccaacuuuuaugacacagaaagcuaggaacgcuuuggacaaccuugcggugcuacacacagccgaagcuggaggaagggcguacaaucacgcgcuaagugaacugccugaaacauuggaaacuuugcuauuacuaacuuuacucgcgacaguaacuggugguauuuuucucuuccucaugucaggcaaggguaucggcaaaaugacauugggcauguguugcaucauaacagcaagcauacuucucugguacgcccagauacaaccacauuggauagcugcauccauuauacuagaguucuuucuuauaguacucuugauaccagaaccggaaaagcaaagaacaccacaagauaaccaauuaacuuacgucguaauagccauacugacaguaguagcagcuacuauggccaacgaaaugggauuccuugaaaagacuaagaaagauuucgggcuugggucaaucacgacgcaacaacccgaaagcaauauucucgauaucgauuugcgaccagcuuccgcuuggacacuuuaugcuguugccacaacauuuauaacaccaaugcucaggcauuccaucgaaaauagcagugucaacguaagccucaccgcuaucgcaaaccaagcaacgguauuaaugggauuagguaaaggguggccuuugucuaaaauggacauuggggugccccuucuggcaauaggcugcuacucucaaguaaacccaaucacgcuaacagccgcucugcuuuugcuuguugcacacuacgccauaaucgggccaggacuacaagcaaaagcaacucgugaagcgcaaaaacgcgcggcggcagggauuaugaaaaauccgacuguugaugguaucacuguaaucgaccuagacccuauaccauaugacccuaaauucgaaaaacaacuaggccaaguaaugcuauuaguucuaugcguaacacaaguucugaugaugcgcacuacgugggcccuaugcgaggcuuuaacucuggcaacgggaccuauaagcacacuuugggagggaaauccaggaagauuuuggaacacuacuauagcuguaagcauggcaaauauauuucgaggcucauacuuagcaggagcgggccuauuauucaguauaaugaaaaauacagccaacaccagaagaggaacgggaaacacuggagaaacccuaggagaaaaguggaaaaaccgcuugaaugcacucgggaaaagcgaguuucaaauauauaagaaaucaggcauacaagaaguugacagaacacuggcaaaggaggguauaaagaggggagaaaccgaucaccacgccgucuccagaggaagugcuaaacugaggugguuugucgaaagaaacuuaguaacaccggaaggaaaaguaguagauuuaggaugugguagaggugguuggucauacuacugcgggggucugaaaaacgugaaggagguuaaaggccuaacaaaagguggaccuggacaugaagaaccaauccccaugucaacuuaugguuggaaucuggugcgacuacaaucugggguagauguuuucuucaccccaccagaaaaaugugauaccuuauugugugauaucggagagucgucaccaaacccaacgguugaggcagguagaacccuaaggguauuaaaucugguagaaaacuggcucaacaauaacacgcaguuuugcauaaagguauuaaauccuuauaugccgagugucauugaaaagauggaggcguuacaaagaaaauaugguggagcacucgugcggaauccauuaucuagaaauucaacacacgagauguacuggguaucaaaugcaagcggcaacauaguaaguucuguaaacaugaucucaaggaugcuuauaaacagguuuacaaugagacauaagaaagcuacguaugaaccugacguggaucuaggaucgggaacacgaaauaucgggaucgaauccgaaacgccgaacuuggauauaauaggcaagcggaucgagaaaauaaaacaggagcaugaaacaucauggcauuacgaucaagaucacccauauaaaacaugggcauaucaugguagcuaugagacgaagcagacaggcucugcuagcucaaugguaaaugggguaguaagacuuuuaacuaaaccaugggauguaauuccgaugguaacucaaauggccaugacugacacaacuccguuuggucaacaaagaguauucaaagaaaaaguugacacaagaacucaggagcccaaagaagggacgaaaaaguuaaugaaaaucacagcagaauggcucuggaaagagcucggcaaaaagaaaacuccgcgaauguguacgcgugaagaguucacaagaaagguccguucaaaugcugcuuuaggagcgauauucaccgacgaaaauaaauggaaaucggcaagagaggcgguugaagauucgggauucugggagcuuguagacaaggagcgcaaucuacaccuagaaggcaaaugugaaacuugcguauauaacaugauggguaaacgagagaagaaauuaggugaguuuggaaaagcuaaaggaucacgagcuauuugguauaugugguugggugcacgauuuuuagaguucgaagcucuaggauuucuaaacgaagaccacugguucucaagagaaaacucgcuaaguggaguagagggugaggguuuacauaaauuaggguauauacuacgugauguuaguaagaaagaagguggggcuauguaugccgaugacacagcggguugggacacacgcaucacccuagaggauuuaaagaaugaagagauggucacuaaucauauggaaggagaacacaagaaacuagcggaggccauauuuaaauuaaccuaccaaaauaagguuguaagagugcaacggccaacuccgcgugguacaguuauggacauuauaucacgacgugaccagcguggaucaggacaaguuguuacguacggcuugaacacauucacuaauauggaagcccaauugauucgacaaauggaaggagaaggagucuuuaaaucaauacagcaauugaccguaacagaagaaauagcagugaaaaauuggcuuguuaccguagguagagaaagauuauccagaauggcaauaaguggagaugauuguguagugaaaccucuagacgauagauucgcaucagcauuaacagcguuaaacgauaugggaaaggucaggaaagauauucagcaaugggaaccuucccgaggauggaaugauuggacacaaguccccuuuugcucucaucacuuccaugagcucaucaugaaggaugguaggguguugguaguaccuugccgcaaccaagacgaguuaauaggcagagcgagaauaucucaaggcgcuggauggucuuugagagaaacagcuugcuuaggaaagucauacgcacaaauguggagccuuauguauuuucaccguagagauuugaggcuagcugcuaaugccauauguucagccgucccuucacauuggguuccaaccucaaggacuacuuggagcauacaugcaacgcaugaauggaugacgaccgaggauauguuaacaguauggaacaggguauggauacaagaaaauccguggauggaagauaagacaccgguugaaagcugggaagaaauucccuaccuagguaaaagagaagaucaauggugcgguaguuugauaggguuaaccucucgagcuacuugggccaaaaacauacaaaccgcaauaaaucaagugagaucgcuuauagguaaugaagaauauacggacuauaugccgucgaugaaaagauuucgaagagaagaagaagaggcaggcguauugugguag

SEQ ID NO: 22851 - RNA, 9876 nt, Artificial Sequence
  derived and/or modified CDS sequence (opt6) from DENV-2__KC762675__SS-prME
acggcagguaucauaauaaugaugauaccuacgguaauggcauuccaucucacgacacgaaacggugaaccgcauaugauaguaagucgacaagaaaaagguaaaucgcuucuauuuaaaacggaaaacgguguuaauauguguacucugauggcaauggacuuaggcgaacuaugugaagacaccauaaccuauaauugcccucuacuaagacagaacgaaccagaagacauagauugcugguguaauuccaccucuacuuggguaaccuaugggaccuguacagcaacaggagaacaccgaagagagaaaagauccgucgcauuaguaccacauguaggaauggguuuagaaacgagaacggaaacauggaugucguccgaaggcgcauggaaacacgcacaaagaaucgaaacguggguacuuagacauccagguuucacaauaauggcagcaauacuggcauacacgauaggcacaacucauuuucaaagagucuuaauauuuauacuucuaacagcaguagcgccaaguaugacaaugagaugcaucggaauuuccaaucgagacuuuguggaagggguaucugguggaucauggguagacaucguauuagaacacgguaguugcguuaccacaauggccaaaaacaaaccaacccuugauuucgaauuaaucaaaacagaagcaaaacauccugcaaccuugagaaaauauuguauugaagcaaaauuaaccaacacuacuacugcaucaagaugccccacacaaggugaacccagccuuaaugaagaacaggauaaacgguucguuugcaaacauucuaugguagaccguggguggggcaauggcugcggucuguuuggaaaaggaggaauuguuaccugugcgauguucacuuguaaaaagaacauggaaggcaaaaucgugcagccugagaaucucgaauauaccauuguaauaacgccacacucuggcgaagaaaacgcaguagguaaugauacagguaaacauggaaaagaaauaaaaguaacuccacagucaucaauaacagaagccgaacuaacagguuacgguacaguaacuauggaauguaguccaagaacgggauuggauuucaacgaaauggugcuacuacaaauggaaaauaaagcauggcugguccauagacaaugguuccuagaccugccucucccguggcugcccggcgcagauacacaagguucaaauuggauucaaaaagaaacccuugugacauuuaaaaacccacacgcuaagaaacaagauguaguaguacuggggucucaagaaggagcaaugcauacagcguugacgggagcuacagaaauacaaaugucaucaggaaaucuauuauuuacuggacaccuaaaauguagacucagaauggauaaacuacaguugaaaggaaugucuuacaguauguguacaggaaaauucaaaguaguuaaagaaauagcugagacucagcacgguaccauuguaauucguguacaauacgaaggugauggcagcccaugcaaaauaccuuuugaaauaauggaccuagagaaaagacauguguugggucgauugaucacaguaaacccaauugugacagagaaggauucuccaguaaacaucgaagcagaaccacccuuuggcgacucguacaucaucauaggaguugaaccuggccaacugaaacuaucaugguucaagaaagguagcucuaucggacaaauguucgaaacgacgaugcgaggugcuaaacgaauggcaaucuugggcgauacagcaugggauuuugggagucucgguggaguguucacaaguauuggcaaggcucuacaucaggucuuuggagcgauauacggcgccgcauucagugguguaaguuggacaaugaaaauacuaaucgggguuguaauuacuuggaucggaaugaacucacgcaguacuuccuuaucaguaucguugguauuaguugggguaguaacauuauaucuuggaguaauggugcaagcagacagcggaugcguuguaucuuggaaaaacaaagaacucaaaugugggucaggcaucuucauaacagacaauguacauacauggacggaacaguauaaauuucaaccagaaaguccuucgaaauuggcuagcgcuauucagaaagcgcaugaagaaggcauaugcggaauuagaucugucacuagauuagagaaccucauguggaaacaaauaacuccagaauuaaaccauauauuaagugagaaugaagucaaguuaaccauaaugacaggagacauuaaagggauuaugcaagcagguaaaagaucuuuaaggccucaaccaacagaauuaaaguauucauggaaaacauggggcaaagcgaagauguugucaacagaacuucauaaccauaccuuuuugaucgauggaccggagaccgccgagugcccaaacacuaaucgugcauggaacagccuugagguggaagauuaugguuuuggaguguuuacuacaaacauauggcuuaaguuaaaagaaaggcaggacguuuacugugacucgaaacuaaugucugcggcuauuaaggacaaccgggcaguacacgccgauaugggguacuggauugaaagcgcauuaaaugauaccuggaaaauugaaaaagcaucauuuaucgaagucaaauccuguuacuggccgaagucucauacguuauggucuaacggaguauuggaaucagagaugaucauacccaaaaauuucgccggacccgugucacaacacaacuaccgcccagguuaccacacccaaacagcgggcccguggcaccuaggaagguuagaaauggauuuugacuuuugugaaggaacaacaguaguagugacagaagauuguggaaaucgaggcccuucacuuagaacuacaaccgcuagugggaaacuaaucacagaaugguguuguagaaguugcacacuuccuccuuuaagauaucguggagaagauggaugcugguauggaauggagauuaggcccuugaaagagaaagaagaaaacuuaguaaacucauuagugacugccgggcaugggcaaaucgacaacuuuucuuuggggguucuuggaauggcacuauuuuuagaggaaaugcuccgcaccagaguagguacuaaacacgcuauauuauugguagcgguaucuuuugucacccuuaucacagguaauaugucauuuagagaucugggaagaguuauggucaugguaggugcgacaaugacugaugauauaggcaugggaguaacauacuuagcacugcuugcagcguuuaaagugcggccgacguucgcagcuggcuuguuauuaagaaaacuaacaucgaaagaguuaaugaugacaacaauuggaauuguuuuacucucccaaucaaccauuccagaaacuauccuagaacuuaccgacgcacuggcauuaggaaugauggcacuuaaaauuguucgaaacauggagaaauaccagcuugcagucacaauuauggcaauauuaugcguaccaaaugcuguaauauuacagaaugcauggaaaguuaguuguacaacauuggcuguaguuucgguuucgccguuacuacuuaccagcagccaacagaaagcugauuggauaccgcuagcucuaacaauuaaaggguuaaaccccacagcaaucuucuuaacuaccuuaaguagaacaucaaagaaacggucuuggccacucaacgaagccauaauggcggucgguaugguaagcaucuuagccucaucguuacucaagaacgauauuccaaugacagggccucuaguagcaggcggauuauuaacaguuugcuacguacuuacgggaaggucggcugauuuagaauuagaaagagcggccgacgugcgaugggaggaacaagcugaaaucucaggaucauccccaauacuaucuauaacuaucucugaggacggaucuauguccauuaagaacgaagaagaagaacaaacguuaacaauacuaauaagaaccggucuguuaguaauaucgggucuauuuccagugaguauaccaauaacugcugcugcgugguaucucugggagguaaagaagcagagagccgguguuuuaugggaugucccaagcccuccuccugugggcaaagcagaguuggaggacggggcguaccguauaaaacaaaaaggaauauuaggauauucacaaauaggagccggaguauacaaggaaggcacuuuccacacaauguggcacguaacacgaggugcaguucugaugcauaagggaaaaagaauagaaccgucaugggccgaugucaagaaagacuuaaucucguacggggguggcuggaaacuugaaggagaauggaaggagggggaggagguucagguacuagccuuagaaccaggcaaaaauccgagagcuguacagacaaaaccaggcuuguucaaaacaaauacuggaacgauaggagcuguaucacuugacuucagcccugguaccucuggaucaccaauuguagauaagaaaggcaagguuguuggacuuuacggaaauggggugguaacgcgauccggaacguauguaucagcuauagcgcaaaccgaaaagaguauagaagauaaucccgagauugaggaugacauuuucaggaagaaacgauuaacuauuauggauuuacacccaggagcaggaaaaacgaaacgguaccuuccugccauugucagagaggcaauaaaacgcggacucagaacucuaauacucgccccuacacguguaguugccgcugaaauggaggaggcauugaggggacuaccaauaagauaucaaacuccagcgauacgcgcagaacauaccggccgggaaauuguugacuuaaugugccaugcaaccuucacaaugagauuacuuagcccgauacguguaccuaacuacaauuugauuaucauggaugaagcccauuuuacagaucccgcuaguauagccgcaagaggcuacaucaguacaagaguagaaaugggugaagcugccggaauauucaugacagcaacaccaccggguucgcgggaccccuuuccacaaucaaaugcuccgaucauggaugaagaaagagagauuccugaaagaaguuggaauagcggccaugaaugggucacagauuucaaaggcaaaacuguuugguuuguuccaucgauaaaagccggaaacgauauugcagcuuguuugcguaagaaugguaaaaagguaauucaguugucgagaaaaacauuugacuucgaauauauaaagacucguacuaacgauugggauuuuguagugaccacagacauaucagagaugggggcgaacuuuaaagcugaaagaguaauagauccucgacgcuguaugaaaccaguaauacucacagacggugaagaaagagugauucuggcaggcccaaugcccguaacacacucaucugccgcacagaggagagguagagucggucgaaauccuaaaaaugaaaaugaucaguacauauacaugggugaaccauuagaaaaugacgaggacugugcacauuggaaagaggcgaaaaugcuacuugauaauauaaacacacccgaaggaauaaucccauccauguucgagccugagagagaaaaaguggaugccauagacggagaauacagacuaagaggugaggcuaggaaaaccuuuguggaccuuaugcggaggggugacuugccugucugguuggccuaucggguagcagcugaagggauuaauuaugcggauaggagauggugcuuugacggaguaaagaauaaucaaauacucgaagagaauguggaaguugagaucuggacaaaagaaggugaacgaaagaaauugaaacccagguggcuugaugcaagaauuuauucagacccuuuagcgcuaaaggaguucaaagaguucgcagcggguagaaagagucugacucugaaucuaaucacagaaaugggaagauuaccaacauucaugacucaaaaggcucgaaacgcauuagauaaccuagcgguacuucacacugcagaagcaggagggcgagcuuacaaucacgcccuaagcgaacucccagaaacucuugaaacacuuuuauugcuaacucuuuuggcuacuguaacugggggaauauuucuguuucuaaugucagguaaaggcaucggcaaaaugacucuagguauguguugcauaauuaccgcaaguauuuuacuaugguacgcacaaauccaaccacacuggauugcagccaguauaauacuagaauuuuuccugauuguguugcucaucccagaaccagaaaaacaacguacaccccaagacaaucaguuaacuuacgugguuauagcaauauugacugucgucgcagcaacaauggccaaugaaaugggguucuuggagaaaacuaaaaaggauuuuggcuugggauccauaacaacacaacagccagagagcaauauucuggauauugacuugcgaccggcuucagcauggacucuauaugcuguagcaacgacauucaucacgcccaugcuaaggcauaguauugaaaauagcagcguaaauguaagucuuacggcuaucgcaaaucaggcaacgguauuaaugggccuaggaaaaggauggccucucaguaaaauggauauaggaguuccacuauuagcaauaggauguuauagccaaguaaacccaauaacacuuacagcagcuuuacuacuuuuaguagcacauuaugccauuauaggaccuggucuacaagcaaaagccacacgcgaagcacaaaaacgugcugcagcgggaaucaugaagaauccaacuguugacgguauaacgguaaucgaucuagacccaaucccguaugauccaaaauuugagaagcaacuuggucagguaauguuauuaguauugugugugacccaaguuuuaaugaugagaacgacaugggcucuaugugaagcauuaaccuuggcaaccgguccaauuucaacgcucugggaaggaaacccaggaagauuuuggaacacaacuaucgcaguaucuauggcaaauauuuucaggggaucuuauuuggcgggagcaggauugcuauucucgauaaugaaaaauacagcuaauacuaggcggggaacggguaauaccggagagacauugggcgagaaauggaagaaccgacuuaacgcuuugggaaaaucagaguuccagauuuauaagaaaucugguauccaagaagucgaccguacacucgcuaaagaaggaauuaagcgaggugaaaccgaccaucaugcugucagucgggggucggccaaauugcguugguucguagagagaaaucucgucacgccggaagguaaaguaguugauuuaggguguggaagaggaggaugguccuauuacuguggaggacuuaaaaauguaaaggaagucaagggccuaaccaaagguggaccuggacacgaagaaccuauuccaaugucaacuuacggguggaauuugguacgacuacaaagcggcguugacguguucuuuacuccaccagaaaaaugugacacccuacuaugugauauaggagaaucaucgccaaauccaaccgucgaagcagguagaacucugcgaguacuuaauuugguugaaaauuggcuuaauaauaacacacaauuuugcauuaaaguacucaauccuuauaugccgucuguuauugagaaaauggaagccuuacagagaaaguauggaggcgccuuaguacguaacccgcuaucacgcaacucuacccacgagauguacugggugucuaacgcuagcggcaauauaguuucgagcguuaauaugaucaguaggaugcucauuaacagauuuaccaugagacauaaaaaggcgaccuacgaaccugacguggauuuagguucugguacaaggaacauaggcauagaaagcgaaauucccaauuuagauauaaucggaaagcgaauagagaaaauccaacaagaacaugagaccucuuggcauuaugaucaagaccauccauaccggaccugggcauaucaugggaguuacgaaaccaagcagacagggagugcuaguaguaugguaaaugguguaguaagacuacuaaccaagcccugggauguaaucccaaugguaacucaaauggcaaugaccgacacaacuccguucggccaacagcgcguuuucaaagaaaaaguugauacacgaacucaagaaccaaaggaaggaacgaaaaagcucaugaagauaacagcagaauggcuuuggaaggaacuuggcaagaagaaaacuccccgaauguguacccgcgaagaauuuacacgaaaaguacgaucgaaugcagcauuaggugcaaucuucacagacgagaauaaauggaaaucagcaagggaagcgguagaagauucuggauucugggaauuagucgacaaagaacgaaaccuacaucuggaaggaaaaugcgagaccuguguauacaacaugaugggaaagcgugagaagaaauugggcgaguuuggcaaagcaaaaggauccagagcaaucugguacauguggcugggugcucguuucuuggaguucgaagcacuaggauuuuuaaaugaagaccacugguuuucacgugaaaacucacuaucggguguugaaggugaaggccuacauaaauuggguuauaucuuaagagaugucucuaagaaagaagguggugccauguaugccgaugauacggcuggcugggacacuagaaucacacuugaagaucucaaaaaggaagagauggucacuaaccacauggagggugagcauaagaaguuagcagaagcaauuuucaaacuuacauaucaaaauaaaguuguuagaguacagcguccgacaccgagggguacaguuauggauauuauuucccgaagggaccaaagggguuccgggcaagucguaacauauggacugaacacuuucacaaacauggaggcacagcuuauuagacaaauggaaggugagggaguguucaaaucaauacaacaauugacagucacggaagagauagcugugaaaaauuggcuggugagaguaggcagagaaagguugucuagaauggcuauaaguggcgaugacugugucgucaaaccacuggaugaucgcuuugcaucggcuuuaacagcccuuaacgauauggguaagguuagaaaggacauccaacaaugggagccaucuagaggcuggaacgacuggacacagguaccauucuguagccaccacuuccacgaauuaauuaugaaagacggaagaguucuagucguaccuugucggaaccaggacgagcugauuggucgugcuagaauuucucaaggagcaggauggucacuacgggaaacagcaugccuaggcaaaucguaugcacagauguggucucuuauguauuuccacaggcgagauuuacguuuagcugcgaaugcuauauguucagcaguaccaucacacuggguaccuacauccaggaccacauggucuauucaugccacccacgaauggaugacaacagaggauauguuaacuguguggaaucggguauggauucaggaaaauccguggauggaagacaaaacgccuguugaaaguugggaagagauaccuuaucuagggaagagggaggaccaaugguguggaaguuugauugggcugacgagucgagcgacgugggcuaaaaauauacagacugcaaucaaccaaguaagaagccuaauaggaaacgaagaauacacagauuauaugccaucuaugaaaagguuuagaagagaagaagaagaagccgguguguuaugguaa

SEQ ID NO: 22852 - RNA, 9876 nt, Artificial Sequence
  derived and/or modified CDS sequence (opt6) from DENV-2__KC762671__SS-prME
accgcaggaauuauaauaaugaugauucccacgguaauggcuuuucaccuuaccacucgaaauggugaaccucacaugaucguaucucgacaagaaaaaggcaaaucucuauuauucaaaacugaaaauggagugaauauguguacucuaauggcaauggaucuaggagaacugugugaagacacaaucacguauaauugcccgcuucuaagacaaaacgaaccagaagauauugauugcuggugcaauucaaccaguacauggguaacauaugggacaugcacagcaacaggagagcaucggcgggagaaaagaucuguagcacuuguuccccacgugggcauggguuuagaaacacgaacugagaccuggaugucgucugaaggcgcauggaaacaugcacaaaggauugaaacuuggguauuaagacaccccgguuucacuauaauggcagcaaucuuagcauauacaaucggcacgacauauuuucagagaguacucauuuuuauacuacugacugcuguagcaccaagcaugacaaugagauguaucggaauauccaacagagauuuuguagagggaguaucaggagguucauggguggauauuguccuggaacauggaucaugcgugaccacuauggcgaaaaauaaaccaacauuggacuucgaauugaucaaaaccgaggcaaagcaucccgcaacacuucggaaauauuguauugaagcuaaguugaccaauaccaccacugcaucaagguguccaacccaaggugaacccucacuuaacgaggaacaagauaagcgauuuguauguaagcacucuaugguagacagggguuggggcaauggauguggucucuuuggcaagggaggcauuguaacaugcgcaauguucaccuguaaaaagaauauggaaggaaaaaucguucaacccgaaaauuuagaauacacuauaguaaucacgccccauagcggagaggaaaaugcuguagguaaugauacaggcaaacacggcaaggaaauaaaagucacuccacaaagcucaauaacugaagcagaguugaccggcuaugggacagucacgauggaauguucgccacggaccggacucgauuucaaugaaaugguauuauugcaaauggagaacaaggcaugguuagugcaccggcaaugguuuuuagaucugccacugccuugguuaccaggugcagauacacaggguucgaauuggauacaaaaagaaacccuuguuacguucaaaaacccucaugccaagaaacaagacguaguugugcuuggcucucaagaaggugccaugcauacugcuuugacaggggcaacggaaauccaaaugucuucuggaaaucuauuauuuaccggucauuuaaaguguagauugagaauggacaaauuacaacugaaaggcaugucauauucaaugugcacugguaaauucaagguaguuaaagaaauugccgagacgcaacacggaaccauuguuauuaggguccaauaugaaggcgauggcucacccugcaaaauaccauuugaaaucauggaucuagagaaaagacauguauuaggucggcuaauaaccguaaacccgauagugacggaaaaggacucaccuguaaacauugaggccgaacccccauuuggcgauucauauauaauaauaggaguggaaccuggacaauuaaaacuaucaugguucaagaaaggaucguccauuggacagauguucgaaaccacaaugagaggugcaaagagaauggcuauccuaggggauacagcuugggauuucgguagcuuggguggcguauucaccucuaucggcaaagcacuccaccagguuuuuggugcuaucuauggugcugcguuuagcggcguauccuggaccaugaaaauauugauuggcguagucauaaccuggaucggcaugaauaguaggucgacgucauuaucugucucauugguauuagugggaguggucacuuuauaccuuggugugaugguucaagcagacagcgguuguguaguaaguuggaaaaauaaagaauuaaagugugggucaggcaucuuuauaacugacaauguacauacguggacagaacaauacaaauuccaacccgaaagcccuagcaaacuagccucagcuauacaaaaagcccaugaggagggaauuugcggaauaaggucuguaacaagacuugaaaacuuaauguggaaacaaauaacgccagaacuaaaucacauauuaagugaaaaugaagugaaacucacaauuaugacaggagauauaaagggaauaaugcaggcuggaaaaagaagucucagaccacagcccacggaauuaaaauauaguuggaaggcuuggggaaaagcuaaaauguuaaguaccgagcuccacaaccauacauuuuugaucgacggacccgaaacagcagaaugcccaaauacgaacagagcguggaacucauuagaaguagaggauuacggauucgguguauuuacuacaaacauuuggcuuaaauuaaaggagagacaagacguauuuugcgauagcaaauuaauguccgcugcaauaaaggacucccgagcuguacacgcggauauggguuauuggauugaauccgcucugaacgacaccuggaaaauagaaaaggccagcuuuauagaaguaaaaagcugccauuggcccaaaucacauacuuuguggucaaaugguguucuagaauccgagaugauaauucccaaaaauuucgccggcccugucucacaacauaacuacagacccggauaccacacucaaacggcugguccauggcauuuaggaagauuagaaauggauuucgauuuuugcgagggaaccaccguuguggugacggaggacugcggaaacaggggaccuagcuuaagaacaacaacugcaagugggaaacugauuacugagugguguuguagaaguuguacauuaccaccacuuagauaucgaggugaggauggguguugguaugguauggaaauccgaccgcuuaaggaaaaggaagaaaaucucguuaauucauugguuacagccggccauggacaaauagauaauuucuccuuggguguucuagggauggcguuguuucuugaagaaaugcucagaacaaggguuggcacuaaacaugcaauauugcuaguagccguaaguuucguaacguuaaucacaggcaacaugucguuuagggauuuaggcagaguuaugguaaugguaggugcaacaaugacggaugacauagguauggggguaaccuaucuagcacuauuagcggcuuucaaaguacgccccacguucgcagcuggccuucuuuuacgcaagcuaacaucuaaagagcuaaugaugacaaccauagguauuguauuacucagucaagcaacaaucccagaaacuauacuagaacucacggacgcucuggcauuagguaugaugguucuuaagauagucaggaauauggagaaauaccaacucgcuguaacuauuauggccauauuaugcguaccaaaugccguaauacuacagaaugcguggaaagugucauguacgacacuagcggucguuagcguaaguccacugcucuuaacuucaucacagcaaaaggcagacuggauacccuuagcccucacgauaaaagggcuuaaucccacggccauauuucuaacaacacucagucgcacaagcaaaaagcgaucauggccacuaaacgaagcuaucauggccguaggaaugguaucaauauuggcaagcagcuugcucaaaaaugauauacccaugacggguccuuuaguugcaggaggacuauuaacaguuuguuauguacuaacuggaagaucggcugaucuggaacuugaaagagccgcugaugugagaugggaagaacaagcagaaauuuccggcuccucaccuauacuaucuauaaccauaagcgaagauggaaguauguccaucaagaaugaagaagaggaacagacacuaacaauccuuauacgcacgggucugcuggugauuucuggauuauuuccuguaagcauaccgauaacagcugcagcaugguaucuuugggaagugaagaaacagagagccggugucuuaugggacguuccuucuccacccccaguagguaaggcagaacuagaagauggagccuacaggauuaagcaaaaaggaauacuugguuauucacaaaucggugccgguguauacaaagaagggacauuucacacuauguggcaugucaccagaggggcaguacugaugcacaagggaaagaggauagaaccuagcugggccgacgucaaaaaggacuuaaucucguaugguggugguuggaagcuagaaggugaauggaaggaaggggaggagguacaggugcuugcucucgaaccuggcaagaauccgagagcaguucaaacaaagccagguuuauuuaaaaccaauacaggaacuaucggggcuguuagcuuagauuuuucgccagguacgagugguaguccaaucguagacaagaaaggaaaaguagucggacuauaugguaauggagugguuacgcguucggggaccuauguuagugccauagcucaaacggagaaaagcauugaagauaacccagaaauagaagacgauauauuuagaaagaaaagacuuacgauaauggaucugcaccccggugcgggaaagaccaagcgauaucuuccagcaauaguaagagaggcuauaaaacgaggacuacgcacacugauacuagcucccaccagaguaguugcagccgagauggaggaagcauuacgagguuuaccuauuagguaccaaacaccagcaauaagagcagaacauacuggccgagaaauuguagacuugaugugucaugcaacuuuuacaaugcgacuccuauccccaauaagggucccaaauuauaauuuaaucauaauggacgaagcccacuuuacggacccggccaguauagcagcgcgagguuauauaagcacucgggucgagaugggagaggcugcaggcauuuucaugaccgcaacuccaccgggguccagagacccauuuccgcaguccaaugcuccgauaauggacgaggagagagaaauuccugaacggucauggaauaguggucaugaauggguaaccgacuucaaagguaaaacugucugguuuguuccaagcauuaaagcagguaaugacauugccgcaugcuuaaggaaaaauggcaagaaaguuauacaauuaucucggaaaacuuucgauuucgaauauauaaagacacgaacaaacgacugggacuuuguaguaacuacagauauaagcgaaaugggcgcuaauuuuaaagcggaaagggugauagauccacgaaggugcaugaaaccagucauucucacagacggggaagaacgaguaauucuagcuggcccaaugccugucacacauucgucggcugcacaaagaaggggacguguggggagaaauccuaaaaacgaaaaugaucaauauauauacaugggggaaccacuggaaaaugacgaagauugugcacauuggaaagaagcaaagaugcuuuuagacaacauuaauacaccggaagggauuauaccaucuauguuugaaccagaaagggaaaaaguagacgcaauagauggugaauauagacuccgcggagaggcucguaaaacauuugucgacuugaugagacgaggagauuuacccguuugguuggcguacagaguggcggccgaagguaucaauuaugcggacagacgauggugcuuugacgggguuaaaaauaaucagaucuuagaagaaaacgucgagguagagaucuggacuaaagaaggagaaagaaagaaacuaaaaccacgauggcuagaugcaagaauuuauagcgacccacuggcguugaaagaauuuaaagaguucgcagcuggcagaaaaagucucacacuaaauuuaauuacggaaaugggucgacuuccaaccuucaugacacaaaaagcccgaaacgcacuugauaaccuggcaguacuacacacagcugaagccgguggaagggcauacaaccaugcacuaagcgagcuucccgaaacuuuagagacucuuuuacuccucacauuguuggcaacaguaacaggugguaucuuucuauucuuaauguccggaaaagguaucggaaaaaugacuuuagggauguguugcauuauuacagcgaguauauuauuaugguacgcacagauacagccacacuggauagcagcuucaauaauccuagaguucuuucuuaucguacugcuaauaccugaaccugaaaaacaacgcacaccacaagacaaucaguugacauacgucguaauugcgauauuaacuguaguugccgcaacaauggcgaacgaaaugggauucuuggagaaaacaaagaaagacuucggauuagggaguauaacaacgcaacaaccagaauccaacauacuggauauagacuuaaggccugccagcgcuuggacguuauaugcaguagcuacgacauuuauaacccccaugcucagacauaguauagaaaauucuagcgucaacguaucucuuacugcaauagcuaaccaggcuaccguacuaaugggcuuaggaaaagguuggccgcuuucaaaaauggacauaggcguaccauuacucgcaaucggcuguuacucgcaaguuaacccuauaacguuaacugcagcguuauuacugcucguagcacacuaugcgauaauaggacccggauugcaagcuaaagcaacaagagaagcgcagaaaagggcagcagcagggauuaugaaaaauccaacgguggacggaauaacagugaucgaucuugaucccaucccauacgacccgaaauuugaaaaacaacuuggccaagucaugcuguuaguauuaugcgugacgcaagugcuuaugaugagaacgacaugggcacuuugugaagcacuaaccuuagcuacuggucccauuucuacguugugggaaggcaaccccggucgauucuggaauacuacuaucgcaguauccauggcuaacauauuucggggguccuaucuugcuggagcagguuuguuguuuucgauaaugaaaaauacagcgaacacaagacgaggaacgggaaauacaggagaaacgcuaggagaaaaauggaagaacagacuaaacgcauuaggaaaaucggaauuucagauauacaaaaagagcggcauucaagaaguggaucgaacuuuggcaaaagaaggaaucaaaagaggagaaacagaccaucaugcaguuucaagagggagcgcaaaacuccgaugguuuguggaaagaaaccuaguuaccccagaggggaaaguuguugaccuaggauguggucgcggaggcuggucuuacuacugugggggacuuaaaaacgucaaagaggucaaaggacuaacuaaaggcgggccgggacaugaagaaccaauacccaugagcacauacggauggaaucuugugcgccuacaaucaggaguagauguuuucuuuacaccuccagaaaaaugugacacucuauugugugauauaggagaaucuucaccaaauccaacugucgaagcggguagaacccuuagaguuuuaaaccuaguugagaacuggcucaauaauaacacccaguuuuguauuaaaguucuaaacccuuacaugccaucggugauagagaaaauggaagcacuucaaagaaaauauggcggagcauuaguccgcaacccucuaucuagaaacagcacccacgaaauguacuggguaucaaacgcaucuggaaacauaguaagcuccguuaauaugauaucaagaaugcuaauuaauagauuuacuaugcgucauaagaaggcaacuuacgaaccagaugucgaccuaggaucaggaacgagaaauauugguauugaaagcgagacgcccaauuuagauauaauagguaaacgaauagagaaaauaaagcaggaacacgaaacaucguggcacuaugaccaggaucauccuuauaagacuugggccuaccaugguucauacgaaacgaaacaaacagguagugcgagcucaaugguaaaugggguuguuagguuauuaacuaaacccugggaugugauacccaugguaacucaaauggcaaugacagauacuacuccauuugggcaacaacgaguguuuaaagaaaaaguagacacacgaacacaagaacccaaagaagguacuaagaagcuaaugaaaauuacugcggaaugguuauggaaggaauuaggcaaaaagaaaacaccuagaauguguacacgagaagaauuugcccgaaaaguacgaucuaaugcagcacugggagccaucuuuacggacgaaaacaaauggaaaagugcaagagaagcuguagaagauagcggauucugggaauuaguagauaaagagcgcaaucugcauuuagaagguaaaugugaaacuugcguauauaauaugauggggaaacgugagaagaaacucggggaguuugggaaagcaaaggguucccgcgcaauaugguauaugugguugggcgcacguuuccuggaguucgaggcacuaggauuuuugaacgaagaucacugguuuagccgggaaaauucucuuuccgguguagaaggagaagggcuccauaaguuaggauauauauuaagagacgucucuaugaaagaaggcggugccauguaugccgaugauacggcgggcugggauacuagaauaacgcuagaagaucuuaaaaaugaagaaaugguaacuaaucacauggaaggagaacauaagaaacuugcagaggcuauuuuuaaacuuaccuaucaaaauaaggucguucggguacagagaccaacaccaaggggcacagucauggacauaauaucgagaagggaccaacguggaucaggacagguaguuacuuacggauuaaauaccuucacaaacauggaagcucaauuaauccgacagauggagggggaaggaguguuuaaaaguauacaacaacucacgguaacagaagaaauugcagugaagaauugguuggugcgaguuggcagagaaagauugucaagaauggcaauaucgggggacgacugcguuguaaagccccuugaugaccgcuuugcuagugcguuaacagcacuuaaugauauggguaaggucagaaaagacauccaacagugggaacccucucgagguuggaacgauuggacgcagguucccuuuugcucgcaccauuuucacgaauuaauaaugaaggauggacgaguacuuguggucccuugcagaaaucaagacgaacugauuggcagagcacgaaucucucaaggagcaggcuggaguuuaagggaaacagcuuguuuagguaaaucauacgcccagauguggagccugauguauuuucauagaagggaucuaagacuagccgcaaaugcaauauguagcgcaguuccaucacacuggguuccuacgagucguaccaccuggagcauccaugcuacacaugaauggaugaccacggaagacaugcuaacaguuuggaauagaguauggauacaagaaaacccauggauggaagacaaaacaccgguggagaguugggaagaaauacccuaucuuggcaaacgcgaagaccaauggugugggaguuuaauaggauugacaagucgugcaacaugggccaaaaauauccaaacagcuauaaaccaaguacguagcuuaauagggaaugaagaauauacagacuauaugccuucaaugaaacgauuuagaagagaagaagaagaagccgguguucuuugguag

SEQ ID NO: 22853 - RNA, 9876 nt, Artificial Sequence
  derived and/or modified CDS sequence (opt6) from DENV-2__KC762664__SS-prME
acggcagguauuauuauaaugaugauaccuacagugauggcauuucauuugacaacgagaaauggagaaccacacaugauaguaucuagacaagaaaaaggaaaaagucugcuauuuaaaacagaaaaugggguaaauauguguaccuuaauggcgauggaucugggagaacuaugcgaagauacuauaacuuacaauugcccacucuugcgacaaaaugaaccagaagauauagacuguuggugcaauagcacaucgacaugggucacauacgguacaugcacugcaacuggugagcauaggagggaaaaacguuccguagcauugguuccacacguaggaaugggauuagagacacggacggaaaccuggaugaguucagaaggugcauggaaacacgcacaacgaauagaaacauggguccuaagacaccccggauuuacuauuauggcggcuauacucgcauauacuauaggaacgacguauuuccaaagaguacuaauauucauacucuugaccgcaguaaccccgaguaugacuaugagauguauaggaauuucgaaucgggauuuugucgaaggagugaguggagguucuuggguagauauaguuuuagagcacggaucgugugucacaaccauggccaaaaauaaaccaacucuugauuuugaacuaauaaaaacugaagcuaaacauccugcgacauuaagaaaauacuguauagaagcaaaacuaacgaacacgacaacggcaucaagauguccaacgcaaggagaaccuagccugaacgaggaacaagauaaaagauuugucuguaaacacucgaugguagaucguggcuggggcaaugguugugggcucuuugggaaaggaggaauagucacaugcgcaauguuuacaugcaagaaaaacauggaagggaaaauaguucagccagaaaaccuugaguauacgauaguaauaacgccacacucuggggaagaaaaugcaguuggcaacgacaccggaaaacauggaaaagaaaucaaaguaacuccacaaaguagcauuacggaagcggaauuaacggguuauggaacaguaaccauggaguguaguccacguacuggccuagauuucaacgaaaugguacuuuuacagauggaaaauaaagcauggcuaguccacagacaaugguuccucgaccuaccgcucccuugguuaccuggugcagauacccaggguucuaauuggauacaaaaagaaacauuaguaaccuuuaaaaauccucacgcaaagaaacaagauguaguaguauuagggucacaggaaggagcgaugcauaccgcguuaacaggggcaacagaaauccaaaugucaucaggaaaccuacuauuuaccgggcaucuuaaauguaggcugaggauggacaaauugcaauuaaaaggaaugucuuacucuaugugcacuggaaaauucaaaguugucaaagaaauagcagaaacacaacaugggaccauagugaucagaguacaauacgaaggcgaugggucccccugcaaaauaccuuuugagaucacagaccuggaaaaacggcauggucuaggaaggcugaucacugugaacccaaucgugaccgaaaaagacaguccaguuaacauugaagcagaaccuccauuuggagauaguuauauaauaaucgggguugaacccgggcaacucaaauuaucaugguuuaagaaagguucuucaauagggcaaauguuugaaacaacuaugcgaggcgcuaaaagaauggcuaucuuaggugauacagcaugggauuuugggucuuuaggcggugucuuuacuucaaucggcaaagcgcuacaccaagucuucggggccaucuacggagcagcauucuccggagucuccuggaccaugaaaauauuaauaggugucgucauaacauggauaggaaugaacucaagaaguaccucauuaucaguaucccuuguguuaguaggggugguuacgcuuuaccuaggaguuaugguacaagccgauucgggguguguugugaguuggaaaaauaaagagcuuaaauguggaucgggcauauuuauuaccgacaauguacauacuuggacugaacaguacaaauuccaaccagagaguccuaguaaauuagccucugcaauccaaaaagcacacgaagagggcaucugugggauaagaaguguaacacgacuggaaaauuuaauguggaaacaaauaaccccugagcuaaaucauaucuuauccgaaaaugaagucaaacuuacuauuaugacgggugacauuaaaggcaucaugcaagcaggaaaacgaucgcuccggccccaaccaacagaacuuaaauauucuuggaaaaccuggggcaaagcgaaaauguuauccaccgagcuucauaaccauaccuuccuaaucgacgguccagaaacugcagaguguccaaacgcuaaucgcgcuuggaacucauuagaaguugaagauuaugguuucggagucuuuacgacaaacauauggcuaaaacuaaaagaaagacaagacgcauuuugugacagcaaacuuaugagcgcugcgauaaaggauaaucgcgcaguacacgcugauaugggauauuggauagagucggcacugaacgauacguggaaaauagagaaagcaucauuuaucgaaguaaaguccugccacuggccuaaaucgcacaccuuauggagcaacggaguauuagagucggaaaugauaauacccaaaaauuucgcugguccggucucccagcauaauuauagaccaggcuaucacacgcaaacagcagggcccuggcaucuuggcagacuagaaauggauuucgauuucugugaaggcacaacaguaguaguaacagaagauugugguaaucgugggccaaguuuacgaacaacaaccgcaaguggaaaguuaaucacugaaugguguuguagaucuugcacucugccuccccuccgauacagaggagaagaugggugcugguacggaauggaaauucgaccccuuaaagagaaagaagaaaauuuaguaaauagucuggucacugccgggcacggucagauugacaauuucucguuagguguacuuggcauggcacuauuccuugaagaaaugcugcgaacucguguagggacaaaacacgccauacuauuaguugcgguuucauucgugacucuuauaacgggaaauaugucauuuagggacuuagguagagucaugguuauggugggagcuacgaugacugacgacauugguauggggguaacauaucuggcucuccucgcagcauuuaaaguucgaccuacauuugcugcuggacuguugcucagaaaguuaaccucaaaagagcuuaugaugaccacaauaggaauaacacuauuaucucaaucuacaauaccugaaacaauacuugaacucacggaugccuuagcucuuggaaugaugguauuaaaaauaguacgaaacauggaaaaguaucagcucgccguaaccaucauggccauauuauguguuccuaacgcugucauacuucaaaaugcauggaagguuucuuguacuacgcucgccguagucaguguaucaccauuauugcuaacaucaucacaacagaaagccgauuggauuccauuggcguugacaauuaagggauuaaacccuaccgccauauucuuaacaaccuuaucacgaacaaguaaaaagcgcucuuggccgcuuaacgaagccaucauggcaguggguaugguuagcauacuggcaagcagcuuacugaaaaacgacauuccaaugacuggcccauuaguggcuggaggauuauugacuguaugcuauguacugacugguagaucugcugaccuagaauuagaacgagcagccgacguccgcugggaagaacaagcagaaauuuccgguaguaguccaaucuuaagcauaacuaucagcgaggacgguucaauguccauuaaaaaugaagaagaagaacaaacucuuacuauacuuauaagaaccggcuugcugguaaucuccggauuauucccaguaucaauaccaauaacugcagcggcaugguacuugugggaaguuaagaaacaacgugcagggguauuaugggacguaccauccccuccuccuguagagaaagccgaacucgaggacggagcuuacaggauuaaacaaaaaggaauacuaggauacagucaaauaggggcuggcguauacaaagaagggacauuccauacgauguggcauguaacucgaggugccguauugaugcacaaaggaaagcgcauagagccgucaugggcagacgucaaaaaggauuuaauaaguuauggagguggauggaagcuagaaggagaauggaaagagggagaagaaguccaaguacuagcacuggagccugggaagaauccacgagccguccagacaaaaccaggccuuuucaaaacaucgacggguacgauuggagccguuagucuagacuucucaccgggcaccucuggcaguccgaucguagauaagaaaggcaagguggucggucuauauggaaacggaguaguuacacguaguggaacuuacguaucagcaauagcucagacagaaaagucaaucgaggacaaccccgaaauagaggacgacauuuuuaggaagaaacgacucacaauaauggacuuacaucccggugcaggcaaaacuaaaagauauuuacccgcgauaguacgggaggcaaucaaacguggacuuaggacacuuauauuggcuccaacgaggguaguggcagcagaaauggaggaggcacugagaggucuaccaauacgcuaucaaacgccagcuauuagagcagaacacacaggacgcgaaaucguagaucuaaugugucacgccacauuuacgaugcgccuucuaucaccgauaagagugccuaacuauaacuuaauaaucauggaugaagcgcauuuuacagacccggcguccauugcagcacguggguauauauccacgagaguagaaauggguaaagcugccgguauuuucaugaccgcaacuccaccagggucaagagauccauucccucagaguaaugccccuauuauggacgaagaaagggaaauuccagagagaucauggaacucaggacaugaguggguuacagauuucaaaggaaaaacuguaugguuugugccuuccauaaaggcgggaaaugacauugcagcgugucugaggaaaaauggcaagaaaguuauacaauuaagucgaaaaacauuugauuuugaauauaucaaaacacgaaccaaugauugggauuuuguggugacaacagauauaagcgaaaugggagcuaacuuuaaagcugaaagagucauagacccucggcguuguaugaaacccguaauuuugacggauggugaagagagaguuaucuuagcaggaccaaugccgguaacgcauuccucugcagcacagcgcagaggucggguuggccggaacccuaaaaaugaaaacgaucaauauauauauaugggcgaaccucucgaaaaugaugaggauugugcucauuggaaagaagcgaaaauguuacuugauaacaucaacacaccggaaggaaucauaccaucuauguuugaaccagagagagaaaaaguugaugcaauugauggugaauauagguuacgaggagaagcaagaaaaacuuuuguugauuuaaugagaagaggagaucuucccguaugguuagccuacaggguagccgcggaggguauuaacuaugcagaccgaagguggugcuucgacggagucaaaaauaaucagauucucgaagagaacgucgagguugaaaucuggacgaaagaaggagaacggaaaaagcuaaaaccuagaugguuggaugcgaggauauauagcgacccccuagcguuaaaggaguuuaaagaguuugcagcuggucguaagaguuuaacccucaaccuuauaacagaaaugggucgccuaccgaccuuuaugacucagaaagcaaggaacgcgcuggauaaccuugccguuuuacacacagccgaagccggcggaagggcuuacaaucaugcccuaagugaacuacccgaaaccuuagaaacccuacuucugcuaacacuauuagccacagugacuggagguauauuucuguucuuaaugucaggaaagggaauuggaaagaugacgcugggaauguguugcauaauuacagcaagcauccugcuuugguaugcacaaauucaaccacauuggauagcugcuaguaucauauuagaguucuuucuaauuguccucuugaucccggaaccggaaaaacaaagaacaccccaggauaaccagcuuaccuacguaguaauugcaauuuuaacaguuguugcugcgaccauggccaacgagaugggcuuuuuagagaaaacaaagaaggauuuuggauugggaaguauaaccacccaacaaccagaaaguaacauacuagacauagacuuaagaccagcaagcgccuggacucuauaugccguagcaacuaccuucauuacaccgaugcuaagacauucuauugagaacucaucuguaaacguuagucugaccgcaauagcuaaucaagccaccguauuaauggggcucggaaaagguuggccuuuaagcaagauggauauuggcgugccucuauuagcaaucgguuguuacagucaaguuaacccaauaacucuaacugcugcgcuacuacuacucguugcacacuaugccauaauaggaccaggucuacaagccaaagcaacuagggaagcucaaaaacgagcugcugcaggcauaaugaaaaacccgacaguagauggcauaacagugauagauuuggaccccaucccauaugacccaaaauuugaaaaacaacuaggucagguaaugcuacuuguucuguguguaacacaaguccucaugaugagaacgacaugggcccugugugaagcccuaacgcucgccacuggaccuauaaguaccuugugggaagguaauccagggcgauucuggaauacgacaauagcagugucgauggcuaauauauucagggggucauauuuagcaggagcagguuuacuuuucucaauuaugaaaaauacggcaaacacuagaagaggaacagggaauacaggagagaccuugggagaaaaguggaaaaacagauugaacgcccuagguaaauccgaauuucagauauauaagaaaaguggaauccaggaaguggauagaacauuagccaaggaggguaucaaacgaggagagacggaccaucaugcaguaucacgggguucugcaaaauuaaggugguucguagagcgaaaccucguuacaccggagggaaagguuguagaccuaggauguggaagagguggauggucuuacuauuguggcggacugaaaaacgugaaagagguaaagggacugacaaaaggugguccaggacaugaagaaccaauuccuaugaguaccuauggguggaaccuaguuagguuacaaucagggguggacguauucuuuacaccaccagaaaaaugugauacucuauuaugugauauaggagaaucgagucccaauccaacaguagaggcggggagaacauuaagaguucugaaucuuguggaaaauuggcucaacaacaauacacaauuuugcauaaaggugcuaaacccauacaugccaaguguaauagagaaaauggaagcguuacaaagaaaauauggcggggccuuaguaaggaauccacuaucuaggaacagcacccaugagauguauuggguaaguaacgccucaggcaauauagugaguuccguaaacaugaucucaagaaugcuuaucaauagauuuacaaugaggcacaagaaagcuacauaugaaccagaugucgaccucgguuccggaaccagaaauauagguauugaaagcgaaacuccaaaucuugacauuauaggaaaaagaauagagaaaauuaaacaggaacacgaaacaagcuggcauuacgaccaagaccauccguauaaaacaugggcguaccauggcucguaugaaacaaaacaaacagggucagcaucaucgaugguaaacggagucgugagacuucuaacaaaaccaugggaugucauaccuaugguaacacaaauggcgaugacugacacaacccccuucgggcaacaacgaguauuuaaagagaaaguagauacuagaacgcaggaacccaaagagggcacaaagaaauugaugaaaaucaccgcagaauggcuauggaaagaauugggaaagaagaaaacaccaaggauguguacaagagaggaauuuacccggaaagugagaagcaacgcagcucucggagccauauuuaccgaugaaaauaaauggaaaucugcucgggaagcgguagaagauaguggauucugggagcuaguagacaaagaacguaaucuucaccuggaaggaaaaugcgaaaccuguguauauaacaugauggggaaaagagagaagaaauuaggagaauuuggaaaagcaaaagguucgagagccauuugguauaugugguugggagccagauuuuuagaguuugaggcauuaggauuuuuaaaugaagaccauugguuuucucgagaaaauagucucaguggaguagagggagagggacuccauaaauugggauacauacucagagaugucucuaagaaagaagggggugccauguacgcagacgauacagcugggugggauacgcgaaucacacuagaagaccugaaaaaugaggaaauggucacuaaccauauggaaggugaacauaagaaacucgcugaagcuauuuuuaaauuaacauaccaaaauaaaguagugagaguucagcgaccaacuccaagaggaacgguaauggauauaaucucucgaagggaccagaggggcuccgggcagguaguaacguacgguuuaaacacauuuacaaacauggaagcucagcuaaucaggcaaauggaaggggaaggaguauuuaaaagcauacaacaacuaacaguuacggaagagaucgcggucaaaaauuggcuagugacagucggccgcgaaagacucucuagaauggcaaucagcggugacgauugcguagugaaaccauuagacgauagauuugcaucagcucuaacagcccucaaugauaugggaaaaguaagaaaggauauucaacagugggaaccaucucgcggauggaacgacuggacacaaguaccauuuuguagccaucacuuucaugaacucauaaugaaagauggaaggguccucgucguaccuugcagaaaccaagacgagcuuauugggagagcacggaucucacaaggugcaggauggucgcuacgcgaaacagccugucugggaaaaucuuacgcacaaauguggucccuuauguauuuccauagacgcgaccuccggcuugcagccaacgcgauuugcucugcaguaccgucacauuggguacccacaucaagaaccacuuggagcauucaugcaacucaugaauggaugacuacagaagacauguuaacagucuggaaucgaguauggauccaagagaaucccuggauggaagauaaaacccccgugggaucuugggaagaaauuccauaucuaggaaagagggaggaccaguggugugggagccuaauuggauuaacgucccgagcuacuugggccaaaaacauacaaacugcuaucaaucaaguuaggucacuaaucgguaaugaagaauacacugauuacaugccuuccaugaaaagauuuagaagagaagaggaagaagccggcguauuaugguaa

SEQ ID NO: 22854 - RNA, 9876 nt, Artificial Sequence
  derived and/or modified CDS sequence (opt6) from DENV-2__KC762674__SS-prME
acugcggggauuauaauaaugaugaucccaaccguaauggcguuucauuuaaccacucgaaauggagaaccgcauaugaucgugagccgucaggaaaaagguaaaucacuacuauucaaaaccgaaaacggagugaacauguguacuuugauggcaauggauuuaggggaacugugugaagauacaauaacauauaacugucccuuacuucgacaaaaugagccggaagacauagacugcugguguaacuccacgaguacuuggguuacauaugggacauguacagcuacaggggagcacaggagagaaaaacgaaguguagccuuagugccccauguuggcaugggccuugaaacucggacagaaacuuggaugucgucugaaggugcauggaaacaugcacaacgcauugaaacauggguguuaagacaccccggguuuacaaucauggcggcaauucuugcauacacaauagggaccacacacuuucaacgaguucugauuuuuauauugcugacggcaguagcaccaucuaugacgaugcgauguauaggcauaucaaauagagauuucguagaagguguauccggagguaguuggguugauaucguacuagaacauggcaguugugugacaacaauggcuaaaaauaaaccgacacuugauuucgaacuuauaaaaacagaggcaaaacauccggcaaccuuaagaaaauauugcauugaggcaaaacuuaccaacacaacaaccgcaucuagauguccuacacagggagagccuucucugaaugaagaacaggacaaaagguucguaugcaaacacaguaugguagauaggggaugggggaauggauguggacuauuuggaaaagggggcaucguaacgugcgcaauguucacaugcaagaaaaauauggaagggaaaauaguacaaccugagaaccuagaauauaccaucguaauuacaccacacaguggagaggaaaaugcggugggcaacgauacaggcaaacacgggaaagagauaaaagugaccccacaaucaaguauaacggaagcagaguuaacgggauauggaacggugacgauggaauguaguccaagaaccggguuggacuuuaaugagaugguacuauuacaaauggaaaauaaagccuggcuaguacaccgacagugguuuuuagaucuaccauuaccguggcuaccaggggcugacacucagggaagcaacuggauacaaaaagaaacauuaguaacguucaagaauccccaugccaagaaacaagauguuguuguucuugguucacaagaaggcgcgaugcauacugcauugacuggggcuacugaaauucaaaugucaucgggaaauuuauuauuuacuggccaccugaaaugucgucuaagaauggacaaacugcagcuaaaaggaaugaguuacuccaugugcacaggcaaguuuaagguggugaaagaaaucgcagaaacacaacaugggaccauuguuauacggguccaauaugaaggagacgguuccccuuguaagauaccauuugagaucauggauuuggaaaaacgacacguacuugguagacucauaacgguaaauccuauuguuacagaaaaagauaguccaguaaauauagaagcagaaccacccuuuggcgacaguuauauaauuaucggaguagagccugggcaauugaaauuaucuugguucaaaaagggaucuucaaucggacagauguuugaaacaacaaugaggggagcuaagagaauggcuauauuaggcgacacugcaugggauuuugguagccuaggcggggucuuuacaaguauagguaaggccuuacaucagguauucggagccauauauggugccgcuuuuucgggaguaagcuggacaaugaagauucuaauaggaguggucauaaccuggauugguaugaacucaagaucaacaaguuugagugucaguuugguauuaguaggaguuguaacacuauacuuggguguaaugguacaagcggauucuggguguguagucaguuggaagaauaaagaauuaaaguguggaucaggcaucuuuaucacagacaacguacauacuuggacggaacaauacaaauuccaacccgagagcccaucuaaguuagcgucagcaauccaaaaagcccacgaggaaggcauaugcgggauaaggucuguaacacgacuggaaaauuugauguggaaacaaauaacuccagaacuuaaccauauccucuccgagaacgaaguaaaauuaacaauaaugacaggagauauuaaagggauuaugcaggcugguaagaggucucuaaggccucagccaacggaauuaaaauauucuuggaaaaccugggguaaagccaaaaugcuuucaacggaguugcauaaucauacuuuccuaauagacggcccggaaacagcagaguguccaaauacaaaccgcgcauggaacagucuagagguagaagacuaugguuuugguguauuuacaacaaauauauggcucaaauugaaagagagacaggauguauacugugacucaaaauugaugucugcagcaauuaaagacaaccgggcaguacaugcagauauggguuauuggauagaaucugcacuaaaugauacauggaaaauugaaaaagcgagcuuuaucgagguuaaaaguugcuauuggccaaaaagccacaccuuauggagcaauggaguauuggagagcgaaaugauaauucccaaaaauuucgcaggaccaguuucccagcauaacuacagacccgguuaccacacacaaacagcagguccauggcaucuggggcguuuagaaauggauuuugauuucugcgaaggcacaacagugguaguuacugaagacugugggaacagaggaccauccuuacgaacaaccacagcaucuggaaaauuaauuacagaaugguguugcagaucauguacucuuccaccucuacgcuacaggggugaagauggaugcugguacggcauggagauucguccccuaaaagaaaaagaagaaaaccugguaaauucucuaguaaccgcaggucacggacaaauugauaauuucucauuaggcguacuaggcauggcacuauuuuuagaagaaauguuaagaacccguguuggcacuaaacaugcaauacuguuggucgcagucucauucgugacauuaauuacggguaauaugaguuuuagagaucuaggacgaguuaugguuaugguaggggcuacaaugacugacgauaucgguaugggcguaacguaccuugcauuguuagcagccuucaaagugcggccuacauucgcagcuggucuuuugcugcguaaauuaacuucaaaggaauuaaugaugacaacaauagguaucguccuacuuagccaaaguacgauaccagaaacuauucucgaacucacagaugcacucgcccugggaaugauggcgcuuaaaaucguucguaacauggaaaaguaucagcuugcaguaacaauaauggcaauauuguguguaccuaaugcaguaauuuuacagaacgcuuggaaaguaucuugcaccacacuggcaguggucucgguuagcccauuguuacuuacgaguagucaacagaaagccgacuggauaccacucgccuugacuauuaaaggcuuaaauccaacagcaauauuucugacuacauuaucuaggacaaguaaaaagagaucguggccauugaaugaagcaauuauggcuguagguaugguaagcauacuugcaagcagcuugcucaaaaaugauauuccaaugacaggaccacuuguggcaggcggccuacuuacaguauguuauguauugacagguagaucagccgauuuggaauuagaacgugcagcugauguucgaugggaggaacaagcugaaauaucggggucguccccgauacuuucaauaacuauuucugaagacggaucuaugucuauuaaaaaugaagaagaagaacaaacccugaccauauuaauacgcacaggccuucuaguaauaucaggcuuguuuccaguaucgauaccaauuaccgcugcugcaugguacuuaugggaagucaagaaacagcgagcagggguucucugggauguuccaaguccuccaccaguaggcaaggccgaguuagaggauggggcguacagaauaaaacaaaagggaauacucggauacucgcaaauaggagccggaguauacaaagagggaacuuuccauaccauguggcauguaacucguggugcaguucuaaugcauaagggaaaacgcauugagccgaguugggcagaugucaagaaagaccuaauuucguauggaggagguuggaaauuagaaggagaauggaaagaaggagaagaaguacaggugcucgcauuagaaccagguaaaaacccacgugcaguucagacaaaacccggccuauucaaaacuaauacaggaacuaucggcgcuguuucacuggauuuuucccccgguacaucagguucgcccauuguagauaaaaagggaaaagucgucggucuauaugguaauggaguugugacacgauccgguacauauguaucagcaauagcacagacagagaaaagcauugaagauaaccccgaaauagaagaugauauuuuucgcaagaaacgguuaacgauaauggaucuccauccaggugcaggaaaaacuaagcgguauuugccugcaauugugcgagaagcuauaaaacgaggauuaagaacguuaauucuugcuccuacgagaguuguggcagcagaaauggaagaagcauuacgagguuuaccuauucgcuaucagacuccugcuauccgagccgagcauaccgggcgggaaauuguugauuugaugugccaugcaacuuucaccaugcgccuauuaagucccauuagaguuccuaauuauaaccuaauaauuauggaugaagcccacuucacagacccggcguccauugcugcgagaggauauaucaguacgagagucgagaugggcgaagcagcagguauauuuaugaccgcgacuccaccuggaagccgagacccuuuuccacaaucaaacgccccgauaauggacgaagaaagggaaaucccagaacggagcuggaacucaggucacgaguggguuacugacuucaaaggaaaaacagucugguuuguuccaucuauaaaagcggguaaugauauugccgcaugucuucgcaaaaauggaaagaaaguaauucaguugucuaggaaaacuuucgauuuugaguauauuaaaacccgcacaaaugacugggauuuugucguaacaacagauauuucagagaugggggcaaauuucaaagcugaaagaguaauagauccgagaaggugcaugaaaccaguaauauuaacugauggggaagagagagucauauuagcuggaccuaugccaguaacacacucgagcgcggcucaacgucgcggacguguuggcaggaauccuaaaaacgaaaaugaccaguauauauacaugggggaaccacuugaaaacgacgaagauugugcacauuggaaagaagccaaaaugcuauuagauaauauuaauaccccagaaggaauaauuccaucaauguuugaaccagaaagagaaaagguggacgcaauugauggagaauaucgauuaagaggagaagcaagaaaaacguuuguagauuuaaugagacgaggcgaucuaccaguauggcucgcuuacagaguugcagcagaagguauuaacuacgcagacagacgaugguguuuugacggcguuaaaaacaaucagauauuagaggaaaauguagaaguagaaauuuggacaaaagaaggcgaacguaaaaagcucaaaccacguuggcuugaugcaagaaucuauagcgacccuuuagcguugaaggaauuuaaagaguucgcagcagguagaaagucauugacuuugaaucugaucaccgaaauggguaggcuucccacguuuaugacgcaaaaagcuagaaacgcacuugauaaucuugcaguuuuacauacagcagaggcuggaggacgggccuacaaucacgcuuugagcgaacugccggaaacccuugaaacacuucuuuuacuaacacuacuugccacaguaacaggaggaauuuucuuauuucuuaugucuggaaaggggaucggaaaaaugacauuaggaaugugcugcauaauaacugcuucuauacuucuuugguacgcucagauucagccacauuggaucgcagcauccauuauuuuagaauuuuuccuaauaguacuacuaauaccugaacccgaaaagcaaaggacgccacaggauaaucaacuuacuuauguuguaauagcgaucuuaacgguagucgcugcgaccauggccaaugaaaugggcuuuuuagagaaaacuaagaaagauuucggacucgggucuauuacaacucaacaaccugaaucaaauauuuuagauauagaucuuaggccggcaucugcuuggacacucuaugcugucgcgacaacuuuuauaacaccgaugcuuaggcauuccauagaaaauuccuccguaaacguaucauuaacagcaauugcaaaucaagcaacaguacucaugggucugggaaagggauggccauuaucaaaaauggauauuggcguuccguuauuagccauaggcugcuacucacagguuaauccaauaaccuuaacugccgcccuucuacucuuaguugcacacuacgcgauaauaggaccaggacuacaagcgaaggcaaccagagaagcucaaaagagagcagcagcagguauuaugaagaacccaacagucgaugguauaacgguaauugaccuagaucccaucccauaugauccaaaauucgagaagcaacuuggucaagucauguuguuaguuuuguguguaacccaggugcuuaugaugagaacaacgugggcccuaugugaggcguugacauuggccacggguccuaucagcacucuaugggaagguaauccaggacgauucuggaauacaacgauagcagucaguauggcgaauauauuuaggggaucauaccuugccggcgcagguuuacuguuuucaauuaugaaaaacacagcgaauacccgcagagguacugguaauaccggggagacccuaggcgaaaaauggaagaaucgucuuaaugcguuaggcaaaucugaauuucaaauuuacaagaaauccggcauacaggaggucgauagaacucucgccaaggagggaaucaaaagaggagaaacagaucaucacgcuguaucaagaggaagugcuaaacuuagaugguuuguagaaaggaaucuugucacacccgaagggaagguuguugauuuagggugcgggagaggcgguuggagcuacuauugcgguggauuaaagaacgucaaagaaguuaaaggucugaccaaaggaggcccgggacaugaagaaccuaucccuaugagcaccuacgguuggaaucuuguaagauugcaaaguggaguagacguauuuuucacaccaccagagaaaugugauacguuacucugugauauaggagaaaguagcccgaacccuacgguagaagcaggaaggacccuacgaguacucaauuuagucgaaaauuggcucaauaauaauacccaauuuugcauaaaaguccuaaacccuuacaugcccucaguaauagagaaaauggaagcacuccagagaaaauacgguggcgcuuugguaaggaauccuuuaucacgaaauucaacacaugaaauguauuggguaucaaaugcgucagguaauaucguuucaaguguaaauaugaucaguagaauguugaucaauagguuuacaaugagacauaagaaagcaacauacgaaccggacguugaucuggggagcggaacuagaaacauaggcauugaauccgaaauuccaaacuuagauauaauuggcaaacggauagagaaaauuaaacaagaacaugaaacgaguuggcacuaugaccaagaccacccauauaaaacuugggccuaucauggaaguuaugagacaaagcaaaccgggucugcaagcaguaugguaaacggcguuguuagacuacuaacuaagccgugggauguuauuccaaugguaacucaaauggccaugaccgauacuacaccuuuuggacaacagcgugucuucaaggaaaaaguugauacaagaacgcaagaaccuaaagaaggaaccaaaaagcuaaugaaaauuacagcagaguggcuguggaaagagcuggggaaaaagaagacaccuagaaugugcacuagggaagaguucacgagaaaaguucguucaaacgcagcgcugggagcgaucuuuacagaugagaacaaauggaaaucugcacgagaagccguagaggauagcggguuuugggaauuaguagauaaagaaaggaaccuccaucuugaaggaaagugugaaacuuguguauauaauaugauggguaagagagagaagaaacuaggagaguuugggaaagccaagggaagcagggcgauuugguauauguggcuuggagcccgauuccucgaguuugaagcacuggguuuucuuaacgaagaucauugguucucgcgugaaaauucuuuaagugggguagaaggggagggguugcacaaacuaggauacauauuacgagacguaucaaagaaagaggguggcgcuauguaugcagacgauacagcugggugggauacaaggauaacccuagaagacuugaaaaaugaagaaaugguaacuaaucacauggaaggcgaacacaagaaauuggcugaagcaauauuuaaacuuaccuaccagaauaaaguaguacgcguacagaggccgacuccgcgaggaacagugauggacauaauuucuagaagagaucaacgagguucaggacaagucguuaccuaugguuugaacacuuuuacaaauauggaagcacaguuaaucagacaaauggaaggggaagggguuuuuaaaucgauccaacaauuaacggugaccgaagagauagcaguuaaaaauugguugguaagggucggaagagaacgucuuucgcggauggcaauuuccggcgacgauuguguaguuaaaccauuagaugauagauucgcauccgcauugacagcucuaaacgauauggggaaaguaagaaaagauauacagcagugggaacccaguagaggauggaaugauuggacccaagugccauuuugcucacaccacuuucaugaguugauaaugaaagacggaaggguauuagugguaccuuguaggaaucaagacgaauuaauaggucgagcuaggauuucacaaggugcgggguggucuuuaagagaaacggccuguuuaggaaaaagcuaugcucaaauguggucgcugauguauuuucacagaagggaccuacgacuagcggcaaacgcuaucuguucagcaguccccucccauuggguaccgacuucgaggacgacguggaguauacaugcaacacacgaauggaugacuacagaggacaugcucaccguauggaaccguguauggauucaagaaaaccccuggauggaagacaagacuccgguagaaagcugggaagaaauacccuaccuagguaaacgagaagaucaaugguguggaaguuuaauaggacucacaucaagggcaacaugggcuaagaacauucaaaccgcaauuaaccaaguaagaucauuaauuggaaacgaggaauauacggauuauaugccuuccaugaaacgauuucgucgagaagaagaagaggcgggcguauuaugguag

SEQ ID NO: 22855 - RNA, 9876 nt, Artificial Sequence
  derived and/or modified CDS sequence (opt6) from DENV-2__KC762672__SS-prME
acugcagggauuauuauaaugaugauccccacugugauggcauuucauuuaacuacccggaacggggaaccgcauaugauuguaagucgccaggaaaaaggaaaaagucuacuauuuaaaaccgaaaacggcgugaacauguguacccuaauggcuauggaccuuggcgaacuaugugaagacacuauuacauacaacugcccuuuauuaaggcaaaaugaaccagaagacaucgauugcuggugcaacuccacaucaaccuggguaacuuacggaaccuguacggcaacgggagaacaccgaagagaaaaacguagcguugcauuaguaccacauguuggcaugggauuagaaacuagaacagaaacguggaugagcagcgaaggugcauggaaacaugcucagagaauagaaacauggguauuaagacauccgggguucacaaucauggcggcaauccuggcguacacaauaggaacaacauacuuccagagaguauuaauuuuuauacugcuaacugcaguagcuccuucgaugacaaugagauguauagguauuucaaaucgcgauuucguagaagggguaucaggagguaguuggguugauauaguacuagaacacggaagcugcguaacgaccauggccaaaaacaaacccacacuugauuuugaacuuaucaaaacagaagcaaaacaucccgcaacuuuacgaaaauacuguauagaagcaaaacucacaaacacuacaacggcuagucgaugcccaacucaaggggagccuagucuuaaugaagaacaagauaaaagauuuguuuguaaacauucaaugguagaccgaggauggggaaacgguuguggcuuauucggaaaaggggguauaguaacaugugccauguucacuuguaagaaaaauauggaggguaaaauaguacaaccagaaaaucuugaauacacaauaguaauaacaccccauucaggagaagaaaaugcuguagggaaugacacugggaagcacggaaaagaaauaaaaguaaccccacaaagcucuaucacagaagcggaacuuaccggauauggcacaguaacaauggaauguagucccagaacagguuuagacuuuaaugaaaugguauuauuacaaauggaaaauaaggcaugguugguacacagacaaugguuccucgaccuaccuuuaccauggcugccaggcgcugauacccaaggcucuaacuggauacaaaaagaaacguuaguuacguucaaaaacccccaugccaaaaagcaggauguaguaguauuaggaagccaggaaggagcaaugcacaccgcuuugacuggagcaacagagauccagaugucaucaggcaacuuauuauucacaggacauuugaaaugccgacuacgaauggacaaauuacaguuaaaagggauguccuauuccaugugcacgggaaaauucaaagugguuaaagagauugcggaaacgcaacauggaacuauagugauucguguacaguacgagggggauggaucuccgugcaaaaucccuuucgaaauaauggaccucgaaaaacgucauguacuaggacgauugauaacgguaaauccaauagucacagagaaagauucuccgguaaacauugaagcagagccaccauuuggagauucguauauaauaauaggaguggaaccaggccaauuaaaauugagcugguucaagaaagguucauccauaggucaaauguucgaaacaacgaugcgaggagcuaaaagaauggcaauccugggugauacugccugggauuuuggaagccuuggaggaguuuuuacaucaauagggaaagcacugcaucagguuuuuggagcuauuuacggcgccgcuuucagcggcguuagcuggacuaugaaaauucuuauuggaguaguuaucacguggaucggcaugaacucuagguccacuucacuaucggugagccuaguccuaguggggguaguaacacuuuaccuaggugucaugguacaggcugacucuggcugcgucguuucuugggaaaacaaagaauuaaaaugugguagugguaucuuuaucacagacaacguucauaccuggacggaacaauacaaauuucagccagaaucuccaucgaaauuagccucagcuauacaaaaagcacaugaagaggguauaugugguauaagaucaguuacuagguuggaaaaucucauguggaagcaaauuacucccgaguuaaaucauauccuaagugaaaacgaagugaaauuaacaaucaugacaggagauauaaaggggauaaugcaagcagguaaaagaucauuaagaccucaaccaacagaacuaaaguacagcuggaaggcuuggggaaaagcaaaaaugcuuagcacagaacuccacaaucacacuuuucucauugacgggccagaaacggccgagugcccuaacacaaaucgagcauggaacagucuagaaguugaagacuacggauuuggggucuuuacuaccaauauuuggcugaaacuuaaagaaagacaggauguguucugugacucgaaauuaaugagugcggcgauuaaagauaguagggcuguacacgcagauaugggauauuggauugaaucggcucuaaaugacacauggaaaauugaaaaagccucuuuuauagaaguaaaaucaugucauuggccgaaaagucacacuuuauggucaaaugguguacuagaaucagaaaugauuauucccaaaaacuucgcugguccaguaagccaacacaacuaucguccuggcuaucauacucagaccgccggacccuggcaucuaggaagauuagagauggauuuugacuuuugcgaaggaacgaccguuguuguaacagaggauugugguaaucgcggcccuucuuuacgaacaacaacagccucuggaaaacuaauaacggaaugguguugcaggucaugcacuuuaccacccuuacguuauagaggggaagauggcugcugguauggaauggagauaagaccgcuaaaagaaaaagaagaaaacuugguuaauucauugguuacagcuggucacggacaaauugauaacuucucacugggaguauuaggaauggcauuauuucuagaggaaaugcuccggacuagaguugguacuaagcacgcgauauuauugguugcuguuagcuuuguaacgcucauaacaggcaacaugaguuuucgugaccuggggcggguaaugguuauggugggagcuacaaugacagaugauauagggauggguguuacauacuuagcacugcuggcagcguuuaaaguacgaccaacuuuugcagcaggucuacuccucaggaaacuaacgucgaaggagcugaugaugaccacaauaggcauaguuuuacuaagccaggcgacaauaccagaaacuauacuagaguugacggacgcccucgcguuggguaugaugguucuaaaaauuguucgcaacauggaaaaauaucaacuagcuguuacuauuauggcaaucuuauguguaccaaacgcaguuauuuuacagaaugcauggaaaguaucguguacuacacuggcaguagugucaguuucaccacuccuauuaacaaguagccaacagaaagcugacuggauaccacuagcauuaaccauaaagggccuaaacccaaccgcuauauuucuaacaacucuaagccgcacaucaaagaaaagaucauggccacuuaacgaagcuauaauggccguaggaaugguuucaauacuagccuccucacuccucaaaaaugacauaccuaugacagggccacucguagcaggagguuuauugacuguuuguuacguguuaaccggucgaagugcagaucuagaauuagaaagagcagcggacguuagaugggaagaacaagcggaaauaucagguucgucaccaauacuuucaauaacgauaucagaagaugggucaaugaguauuaaaaacgaggaagaggaacaaacacuuacaauauuaauaagaaccggccuacucgucauaucugguuuauuuccaguaaguauaccuauaaccgcggcagcaugguaucuuugggaagucaagaaacaacgugcagggguacuaugggauguuccaucuccucccccagugggcaaggccgaauuggaagacggggcauaucgaauuaaacaaaaagguauuuuagguuacucacaaauaggcgccgguguauauaaagagggaacauuucauaccauguggcauguuacgcggggagcuguucucaugcauaaaggaaaaagaaucgaaccaucaugggcagacguuaagaaagaccuaaucucuuauggugggggauggaaacuagaaggcgaauggaaagaaggcgaagagguccagguauuagcauuggaaccaggcaagaacccuagagcaguccaaacaaagccuggucuauuuaaaacaaacacaggaacaauaggcgccguaagucuggauuuuucaccuggaaccucagggucaccgaucguagauaagaaaggaaaaguaguuggacuuuaugguaacggcguaguaacaaggucaggaacuuacguaucggcuauagcacagaccgaaaagaguauagaagauaauccggaaaucgaggaugacaucuuuaggaaaaagcgacugacaauaauggaucuccaucccggugcggggaagacgaaacgcuauuugccggcgauaguucgagaggcuaucaagaggggacuacgcacucuaauacuagcgccaacacguguagucgcggcugaaauggaagaagccuuaagagggcugccuaucagauaucaaacaccagcuauacgagcggaacacaccggaagagaaauuguagaucuaaugugucaugcuacuuucacgaugcguuugcuaucaccaauuagaguaccaaauuauaacuuaauuaucauggacgaagcccauuucacugacccagcgucaauagcagcccgcggauauauuagcaccagagucgaaaugggugaggcggcgggcauauucaugacagccaccccgccaggaucuagagacccguuuccacagagcaaugcaccuaucauggaugaagaacgagaaaucccggagcggaguuggaacucaggacaugaauggguaacagauuuuaaggguaaaaccguuugguucguuccauccaucaaagcaggaaaugauauugccgcaugucuucguaaaaauggcaagaaaguuauucaguugucaaggaagacuuuugauuuugaauacaucaagacuagaacuaacgacugggauuuuguggugacgacagacauaagcgaaaugggugcuaauuuuaaagcggaaagaguaauagacccccguagauguaugaaaccaguaauucuaaccgacggggaggaaagagugauacuggcaggacccaugccggucacacauuccucugcggcacaaagaagaggccgaguugggagaaaccccaaaaacgagaaugaccaguauaucuauaugggcgaaccguuagaaaaugaugaggauugcgcacauuggaaagaggcuaaaauguuacuugauaauauaaauacgccagaggguauuauaccaaguauguucgaaccggaaagagaaaagguagaugcgauugauggagaauaucgcuugagaggggaagcaagaaagacuuucguggaucucaugagacgaggagauuuacccgucuggcucgcauauagaguagcugcggagggaauaaauuaugcagaucgaagaugguguuuugacggugucaaaaacaaucaaauccuagaagaaaauguggagguugaaaucuggacaaaagagggggagaggaagaaacucaaaccaagguggcuagaugcucgcauuuacucagacccacuagcuuuaaaagaguucaaagaauuugcugcaggcagaaaaaguuuaacguuaaauuuaauaacggaaaugggacgacuaccuacuuuuaugacacaaaaggcacgaaacgcgcuugauaacuuggccguacugcauaccgcagaagcaggggguagggcauacaaccaugcauugagugaacuuccugaaacacuggaaacccuauugcuacuaaccuuauuggcuacuguaacugguggcaucuuuuuguuuuugauguccggaaagggaauaggcaaaaugacucugggcaugugcugcauuauaacugcaagcauccuuuugugguaugcucagauucaaccacauuggaucgcagcaucuauuauauuagaguucuuucugaucguauuauuaaucccagaaccugaaaagcagcgcacgccucaagauaaucaacuuacuuacgucgugauagcuauuuuaacugucguagcggcuacaauggcaaaugaaaugggcuuucucgagaaaaccaagaaagauuuuggcuuagguuccauaaccacucagcaaccagaaucuaauauacuugacaucgaccuacgaccugccagugccuggacucuauaugcuguggccacuaccuuuauuacaccaauguuacgccacagcauagaaaauucaagcgugaacguaucauugacugccauagcaaaucaggcaacuguacuaauggggcuagguaagggauggccguugaguaaaauggacauaggggucccauugcuugcaauaggcuguuacucacaaguuaauccuauaacauuaacagcugcauuauuauuauuaguugcccacuaugcaauaauagggccaggucuacaagcaaaggcgacaagggaagcucaaaaacgcgcagcagcgggaauaaugaaaaaccccacaguagauggaauuacuguuauagaucuugauccaauuccauacgauccuaaauucgagaaacaauuaggacaaguaaugcugcuagucuugugcguaacacaaguacuaaugaugagaacaacaugggccuuaugugaggcucuaacgcuagccacaggaccuauuaguacguuaugggaggguaaccccggcagauucuggaacacuacaauugccguaucaauggcaaacauuuuucguggaucuuauuuggcaggagcaggucuccuauuuaguauaaugaaaaauacagcaaauacacgacgggggacagguaaugcgggggaaacucuuggugaaaaauggaaaaauagacucaaugcucuagguaaauccgaguuccagauuuacaaaaagucuggaauacaggaaguugauagaacgcucgcaaaggaaggcauaaaacgaggagaaacagaccaccaugcaguaagcagagguuccgcuaaguuacgaugguuuguugagagaaauuuggugacaccggaagguaaaguuguagauuuaggcuguggacgcgguggcuggaguuauuacuguggagguuuaaagaacgugaaagaggugaagggauugacgaagggagguccuggucaugaggagccaauuccaaugaguacguauggauggaauuuagugagacuucagagcggcguagacgucuucuuuaccccaccagaaaaaugcgacacucuauugugugacauuggcgagucuaguccaaauccgacagucgaggcgggaagaacacuuaggguacuuaaccucgucgagaauuggcugaacaacaauacacaauuuuguauuaaaguguugaauccauauaugccuucggucauagaaaagauggaagcguugcaacggaaguacggaggcgcucugguaagaaauccccuuucaagaaacaguacccaugaaauguacuggguaaguaaugcgaguggaaauauaguuaguagcguaaacaugauaagcagaauguuaauaaauagauucacaaugagacauaagaaagcuacuuacgaacccgacguagaccugggcucagguacgagaaacauugguauugaaucggaaacaccaaaucuagauauuauuggcaaaagaaucgagaagauaaaacaagaacaugaaacaagcuggcauuaugaccaagaucauccuuauaagaccugggcauaucauggcucuuacgaaaccaaacaaacuggcagugcaaguucuauggucaaugggguaguaagacuacugacgaaaccuugggaugucauaccaaugguaacccaaauggcuaugacggauacuacaccuuuuggucaacagagggucuucaaggaaaaaguagauacuaggacgcaagagccgaaagaagguaccaagaaacuuaugaaaauaacugccgagugguuauggaaagaacuuggcaaaaagaagacaccuaggaugugcaccagagaagaauuugcacguaaagugagaucaaacgcugcgcucggagccauuuucacagaugaaaacaaauggaaaucagcaagagaagccguagaagacaguggauuuugggagcuaguagacaaagaaagaaaucuucaccuagaaggaaaaugcgaaacauguguguauaacaugaugggcaaaagagagaagaaacuuggagaauuuggcaaagcgaaaggaaguagggcuauaugguauauguggcucggugcaagguuuuuagaguucgaggcuuuaggauuuuugaaugaggaccacugguuuucucgagaaaacagcuugaguggaguugaaggugaagggcuacacaaauugggauauauuuugcgggacgucaguaugaaggaaggaggcgcuauguaugcggacgauacagccggaugggauacacguauuacauuggaagaucucaaaaaugaggaaaugguaacuaaccacauggaaggggaacauaagaagcuagccgaagcuauauuuaaauugacguaucagaacaaaguggugagaguacaacgaccgacaccacgcgggacaguuauggauaucaucagucgucgagaccagcgaggcucuggucaagucguaaccuacgguuuaaauacauuuacuaauauggaggcacaacuaauccgacaaauggaaggcgaagguguuuuuaagucaauacagcaacuaacaguuaccgaagaaauugcagucaaaaacugguuagugcgaguaggcagagaacgucuuagccgcauggcaaucuccggcgaugauugcgucgucaaaccgcuugaugacagguucgcauccgcucuuacagcguuaaacgauaugggcaaaguacguaaagacauccaacaaugggaaccaaguagggguuggaaugacuggacucaaguccccuuuuguucacaucacuuccaugaacugauuaugaaagacgguagaguacucguaguaccauguagaaaucaagacgaacuuauugguagagccagaauaucgcaaggcgcggguuggagucucagggagacugcgugucugggcaagucauaugcccaaauguggaguuuaauguacuuccaucgcagagacuuacgucuagcagcaaacgcuaucugcagugccguaccgucacacuggguuccaacaucacgaacaaccuggaguauacaugcaacgcaugaauggaugacuaccgaggauaugcuaacuguuuggaaucgaguguggauacaggagaauccuuggauggaagacaaaacgccuguugagaguugggaggaaauuccauauuuggguaaacgagaagaucaguggugcggaucguuaauuggacuuacgucacgcgcaacaugggcgaaaaacauacaaacagcuauaaaccagguuagauccuuaauuggcaacgaagaauacaccgauuauaugcccaguaugaaaagguucagaagagaagaagaagaggcaggcguacuaugguga

SEQ ID NO: 22856 - RNA, 9876 nt, Artificial Sequence
  derived and/or modified CDS sequence (opt6) from DENV-2__KC762667__SS-prME
acggcaggaauaauaauaaugaugauuccuaccguuauggcuuuucacuugacaacacgaaauggagaaccacauaugauaguauccaggcaggaaaaaggaaaaagccuuuuauuuaaaacugaaaauggaguaaauaugugcacauuaauggcaauggaccugggcgaauugugcgaagauaccauaacuuauaacuguccuuuacugaggcagaaugaaccagaagacauugauuguugguguaacucaacaucaacauggguaacuuaugggaccuguacagcuacaggagaacauagaagagagaaaagaagcguagcucuuguaccacacguggguaugggauuggaaacaagaacugaaacauggaugaguagcgaaggugcauggaaacacgcacagcgcauagaaacguggguacuaagacaucccggauucacaauuauggcagccauucuugcauacacaaucgguacuacauacuuccaaaggguauugauauuuauuuuauuaacggcaguaacaccaagcaugacaaugagauguauaggaaucaguaauagggauuucguugaaggagugagugguggcucuuggguugauauaguucuggaacauggaaguugugugacaacuauggccaaaaauaaaccuacauuggauuucgaauuaaucaaaacugaagcuaaacauccagccacccugaggaaauauuguauagaagcaaaauuaacuaauacaacuaccgcuucucguugcccuacccagggugaaccuucucuuaaugaagaacaagacaaaagguuugugugcaaacauucuaugguggaccgaggauggggaaaugguuguggcuuauuuggaaaaggugguauuguuacuugcgcuauguuuacauguaagaaaaauauggaaggaaaaaucguucagccagaaaaccuugaauacacaauuguaaucaccccucauaguggggaagagaaugcaguagggaaugauacgggaaaacauggaaaagagauuaaaguaacaccgcaaucguccauuacagaggcugagcuaacuggauaugggaccgugacuauggaaugcagcccuagaacaggucuugacuuuaaugaaaugguuuuauuacagauggaaaauaaagccugguuagugcaucgacagugguuucuagaucugccucuaccuuggcuaccaggggcugacacucaaggaagcaauuggauacaaaaagaaacacuuguaacauuuaaaaacccacaugcaaagaaacaagauguugugguucuagggagucaagagggcgcaaugcauacggcgcuaacgggcgcgacagagauacaaaugagcucugggaauuuacuuuuuacuggacauuuaaaauguagauuacggauggauaaacuucaauuaaaaggaaugucuuacaguaugugcacagguaaauuuaaaguggugaaagagauugcugagacgcaacaugguacaauuguaauaagaguucaauaugaaggugauggaucaccauguaaaauaccauuugaaauaauggaccuugagaaacgacauguacuagggaggcugaucacgguuaacccaauaguuaccgaaaaagacagccccguuaacauugaggcagaaccgccauucggugauaguuauaucauaauaggaguugaaccuggccaauuaaaacuaaguugguucaagaaaggaagcaguauaggacagauguucgaaaccacuaugagaggggcgaaacgaauggcaauauugggcgauaccgcuugggacuucggcucucuaggaggaguauuuacaaguaucggaaaagcauuacaucagguguuuggggccauuuacggagcggcguuuuccggcguaaguuggacaaugaaaauauuaaucggaguaguaauuacauggaucggcaugaacucgcgaucgacuagccuuucaguaucauuaguguuggugggagucguuacacuuuaccugggaguuaugguacaagccgacucaggaugcguuguuaguuggaaaaacaaagaacucaaaugugguaguggcauuuuuauaacagauaaugugcauacauggacagagcaauacaaauuucaaccggaaucaccgucaaaacucgccagcgcaauacaaaaagcucaugaagaaggaauauguggaauaagaucggucacacgacuugaaaaucuuauguggaaacagaucacacccgaacucaaucauauauuaagugaaaaugaaguaaaacucaccauuaugacuggggacaucaaagggauuaugcaagcaggaaaacggucauuacgaccucaaccuacggagcuaaaauauaguuggaagacgugggguaaagcuaaaaugcuuucuacagaacuucacaaucauacguuccuaauagaugggccagagacugcugaauguccaaacgcaaauagggcauggaacuccuuagaagucgaggauuauggguuugggguauucacaacaaacauauggcuaaaacuaaaagaaagacaagaugcguuuugugacucaaaauuaauguccgcagccauaaaagauaacagagcugugcaugcagauauggguuauuggauugagucugcacuuaaugauacuuggaaaauagaaaaggccuccuuuaucgagguuaaaucaugccacuggccaaaaucacacacauuauggagcaaugguguccuugaaagugaaaugauuauaccuaaaaauuuugcaggucccguaagccaacauaacuauaggccuggcuaucauacccaaacugcuggcccguggcaccuggggcgauuagaaauggacuuugauuuuugugaaggaacuaccguggucguuacugaagauugcggaaauagaggacccagcuuaagaacaaccacggcuucaggcaaacuaauuacugaaugguguugcagaagcuguacacuuccuccucuccgguaucggggagaagauggcugcugguaugguauggagauccguccauugaaagagaaagaagaaaaucugguaaauagcuuaguaacagcgggucacgggcaaauagauaacuucucacuuggaguccuuggcauggcacuauuuuuggaggaaauguugaggacacgcguuggcaccaaacacgccauccuguugguagccgucucauuuguuacuuuaaucacugggaacaugaguuuccgcgacuuaggcaggguuaugguaaugguuggagccacaaugacggaugauaucgguauggggguaacuuaccuagcauuguuggcagcauucaaaguucguccaacuuuugcagcuggccucuuacuuagaaaauugacauccaaagagcucaugaugacuacuauuggaguuacguuacugagucagucuacaauaccugagaccauauuagagcuaacugaugcccuagcgcugggaaugaugguucuaaaaaucgucagaaacauggaaaaauaucaacucgcagugaccaucauggcgauccucuguguuccaaacgcaguuauauuacaaaaugcauggaaaguaaguugcacuacacuugcaguaguaaguguaaguccguuauuacuuaccucuucgcaacagaaagcugacuggauaccccuggcguuaaccauaaaaggguuaaacccgacugcuauauuccucacgacacucagccgcacaagcaagaaacgaaguuggccguugaaugaggcuaucauggcagucggaaugguaucaauauuggcaagcagcuuauuaaagaacgacauaccaaugacagggccucuggucgccggugguuugcuaacaguuugcuauguccuaaccggucguuccgcagaccuggagcuagaacgcgcugcggauguaagaugggaagaacaggcagaaauuucuggcaguucaccaauacuuaguauuacaauaucggaagaugguucuaugaguaucaagaaugaggaggaggaacaaaccuuaacaaucuuaauaagaacuggucugcucguaauauccggccucuuuccggucaguauaccaauaacugcagcagcaugguaucuuugggaagucaagaaacaaagagcaggaguccuaugggacguaccaaguccgccgccgguaggcaaagcggaguuagaagacggggcauaccggaucaaacaaaaggggaucuuaggauacucgcaaauaggagccgguguauauaaagaagggacauuucauacaauguggcacguaacacgaggggcaguauugaugcacaaggguaagcguauagaaccguccugggcagacguuaagaaagauuuaauaagcuacggaggcggauggaaacucgaaggagaguggaaagaaggugaagaagugcaaguacuugcacuagaaccagguaaaaauccucgggcaguacaaacaaaaccaggacuguuuaaaacaucaacugguacaauuggugccguauccuuagauuuuucuccaggaacaucagguagcccgauuguggacaagaaagguaaaguuguuggguuauauggaaacggaguuguaacgagauccggaaccuacgugucggcaaucgcacagacugagaaaaguauagaagacaaccccgagauagaagaugauauuuuccgaaagaagagacuaacgauuauggaucugcauccaggugccgggaagacaaaacgauacuugccagcgaucgucagggaggcuauaaaaagaggucuucgaacacuuaucuuagcgccgacuagaguaguugcagcggaaauggaagaagcacuccgaggauuaccgauaagauaucagacgccugccauaagagcagagcacacuggaagagaaauuguugauuuaaugugucaugccacuuucacaaugagguuauugaguccaauaagaguacccaacuauaaucugaucauaauggacgaagcacauuuuacagacccagcuagcauagcggcucgaggcuauaucucaacaaggguugagaugggggaagcugcuggaauauuuaugaccgccacaccuccuggcaguagagacccuuucccacagucaaaugcaccuauaauggaugaagaacgggagauaccagaaaggucauggaacucuggucaugaauggguaaccgauuucaaaggaaaaacugugugguuuguaccaagcauuaaagccggcaacgauauagccgcauguuuacgcaaaaaugguaaaaaggugauacaacuaaguagaaagacauucgacuucgaauauauaaaaaccaggacaaaugacugggauuuugucguaacuacugacauaucggaaaugggcgcuaauuuuaaagcagagcgcguaauagauccgcgcagaugcaugaaaccagucauuuuaacugacggggaggaaagagucauccuagcugggccgaugccugucacacauucauccgcugcacagcggaggggacgagucggacgaaaucccaaaaaugagaaugaccaauauauauauaugggugaaccacuagaaaaugaugaagauugugcacauuggaaagaagcuaaaauguuauuggauaauauaaauacaccagaaggaauuauuccgagcauguuugagccggaacgugagaaaguagaugcgauagauggagaauauagacuuagaggagaagcuagaaagacuuuuguggaucuaaugagaaggggugauuugccaguuuggcuagcguaucguguggcugcagaagggauuaauuacgcagauagaaggugguguuucgacggaguuaaaaacaaucaaauccuagaggaaaauguugaaguagaaaucuggacgaaggagggagaaagaaagaaauugaaaccuagauggcuugaugcuagaaucuauagugacccccuagcauuaaaagaguucaaagaauuugcagcaggaagaaagucacuaacccucaaucucauuacagagaugggucgauugccaacuuuuaugacacaaaaagcaagaaaugcauuagauaacuuagcaguauuacacacugcagaggcaggggguagagcauauaaccacgcauugucagaauuacccgagacgcuagaaacucuccuuuuacuaacacucuuagccaccguuaccggcggcauauuucuauuccuaaugucugggaaagggauaggaaaaaugacucuagguaugugcugcauuauuacagcaagcauacuguugugguaugcacaaauucaaccacauuggauagcugcuucgauuauccuugaguucuucuuaaucguucuauuaaucccagaacccgaaaaacagcgaacgccacaagauaaccaacuaacauacguaguaauagcaauuuugacuguugucgcagcaacuauggccaaugaaauggguuuucuugagaaaaccaagaaagauuuugguuuggguucuauaacuacccaacaacccgaaucaaacaucuuagauaucgacuuaagaccagcgagugcauggacccuauaugcuguagcgacaacuuucauuacacccaugcucaggcauucgauagaaaauucaucaguaaauguuucuuuaaccgcaauagcuaaccaagcaacgguacugaugggcuuggguaaggguuggccccuaucuaaaauggacauuggaguaccucuacuugcaaucggguguuacucucaagugaauccuauuacucuaacugcggcacuccuacuuuuaguugcacauuaugcuauaauuggaccugguuuacaagcgaaagcaacgcgugaagcacaaaagcgagcagccgccggcauuaugaaaaauccuacaguagauggaauuacggugaucgaucuagacccaauaccauaugauccaaaguucgaaaaacagcuagggcagguaaugcuacugguccuauguguuacacaaguuuugaugaugcguacuacaugggcgcuaugcgaggcacugacccuugcaacuggaccaauuucaacuuuaugggaaggaaauccugguagguucuggaauaccacaauugcagugucuauggcuaauauuuuccguggcagcuaccuagccggcgcgggauuauuauucucuauaaugaagaauacggccaauacgcgucgaggcacggguaacacaggagagacgcuaggagaaaaauggaagaauagacucaaugcacuuggaaaaucugaguuccaaauauacaagaaaagugguauacaagaagucgaucguaccuuagccaaggaagggauuaaaagaggggagacagaccaucaugcgguuucgcguggaucugcuaaguuaagaugguuuguggaaaggaaccuugugaccccagaggguaaaguuguagaucucggauguggacgaggaggguggaguuacuacugcggaggacucaaaaaugucaaagaaguaaagggacuaacaaaaggagguccgggacaugaagaaccaauacccaugucaacuuacggauggaaccuuguuagauuacaaagcgguguugauguauuuuucacacccccagaaaaaugugauacguuguuaugcgacauuggagagucgucuccuaauccaacugucgaggcaggacgaacucuuagaguacuuaacuuaguagagaauuggcucaauaauaauacccaauuuuguauuaaaguacuaaauccuuauaugccuucuguaauugagaaaauggaggcauuacaaagaaaguacggaggagcgcuaguccgaaauccguugucccgaaauaguacacacgagauguacuggguauccaaugcuuccggaaacaucguaucuagcgugaauaugauuucaagaauguuaaucaaucgauucacuaugagacauaaaaaggcuacauaugaaccggacgucgaucuaggaagcggcaccaggaauauugggauugaaagugagaccccaaauuuagauaucauuggaaaaagaaucgagaaaaucaaaagagaacaugagacgagcuggcauuaugaucaagaucacccauacaagacuugggcguaccauggaucguaugaaacgaaacaaacugggagcgcguccucaaugguuaauggugucguucgucuacucacuaaaccuugggaugucauacccaugguuacacagauggcuaugaccgacacaacgccguuuggucaacaaagaguauuuaaagaaaaaguugacacgagaacacaggaaccaaaagaaggaaccaagaaauuaaugaagaucacagcugagugguuauggaaagaauuaggaaagaagaaaacuccccgaauguguacccgagaggaauuuacccgaaaaguacgaucuaaugcagcucuaggagcaauauuuacggaugaaaacaaauggaaaucggcgcgugaagcagucgaagacucaggauuuugggaacugguagacaaagaacgaaaccuacauuuagaaggaaaaugugagacuuguguauauaauaugaugggaaaacgagaaaagaaauuaggggaauuuggcaaagcaaaagguuccagagcaauaugguacaugugguuaggagccagguuucuugaguucgaagcacuagguuuccuaaaugaggaucauugguucagucgugaaaacucacuauccggaguugaaggggaaggauuacauaaacuuggauauauacucagggaugugagcaagaaagaaggcggggccauguaugcagaugacacugcgggaugggauaccaggauaacacuggaagacuugaaaaaugaagaaauggugaccaaccacauggagggggagcacaagaaauuagcagaggcuaucuucaaacugacuuaccagaauaaagugguuagggugcaaagaccuaccccacgugguaccguuauggacauaaucucucggcgagaccagagagguagcggccaggugguaaccuacggacuaaacacauuuacuaauauggaagcacaacugauuagacaaauggaaggugaggguguuuucaaaagcauucaacaucuuacaguuacggaagagaucgccguuaaaaauuggcuuguuagagucggaagggagagauuaucacguauggccauaucuggcgaugauuguguaguuaaaccauuagacgacagauuugcuagcgcacuaacagcguuaaaugauaugggcaaaguuaggaaagauauucaacagugggaaccauccagaggauggaacgauuggacacagguaccauuuuguucacaucacuuucacgaacucauaaugaaagacggccgaguauuaguagugcccugcaggaaccaggaugaacuuauaggacgugcccgaauuucgcaaggagccggcuggucuuuacgcgaaacggcaugucuuggaaaaucuuacgcacaaauguggucccucauguacuuucacagacgggaucuccgccuagcggcaaaugccaucugcucagcggucccaucccauugggucccaacaucacggacuacgugguccauucaugcaacacaugaauggaugacuaccgaagacaugcuuacaguauggaaccgcguuuggauccaggaaaacccguggauggaagacaaaacuccggucgaaagcugggaggagaucccauaccuaggcaaacgugaagaccaauggugcgggagcuuaauaggccuaaccucuagagcaacuugggcaaagaauauacaaacugcuauuaaccagguaagaaguuuaauuggaaaugaagaauacacagacuauaugccuagcaugaagagauuucgucgugaagaagaggaagccggaguauuaugguaa

SEQ ID NO: 22857 - RNA, 9876 nt, Artificial Sequence
  derived and/or modified CDS sequence (opt6) from DENV-2__KC762659__SS-prME
acagcagguauuauaauaaugaugauaccuacaguaauggcauuccaucuuacgacaagaaauggagaaccccauaugauaguuucccgccaagaaaaagguaaaucauuguuauucaaaacagaaaauggaguaaacaugugcaccuuaauggcaauggaucuaggagaauuaugugaagauacaauaacauacaacuguccacuucuaagacagaacgaaccagaagauauagauuguugguguaauucgacuuccacaugggugacauauggaacauguacggcaacaggagaacacagacgugagaaaagaucaguugcacuugugccucauguagggaugggacuagaaacgcgaaccgaaacuuggaugagcucagaaggggcauggaaacacgcucaacguauagaaacguggguauugcgccacccagguuuuaccauaauggcagcaauucuugcguauaccauaggaacaaccuauuuucaacgcguacuaauauuuauauuauuaacagcuguaacuccaaguaugaccaugagaugcauagggaucucaaauagagacuuuguagaaggugucagcgggggaucauggguagauaucguauuagaacacggaucuugugucaccacaauggccaaaaacaaaccgacacuugacuuugaauuaauuaaaacagaagcgaaacauccagcaacacuacgaaaauacuguauugaagcgaaauuaacuaacaccacaacggcgucgcguugcccaacacaaggagaaccaucguuaaaugaagaacaagacaaaagauuuguauguaaacauucgaugguagaucguggaugggggaaugggugcggccuuuuugggaaagguggcauugucacaugcgcuauguuuacauguaagaaaaauauggaaggcaaaguaguucaaccagaaaauuuagaauauacaauugucauaaccccgcacagcggugaggaaaacgcgguaggaaacgauacggguaaacacggcaaagaaauaaaaguaacgccgcaaucauccaucacugaagcagaacuuacaggcuacggaaccgugacaauggaaugcaguccacgaacugguuuggauuucaacgaaaugguauuacuacagauggaaaauaaggcuugguuggugcacagacagugguuuuuagauuugccuuuacccuggcuaccaggugcagacacucaaggcucaaauuggauccaaaaagaaacauuaguaacguuuaaaaacccucaugccaagaaacaagacguugugguacuagggucacaagagggugcuaugcauacagcauuaacaggagcgacugaaauccaaaugucaagcggaaaccugcuguucacugggcauuuaaaauguagauuacggauggauaaacuacaguuaaaaggaaugagcuauucuaugugcaccggcaaauucaaagugguaaaagagauagcagagacgcaacaugggacaauugucauacguguccaauaugaaggugacggaucaccgugcaaaauacccuucgaaauaauggauuuggagaaaaggcauguucugggccgacuuauaacggugaacccaauaguuacagaaaaagacagccccguaaacauagaagcagaaccgccguuuggggacucuuauauaauaauaggaguugagccaggucaguuaaaauuaucaugguuuaagaaaggaucgucgauaggacaaauguucgagacuacaaugaggggcgcaaaacgaauggcgauacuaggagauacagcaugggauuuuggcuccuuggguggcgucuucacuucaaucggcaaagcucuacaccaagucuuuggagcuauuuauggggcagcguucucaggggugucuuggacaaugaaaauacuuauaggaguuguuauuacguggaucgguaugaacagccgaucuacuucguuaucagugagcuugguguuagucggcgucguaacguuauaucugggaguaauggugcaagcagauagcggcugugucguuaguuggaaaaauaaagaacuuaaaugcggaucuggcauuuuuauuacagacaacguacauacguggacagagcaguauaaauuccaaccagaauccccaucgaaacuggcaagugcaauucaaaaagcucacgaagaaggcauauguggaauacguagugucacuagacuagagaaucuuauguggaaacagauuaccccugagcuuaaucacauucuaucugaaaaugaaguaaaauuaacuauaaugaccggcgauaucaaagguauaaugcaagcaggaaaacgaucauuacgaccucaaccaacugaauuaaaauacaguuggaagacuugggguaaggcaaagaugcuaaguacugagcugcacaaucauacauuuuugauagacggaccagaaacggccgaaugcccaaauacuaaccgugcauggaacucacuggaaguagaggauuacggcuucggcguauuuacgacaaauauuugguugaaacuuaaagaaagacaggacguauucugugacucgaaacuaaugucugcagcuaucaaagacaacagagcaguucacgccgacauggguuacuggauggaaagugcgcuaaacgauacauggaagauagaaaaggcuucguuuauagaggucaaaucaugucacuggccuaaaucucacacacuauggaguaauggugugcucgaaagugagaugauuaucccaaagaacuuugcaggacccguuucacaacauaauuacagaccugguuaccacacgcaaacugccggcccuuggcauuuagggcgacucgaaauggacuucgacuuuugcgaagggacaacaguaguaguaaccgaagacugugguaaccgcgggccuucacuccgaaccaccacugcauccgggaaacuuauaacugagugguguuguagaagcuguacucugcccccacuaagauacagaggagaagauggcuguugguacggaauggaaauaagaccguuaaaagaaaaagaagagaaucuuguaaacaguuuaguaacggcuggccauggacagauugauaauuuuucccuagggguccuuggaauggcacuauuccuggaagagaugcuacguacccgcguugguacgaaacaugcaauccucuuaguugcggucagcuucguaacucuuauaacggguaacaugucauuuagagaccuuggucgugucauggucauggucggagcgacuaugacagaugacauugggaugggaguaaccuacuuagcuuuacuggcugcauucaaaguaagaccaacauuugccgcagggcuauuacugcgucgacugacgucuaaggaauuaaugaugacaacaauaggcauaguguuacucucacaauccacuauuccagaaaccauauuagaacuaacagacgcucuagccuuaggaaugaugguacucaaaauuguuaggaaaauggaaaaguaucaacuggccguuacaauuauggcuauauuguguguacccaaugcgguaauacuccaaaaugcguggaaaguaaguuguacaacuuuggcugucguaagcguaaguccccuucuucucacaagcucucaacaaaaagcggacuggauuccacuagcccuuacaauaaaggguuugaauccgaccgcuauauuccucacaacacucagcagaaccucaaagaaacggucauggccacugaacgaagcuauaauggcgguugguaugguuucaaucuuagcuucaucacuuuuaaagaaugacauaccuaugaccggcccucuaguugcuggagguuuacuaacuguuugcuacgugcugacaggaagaucagcggaucuagaauuagaacgagcggcagacguuagaugggaagaacaggcggaaauaucaggcaguagccccauucuuucgaucacaauuagcgaggacgggagcaugucaaucaaaaaugaagaggaagaacaaacauuaacuauuuuaauacggacagggcuucuaguaauuucaggguuauuuccagugucgauaccaaucaccgcugcugccugguaucuaugggaagucaagaaacaaagagcaggagugcuuugggacgugccuaguccacccccaguggguaaggcugaauuagaagauggggcuuauagaauaaaacaaaaggguauucuagguuauagucagauaggagcgggaguuuauaaagaaggcacauuucacacaauguggcacguaacuagaggcgccguccuaaugcacaagggaaaaagaauagagccuaguugggcagacgucaagaaagaucugauaaguuauggaggaggauggaaauuagaaggagaauggaaagaaggagaagaaguccaaguuuuagcacuggaaccaggcaaaaacccaagggcggugcagacuaaaccuggguuauuuaaaacaaauaccggcacgauuggugcagugucgcuugacuuuuccccugguacgagugguucuccaauugucgacaagaaagguaaagucgucggacuauacgguaauggcguuguaacacgaucuggaacuuacguaucggcuaucgcccagacugagaaaaguaucgaggacaacccagaaaucgaagaugauauauuuaggaagaaacgacuuacuauuauggaucuacaucccggcgcgggcaagacgaaacguuaucuaccugcuauaguucgcgaagcaauaaaacggggguugagaaccuuaauacuggcuccaaccagaguuguagcagccgagauggaagaggcucuccgagguuuaccuauacgguaucaaacgccugcuauccgggcagaacauaccgguagggaaauaguggaucuuaugugccaugcaacauuuacgaugagauuacuaucuccaauuagaguaccuaauuacaacuuaauaaucauggacgaagcccacuucacagacccagcgucaauagcagcaagaggguacauaucaacacgagucgaaaugggagaagccgcugguauauucaugacugcuaccccaccugguucuagagacccauucccccaaaguaaugcaccuauaauggacgaagaaagggagauaccggaaaggucauggaacagcggacaugaaugggucacagauuucaagggcaagacaguaugguuugucccaagcaucaaagcuggcaaugauaucgcugcaugucugaggaagaacggcaagaaagugauucaauuaucucgaaaaacauuugacuucgaauacauuaagacacggacuaacgauugggacuuuguugugacuacugacauaucggaaaugggagcaaacuuuaaagccgaaagaguaauugaccccagacgguguaugaaacccgucauacugacugauggagaagaacgggucauacuugcaggaccuaugccuguaacccacagcucagcagcccagaggagagguagagucggucguaaccccaagaaugaaaaugaucaguacauauauaugggggaaccacuugagaaugaugaagauugugcacauuggaaagaagcgaagauguuacuagacaauauuaacacaccugaaggaauaauaccuuccauguucgaaccugagcgggaaaagguagaugcaauagacggagaguaccguuugcgaggugaagcacgaaaaacauuuguagaucuaaugcgacgaggagaccugcccguguggcucgcauacagaguggccgccgaaggaauaaauuaugcggaccgucguugguguuucgacgguguuaaaaacaaucaaauacuggaagaaaaugucgagguagaaaucuggacuaaagaaggugaaagaaagaaauuaaaaccaaggugguuggacgcaagaauauacucagauccauuagcucuaaaagaauuuaaagaauuugccgcaggucgaaaaucauuaacauuaaacuuaauaacagagaugggcagguuaccaacauuuaugacccaaaaagcgagaaacgcacucgauaaucucgcagugcuccauacggcggaggcugguggcagagcauacaaucaugcccucucggaacuucccgaaaccuuagaaacacuucugcuucugacucuguuagccacagucaccggugguauauuuuuguuucuaaugagugguaaagggauugggaaaaugacccuaggcauguguuguauuauaaccgcaaguauuuuguuaugguacgcccaaauacaaccacacuggauagccgcuucaaucauucuagaguuuuucuuaauuguuuuauuaauaccagaaccugagaagcaacgaacaccacaagauaaucagcucacuuauguaguuauagcaauccucaccguuguggcagcgacaauggcaaacgagaugggauucuuagagaaaacuaagaaagauuuuggacuggguagcauaaccacacagcaaucugaaagcaauauucucgacauagaccuacggcccgcuucggcauggacguuauacgcuguggcuacaacguuuauaaccccaaugcuacgucacucuauagagaacuccucagugaauguaagucuaacggcaaucgcaaaucaagcaacaguuuuaaugggccucgguaaggguuggccacuaucuaaaauggacauagguguaccucuuuuagcaauaggcuguuacagccaggugaacccuauaacccuaacugcggcauuauuacuccuaguagcacacuacgcaauaauugggccagguuuacaagccaaagcaacucgugaagcucagaagagagcggcugcaggaauaaugaaaaaucccacaguagacggaauuaccgucaucgaccuggauccgauaccauaugauccaaaauucgaaaaacaacugggucaaguaaugcuccucguucucugugucacucaaguccuaaugaugcgaacuacaugggcgcuuugcgaagcccuuacucuagcgacgggcccaauaucgacucugugggaagguaauccaggaagauuuuggaauaccacaauagcgguuagcauggcaaauaucuuucgcgguaguuaucuugcgggagcaggauuacuauucaguaucaugaaaaauacagcuaacacacgcagaggaacagguaauacaggggagacuuuaggagagaaguggaaaaaccggcuuaacgcucuaggcaaaucagaauuucaaauauauaagaaaucagggauacaagagguagauaggacauuagcaaaagaagguauaaaaagaggcgaaacagaucaucaugcuguaucucgaggauccgcaaaacuacggugguuuguugaaagaaauuuaguaacaccugaaggaaagguagucgaccuaggaugugggagggguggcuggagcuauuauugcggaggacucaaaaacguaaaagaagucaaaggauuaacaaaaggaggaccgggccaugaagaaccaauacccaugucaacauauggguggaaucuaguucgucuucaaagugguguugaugucuuuuucacgccaccagagaaaugugauacucuacuuugugauauaggugaaagcagcccaaacccuacaguagaggccggaaggacucuaagaguauuaaacuuaguugaaaacugguuaaauaacaauacacaauuuugcauuaagguguugaacccauacaugccaucuguaauugagaaaauggaagcacuccagagaaaguacgguggagcacuggugaggaauccucucuccagaaacaguacacaugaaauguauuggguaaguaaugcgucagguaacauaguuagcaguguuaacaugauuaguaggauguuaauuaauagauucacaaugcgacacaagaaagcuacguaugagccggacguugauuuggguaguggaacgagaaacauagguauugaaagugaaacaccgaaccucgauaucauuggaaaaaggauagagaaaauaaaacaagaacacgaaacaucuuggcauuaugaucaagaucacccauauaaaacgugggcuuaucaugguaguuacgaaacaaaacagacaggcucggcuucaaguaugguuaauggagugguccggcuacucaccaaaccuugggauguaauaccgaugguaacacaaauggcuaugaccgauacaacaccuuucggucaacaaaggguauuuaaagaaaaaguagacaccaggacucaagaacccaaagaaggaaccaagaaauuaaugaaaauaacagcagaauggcuauggaaggagcuagguaagaagaaaacaccaagaauguguacaagagaagaauuuacacggaaaguaagauccaaugcugcgcuaggcgcuauuuuuacagaugaaaacaaauggaaauccgcccgagaagcgguagaagauucagguuuuugggaauuaguggacaaggaacgaaaucuacauuuagaagggaaaugugagacuugcguuuauaauaugauggguaaaagagagaagaaauuaggagaguuugguaaagcaaaagguucucgagcgauuugguacaugugguugggagcacgauuccucgaauuugaagcauuagguuuucuaaacgaagaucauugguucucaagagagaacucauugucagguguugaaggugaaggccuucauaaguuagguuauauacugagggauguaucaaagaaagaagggggagcaauguacgcugacgauaccgccgguugggacaccagaauaacacuagaagaucucaagaacgaagaaauggugacuaaccacauggaaggagaacacaagaaauuagcagaagcuauauucaaauuaacuuaucaaaacaaaguaguaagaguacaacggccaacgccaaggggaacaguaauggauauuauaucaagacgggaccaaaggggaucuggucaaguagucacguacgguuugaauaccuuuacaaauauggaagcacaauugauacgucaaauggaaggagaaggaguauucaaaaguauccaacagcuuacagccaccgaagaaauugcagucaaaaacuggcuaguacguguaggaagagaaagacuuucuaggauggcaauauccggagaugauugcguuguaaaaccacuagaugauagauucgcaagcgcguugacugcacucaacgauauggguaaaguaagaaaagauauccaacaaugggagccuucacgcggcuggaacgacuggacacagguacccuucuguucacaccauuuccaugaacuuaucaugaaggauggaagaguacucguaguuccaugccgaaaucaagacgaacugauagggagagcucguauuucucaaggagccggguggaguuuaagagaaacggcuugucuuggaaagucguacgcccagaugugguccuuaauguauuuccauaggagagacuugagacuggcagcaaaugcaauaugcuccgccguuccaucacauuggguuccuacaagccguacaacguggucaauacacgcaacacaugaguggaugaccacagaggauaugcuuacaguuuggaacaggguauggauacaagagaacccauggauugaggauaaaacuccagucgagaguugggaagaaauuccauaccucggcaaacgugaagaucaauggugcggcagccucauaggccuuacgucuagagcaacuugggccaagaacauucaaaccgcuauaaaccaaguacguucacuuauugguaaugaagaauacaccgauuauaugccaucuaugaaacguuuucgcagagaagaggaagaagccggugugcuuugguga

SEQ ID NO: 22858 - RNA, 9876 nt, Artificial Sequence
  derived and/or modified CDS sequence (opt6) from DENV-2__KC762657__SS-prME
acugcgggaauuauaauuaugaugauaccaaccguaaugguguuucacuuaacuacuagaaauggugaaccgcacaugaucgugagucgucaggaaaaagguaaaucauuacuuuucaaaacugaaaauggaguaaauauguguaccuuaauggcaauggacuuaggagaauuaugugaagauacgauaacuuacaauugcccauuacuucgacaaaacgaaccagaagacauugacuguugguguaacucgacaaguaccuggguuacauauggaacauguacagcgaccggagaacaucguagggagaagcggucaguagcguuagugccccacguuggaaugggauuggaaacacgaacugaaacauggaugaguagugaaggugcuuggaaacacgcacaacggauagaaacauggguuuuaagacauccaggauucacaaucauggcagcaauucuugcauauacaauuggaaccaccuauuuucagagaguccuaauauuuauacuuuuaacggcaguaaccccaagcaugacaaugcgauguauagguauaucaaaucgagauuucguugaagguguaaguggugggaguuggguagacauagucuuagaacacgguucauguguuacgacgauggcgaaaaauaaaccaaccuuagauuucgaacuaauuaaaacagaagccaaacaucccgcaacuuuacgcaaauacuguauugaagccaaauuaacaaauacgacaacagcaucucguuguccaacacagggcgaaccuucccucaaugaagaacaggauaaaagguucguuugcaaacauucaaugguugauagggggugggggaauggauguggccuguuuggaaaaggagggauaguaacaugcgcuauguucacaugcaaaaagaacauggaagguaaaguagugcagcccgaaaaccuggaauauacaauaguuauaacaccucauaguggugaagaaaacgcugugggaaacgauacuggaaaacaugguaaggaaauaaaagucacuccccagucaagcaucacagaagcagaacuuaccggcuauggaacuguaacuauggaauguucaccgagaaccggucucgacuuuaacgaaauggucuuauuacaaauggaaaacaaggccugguuagugcacaggcaaugguuuuuagaccuuccauugccuuggcugcccggugcagauacccaggggucaaauuggauacaaaaagaaacuuuaguaacuuuuaaaaauccucacgccaagaaacaagaugugguggugcuagguucgcaagaaggugcaaugcauacggcauugacgggagccacggaaauacagaugagcucagggaauuuacucuucacgggucaccuaaaaugucgauuaagaauggauaaacuacaauuaaagggcaugucauauucaaugugcacggggaaguucaagguuguaaaggaaauugcagagacacaacacgggacuauaguaauuagaguucaguacgagggggauggaucaccauguaaaauaccuuuugaaauaauggauuuagagaaacgacauguccuuggaagacugaucacaguuaaccccauaguaacugaaaaagacucaccagucaauauagaagcagaaccaccguucggugacaguuauauuauaaucggcguggaaccaggacaguuaaaacuauccugguucaagaaaggcucguccaucggccagauguucgagacaaccaugcgaggugcaaaacggauggcaauauugggagauacggcgugggauuuuggaagucucggagguguuuucacaaguauagggaaagcgcugcaccaaguauucggcgcaauauauggggccgcuuuuucaggaguaucuuggacaaugaaaauacucauuggugugguaaucacuuggauugggaugaacucaaggagcacgaguuuguccgucucuuuagucuuagucggugucguaacacuuuacuuaggggugaugguacaagcggauucaggaugcguaguaucauggaaaaauaaggaauuaaaauguggcuccgguauuuuuauaacugauaacguacauacauggacugaacaauauaaguuccaaccugaaagucccaguaaguuggcaucagccauacaaaaagcccacgaagaaggcauauguggcauucguuccgugaccagauuagaaaaccugauguggaagcagauaacuccagaacuaaaucacauuuuaagugaaaaugaaguaaaacuaacgauaaugacgggcgauauuaaagguauuaugcaagcagguaaacgaucacugcguccucagccaacugaacuuaaauacaguuggaaaaccugggguaaagcuaaaaugcugaguacagagcuccauaaucauaccuuccuuaucgacggaccagaaacagcugaaugcccuaacacuaacagagcuuggaacuccuuagaaguugaagauuacggauuuggcguguucacaacgaacaucuggcugaaauuaaaagaaaggcaagaugucuuuugugauucaaaacugaugucagcagcuauuaaggacaauagagcaguccacgcagacaugggauacuggauggaaagugcgcucaaugauaccuggaaaaucgaaaaagccucuuucauagagguuaaaaguugucauuggcccaaaucacauacccuauggucuaauggaguauuagaguccgagaugauuauucccaaaaauuucgcagggccggugagucaacacaacuaccgcccaggauaucauacgcagacagcaggcccguggcacuuggguagacuugaaauggauuuugauuuuugugaagggacaacaguggucguaaccgaagauugcggcaacaggggccccucauuacggacgacgacugcuucugggaaguuaauaacagaaugguguugucgaucuuguacauuaccuccccuacgauaccgaggugaagauggcuguugguacggaauggaaauuagaccguuaaaggaaaaagaagaaaaccuaguaaauucacucguaacugcaggucacggccaaauugauaauuuuucucuuggaguuuugggaauggccuuauuccucgaggagaugcuaagaacaagaguagguacaaaacaugcaauucuauuaguugcagucucuuuugugacauuaaucacaggaaauaugucuuucagagaccucggacgagucauggucaugguaggcgcgaccaugacugaugacauagguauggggguuaccuauuuagccuuacuugccgcguuuaaaguaaggccuacauuugcagcgggucuguugcuaaggcgacugacaucgaaagaacugaugaugacgacaaucgguaucgucuuacuuucucaaucuaccauacccgaaacaauacuagaacuaacagacgcauuagcucuuggaaugaugguacucaagauaguuaggaaaauggaaaaguaucagcuagccguaacgaucauggccauacucugcguucccaacgccgugauucuucaaaaugcauggaagguaucuugcacuacccuugcuguuguuucuguaagcccauugcuacuuacaagcucucagcaaaaagcagacuggauuccgcuugcauuaacuauaaaagguuuaaauccuacugccauauuccuaacaacucuaaguagaacaaguaagaaaagauccuggcccuugaaugaagcuauaauggcagucgguaugguaucaauucuagcguccucguuguugaaaaacgacaucccaaugacuggcccucugguagcagggggacuacuaacuguuugcuauguacuaacugggaggucagcugauuuggaguuagaaagagcagcggacgugagaugggaggaacaagcagaaauauccggaucaucaccaauacuaagcauuacuaucagugaggacggaucgaugaguaucaaaaaugaggaagaggaacaaacucucaccauucuaauucguacuggacuuuugguaauaucaggucuauuuccaguaucaauaccgauaacugcugcagccugguauuuaugggagguaaagaaacaacgagcggggguauugugggauguuccaucuccgccuccaguaggaaaagcggaauuagaagacggggcauacagaauaaaacaaaaaggaaucuuaggguauucgcaaauaggggcuggaguuuacaaagaaggcacguuccacaccauguggcauguaacaagaggggcgguuuugaugcacaaaggcaaaaggauagaaccgaguugggcggauguaaagaaggaucucauuagcuauggagggggcuggaaacucgaaggagaguggaaagaaggagaagaaguacagguguuggcacuagagccagguaaaaauccacgugcgguucagacaaaaccuggguuguucaaaacgaauacuggaacgauaggcgcagucucauuagacuucucaccaggcaccuccggguccccgauaguagacaagaaggguaaaguggucggacuauacggaaauggcguugugacgagaaguggaacguacguaucggcaauagcucaaacugaaaaaucuauagaagauaauccagaaauugaagaugauauuuuucgaaagaaaagauuaacaauaauggaucuucauccgggugcuggaaaaacuaaacgauacuuaccugcaaucgugagagaagcgaucaaacguggacuacgcacguuaauuuuagccccaacgcgagucguagcggcugagauggaggaagcauugcgaggauugcccauacguuaucaaacuccagcgauaagggcugaacacacggggagggagauaguggauuugaugugucaugcaaccuuuacgaugcgauuguuaucuccaaucagagugccaaacuauaaccuaauaauuauggacgaagcacauuucaccgauccagcaagcauugccgcaaggggauacauuucgacuagaguggaaaugggagaagcugcagguauauuuaugacagcuaccccacccggaucgcgagacccuuuuccacaguccaaugccccuauaauggaugaagaaagagaaauuccugagaggaguuggaacucaggucacgaauggguuacugauuuuaagggaaaaacuguaugguuugugccuucgauaaaagcgggaaaugauauagcggcaugcuugagaaagaaugguaaaaagguaauucaacugucaaggaaaacauucgauuuugaauauauuaagacucgcacaaacgauugggacuuuguggucacuacagacauaucugaaaugggcgcaaauuucaaagcagagagaguuauagacccaaggagaugcaugaaacccgugauacugacagauggagaagagagaguaauuuuagcugggcccaugccuguuacacauaguucugcggcucagaggagagguaggguuggccgcaauccuaaaaacgaaaacgaccaauauaucuauaugggugaaccucuugagaacgaugaggauugugcacacuggaaagaagcuaaaauguuauuggauaacauuaacacccccgaaggcauaauaccuagcauguucgaaccagagagggagaagguggaugcuauagauggcgaauaccguuuacgaggugaagcgcguaaaacauuuguggaucuaaugcgacggggagaucuaccagugugguuggcauauagaguagcagcagaagggauaaauuaugcagaucguagaugguguuuugauggggucaaaaacaaucaaauucucgaagagaacguugaaguagagauauggaccaaagagggugaaagaaagaaauuaaaaccacgguggcuagacgcccgaauauauuccgauccuuuagcauuaaaagaauuuaaagaguuugcagcuggacgaaaaucauugacacuuaaccuaauaacugaaaugggucgucuacccacauucaugacacagaaagcuagaaaugcauuggauaacuuagcuguuuuacauacagcggaagccgggggcagagcauacaaucaugcguuaucagaacuaccagagacgcuggaaaccuuacugcucuuaacuuuacuggcaacaguuacaggaggaaucuucuuauuuuugaugagugguaaaggcauaggaaaaaugacacuagggaugugcugcauuauaaccgcgaguauacuacuaugguacgcccaaauacaaccgcauuggauugcugcgucaauaauacuagaguucuuucuaauuguucuguugauaccagaaccagagaaacagagaacaccgcaagauaaucaguuaaccuaugucgugauugcuauacuaacagugguugcagcaacuauggcaaaugaaaugggcuuccucgagaaaacaaagaaagacuuugguuuaggaaguaucacgacacaacagagcgaaagcaauauacuugauaucgauuugaggccagccucugcguggacucuauaugcggucgcaaccaccuucauaacaccaaugcuaagacauaguauagaaaauaguucuguuaauguuagucuaacagcaauagcuaaucaagcaacagugcuuaugggacuagguaaaggauggccacuuucuaaaauggacauaggcgucccccuguuggcaauaggcuguuacucucaaguuaauccgauaacgcugacagccgcauuauuauuacuuguugcgcauuacgcaaucaucgguccgggucuccaagcaaaggcaacucgcgaagcucaaaaacgugcggcggcugguauaaugaagaacccaacagucgaugguauuacgguuauugacuuggauccuauaccuuaugauccuaaauuugaaaagcaacuaggacagguaauguuauuaguucuauguguuacacagguuuugaugaugagaacaacaugggcucuaugcgaggcccuaacucuagccaccggaccuaucaguacuuuaugggaaggcaauccuggaagauucuggaauacaacuauagcuguuaguauggcuaauauauuucgugguaguuaccuagcaggagccggucuauuauucagcauuaugaagaacacugcaaauacgaggagaggaacugguaauacaggugaaacacuuggagagaaauggaaaaacagacuaaaugcauugggaaagucagaauuucaaaucuauaagaaauccggaauacaggaaguagauaggaccuuggcuaaagaggguauaaaaagaggugaaacagaucaccacgcuguaaguagggggucagcaaagcucagaugguucguugaaagaaaccuagugacaccugagggaaaaguaguagaccuugggugcggacguggcggguggaguuacuacugugggggacugaaaaaugucaaagaaguaaaaggacuaacgaaggguggucccggucaugaagaaccgaucccgaugucgaccuauggauggaaccuaguaagguuacaaagugguguugauguauucuucaccccuccagagaaaugugauacuuuguugugugauauaggagagucuucaccuaauccaacaguggaagcugggcggacauuacgagucuuaaauuuaguugaaaacugguuaaacaacaauacacaguuuugcauaaaagucuuaaauccuuauaugccaagugugaucgagaaaauggaagcgcuucagcggaaauacggcggugccuuaguaagaaacccucuuagcagaaauucuacacacgaaauguauuggguaagcaacgcgagcgggaauaucgugucaagcgugaauaugauuagucggaugcugauaaaccgauucacaaugagacauaagaaggcgacauaugaaccugaugucgaucuaggaagugguacaaggaauauagggaucgagucagaaaccccaaaucuugacauaaucgguaaaaggauugagaaaauaaaacaggagcaugagacaaguuggcauuaugaucaagaccauccauacaagacaugggcuuaccauggaagcuaugaaacuaaacagacuggaucagcauccagcaugguuaauggaguaguaagauuauugacaaagccaugggacguaauuccaaugguaacccagauggcgaugacugauacuaccccguucggucaacaacgcguauucaaggagaaaguugauacaaggacacaggaaccaaaagaagguacgaaaaagcuaaugaaaauuacagcugaauggcuuuggaaagagcuaggcaagaagaaaacaccacgaauguguacuagagaggaauuuacgcgaaaaguaagguccaacgcagcauuaggggccauauuuacagacgaaaacaaauggaaauccgcacgcgaagcgguagaggauucugguuuuugggaguuaguugauaaagaacgaaaucugcauuuagaggggaaaugcgagaccugcguauauaauaugaugggaaagcgugagaagaaacuuggagaauuugggaaagcaaaaggaucaagagcaaucugguacaugugguuaggcgcgagauuucuugaguucgaagcauuagguuucuuaaaugaggaccauugguucucccgcgaaaacucucuuaguggggucgaaggggagggauuacauaaacuuggauauauauuacgagauguuagcaagaaagaaggaggugccauguacgccgacgauacugcaggaugggauacacgcauuacauuagaagaucuuaaaaaugaagaaaugguaacgaaccauauggaaggcgaacauaagaaacuagcagaggccauuuuuaaacuaacauaccaaaauaagguaguacggguacagaggccuacgccacgaggaacugugauggauaucauuucacgucgagaucaacguggaucaggccaaguaguaacauauggcuuaaauacauucaccaauauggaagcccaauuaauuagacaaauggaaggagaaggagucuucaaguccauacaacauuugaccgcuacagaagaaauagcaguaaagaacugguuagugaggguggggcgcgaaagauuaaguagaauggcuaucaguggagacgauugugucguaaaaccccuggaugauagauuugcuucggcccuaacggcacugaacgacaugggcaagguaagaaaagauauacagcaaugggaaccgucuaggggauggaaugacuggacucaaguaccuuuuugcagucaucauuuccacgaacuuauuaugaaagacggucgaguguugguuguaccaugucgaaaccaggaugagcuuauugguagagcgagaaucucccaaggugcuggauggagcuuacgcgaaacagcauguuuagguaaaaguuaugcacaaauguggucccuaauguacuuccaucgaagagaucuaagauuagcggcuaaugcaauuuguagcgcagugccgucgcacuggguaccuacaaguaggacaacauggucuauacacgcgacacaugaauggaugaccacagaggauaugcuaacaguauggaaccguguguggauucaagaaaaucccuggauagaagacaagacgcccgucgaauccugggaggagauaccuuaucucggaaagagggaggaccaauggugcggcaguuugauuggccuaacuucuagggcgacgugggccaaaaauauucagacggcuaucaaccaaguaagaucucuaauugguaacgaggaauauacagauuacaugccaaguaugaagcgguucagaagagaggaagaggaagccgguguacucugguaa

SEQ ID NO: 22859 - RNA, 9876 nt, Artificial Sequence
  derived and/or modified CDS sequence (opt6) from DENV-2__KC762666__SS-prME
acagcgggaauaauaauuaugaugauaccaacuguaauggcguuccaucugaccacccgcaauggagaaccacauaugauaguauccaggcaagaaaaagguaaaucucuauuguucaaaacagaaaacggaguaaacauguguaccuuaauggcgauggacuugggugaauuaugcgaagauacaaucaccuacaauuguccucuauugaggcaaaacgaaccugaagauauagauuguuggugcaauagcacauccacauggguaacauauggcacuuguacugcuacaggagaacauagaagggaaaaacgaucgguggcacuuguaccacauguugguauggggcuagaaacacgaacugaaacauggaugucaucagaaggugcuuggaaacacgcacaaagaauagaaacauggguacuccgccauccgggauucacuauaauggcagcaaucuuagcguacacaauaggaacuacguauuuccaacgaguccuaauauucauacuucuuacugcgguaacaccauccaugaccaugagguguaucggcauaaguaaccgcgacuuuguugaagggguaucagggggcucauggguagacauuguacuggaacaugguuccugugugacaacgauggcuaaaaacaaaccaacgcuagauuuugaacuaauaaaaaccgaagcaaaacacccggcgacuuuaaggaaauauugcauagaagcaaaauugaccaauacaacgacagcgagucgaugcccuacccagggugaaccaagccuuaaugaggagcaagauaaacgcuucguauguaaacacucuauggucgaucggggauggggaaaugguuguggucuauucgggaaagggggaauagugaccugugcaauguucacauguaagaaaaacauggaaggaaaaaucguccagccagagaauuuggaauauaccauaguaauaacuccacauucuggugaggaaaaugcuguaggaaaugauacugggaaacauggcaaagaaaucaaaguaacaccacaaagcucaauaacagaggcugaacuaaccggcuacggcacaguaacaauggaauguucaccuaggacaggacuggacuucaacgaaaugguuuuacuccagauggaaaauaaagcguggcuuguucauagacaaugguucuuagauuugccauuaccuuggcuuccgggugcagauacacaagguucaaauuggauacaaaaagaaacauuagucacauucaaaaacccacacgcaaagaaacaagaugucgucgucuuaggcagucaagaaggugcaaugcauacggcuuuaaccggugcuacagaaauucaaaugucaucaggaaauuuacucuucacaggacaccuaaaaugccgacuuaggauggacaaacuucaauuaaaaggaaugaguuacuccauguguacgggaaaauucaaaguuguaaaagaaaucgcagaaacacaacacggcacaaucguaauaaggguacaauaugagggagaugguucaccauguaaaauuccauuugaaauaauggaccuggaaaaacgacacguuuugggccguuuaauuacaguaaacccgauagucacagagaaagacaguccaguaaauauagaggcugagccaccauucggagacuccuauauuaucauuggcguagaaccaggacaauuaaaacuaucuugguucaagaaagguuccucuauaggacaaauguuugaaacaaccaugagaggggcuaaaaggauggcaauacucggcgauacagcgugggauuucgguagccuuggaggggucuucacuagcaucggaaaagcacuccaucaaguauucggggccauauauggagcagcauuuucaggagucaguuggaccaugaaaauuuugaucgguguagucauaacuuggauagggaugaacucuagaucuacuagcuuaagcguaucuuuaguguugguaggcgucguuacauuauaucugggagugaugguacaggcagacagcggcugcguagugucuuggaagaauaaggaacuaaaauguggaucuggaauauucauaaccgacaacguccacacauggacggagcaauauaaauuccaaccagaaucaccuaguaaauuggcaucggcuauacaaaaagcccaugaagaaggaauaugcggaauuagaaguguaacgcgauuagaaaauuuaauguggaaacaaauuacgccugaguugaaucauauucuauccgaaaaugaagugaaacugacaauuaugaccggggauauuaaaggaaucaugcaagccgggaagcgcucauuacgaccacaaccaacagaauuaaaguauucauggaaaacuugggggaaagccaagaugcuaucuacugaauugcauaaucacacauuccugauugacggacccgagacagccgaguguccuaaugcaaauagagcguggaacucgcuagaaguagaagauuauggauuugggguguucacuaccaauauauggcuaaaacuaaaagaacgccaggacgcuuuuugugacuccaaacuaaugagcgcagcaauaaaggacaauagagcaguacaugcagauaugggauacuggaucgagagcgcuuuaaacgauaccuggaagauugaaaaggcaucguuuaucgaagugaaauccugucacuggccaaagucacacacucuauggucgaaugguguccucgagagugaaaugauuauacccaaaaauuucgcaggcccagucucacagcauaauuaccgaccggguuaucauacucaaaccgcagguccauggcaccuaggucgauuagagauggauuuugauuuuugugaggggacaacagucguaguaacugaagauugcggcaaccgaggaccaucccuacgaacaacuacugcuagcggcaagcugauuacggaaugguguugccgaucaugcacuuuacccccucuaagguaucgaggagaggacggaugcugguauggaauggagauuagaccucuuaaagagaaagaagaaaacuuagucaauucuuuaguuaccgcuggacauggucaaauagauaauuucagccuagggguccuagguauggcacuguuccuggaggaaauguuaagaacaagaguuggaacaaaacaugcaauacuauuaguagcaguaucauucgugacucucauaacagguaacaugucauuuagggaccugggaagagucaugguaauggucggggcaaccaugacagaugauauaggaauggguguuacauauuuagcccuguuagcagcauuuaaagugcgcccuacauucgccgcaggauuguuacuuagaaaauuaaccagcaaagaacuaaugaugacaacaauaggaauaacguuacucagucaaagcacuauaccagagaccaucuuggaacuaacugaugcacuggcgcuuggaaugaugguuuuaaaaaucguaagaaacauggaaaaauaccaguuggcaguuacaaucauggcaauccucugcguaccaaaugcaguuaucuugcagaacgcauggaaaguuucaugcacuacuuuagcggucguuucggucucaccacuacuacuaacguccagucagcaaaaagcagauuggauacccuuagcucuuacuauaaagggguugaauccaacagccauuuuucuaacaacucuuaguagaacgaguaagaaaagaagcuggccacucaacgaagcaaucauggcggucgggaugguaagcauuuuagcaagcucucuacuuaaaaacgauauaccaaugacuggaccauuggucgccggugggcuauuaacuguauguuacguguuaacggguagaagugcagauuuagaacuugaaagggccgcagauguacggugggaggaacaagcggaaauaagugguaguagcccuauauuaaguauaacaauaagcgaggacggcucaauguccaucaaaaaugaagaagaagaacaaacccugacuaucuugaucagaacgggacuauuaguaauuucgggguuguucccuguaucuauccccauaacagcagcagccugguacuugugggaagugaagaaacaaagagccggaguucuaugggacguaccaucaccacccccuguugggaaagcggaguuggaagauggugcuuauagaauaaaacagaaaggaauauuaggauauagccaaauuggugcugggguauacaaagaaggaacuuuucacacuauguggcauguuacgcgaggggcuguguuaaugcauaaggggaagcgaaucgaacccucgugggcugacguuaagaaagauuuaauaucguacgggggaggauggaaacuagaaggggaauggaaagaaggggaagaaguucagguacuugcucuagaaccugguaagaauccaagggccguucaaacuaaaccaggauuauuuaaaacuagcaccgguacaauaggggcggucagccuagauuucucccccggaacauccggaagcccaauuguugauaagaaagggaaagucguaggccuguacggaaaugggguaguaacuagaagcggaacauauguaagcgcaauagcgcagacagaaaaaucuauagaagauaacccagaaauagaggacgauauuuuucgaaagaagcgccuaaccaucauggaccuccacccaggggccggaaaaacgaaaagauauuugcccgcuauaguuagagaggcaaucaaacgaggcuuacgaacauuaauucuagcaccaacaagggucguugcugcggaaauggaagaagcgcuccggggucuaccaauuagauaccaaacccccgcuaucagagcagaacacacaggaagggagaucguagauuuaaugugccacgcaaccuucaccaugagauuacuaucaccgauuagggucccaaauuacaaucuuauaauuauggacgaggcacacuucacagauccagcuucuauagcugcacgcgguuacauaagcacccgggucgagaugggggaagccgccggcaucuuuaugacugcaacuccgccagggaguagagauccauuuccgcaaucuaacgcgccuauaauggaugaggaaagggagauaccagagcguucuuggaacucaggccacgaaugggucacagauuuuaaagguaaaaccguuugguuugucccaagcaucaaggcagguaaugauauagcagcuugucuacgaaagaacggcaagaaaguaauucaacuuagcaggaaaacuuuugacuucgaauauauaaaaacucgaacgaacgauugggauuuuguuguaacuaccgauaucuccgagaugggggcuaacuuuaaagcagaacgugucauagauccaagacgcugcaugaaacccguuauauuaacugacggagaagaaagaguaauacuagccggacccaugccagugacccacaguucagcagcucagcgcagaggaagggucggacguaaucccaaaaaugaaaacgaucaauauauuuauaugggagagccauuagaaaaugaugaagauugugcacauuggaaggaggcaaaaaugcuauuagauaauauuaacacucccgaagguauuauacccuccauguuugaaccugaaagggaaaagguagacgcaauagauggagaguaucgguuaagaggagaggcgagaaaaacauucguggaucucaugcgcagaggggauuuaccaguaugguuagcauacagaguagcugcagaaggaauuaauuaugcggaucgacgauggugcuucgauggugucaaaaauaaccaaauauuagaagaaaacguggagguugaaauauggaccaaggaaggggagcggaagaaacuuaagccacggugguuggaugcuaggauuuauucggauccacuagcacugaaagaguuuaaagaguucgcggcaggacgaaaaagccuuacauuaaaccuaauuacagagaugggcagacuacccacguucaugacccagaaggcacgaaaugcucuggauaacuuggcuguucuucacacagcagaagcuggagggcgcgcuuauaaccacgcucuaucugaguugccugaaacacuugaaacacucuuacuccuaacucuacuugcuaccgugacaggcgguauauuucucuuucuaaugucggguaagggaauagguaagaugacgcuaggaauguguugcauaaucacggcaucaauacuacugugguacgcucaaauccaaccgcauuggaucgcagcuucaauuauacuggaguucuuucuaauuguacucuuaaucccagaaccggaaaaacaaagaacaccacaagacaaccagcugacauaugucgugauagccauacugacgguuguagcggcuacuauggcgaacgaaaugggauuucuagagaaaacuaagaaagauuuuggucuggguucaauaacaacucaacaaccggagucuaauaucuuggauaucgauuugcggccagcaagcgcguggacauuauacgcuguagcgacaacguuuauaaccccgauguuacgacacucuauagaaaauucgucaguuaauguaucuuuaacugcaaucgcuaaucaagcaacuguucugauggggcuuggaaaaggcuggccucuuuccaaaauggauaucggaguaccuuugcuugcaauaggcugcuacucacagguaaacccaaucacacuuacugcggcacuauuauugcugguggcucacuacgcuauaauugguccaggacuacaagcuaaagccaccagagaagcacagaaaagagcggcagcgggcauuaugaaaaauccaacaguagauggaauuacaguuaucgaccuagacccaaucccauacgauccuaaauucgaaaaacaacuaggccaaguaauguuauuaguauuauguguaacccaaguucuaaugaugagaaccacaugggcccugugugaagccuugacacuagcaacuggaccaauaucaacuuuaugggaagguaacccaggacgcuuuuggaacacaacaaucgcgguaucuauggcgaauauauuucgugguaguuacuuagcgggugcaggacuguuguuuaguaucaugaaaaacacugcuaacacucgucgcggcaccgguaauacuggagaaacguuaggugagaaauggaaaaacagacugaaugcacucgguaagucugaauuucagauauacaagaaauccggaauacaagagguagaccguacccuagcaaaggaaggaauaaaacgaggagaaaccgaccaccacgcaguuaguagaggaucugcuaaacuacgaugguuuguagaaagaaaucuaguaacgccugaagguaagguggucgauuuggguuguggaagaggagguuggucauacuauugcggaggucucaaaaauguaaaggaagugaaagggcucaccaagggaggaccgggccaugaagaaccuauaccaaugucgacauacggauggaaccuaguaaggcuucaaagcggaguugacgucuucuuuacaccaccagaaaaaugcgacacuuuauuaugugauauaggcgaaaguaguccuaauccgacgguugaggcaggucgcacauugagaguucucaauuuaguugaaaauuggcuuaacaauaauacacaauucuguauaaaagucuugaacccauauaugcccucaguaauugagaaaauggaagcacugcaacguaaguauggcggggcauuaguaaggaacccuuuaaguagaaauaguacacacgaaauguauugggucucuaaugcuuccgguaauauaguaucuucagugaacaugauaucaagaaugcuuauaaaucguuuuacgaugagacacaagaaagcaacguaugaaccagacguagauuuagguucagggacgagaaacauuggcaucgagagugagacuccgaaucuagauauaaucgggaaaagaaucgagaaaaucaaaagagagcaugagacaaguuggcauuacgaucaagaccauccguauaaaacaugggcauaucacggaucuuacgaaaccaagcaaacuggaucagcuaguagcauggucaaugguguaguuagguuacucacaaagccaugggauguaauccccaugguaacucaaauggcaaugacugauacgacuccuuuuggacaacagagaguauuuaaggaaaagguggauacuaggacacaagaaccaaaggaaggaacaaagaaauugaugaaaauuacagcagagugguuguggaaagaauuaggcaagaagaaaacuccccgaaugugcacacgugaagaauuuacacguaagguccguucaaaugcagcgcuaggagcaaucuuuacagaugaaaacaaguggaagucugcaagagaagcaguggaagacucaggcuucugggagcucguugauaaagaacguaaucuacaccuugagggaaaaugugaaacauguguuuauaauaugaugggaaagagagagaagaaacuaggugaguucggaaaagcuaaagggucaagggcaauaugguacaugugguuaggcgcgagauuuuuagaauuugaagcccugggguucuuaaaugaagaucacugguuuucacgugaaaauagcuuaucagguguagaaggugaaggguuacacaaacuaggauauauuuuaagagacguaaguaagaaggaaggaggggcuauguaugcggaugacacagcugggugggauacacgaauaacauuagaagaccucaaaaacgaagaaaugguaacaaaucauauggaaggggaacacaagaaacuagcagaagcaauuuucaaauugacuuaucaaaacaaaguagugaggguccaaagaccaacaccccgagguaccguaauggauauaauaucccggagggaucagagagguaguggacaaguaguuacauauggacucaauacguucacaaauauggaagcacaacuuauucgccaaauggaaggagaaggagucuuuaaaaguauacaacaauuaacgguuacugaagaaaucgcagucaaaaauuggcugguaagagugggacgagaacgguuaagccgcauggccauaagcggagacgauugcguagucaaaccccuagacgaucgcuuugcuucggcacuaacggcucuaaacgauaugggcaaaguucgaaaggacauucaacaaugggaaccaagucgcggauggaaugacuggacucaaguuccguucuguagccaccacuuucacgaguuaauuaugaaagauggucgcguauuggucguaccuugcagaaaccaagaugagcuuauaggacgugcucgcauaucacaaggcgcuggauggagucuacgagagacggcuugcuuagguaagucauacgcccagauguggucuuugauguacuuccaccgcagagaccuuagauuagcagcuaacgcaaucugcagugcugugccuagccacuggguuccaacaucccgaacuacuugguccauacaugcuacccacgaauggaugacgacagaggauauguuaacaguuuggaaccgcguuuggauacaagaaaauccauggauggaagauaagacaccaguugaaucuugggaagagaucccuuaccuuggaaagagagaagaccaaugguguggaagccucauuggauuaaccaguagagcaacgugggccaaaaauauucaaacagcaauaaaucaagucaggucgcuaauagggaaugaagaguacacagauuauaugccaucgaugaaaagguucagaagagaagaggaagaagccgguguucuaugguga

SEQ ID NO: 22860 - RNA, 9876 nt, Artificial Sequence
  derived and/or modified CDS sequence (opt6) from DENV-2__KC762677__SS-prME
acagcaggaaucauaauaaugaugauaccaaccgugauggccuuucaucucaccacaaggaacggagagccacacaugauaguaucaagacaagaaaaagggaaaaguuuguuguuuaaaaccgaaaauggcguuaacaugugcacuuuaauggcaauggaccucggagaacugugugaagauacaauuacuuauaauuguccccuccuaaggcaaaaugaaccagaagauauagacugcugguguaauaguacauccacaugggugacguauggaacuuguacagcuacgggagaacaucgaagagagaaaagaucuguagcucuaguaccccauguuggaaugggacuggagaccagaacggagacguggaugaguucggagggagcauggaaacacgcacagagaauagaaacuuggguucuucgacacccuggauuuacaauaauggcggcgauucuagcauauacuauagggacaacccacuuccaacgaguucuaauuuucauauuguuaacugcugucgcccccaguaugacaaugcgaugcaucgguauuucaaaccgugacuuuguagaaggugugucuggaggauccuggguggacauaguccuggaacauggaaguugcguuacaacuauggcgaaaaauaaaccaacccuugacuuugaacugauaaaaacagaggcaaaacaccccgcuacccuaaggaaauauuguauagaagcuaaguuaacaaauacaacuaccgcuucucgaugucccacgcaaggagaaccuucuuuaaaugaagaacaagauaaacguuucguuugcaaacauaguaugguugauagaggcuggggaaacgguugcggauuauucgguaaaggaggaauugugacgugugccauguucacaugcaaaaaaaacauggaagggaaaauagugcaaccugaaaaucuggaauacacgauugugauuacaccgcacagcggagaagaaaaugcgguagguaaugauacaggcaaacacggaaaggaaaucaaagucacaccccaaaguucaauaacggaagcugaauuaacuggauauggcaccguuaccauggaguguucaccuagaacaggucucgacuuuaacgagaugguucucuuacaaauggaaaauaaagcuugguugguccaccgccagugguuccucgaccuaccauuaccauggcuuccaggagcggacacccaaggaucuaauuggauacaaaaagaaacgcucguaacguucaaaaauccucacgcaaagaaacaggacguuguaguauuagguucccaggaaggugcaaugcauacugcucucacaggugccacggagauacaaauguccuccggaaaccuucucuucacgggacacuuaaaaugucgauuaagaauggacaaauuacaacucaaaggaaugagcuacaguaugugcacaggaaaauuuaaaguaguaaaggaaauugcagagacucaacacgggacuaucguuauaagaguccaauaugagggagauggaucuccuugcaaaauaccauuugaaaucauggaccuggaaaaacgucaugugcuaggacgucuaauaacggucaacccuauuguuaccgaaaaggauagcccugugaacaucgaagcagaaccucccuucggugacagcuacauaaucauaggggucgaacccggacagcucaagcucucaugguuuaagaagggauccuccauuggccaaauguuugaaacaacaaugaggggcgcaaaaaggauggcgauuuugggcgauacugccugggauuuugggucgcucgguggaguauucacuucuaucgguaaagcucugcaccaaguguuuggagcgauauacggggcggcauuuagugguguaucauggacaaugaaaaucuuaauagggguaguuauaacauggaucgguaugaauucacgaagcacaagcuugucgguaucguugguucucguggggguaguaacacuuuaucuaggagucaugguucaagcagauucagguuguguaguuaguuggaaaaauaaggaguuaaaauguggaucaggaauauuuaucacugauaauguacauacauggacagaacaauacaaauuucaaccagaaucuccaucaaaauuagcaucagcaauacaaaaggcucacgaggaaggcaucugugguauaagaaguguuacgagacuggagaaccuuauguggaaacaaauuacuccggaguugaaucacauacucagcgaaaaugagguaaaacuaacaaucaugacaggugacauuaaagguauaaugcaagccgguaaaagaucgcuaagaccacagccaacugagcuaaaauacaguuggaaaacuuggggaaaagcaaaaauguuaagcacggaauuacauaaccacacauucuuaauagacggaccagaaacugcagagugccccaauacuaacagagcguggaacaguuuagaaguugaagauuauggguuuggaguauucacaacgaauauauggcuaaaacuaaaagagcgacaggauguuuauugugacaguaaacuuaugagcgcagcaauaaaagauaaucgugcaguucaugccgacaugggcuauuggaucgagagcgcccugaacgauaccuggaaaauugaaaaagccucauuuauugaaguaaaguccuguuacuggccaaaaagucacacacuauggucaaacgguguccuggaaagcgaaaugaucauaccuaaaaacuucgcaggaccaguuagucagcacaauuacagaccaggauaucacacacaaaccgcgggacccuggcaccuaggaaggcuggagauggacuuugacuucugugaagguacuacaguagucgucacugaagauugugguaauagaggacccaguuugcggacgacaacggcuucaggaaaacuuauaacagaauggugcugccgaucaugcacucuaccuccacuuagauaccgaggggaggaugguugcugguauggaauggaaauuagaccuaugaaagagaaggaagaaaaucuaguuaauagccugguaacagccggacauggacaaauagauaauuucuccuugggcguguuaggcauggcguuguuccuagaagagaugcuccguacaagaguaggaaccaaacaugcuauacuacuagucgccguaucuuucguaacucucaucacaggcaacaugaguuuucgugacuuaggucgaguaauggucaugguuggagcuacuaugacugaugauaucgguaugggaguaacguaccuagcucuucuagccgcguuuaaaguaaggccaacauuugcggcgggacuucuauuaagaaagcugacaucgaaagaauuaaugaugaccacuauugguauaguguuacuaucccagagcaccauuccugagacaauauuagaauuaacagacgcucuagcacugggaaugauggcgcuaaagaucguaagaaauauggaaaaguaucaauuagcaguuacuauaauggcaauucuauguguaccuaaugcaguaauccuucaaaaugcauggaaaguaaguugcacuacuuuagccgucguaaguguuaguccuuuacuacugacgucaucacaacaaaaggcugauuggauuccacuagcuuuaacuauaaaagggcucaauccgaccgcaaucuuucuaacuacguuaagucgcacuuccaaaaagcguaguuggccucuuaaugaggcaauuauggcuguugguaugguuaguaucuuggcaaguucuuuguuaaaaaaugauauucccaugacugggccucuaguugcugggggcuugcugaccguguguuacguucuaacaggacgcucagcagaucucgaacuagaaagagccgcagacgucaggugggaggaacaagcugaaaucaguggaucaucgccaauauuaucaauaaccauuuccgaggaugggagcaugagcauaaaaaaugaggaggaggaacaaaccuuaacuauacugauaaggaccgguuuacuuguuauuaguggacuuuuuccuguaucaauaccgaucacagcagcagcuugguauuuaugggagguaaaaaaacaacgugcugggguuuugugggacguaccaucgccgccaccaguaggcaaagcugagcuagaagacggagccuaucgcauaaagcagaagggaauuuuggguuacucucagauaggugcgggaguauacaaagagggcacuuuucacacaauguggcauguaacgaggggagcuguuuuaaugcauaaaggcaagcgaauugaaccuagcugggcagacgucaaaaaagaucuaauaaguuaugguggcggguggaaauuggaaggggaguggaaggagggcgaagaaguucaagugcuggcccucgaaccagggaaaaacccucgagcuguacagacuaaaccuggauuauuuaaaacgaacacaggcacaauuggagccguuucacuagauuuuucacccgggacuagugguucgccuauuguagacaaaaagggaaaaguugucggcuuauaugguaaugggguuguaacacgauccggaacuuauguaagugccauagcucaaacagaaaagucuauagaagauaacccagaaauagaagaugacauuuuccgaaaaaagagacucacaaucauggacuuacacccaggggcuggaaaaacaaaaagguacuuaccagcaauagugagggaagcuaucaaaagagguuuacgcacauuaauauuagcuccuacuagaguaguagccgcugagauggaagaagcuuuaaggggccuaccaauuagauaccagacaccggcuauaagagcggagcauacagguagggaaaucguagaccugaugugccacgcaacauuuacuaugcgacuuuugucuccaauccguguaccaaauuauaauuugaucauaauggacgaagcgcacuucacagacccugcaucaauagcagcacgagguuauauaucaacgaggguagagaugggugaggcagcaggcauauucaugacagcaacgccgccuggcucucgcgacccauuuccacaaucaaacgcgccaauaauggaugaagaaagagaaauuccugaacgaucguggaacagcggucacgaaugggucacugacuucaaagggaaaacgguaugguuugugccuuccauuaaggccgguaaugacauagcugcaugucuacgaaaaaaugguaaaaaaguaauacaguuaucacgaaaaacguucgacuuugaauacauuaaaacaagaacaaaugauugggauuuuguagugaccacugacauaagugaaaugggugcaaacuucaaagcugaaagaguuauagacccaagacgguguaugaaacccgugauauuaacugacggugaagaaagaguaauucuugcaggaccuaugccaguaacccacaguucugcagcacaaagaagaggcaggguugguagaaauccgaaaaaugagaaugaucaauauaucuacaugggugaacccuuggaaaaugacgaagauugcgcucauuggaaagaagcaaaaaugcuuuuagauaacauaaacacuccugaagggauaaucccaagcauguucgagccagaaagagaaaaaguagaugcgaucgauggagaauauagacugagaggugaagcacguaaaacuuuuguggauuugaugcgacgcggugaucuaccuguauggcuagcauaucgaguagcugcugaggguauuaacuacgccgacagacguugguguuucgaugguguaaagaacaaucaaauauuagaggaaaacgucgagguugaaauuuggacaaaagagggagaacgcaaaaaguuaaaaccccgaugguuagacgcacguauauacucagacccgcucgcuuuaaaagaauuuaaggaauucgcagcuggaagaaagucacuuacgcucaaccuaaucacugaaaugggaagacuuccuacauucaugacgcaaaaagcuaggaaugcauuagacaaccuagcgguauuacauacugcugaagcaggaggaagagcuuauaaucaugcccuaucagaacuaccagaaacauuagaaacucuacuucugcugacccuucuagccaccguuaccgguggaauauuucuuuuccuuaugucugguaaagguauaggcaaaaugacccuugggauguguuguaucauaacagccaguauuuuguuaugguaugcucagauacaaccacacuggauagcggcgaguauaauucucgaguucuuuuuaauuguucucuuaauaccugagccggagaaacaacguaccccacaagauaaucaacuuacuuauguuguuauagcuauccucacaguaguagcagcuacaauggccaaugaaaugggauuuuuggaaaaaacaaagaaagacuuugggcuagguaguauuacaacccaacagccagaaagcaauauauuggauauugaccuccggccggccagugcauggacgcuuuaugcuguagccacuacauuuauuacgccgaugcucaggcauagcauagaaaauaguaguguuaauguaaguuugacagcuauagcgaaucaggcaacaguccucaugggacuaggaaaggguuggccacuaagcaagauggacauuggaguaccucuacuggccauagguuguuauucucaaguaaacccgauaacguugacagcagccuuauuguugcugguagcgcacuaugcuauaauaggaccgggauugcaagcuaaagcaacccgagaggcccaaaaacgagcggcagcgggcaucaugaaaaacccuacuguugaugguaucacaguuauagaccuugaccccauaccguaugauccgaaauucgaaaaacaacuagggcaaguaaugcucuuaguguugugcguaacacaggugcuuaugaugcguaccacuugggcgcuaugugaggcacuaacucuagcuacgggaccaauaucaacacucugggaaggaaacccaggcagauuuuggaacaccacaaucgcaguuagcauggcuaauauauucagagggaguuaucuggccggugcaggguuauuauuuucaaucaugaagaauacugcaaauacaaggagagggaccggaaauacgggugaaacucuaggagaaaaauggaagaaucgcuuaaacgcgcucggaaaaucugaguuucagauuuauaaaaaaucugguauacaagaaguagaucgaacauuggccaaggaaggaauaaaaaggggggaaacugaccaucaugcgguaucucgaggaagugcgaaacugagaugguuuguagaaaggaauuugguaacaccagaaggcaagguagucgaccuugguugcggacgugggggauggucuuauuauugcgguggucuaaagaacguaaaagaagugaaagguuuaacuaaagggggaccugggcacgaagaacccauacccaugaguacauacgguuggaaucucguucgucuucaaagcggagucgauguauuuuuuaccccaccugaaaaaugcgauacguuauuaugugauauaggggaauccucaccuaauccaacaguugaagcuggucgcacucuucggguacuaaaucuuguggagaacugguuaaacaacaauacacaauuuugcauaaaagugcuaaaucccuacaugccgagcguuauagagaagauggaagcauugcagcgaaaauauggaggagcauuagugagaaauccucucucccgaaacaguacacacgaaauguacuggguaucgaaugcaagugguaacaucguuuccucagugaauaugauaucucgcaugcuaauuaaccgguuuacuaugcgacauaagaaagcuacauaugaaccggauguagauuuggggucuggcaccagaaauauagguauugaaagugaaauaccaaacuuagauauuauaggcaagagaauagaaaaaauaaaacaagaacaugaaacuaguuggcauuaugaucaagaccacccauauaggaccugggccuaucaugggucauaugaaaacaaacagacaggaagcgcgucaaguaugguuaauggaguaguaagauugcuaaccaaaccuugggacguaauuccaauggucacccaaauggcgaugacagauacgacaccguucggacaacaaagggucuuuaaagagaaggucgacaccaggacgcaggagccaaaagaggggacgaagaagcuaaugaaaauuacagccgagugguuauggaaagaauuaggaaaaaaaaaaacaccucguauguguacaaggaaggaguuuacaaggaaggucagaucaaaugcagcccuaggcgccauauuuacggacgaaaacaaauggaagagugcuagggaggcagucgaagauucuggcuucugggaacuuguggauaaagaacggaauuuacaucuggaggggaagugugaaacgugcguauacaacaugaugggcaaaagagaaaaaaaacuaggcgaauuugguaaagccaaaggcagccgugcaauaugguacaugugguugggugcaagauuccuagaauucgaagcucucgguuuccuuaaugaggaccacugguucucacgagaaaacagccuuucagggguugaaggagaagggcuacacaaauugggcuauauuuuaagagacguaucaaaaaaggaaggaggcgcaauguacgcggacgauaccgcagggugggauacuaggauuacucuggaggaucuaaaaaacgaggaaauggucacuaaucauauggaaggcgaacauaaaaaacuagcugaagcgauauuuaaacuaacauaucaaaauaagguaguacgcguucaacggcccaccccacguggcacaguuauggauauaauaucucgacgggaucaaagaggaagcggacaaguagucacuuauggccuuaacacuuuuacuaacauggaagcucagcuuauucgacaaauggaaggcgaagguguguucaaaucaauucagcaauuaacagucacggaagagauagccguuaagaauugguuagugagagugggcagagaaagacugaguaggauggcgaucucaggcgacgauuguguaguaaaaccauuggaugauagguuugccagugcauuaacagcacucaaugacauggggaaaguacggaaagauauacaacaaugggaaccgagcagggguuggaaugauuggacucaaguuccguuuuguucacaccauuuccaugaauuaauuaugaaggacggacgaguguugguagucccauguaggaaucaggaugaacugauugggagagcacgcauaagccaaggagcaggauggucauuacgggaaacggcuugcuuggguaaaagcuaugcccaaauguggucucuaauguacuuccaucgaagagacuuacgauuagcagcuaacgcaauauguuccgcagugccaucucauuggguaccaacaucuagaacuacauggucaauacacgcuacucaugaguggaugaccaccgaagacaugcugacaguuuggaauagaguguggauacaagaaaauccguggauggaagacaaaacaccaguggaaagcugggaagaaauaccuuacuuaggaaaaagagaagaccaauggugugggucccuuaucggucuaacgaguagagcuacuugggcaaaaaauauacaaacagcaauaaaucaggucaggucgcuaauugguaaugaagaauauacugauuauaugccuucaaugaaaagguuuagaagggaagaagaagaagcugguguuuugugguag

SEQ ID NO: 22861 - RNA, 9876 nt, Artificial Sequence
  derived and/or modified CDS sequence (opt6) from DENV-2__KC762668__SS-prME
acagccggcauaauaaucauggugauaccaacuguaauggcguuucaccuaacaacucgaaauggggaaccucauaugauuguaucuagacaagaaaaagggaaaucauuguuauucaaaacagaaaaugguguuaauauguguacacuaauggcuauggaucuaggcgaacuaugcgaagacacaauaacuuacaauuguccuuuguuaagacagaaugaaccggaagauauagauugcugguguaauucaacaucaacuuggguaacauauggaacauguacagccacgggagagcaucgucgagaaaaacgcaguguagcacuuguuccgcauguaggcaugggucuggaaacacguacagaaacauggaugucuucugaaggagcuuggaaacaugcucaaagaauagaaacguggguacuuaggcacccuggauuuacgauaauggcagccauccuugcuuacacuauugggacaacauauuuccaaagagucuuaauauucauuuuacuuacugcaguagcaccauccaugacaaugcgcugcauaggaauauccaaucgagacuucgucgaaggaguaucuggagguucaugggucgauauaguacuugagcacgguucauguguaacgacgauggcgaaaaacaaaccuacucuggauuucgaauuaauuaaaacagaagccaaacauccagcuacacuaagaaaauauugcaucgaggcuaaacuaacaaauacaacaacagcaucuagaugcccuacucaaggagagccuagcuugaaugaggaacaagacaaaagguucgucugcaaacauucaaugguagacagagguugggguaaugggugcgggcuauuuggcaaaggagguaucgucacaugugcgauguuuacuuguaagaaaaacauggagggaaaaauuguccagccugagaaucuagaauacacaauaguaauuacaccucauaguggugaggaaaacgcagucggaaacgauacugggaaacacgguaaagaaauaaaaaucacaccucaauccuccauuacagaagccgaauuaacagguuaugguacugucacgauggaauguucaccccgcacuggauuggacuuuaaugaaaugguuuugcuucaaauggagaauaaagcgugguuaguacauaggcaaugguuucuagaucuucccuuaccguggcuucccggugcugauacacaaggaucaaauuggauacaaaaagaaacauuaguaacauucaaaaauccacaugcgaagaaacaagaugucguaguacuaggaucacaagaaggugcaaugcauacagccuugacuggugcaacugaaauacaaaugucuucuggaaacuuauuauuuacugggcaccucaaauguagacuaagaauggacaaacuacaacuaaaagguaugagcuacagcaugugcacagggaaauucaaagucgucaaagagauugcagaaacgcaacaugguacaauaguaaucagaguacaauacgaaggcgauggaucaccuugcaaaaucccuuuugaaauuauggaucuagaaaaacgucacguucuuggaagacuaauuacagugaauccuauaguaacugagaaagauuccccaguaaacauagaggcagaaccaccguuuggagauucauacaucauaauaggaguugaaccgggacaacucaaacucucgugguuuaagaaaggcucaaguauaggucaaauguuugaaacaacuaugagaggcgcgaagagaauggcaauacuaggggacacagcgugggacuuuggcucucuagggggaguuuucaccagcaucgggaaggcuuugcaucaaguauuuggggccaucuauggugcugcauuuucagggguaagcuggaccaugaaaauucuuaucggagugguuauaacguggauaggaaugaacuccagaucuacaagccuauccguaucguuaguucuuguuggagucgugacccuauaucuuggggucaugguacaagcugauucuggauguguugucucauggaagaauaaagaacuuaaaugugguaguggaaucuuuauaacagacaauguacacacauggacugaacaauacaaauuucaaccugaaucaccaucaaaacuagcaagugcaauacaaaaggcacaugaagaaggaaucuguggaauccgcucaguuacuagauuagaaaauuuaauguggaagcaaauaaccccugaacucaaccacauucuaagugaaaaugaagucaaacuaaccauaaugacgggugauauaaaaggcauaaugcaagcaggaaaaaggucucucaggccccaaccuacugaauugaaguacucauggaaagcgugggggaaggcaaaaaugcugagcacagaauuacauaaccacacauuuuuaauugaugggccugagacggccgaaugucccaauacuaaccgagcauggaauagcuuagaaguugaagauuacggcuuugggguuuuuacgacaaacauuuggcuaaaguuaaaagaaaggcaagauguguuuugcgauucaaagcuaaugagugccgcgauaaaagauaaucgcgcaguucacgcggacaugggauacuggauagagagugccuuaaacgauacauggaaaauugaaaaagcaucguuuauugaagucaagagcugccacuggccaaagagucacacacuuuggucaaauggaguauuggaaucagagaugaucaucccaaagaauuucgcaggaccuguaagccaacauaacuaucguccaggguaccacacccaaaccgcaggcccauggcacuugggacgucuggagauggacuuugacuucugugaagguacaacagucgucguuaccgaggauugcggaaauagaggcccaucauuacggacaaccacugcgagcggaaaauugauaacagagugguguugccgaucuuguacauuaccaccccuacgauaucgaggagaagauggauguugguauggcauggagauucgaccucuaaaagaaaaggaagaaaacuugguuaacucgcuugucacagccggccauggacaaauagauaauuuuagcuuaggaguacucggaauggcguuauuccuagaggagaugcuaagaacacguguugggacaaaacacgcuauacuccuaguagcagugucuuuuguuacucuaauuacgggaaauauguccuucagagaucuagguagaguuauggugaugguaggggcaacaaugacagacgauauaggaaugggugugacuuaccuggcacuacucgcugccuucaaaguccgucccacauuugcagcaggguuauuauuaagaaaauuaaccucaaaagaacucaugaugaccacgauaggaaucguacugcuaucacaaucaacaauaccggagacaauuuuggaacuuacagacgcauuagccuuggggaugaugguacuaaaaaucguacggaacauggaaaaguaucaacuagcuguaacaauuauggccauacucugcguccccaaugccgucauauuacaaaacgcuuggaaaguuucuuguaccacacucgcagucguuucuguaaguccacuuuuauuaacgucgagccaacaaaaagccgauuggauacccuuggcucucacuauaaaaggauuaaauccuacggcaauuuuucuuacaacucuuagcagaacuagcaagaaaaggucguggccucuuaacgaggcaaucauggcaguagguaugguaaguauuuuggcaaguagucugcuuaagaaugauauaccaaugaccgguccacugguugcuggagggcuuuuaacggugugcuauguacuaacggguagauccgcagaccuagaacuagagagagcagcagacguucggugggaagaacaagcagaaauuucaggaucuucaccgauauuaucaaucacuaucucugaggauggcucuaugucgauaaagaaugaagaggaagaacaaacccuuacaauccugauaagaacaggacuccuaguuauuucugggcuuuuuccgguuucuauuccuauaacagcugcugcaugguaccucugggaagugaagaaacaacgcgcuggaguacucugggacgucccuucuccaccuccagugggaaaagcugaauuagaggacggggcauacagaauaaaacaaaaaggcauacucggguacucacaaauuggugcuggagucuacaaggaaggcacuuuccauacaauguggcacguaacacguggugcgguucucaugcauaaaggaaaaaggauugagccuaguugggcugauguaaagaaagauuuaauauccuacggugggggauggaaacucgaaggcgaguggaaggaaggagaagaaguacaagucuuagcgcuggaaccggguaagaacccccgggcaguacagaccaaacccggucuuuucaaaaccaacacaggaaucauaggcgccguaucccuagauuuuagcccagguacaucaggaucgccgauugucgacaagaaagguaaaguugugggucucuacggaaauggcguaguaacuagaagcggcacuuacguuagcgccauagcucaaaccgaaaaaucuaucgaagacaauccagagauugaagaugacauuuuuagaaagaagaggcuuacuauaauggaucugcacccgggugccggaaaaaccaaaagauaccucccagcaauuguccgagaggcuauaaagaggggauugcgaacuuugauacucgcuccaaccagagucguggcagcggagauggaagaagcacuaagaggcuuaccuauacgcuaucaaacaccagcaauuagagcggaacacacaggaagagaaauaguugacuugaugugucaugcaacauuuacuaugaggcugcuuucaccaauaagaguaccuaacuacaauuuaauaauuauggacgaagcgcauuucacagaccccgcuuccauagcagcaagagguuacaucucaacaaggguagagaugggggaagcugcaggcaucuuuaugacugccaccccacccggaucacgggacccauucccacagucaaaugcaccuaucauggaugaagaaagagaaauuccugagcgaucauggaacucagggcaugaguggguaacugauuuuaaaggaaaaacaguuugguuugugccuaguauuaaagcggggaacgauauugcugcaugucuacguaaaaaugggaagaaagugauacaauuaucacguaaaacuuuugauuuugaguacauuaagacgcggaccaacgauugggacuuuguagucacuaccgauauuagcgaaaugggugcuaauuuuaaagcagagagagucauugacccucgaagauguaugaaaccugugauauuaacggauggcgaagaaagaguuauacuugcugguccgaugccggucacccauagcucugcagcucagcgacgaggacgaguuggaagaaauccuaaaaacgagaaugaucaguauaucuauaugggcgaaccacucgaaaacgaugaagauugugcucauuggaaggaagccaagaugcuguuagacaacauaaauacuccugaaggaauaauaccuuccauguuugaaccagagcgugagaaaguagaugccauagauggggaauaccgacucagaggggaagcaaggaaaacauucgucgaucugaugagacgcggagaucugccaguauggcuagcguaccgaguagccgccgaaggaauaaauuaugcagacagacgauggugcuuugauggagugaaaaacaaccaaauucuggaagaaaauguagagguggaaauauggacgaaagagggagaaaggaagaaauuaaaaccaagauggcuagacgcaagaaucuauagugacccuuuggcauuaaaagaauuuaaagaguucgcugcagggaggaaaaguuugacauugaauuuaauaacugaaaugggcagacuaccaacuuuuaugacgcaaaaagcacggaacgcucucgacaacuuagcuguuuuacauacagcggaagcuggaggacgcgccuauaaucaugcgcucucagaauuaccagaaacccuagagacacuguuacuucuaaccuuguuagcaacuguaacaggcggcauauuuuuauuucuaaugagugguaaaggaauugggaagaugacguuaggaauguguuguauaaucacugcuucgauuuugcucugguacgcccaaauacaaccacauuggauagcagcgagcauuauucuagaguucuuuuuaauaguacuauuaaucccagaaccugaaaaacaacguacgccacaagauaaucaacuaacauauguugucauugccauauuaacugugguugcggcuacgauggcgaaugaaaugggguuucucgagaaaaccaagaaagacuucgguuuggggucaaucaccacucaacaauuagagagcaauaucuuagauaucgaccuaagaccggcgucugcuuggaccuuauacgcaguugcuacaacguuuaucacacccaugcuaagacauucgauagaaaauagcagugucaauguaucucuaacugcuauugcaaaucaagcuacgguucuaaugggucucgguaaaggcuggccccuaagcaaaauggacauuggcgugccuuuacuagccauuggauguuacucccaaguuaauccaauuacguugacagcagcacucuuauuacuggucgcucauuaugccauaauaggacccgggcuucaggcaaaagcaacgagagaagcacaaaaacgcgcugcagcagggauuaugaaaaauccaacaguagacggaaucaccgucauugaucucgacccaauaccauacgacccaaaguucgaaaagcaacuagggcaaguaaugcucuuaguacuauguguuacacaagucuugaugaugcgaacaacaugggccuuaugugaagcacuuacauuagcaacuggaccuauuaguacgcucugggaaggcaacccagguagguucuggaacaccacaauagcaguaucaauggcaaacaucuuuagggggucauacuuagcaggcgcaggccuauuauuuaguaucaugaagaacaccgcaaauacacgucgggguacuggaaacacaggugaaacuuuaggagaaaaguggaaaaacagacuuaaugccuuagguaaauccgaauuucaaauuuauaagaaaucagguauacaagaaguugacaggacacuagcgaaggagggaauaaaaagaggagaaacagaucaucaugcaguuagucgagguagcgccaaauuacgaugguucguggaacggaauuuggugacuccugaaggaaagguuguugaucuuggauguggacgaggagguuggaguuacuacuguggaggacuuaaaaauguaaaggaaguuaaaggcuugacuaaagguggucccggucacgaagaaccuauaccgaugaguacauaugguuggaacuuaguaagguuacaaagcggaguggauguauuuuucacgccaccugaaaaaugugacacacuccugugugauauuggagaaucuucgccaaauccuacaguggaagcagguaggacucuacgagucuuaaaucucguggaaaauugguugaauaauaauacgcaauuuugcaucaagguccuuaauccauacaugcccagugucauagagaaaauggaagcucuacagagaaaauauggaggagcucuugugagaaauccccuaagcagaaauuccacucacgaaauguauuggguuaguaaugcauccggcaauauaguaaguucaguaaauaugauaagcagaaugcucauuaaccgguuuacaaugagacacaagaaagcaacauacgaaccggauguagaucucggaagugggacacgcaauauaggcauagaaagugagaccccuaaucuagacauaauaggaaaaaggauagagaaaauaaagcaggaacaugaaacaucauggcauuaugaucaagaucaucccuauaagacaugggcuuaucaugggagcuacgagacaaaacagacgggcuccgcaagcaguaugguuaauggaguuguaagacuguuaacgaaaccaugggauguaaucccuauggugacccaaauggcaaugacagauacuacgccuuucggacaacaaaggguuuucaaagaaaaaguagauacccgcacucaagaaccaaaagaagguaccaagaaacuuaugaaaauaaccgccgaauggcuuuggaaagaauuaggcaagaagaaaacgccccggauguguacacgcgaagaguuuacuagaaaaguacgcaguaaugccgcuuugggagcgauuuucacugacgaaaauaaauggaaaucagcuagagaagcaguggaagauaguggcuuuugggagcuaguugauaaggagcggaaccuucacuuggaagguaaaugcgaaacauguguauacaacaugaugggcaaaagggagaagaaauugggggaguucgggaaggcgaaagggucaagggcgauuugguauaugugguuaggagcgcgauuuuuagaauuugaagccuuaggguuccucaaugaagaccacugguuuagucgcgaaaauucucucucaggcguagaaggugagggacuacacaagcuaggguacauccuucgugacguaaguaagaaagagggcggagcaauguacgcagaugauacggcagggugggacacuaggauaacacuugaagaucuuaaaaacgaagaaaugguaacaaaucacauggaaggggaacauaaacgauuggcggaagcaaucuuucgccugacauaccagaauaaaguugugcggguacaacgcccaacaccgcguggaaccgucauggauauaauuucucgaagagaucaaagggggaguggacagguuguaacauacggacuaaacacuuuuaccaauauggaagcacaauuaaucagacaaauggaaggcgaagguguuuucaaaucuauacagcacuuaacaguaacugaagagauugcagucaaaaauugguuagcgcguguaggccgugaaagguuaucaagaauggcuauaucaggagacgacuguguaguaaagccccucgacgauagauuugcaucugcuuuaaccgcacucaaugauaugggaaaagugcgaaaagauauacaacaaugggaaccaagucgggguuggaacgauuggacucagguacccuucugcucacaucauuuucaugaauuaaucaugaaagauggacguguucucgucguuccauguagaaaucaagacgaauuaauaggcagggcccgcauaucccagggcgcagguuggucgcuuagagaaacagcaugcuuaggaaaaucguacgcgcaaauguggucccuuauguacuuccauagaagagacuuaaggcuagcagccaacgcaaucuguagugcagucccaagccauuggguaccuacaucucguaccacuuggucaauacaugccacucacgaguggaugacuacagaagauaugcuuacuguguggaaucggguauggauucaggaaaauccauggauggaagauaaaaccccaguagaauccugggaagaaauaccauaucuagggaaacgugaagaucaaugguguggaagucucauaggccuaacuagccgcgcuacuugggcgaaaaauauccaaacggccaucaaucaaguucguagucugauaggcaacgaagaauauacugacuauaugccaucuaugaaaagauucagacgagaagaggaagaggcuggaguucuuugguag

SEQ ID NO: 22862 - RNA, 9876 nt, Artificial Sequence
  derived and/or modified CDS sequence (opt6) from DENV-2__KC762678__SS-prME
accgcugguaucaucauaaugaugaucccuacugucauggcauuccaucuaacaacaaggaacggggagccacauaugauugugagcagacaagaaaaagguaaaagucuacuauuuaaaaccgagaaugggguuaauaugugcacauuaauggcgauggaccuaggugaguuaugugaagacacuauuacauacaauugcccgcuauuaagacagaacgagccggaagacauugacuguugguguaauagcacgucaacgugggugacguauggcacaugcacggcuacuggugagcaucgacgugagaaaaggagcguagcuuuaguaccacacguagguauggguuuggagacgcgaacagaaacauggaugucaucagaaggggccuggaaacaugcacagaggauagaaaccuggguccugaggcacccuggauucacgaucauggcagccauuuuagcauauaccauaggaacuaccuacuuucaaagaauucuaaucuuuaucuuacuuacugcaguuacaccaaguaugaccaugagaugcauaggaauaucaaaccgggauuucguugagggaguuagcggcggaucauggguagauaucguccucgaacaugguucguguguaacuaccauggcaaagaacaaacccacauuggacuuugaacuaauaaaaacagaagccaaacacccagcuacguugagaaaauauugcaucgaagcgaagcucaccaacacgacuacggcaagcagauguccaacacaaggagaacccaguuuaaaugaagaacaagacaaaagauuuguguguaaacacucaaugguagauagaggcuggggcaacgguugcggauuauucggaaaagggggaauaguuaccugugcuauguucaccugcaaaaaaaacauggaaggcaaaauuguccagccagaaaauuuagaauacacgauaguuauaacuccacacucgggcgaagaaaacgccgugggaaacgauacagguaaacacggaaaagaaaucaaagugacaccacaaucgucuauuacggaagcagaauugacggguuauggaacagucaccauggaauguucccccagaacaggccuagauuuuaacgaaaugguccucuuacagauggaaaauaaagcaugguuaguucaucgacaaugguuuuuagauuugccccuaccuugguugccaggagcugauacacaaggaagcaacuggauucaaaaggaaacauuaguuaccuucaagaacccacaugcaaaaaagcaagacgucguagucuuaggaagccaagagggcgcuaugcauaccgcacuuacgggggcgaccgaaauccaaaugucaucuggaaauuuauuguuuacgggccaccugaaaugucgucuaaggauggacaaguuacaacuuaaagguauguccuauucgauguguacaggcaaauucaaggucgugaaagaaauagcagaaacgcaacaugguacuauaguaauacgaguacaauaugaaggagauggaucuccuuguaagauacccuucgaaauaauggauuuagaaaaaagacauguacuagggagauuaauaacaguaaauccaaucguaacagagaaagacucuccuguuaauauagaggcugaaccaccauuuggcgauagcuauauuauaauaggaguugagccgggacaguuaaaauuaucaugguuuaaaaaagguucaucgauaggccagauguuugagacgaccaugcguggugcaaaaagaauggcuauauuaggagauaccgcuugggauuucgggaguuuagguggaguuuucacaaguauugggaaagcgcugcaucaaguauuuggggcaauuuauggggcagcauucaguggaguuucguggaccaugaaaauucuaauaggaguggucauaacauggauagguaugaacucaagaaguacgucacuuagugucucucuggucuuagucggaguuguaacgcuuuaucucggggugauggugcaagcggacuccggcuguguagugaguuggaaaaauaaggaauuaaaauguggcucaggaauuuucaucacggacaauguacauaccuggacagaacaauauaaauuccaacccgaaucuccaagcaaauuagcuuccgccauccaaaaagcucacgaagaaggaaucugugguauccgcucugugacaaggcuagaaaacuugauguggaaacaaauaacaccagaauugaaccauauacucagugaaaaugaaguaaaauugacgauaaugacuggagauauaaaaggcauaaugcaggcgggaaagagaagccuuagaccucaaccaaccgaacuaaaauauaguuggaaaacauggggaaaagcuaaaaugcuaucuacagaacugcauaaccauacuuucuuaauagacgggccagaaacagcagagugccccaaugcgaacagagccuggaacucauuagaaguagaagauuacggauucggcguauucacgaccaacauuugguuaaaauuaaaagaaaggcaagacgcuuucugcgacaguaaacuuauguccgcugccauaaaggauaaccgagcuguacaugcggacauggguuacuggauagaauccgcacucaacgacacauggaagauugaaaaggccuccuuuaucgaaguuaagucaugucauuggccgaaaucccacacguuauggucaaaugguguauuagagagugagaugauaauuccaaaaaauuuugcagguccaguaucucaacacaauuaccguccagguuaccacacucaaacagcaggcccauggcaucuagguagauuggaaauggauuuugauuuuugcgaagguacaacaguaguaguuacagaagauugcggcaauagagguccaucuuuaagaaccacuacagccucaggaaaguuaauuacugaaugguguugccguaguugcacauuaccaccguuaagauacaggggggaagacggguguugguauggaauggaaauaaggccuuuaaaggaaaaagaggaaaaccucguaaauucguugguuacggcaggucacggacaaauugacaacuuuagucuaggcguacuaggaauggcucucuuucucgaagaaaugcuucgaacgaggguugguacaaaacacgcgauccuccuaguagcaguguccuuuguaacuuugauuaccgguaacaugucuuuucgugacuuaggacgagucaugguuaugguaggcgcgaccaugacagacgacauugguauaggcgugaccuaucuagcacuuuuagcagcauuuaaaguaagaccaacauuugcggcaggccugcuguugaggaaauugacuucgaaagaguugaugaugacuacuauagguauaacguuacuuucacagucaacaauaccugaaacgauuuuagaauuaaccgaugcucuggcacuuggcaugaugguacucaaaauaguacgcaauauggaaaaguaccaguuagcaguuacuauaauggcaauccucuguguaccaaaugcagucauccuacaaaacgcauggaaaguauccugcaccacuuuagcugugguuagcguuucuccacuauuacucaccagcagccagcaaaaagccgauuggaucccuuuagcacuuaccaucaaagggcugaauccuacagcuauuuuccucacaacucuaucuagaacuuccaaaaaaaggaguuggccccuaaaugaagcgauuauggcaguagggaugguaagcauauuagcgagcucgcuacuaaaaaacgacaucccaaugacugggccucuaguagcaggcggucuauuaacuguguguuauguguuaacagguagaagugcugaucuugaauuggaaagagcagcggaugugcggugggaagaacaagcggaaauuucagggucuucaccaauccugucgauuacuauuucagaagaugggagcaugagcauaaagaaugaagaagaggaacaaacacuaacaauccuaauaaggacaggacuucuuguaauuagcggauuguuuccaguuaguauuccgauaaccgcagcagcaugguauuugugggaagucaaaaaacaaagagcuggagucuugugggaugucccaagucccccaccaguagguaaagcugaguuagaggauggcgcguacagaauaaaacagaaaggcauacuggguuacagucagauaggcgcuggggucuauaaagaaggaacguuucauaccauguggcaugucacaaggggugcuguacuaaugcacaagggcaaaaggauugaaccaucuugggccgacguaaaaaaagauuugauuucuuacggcggcggauggaaauuagaaggagaguggaaagagggagaggaagugcaaguuuuggcauuagaaccaggcaaaaauccccgagcgguacagacuaaacccggucucuucaaaacuaguacuggcacaauaggggcgguuagcuuagacuucucaccgggaacaucagguagcccaauugucgauaagaaggggaaagucguaggcuuauaugguaacgggguugugaccaggagugguacauacguaagcgccauugcucaaacggaaaaaucuauagaggauaacccagagauugaggacgauauauuuagaaaaaaacggcuuacaaucauggaucuacaucccggagcuggaaagaccaaacgauauuuaccagcuauaguccgugaagcaauaaaaagaggauuaagaacauuaauacuugcaccaacgaggguaguugcugcugaaauggaagaagcacuacgcggccugccaauuagauaucaaacaccugcuauaagagcugaacauacagguagagaaauaguagauuuaaugugccacgcaacauuuacaaugcgauuacugucacccauaagagucccaaauuacaauuuaauuauaauggacgaggcucacuuuacugacccugcuucaauugcagcucgugguuauauuuccacgcgaguugaaaugggugaagcugcgggcauauuuaugaccgcuacaccucccgguucaagagauccauuuccacaauccaaugcuccaauaauggacgaggaacgugaaauaccggaaagaaguuggaacucaggacacgagugggugacugacuucaaaggaaagacagugugguuuguccccucaauaaaggccgggaaugacaucgcagcuugccuaaggaaaaacggaaagaaagucauucaacugucuagaaaaacauucgauagugaauacaucaaaacaagaaccaaugacugggacuuuguuguaacuacagauauaucagaaaugggggcuaacuucaaggcagaaagagucauugauccaagaagaugcaugaagccaguaauuuugaccgacggugaagaaagaguaauccuugcgggaccgaugccagugacgcauucguccgcggcacagagacgaggacggguagggcgcaacccaaaaaaugagaacgaucaauacaucuauaugggagaaccacuagagaacgacgaagacugugcgcauuggaaagaagcgaaaauguuacucgacaauauaaacacaccagaagguauaauccccuccauguucgaaccugagcgagaaaaagucgacgcaaucgauggcgaauaccgguuaagaggagaagcaaggaaaacauuuguagacuuaaugagacgaggugacuuacccgucuggcuugcuuacaggguggccgcggaagguauaaauuacgcagacagaagaugguguuucgacggcguaaaaaacaaucaaauucuggaagaaaacguagaaguagagauuuggacaaaggagggcgaaagaaaaaaauugaaaccccgguggcuggaugcacggauuuauucugauccucuggcgcucaaggaauucaaagaauuugcugcgggucgaaaaaguuuaacucuuaaccuaauaaccgaaaugggucgguuaccaaccuucaugacacaaaagguaagaaacgcgcuagauaaccucgcaguucugcauacagcggaagcgggagggcgagccuauaaucaugcgcuuagcgaacuuccugaaacacuagagacccuucuauuacuuacauuacucgccacgguuacaggaggaaucuuuuuguuucucaugucgggaaaaggaguaggaaagaugacgcuuggaauguguugcauaaucacugcaucuauacuacucugguaugcccaaauccaaccucauuggauugcggcgagcauuaucuuagaauucuuuuuaauaguacuguugaucccugaaccagaaaaacaacggacaccacaagacaaucaauuaaccuauguggucauugcaauccuaacaguugucgcggcuacaauggcuaaugagauggguuuuuuagaaaaaacuaaaaaagauuuuggacuuggguccaucacaacucaacagccugaaucuaauauacuggacauagaucuucgaccugccagcgcauggacgcuauaugcgguugcgacuacauuuauaacgcccauguugaggcauaguaucgagaauucuagugucaacguaucguuaacggcuauagcgaaccaggcaacuguuuugauggguuugggaaaaggauggccucucucaaagauggacauaggaguuccccuguuggcuauagguugcuauucucaaguuaacccaauaacauuaacagcugcauuauuauuacuuguggcacacuaugcgauaauaggaccaggucuacaggcgaaagcuaccagagaagcccaaaaacgaacagcggcagggauaaugaagaauccaaccgucgaugguaucacugugauagacuuagacccaaucccuuaugaucccaaauuugaaaaacaauugggccaagucauguuacucgugcuauguguaacacaaguacuaaugaugcguacaacuugggcuuuaugcgaggcacuaacucuugcaacuggaccaauaucuacgcuaugggagggaaauccagggcgauuuuggaauacaaccauagcuguuuccauggcaaacauuuuccgugguucauacuuagcuggagccgguuuacuuuuuucaauaaugaaaaauacggcuaauacaagaagagguacugguaacaccggagaaacauugggcgaaaaguggaagaaucgauuaaaugcuuuaggcaaaagcgaauuccagauauacaagaagucuggcauccaagagguugaccgaacauuagcaaaagagggaauuaaacgcggggaaacagaucaccacgcuguaucaaggggcagugcgaaacugaggugguucguagaaaggaacuugguaacuccagaaggaaaaguaguggauuuaggcugugggagaggcggguggaguuauuacugcggaggauuaaaaaacgucaaagaagugaaaggauuaacuaaggggggaccaggucaugaagaaccaauaccuaugucgacuuaugguuggaacuuaguaaggcuucaaucuggcguagacgucuuuuucacccccccagagaaaugugacaccuugcuaugugauauuggagagagcucaccaaacccaacugucgaggcaggacgaacuuuaagaguacuuaaucuggucgaaaauugguuaaauaacaauacacaauuuugcaucaaagucuugaguccuuacaugccaagcguaaucgagaaaauggaagcacuacagagaaaauauggaggugcacuaguacguaauccacucagccggaacagcacacacgaaauguauugggucaguaacgcaucggguaacauagucucaagugucaacaugauuucgagaaugcuuauaaacagauucacuaugagacauaaaaaagcaacuuacgaaccagauguggaucugggaagugggaccaggaacaucggaauugaaucggaaacgccuaacuuagacauaauugggaagagaauagaaaaaauaaagcaggaacaugaaacaucuuggcauuacgaccaagaccauccauauaaaacaugggcauaccauggguccuaugagacaaagcagacaggauccgcuucuucgauggugaauggcgugguaagauuacuaacaaagccuugggacgucaucccaaugguaacacagauggcaaugacggauacaacgccauuuggacagcaacgaguauucaaggagaagguggauacacggacucaagaaccaaaggaaggaaccaaaaaacuaaugaaaaucacagcugagugguuauggaaagaacuagguaaaaaaaaaacaccuaggaugugcacuagagaggaguucaccaggaagguaagaucaaaugccgcuuuaggugcaauauuuacugaugaaaauaaauggaagagcgcgcgugaagcaguggaagauuccggauuuugggaauuaguggauaaagaacgaaaccuacaccuagaagguaaaugcgaaaccugcgucuacaauaugaugggaaaacgagaaaaaaaauuaggagaauuugggaaagcgaagggaucgcgggcuauaugguacaugugguuaggagcgcgauuccuagaauucgaagcauuaggauuuuuaaacgaggaucacugguuuucacgcgaaaacagccucuccggcguagaaggugaaggauugcacaaacucgguuauauacuaagagacgucagcaaaaaagaaggaggcgcaauguaugcugacgauacggcugguugggauacccgaauuacguuagaggacuugaagaacgaagaaauggucacuaaucauauggaaggcgagcacaaaaaauuggcggaagcuauauucaaacugaccuaucaaaacaagguaguacgaguucaacgaccgaccccgcgcggaaccguuauggacauaauaaguaggagagaucaaagagggagcggccaaguagucacuuacggucuuaauacuuucacuaauauggaagcacagcugauacgucaaauggagggagaagguguguuuaagucuauacaacaauuaacuguuacagaagaaauagcagucaaaaacugguuagucacgguaggacgagagagguugucucguauggccauaucuggagaugacugugugguaaagccguuagaugauagguuugcaagcgcccuaacagcacuaaaugacauggggaaagugcggaaggacauacaacaaugggaaccaucuagaggauggaacgacuggacacaaguacccuuuugcucgcaucauuuccaugaauuaauaaugaaagauggccgugugcuuguaguaccgugucguaaccaagacgaauugauuggccgcgcgcgcauaagucaaggagcagguuggucacugcgcgaaaccgcaugcuuagguaagucauaugcucaaauguggagucuaauguacuuccaucguagagaccuuagacuagcagcaaacgcuauauguagcgcaguuccuucgcacuggguacccacaaguagaacaacuugguccauacacgcaacucaugaauggaugacuacagaagauauguuaacuguuuggaauagggucuggauccaagagaacccuuggauggaagacaaaacuccaguugaaucaugggaagaaauacccuaccuuggcaaacgagaagaucaaugguguggaucauuaauaggcuuaaccucacgggcaacaugggcaaaaaacauacaaacggcaauuaaucagguuagaucauugauaggcaacgaggaauacaccgacuauaugccgaguaugaaaagauucagaagagaagaagaagaagcaggaguacuuugguaa

SEQ ID NO: 22863 - RNA, 9876 nt, Artificial Sequence
  derived and/or modified CDS sequence (opt6) from DENV-2__KC762679__SS-prME
accgcaggaauuauaauaaugaugauaccuacaguaauggcuuuccacuuaacuacgagaaauggggaaccacauaugauaguuagcagacaagaaaaaggaaaaaguuuacuauuuaaaaccgaaaauggaguuaacauguguacauuaauggccauggacuuaggagaauugugugaagacacgauaacauacaacugcccacuucucaggcaaaaugaaccagaagacauugauuguuggugcaauucaacgaguacuuggguaacuuauggaacauguacagcaacgggagaacacagacgagagaaacgaagcguugccuuaguuccucauguaggaauggguuuagaaacacgaacagaaaccuggaugucuucagaaggagcauggaaacacgcacaacgaauagaaacuuggguacuuaggcacccuggguucaccauuauggcggcuauccuggcauauacaaucggaacgacuuauuuccagagaguacucaucuuuauacuccuaaccgcaguagcaccgucgaugacgaugagaugcauaggaauuagcaauagagauuucguagaagggguguccggugguagcuggguggauauaguccuugaacauggaagcugcguaacgacgauggcuaaaaauaaaccaacauuggauuucgaauuaauuaaaacggaggccaaacauccggccaccuuacgaaaauauuguauagaagcaaaguuaacaaacacuacaaccgcgucuagauguccgacucagggugagccaucucugaaugaagaacaagacaaaagauuuguauguaaacauucaaugguagaucggggguggggaaauggguguggacuauuuggaaagggagguauaguaacaugcgcuauguuuacaugcaagaaaaauauggaaggaaagauaguccaaccugagaaucuagaauauaccauagucaucacuccccauagcggugaagagaaugcaguaggaaaugacacugggaaacauggcaaagaaauuaaagugacuccacaaucaucaauuacagaggcagaauuaacaggauacggaacaguuacuauggagugcucaccacguacagggcuagauuuuaaugaaaugguauuguugcaaauggagaauaaagcaugguugguucaucgucagugguuucucgaccucccauugccauggcuaccaggagcagacacucagggaagcaacuggauucaaaaagaaacccuaguaacuuuuaaaaauccgcaugccaagaaacaggacgucgugguccuaggaucgcaagaaggugccaugcauacugcguugacaggugcaaccgagauccaaaugagcucugggaacuuacuauuuaccgggcaccuuaaaugcagacugagaauggacaaauuacaauuaaaaggaaugucuuauaguaugugcaccggaaaauucaagguagugaaagaaaucgcugagacacagcauggaacgauuguaauccguguacaauacgagggugaugguucaccaugcaaaaucccauucgaaaucauggaucuagagaagagauacguuuugggacgucuuauuaccguuaauccgauugugaccgaaaaggauucacccguaaacauagaggcagaaccaccuuuuggcgacucauauaucaucauaggcguagaaccuggacaauuaaaacuaaacugguuuaagaaaggcagcaguaucggacagauguuugaaaccacaaugagaggagcuaaaagaauggcaauacuuggagauaccgccugggacuuuggaucguuaggcggcguuuucacaucuauaggaaaggcacuacaucaaguguucggugcaauuuauggagccgcguucucuggaguuucuuggacuaugaaaauucugauagguguuguaaucacguggaucggaaugaacucgcgauccacaagccucucagucucauuaguccuaguaggaguagugacacuauaccuaggcgucaugguacaggcggacagcgguugcguugugucguggaaaaacaaagaauugaaaugugguuccggcauauucauaacagacaacguucauacauggacggagcaauauaaguuucaacccgaaucuccaagcaaacuggccucugcaauucagaaagcacacgaagaagguauaugugguauaagaaguguaacaagguuagaaaaccuaauguggaaacaaauuacgcccgaacuaaaucacauauuaucagaaaacgaaguaaaguugacaauuaugacuggagauauaaaaggcaucaugcaagccggcaaacgcuccuuaaggccacaaccaacagaauuaaaauauucuuggaaggcauggggcaaagcgaaaauguuaaguacagaauuacacaaccauaccuucuugauagauggaccugaaacugcagaaugccccaacacgaauagagcauggaacucuuuagaaguugaagauuacggguucgggguguucacuacuaacauauggcuaaaacucaaagaacgacaagauguguucugugacucgaaacuuaugagugccgcaauaaaagauagccgcgcaguacaugcagacaugggcuauuggauagaaagcgcacucaaugacacuuggaaaauagaaaaagcaaguuuuauagaaguaaagaguugucauuggccgaaaucacauacucucuggucaaauggaguuuuagaaucagaaaugauaauaccgaaaaauuuugcaggacccgugucacaacauaacuacaggcccggauaccauacacagacagcaggcccauggcaucuaggucgauuagaaauggauuuugauuuuugugaagguacuacaguagucgugacagaagauugcggaaauagagggccgagucuuagaacaacuaccgcgaguggaaagcugauaacggaauggugcuguagaucaugcacacucccaccauuaagauaucguggggaagauggauguugguacggcauggaaauuagaccauuaaaagaaaaagaagaaaaucuuguuaauagucuaguaacagcgggucacggacagauugacaacuuuucacucgguguuuuagggauggcucuguuuuuagaagaaaugcuacggacuaggguaggaacaaaacaugccauucuguuaguagcuguuucauuuguuacacuaauaacugguaacaugaguuuccgugaccuuggaaggguuaugguaaugguuggcgcaacuaugacagacgauaucgggaugggaguaacuuauuuagccuugcuagcagcuuuuaaaguacgaccuacauucgcagcaggccuccucuuaagaaagcuaacuagcaaagaacuaaugaugacaacuauagggaucgugcuuuuaucccaggcuaccauaccagagacgauucuugaacugacagaugcgcuagcacuaggcaugaugguccuaaaaauaguaagaaauauggaaaaauaccaauuggcagucacgauuauggcgauccuuuguguuccuaaugcgguaauacuccagaaugcauggaaggucagcuguacaacauuggcuguaguaucaguuucaccgcuacuacuaacaucgagccaacaaaaagcggacuggauuccucuagcauuaacgauaaaaggauuaaauccaacagcaauuuuccugacaacgcucagucguacauccaaaaagagauccuggccacucaaugaggccaucauggccguuggaaugguauccauccuagcgagcucauuauugaagaacgacauuccaaugacagguccuuuagucgcaggggguuugcugacggugugcuacguucugacaggacggagugcagaccuagaauuggagagagcugcggauguacgaugggaagaacaggcugaaauuagugggucgucaccaauacucagcauaacaaucagugaagauggaucgaugaguauuaaaaacgaagaagaggaacaaacgcucacgauacuaaucaggacgggucuccuuguuaucucuggacuauuuccugucucgauuccaauuacagccgccgcuugguauuuaugggagguaaagaaacagagagcaggcguacugugggauguuccaaguccgccaccaguaggcaaagcugaacuugaagacggcgcguacagaauaaaacaaaaaggcaucuuagguuacucccaaaucggagccggagucuacaaagaaggcacuuuccacacaauguggcauguaacuaggggagccguguuaaugcauaaagggaaacgaaucgaaccaagcugggcagauguuaagaaagacuuaauuaguuacggaggaggcuggaaacuugagggugaauggaaagagggugaagaaguacaggugcuugcguuagaaccagggaaaaacccacgagccguucagacaaaaccaggacuauuuaagaccaauacgggaaccaucggggcggucucucuagauuuuucaccuggaacaaguggcuccccaaucguggacaagaaaggcaaaguaguuggauuauauggaaauggugugguaacgagaucugggacauaugucuccgccauagcucaaaccgagaaaagcauugaagacaauccagaaaucgaggacgacauauuccgaaagaaacgauugacaauaauggaccuucacccuggagcagguaaaacaaaaagguaucuaccugcaauaguacgggaagcaauaaaaaggggucuaagaacgcuuauacuggcgccgacaagaguuguugcagcggaaauggaagaggcccuaaggggacucccuauccgauaucaaacuccggcaauacgugcagagcacacaggaagagaaauuguagauuugaugugccacgcgacuuucaccaugagacucuuaucucccauaagagugccuaauuauaaucuaauaaucauggaugaagcacauuuuacggauccagcuucaauugcagcaagaggcuauaucagcacucguguggaaaugggcgaggcggcagguaucuucaugacagccacaccaccagggucccgugacccguucccucagagcaacgcaccaauaauggaugaggaaagagaaauaccugaaagaucuuggaacucaggucacgaaugggucacugauuucaagggaaaaacagucugguuuguaccaucaauuaaagcuggaaaugauauagcagccuguuugaggaaaaaugggaagaaaguaauacagcuaucaagaaaaacauucgauucagaauauauaaaaacacgcacgaaugacugggacuuugucgugacaacagacauaucagaaaugggcgcuaacuuuaaagcugaaagggucauagauccaaggagauguaugaaaccugucauauuaacagauggagaagaacgaguuaucuuggcuggcccuaugccuguuacacacucaucugcagcacaaaggagaggacguguaggacggaacccuaaaaacgaaaaugaucaauauauauacaugggagagccccuugaaaaugaugaagacugcgcccauuggaaagaggcuaaaauguuauuggacaauauaaacacaccagaagguauuauccccucuauguucgaaccagaaagagaaaaaguggaugccauagacggcgaauauagacuaagaggugaggcaagaaaaacuuuuguggaccucaugcggaggggugacuugccuguuugguuagcauauagaguugcggcagaaggaaucaacuacgccgaccgcagaugguguuuugacggugugaaaaacaaccaaauauuggaagagaauguagaaguagaaauauggacuaaagaaggagagcgaaagaaacucaagccaagaugguuggaugcaaggaucuacagugacccacuagcacugaaggaguucaaggaguuugccgcuggaaggaaaucauuaacauugaaucuaauaacugagauggguagauuaccaacuuuuaugacccaaaaggcgcgaaaugcacuggauaaucuggcaguauuacauaccgcagaggcgggaggccgagcguacaaucaugcacuuagcgaacucccagaaacacucgaaacauugcuguugcuaacacuacuugcaacgguuacaggagguauauuucuauuucucauguccggaaaagggauuggcaaaaugaccuugggaauguguuguauaauaacugcaucaauacuguuaugguaugcucaaauacaaccgcacuggaucgcggcaucaaucauauuagaguuuuuccugaucguucuucucauaccugaacccgagaaacaaaggacaccucaggauaaucaacuuacuuauguaguaauagccauacugaccgugguagcagcaaccauggccaaugaaaugggauuuuuggagaaaacgaagaaagacuucggcuuaggaaguauaacaacccaacaaccagaaucuaacauuuuagauauagaucuaagaccugccucagccuggacgcuauaugccguugcgacgacauucauaacgccgaugcugagacauaguauugaaaacaguucgguaaauguaucacuaacggcaauugcaaaucaagcuaccguauuaaugggguuaggaaaaggauggccguuaagcaagauggacaucgguguaccucuucucgcuauaggcugcuacagucaagugaauccaauaacauuaacagcugccuugcugcuauuaguagcgcauuaugccaucauagguccaggucuccaagcgaaagcaaccagagaagcgcaaaaacgagcagcugcaggcaucaugaaaaauccuaccguagacgguauaacggugauagacuuggauccuaucccauacgauccaaaguuugaaaaacaguuaggccaaguuaugcuccuuguucuuuguguuacccaggugcugaugaugaggacaacaugggcacuaugcgaagcguuaacccuagcaaccggaccaauuaguaccuugugggaaggcaauccuggaagauuuuggaacacgacaauagccgugucaauggcgaauaucuuucgaggaucuuaucuagcuggggcuggcuuauuauucucgauaaugaaaaauacagccaacacccggcggggaacugguaauacuggcgaaacacuuggagaaaaguggaaaaacagacuuaaugcucuggggaaaucagaguuucagauauacaaaaagucaggcauucaagaaguggauaggacguuagcaaaggaagggauuaaacgaggagaaacggaucaccaugcugugucaagaggaucugccaaacuuaggugguuuguagaaaggaauuuggucacuccagagggaaaagucgucgacuugggcuguggucgaggaggcuggagcuacuauuguggcggacuuaagaacguaaaagagguaaaaggacuaacgaaaggaggacccgggcacgaagaaccgauucccauguccacuuaugguuggaaccuaguacgcuugcaaagugggguagacguuuucuuuacaccacccgaaaaaugcgauacauuauugugugauauaggugaaucaucccccaauccaaccguagaagcaggcagaacauuacgagucuuaaaucuagucgagaacuggcuuaacaauaacacacaguuuuguauuaaaguacuuaacccauacaugccauccguuauugaaaagauggaagcccuacaaagaaaauacggcggugcucuaguucgaaacccauuaaguaggaacucuacucaugagauguacuggguuagcaaugcaaguggaaauauaguuagcucaguuaacaugauaucaaggauguugauaaauagauuuacuaugcggcacaagaaagcuacguacgaaccagacguggauuuaggcagcggaacgagaaauauaggaaucgaauccgagacgcccaauuuagauaucaucggaaagcguauagagaaaauuaaacaagaacacgaaacuagcuggcauuaugaucaagaccacccauauaaaacgugggccuaccacggaagcuaugaaacaaaacaaacuggaagugcaagcucaauggucaauggaguaguaagauuguuaacgaagccaugggacguuauaccaaugguaacgcaaauggcuaugacugauacaacucccuucggccaacaacgagucuuuaaggaaaaaguggauacucgaacccaggaaccgaaagaagguacuaagaaauuaaugaaaauaacagcagaauggcuguggaaagaacuuggcaagaagaaaacuccuagaaugugcacccgagaagaauuuacccgaaaaguacggagcaaugcagcucuaggugcuauauuuacugaugaaaauaaauggaaauccgcgagagaggcaguugaagacagcggguuuugggagcuaguagauaaggagaggaauuuacauuuagaagguaaaugugaaaccuguguuuauaacaugaugggaaaacgagagaagaaauuaggagaauuuggcaaagcaaaagguucccgcgcuauuugguacauguggcucggugcaagauuuuuagaguuugaagcacuuggguuuuugaaugaagaucauugguucucuagagaaaauucacuaucgggaguagaaggugaaggacuccauaaacugggauacauauuacgggacgucaguaugaaagagggaggagccauguaugccgaugauacggcaggaugggauacacguauuacacuagaagauuuaaagaaugaagagaugguaaccaaucauauggaaggagaacauaagaaauuggcagaagcaauuuucaaguugacauaucaaaauaaaguaguacguguacaaaggccaacgccacgugguacaguuauggauauuauaucacgccgugaucagcguggcaguggccaaguuguaaccuaugggcuaaauacuuuuacaaauauggaagcgcaauuaauuaggcaaauggagggagaaggaguuuucaagucgauccaacaguuaacagucacggaggaaauugcugugaagaauugguuagucagaguaggaagggaacgauuaagucggauggcaauuaguggcgaugauuguguuguaaagccacuugaugaucgauuugcuagugcacuaacagcgcucaacgauaugggaaaaguccguaaggacauacaacaaugggaaccuagucgagguuggaaugacuggacacagguacccuucugcucucaucauuuucacgaauuaauuaugaaagauggaagaguacugguaguaccaugcagaaaucaagaugagcucaucggcagagcaagaaucucucagggagcugguuggucacuaagagagacggcaugucuaggaaaauccuaugcucaaauguggagucuuauguacuuccaccguagagauuuacgauuagcagcaaaugcaauaugcagcgcgguuccuucacauugggugccuacgucacgaacgacauggucgauucacgcaacccacgaauggaugacgacugaagauaugcuaacagucuggaauagaguuuggauucaagagaauccguggauggaagauaaaacaccaguagaaucaugggaagaaaucccauauuuaggcaaacgugaggaucaauggugugggagucuuauaggcuuaacaagccgagccacaugggcgaagaauauucaaacggcaauaaaccaaguuaggagucuaauugggaaugaagaauacaccgacuacaugccaaguaugaaaagguuucgacgggaagaagaagaagcugguguuuuaugguaa

SEQ ID NO: 22864 - RNA, 9876 nt, Artificial Sequence
  derived and/or modified CDS sequence (opt6) from DENV-2__KC762680__SS-prME
acagcaggcauaauaauuaugaugauuccuacggugauggcauuccaucuaacgacucgaaacggggaaccgcauaugauaguuucaagacaagaaaaaggaaaaucauuguuguuuaaaacagaaaaugggguaaacaugugcacacuaauggcaauggacuuaggcgaacuuugcgaagauacaauuacuuauaacuguccacuacuaagacagaaugaaccugaagacauagacuguugguguaauucuacaaguaccuggguaaccuauggaacguguacggcuacaggagaacauagaagggagaaacgaucaguagcccuaguuccgcauguugguaugggauuagaaacccgaacagaaacauggaugucuucugaaggggcauggaaacacgcucagaggauagaaacauggguucuacgacacccuggauuuacaauuauggcagcaauacuagcauacacuauugggacaacauauuuucagagaguacuuauauuuauauuauugacugcuguagcaccuucgaugacuaugaggugcauuggaauuucgaauagggacuuuguagaggggguaagugggggcaguuggguagacauagugcucgaacaugguucauguguaacuacuauggccaaaaauaaaccuacacuugauuuugaauugauaaaaacagaggcuaaacacccagcgacccuaagaaaauauuguauagaagcaaaacuaacaaauacaacaacagcaucaagguguccuacacaaggggaacccaguuuaaacgaagaacaggauaaaagauuuguguguaaacacaguauggucgaucgaggauggggaaacggaugcggcuuauuugggaaaggagggaucguaacaugugcaauguucacuuguaagaaaaauauggaaggaaaaaucguacaacccgagaaccuugaauauacaauaguuaucacaccucacagcggagaagaaaaugcuguaggaaaugauacaggaaaacaugguaaagaaauaaaaguaaccccgcaaucauccaucacggaagcugaacucacgggauaugggacaguaaccauggagugcaguccucgaacugguuuagauuucaaugagaugguccuguugcagauggaaaacaaagcaugguugguacauagacaaugguucuuagauuuaccauuaccauggcuccccggagcagauacccaggggaguaacuggauucagaaagaaacccuaguaacuuuuaaaaacccgcaugcuaagaaacaagauguaguaguauuggggagccaagaaggagcuaugcauacagcacuaacgggagcgacugaaauucagaugaguucuggaaacuuauuauucacaggucaucucaaaugucgacuccguauggauaaacuucaauuaaaaggaaugucuuauucaauguguacagggaaauuuaaaguugugaaagagauagcggaaacgcaacauggcaccauaguuauucgcguacaauaugaaggugacggaaguccaugcaaaauuccauucgagaucauggauuuagaaaagcgauacguccugggacgucuaaucacaguaaauccaauagucacugaaaaagauucccccgugaauauagaagcagaaccaccuuuuggagacaguuacauuauuauagguguagaacccggccaauuaaaauuaaauugguucaagaaagguagcucuauuggacagauguuugaaacaaccaugagaggagcuaaaagaauggcaauacuaggugauacagcgugggacuucgguagcuuaggaggggucuucacaagcauagguaaagcauuacaucaagucuuuggggcgauauacggugcagcauucagcggaguaucuuggaccaugaaaauucuaaucggagucguaauaacauggauagggaugaauagccggucuacuagccuaucaguuucacuuguacucguagguguaguaacacuguaucuaggugugaugguacaagcagauagcgguuguguaguaucuuggaaaaauaaagaacuuaaauguggcaguggaauauuuauaacagacaacguccauacuuggacugagcaauauaaauuccaaccggagucccccagcaaguuagcaucugcuauacaaaaagcucaugaagaggggauaugugggauaagaagcgugaccagacuagaaaauuugauguggaaacaaauaacuccggaauugaaucacauccuaucagagaacgaagucaagcucaccauaaugacaggagacauaaaggggauaaugcaggcggguaagcggucccuacgaccacaaccaaccgagcuuaaguauucuuggaaggcuuggggaaaagcaaagaugcuaaguacggagcuacacaaucacaccuuccuuauugacggaccagagacugcagaguguccaaacacgaaucgagcuuggaauaguuuggagguagaggacuaugguuucggugucuuuacaaccaacauuugguugaaauuaaaggaacgucaggacguauucugcgauuccaaacuuaugucagcagcgaucaaagauuccagagcuguacaugcagauaugggguauuggauugaauccgcucuuaacgauacauggaaaaucgagaaggcaaguuucauugaagucaaauccugucacuggccaaaaucacauacauuauggucaaacggaguacuagaaucggagaugauuaucccgaagaauuuugcugguccuguuucgcaacauaacuauaggccaggguaucauacccagacagcuggaccauggcaccuuggaagacuagaaauggauuucgauuuuugugagggaacuaccguuguaguaacagaagacugcggcaaucgaggccccucuuuacguacuacuacagcgucaggaaaauugauaacugaguggugcugucggaguuguacuuugcccccauugagauauagaggggaggaugggugcugguauggaauggaaauuagaccacugaaagaaaaagaagaaaacuuagucaauucauuaguaacggcaggacacggacaaauugauaacuucucacuuggaguguuggguauggcacuuuuucuugaagaaauguuaaggacacgagugggcacaaagcaugcgauacuuuuaguagcaguaaguuucgugacccucauaacaggaaauaugucauuccgagacuuaggaagaguaauggucaugguaggagcaacuaugacggaugacauugggauggggguaaccuaucuggcucuauuggcugcguuuaaaguaagaccgacauuugcggcuggucuuuuauugaggaaacuaacaucaaaagaacugaugaugacgacgauugguauaguuuuguugucacaagcaacuaucccagagacuaucuuagaauuaacagacgccuuggccuuaggaaugaugguguuaaagauuguacgaaacauggagaaauaccaacucgcaguuacuauaauggcuauccuguguguaccuaaugccguuauucuacagaacgcuuggaagguaagcugcaccacauuagcaguuguuucuguauccccauugcuacuaacaagcucacaacaaaaagcagauuggauuccccuagcacuaaccauaaagggacugaacccaacggcgauauuuuuaacuacuuugagcagaacuuccaagaaaagaucauggccacuuaaugaagcaaucauggcaguuggaaugguauccauauuagcuucgucccugcuuaagaaugacauuccgaugacuggucccuuaguugcugguggacuacuuacaguaugcuauguacuaacagguaggucggcagaccucgaacuggagagggcagccgauguacgaugggaggaacaagcggagauaucugggucaucaccgauauuaaguauaacaauaagcgaagaugggucuaugaguaucaaaaaugaagaggaagaacaaacguuaacaauccuaauucgaacugguuugcugguaauaaguggguuauuuccggucucaauaccuauaacagcagcggccugguaucucugggaaguuaaaaagcaaagagccgguguccuaugggacguuccuucacccccuccuguagggaaagcagagcuggaagauggugcauauaggaucaaacaaaaaggcauucuaggauauagccaaauuggagcaggaguuuacaaagaagguacuuuccauacgauguggcauguaacaagaggagcuguguuaaugcacaagggcaaaagaauagaacccagcugggcggacguuaagaaagaccuaauuucuuauggagguggguggaaacuagaaggugaguggaaagaaggugaagagguacaaguucucgcucuagaaccuggcaaaaacccaagagccguccaaacaaaacccgggcuauuuaaaacuaauacgggcacuauaggagccguuucauuagacuuuucacccggaacgagcggaaguccuaucguagacaaaaaggggaagguaguuggauuguacggcaaugguguuguuacacgcucaggaacguaugucucugcaauagcucagaccgagaaaaguauagaagauaauccggaaauagaggacgauauuuucagaaagaaaaggcuaaccauaauggaccuacacccaggagcuggaaaaacaaaaagauaucugccagcgauaguuagggaagcgauaaagcgcgggcuucgaacacuuaucuuggcaccaacaagaguuguugcggcagaaauggaggaagcauuaaggggucuccccaucagguaucaaacaccagcuauucgggcugaacacaccggcagagagauuguggauuugaugugccacgcgacauuuacaaugagauuacuaucaccgauacggguucccaauuauaaucuuaucauaauggaugaagcccauuucacugauccggcaagcauagcagcacgaggcuauaucaguacucgcguggagaugggagaggcggcggggauauuuaugacagcaaccccgccagguucaagagacccauucccgcaaaguaaugcaccaauaauggacgaagaacgcgaaauaccugaaagaucauggaacucaggccaugaaugggucacagauuucaaagggaaaacuguaugguucguaccaucuauuaaagcugggaaugauauagcagcauguuuaagaaagaacgggaagaaagucauacaauuaagucgaaaaacauucgauuucgaguacauaaaaacucgaacaaaugauugggauuucgugguaacuacugauauuagcgaaaugggugcuaauuuuaaagcagagagaguaauagacccucgaagguguaugaaacccguaauacuaaccgauggcgaggagcgagucaucuuggcugguccuaugccgguaacucauucuagugcugcccaaaggcgugggagggugggaaggaacccgaaaaacgaaaaugaucaauauauauauaugggagaaccucuggagaacgaugaagacugugcacacuggaaagaagcgaaaaugcuuuuagacaauauaaauaccccagaaggaauuauaccaucuauguucgaacccgaacgggaaaaagucgaugcaauagacggagaauaucgccucagaggggaagcaagaaaaacuuuuguagacuuaaugcgacguggagacuugccuguauggcuagcguacagaguugcagccgaaggcauaaauuaugcagauagaaggugguguuucgauggaguaaagaauaaucaaauauuagaggaaaauguugaagucgaaaucuggacaaaggagggugaacgaaagaaacuaaaaccaagauggcuagaugcuagaauauacagugauccacuagccuuaaaggaguucaaagaauuugcagcagggagaaaaucuuuaacacuaaaccucauaacugaaauggggagacuuccgacauucaugacucaaaaagcaagaaacgcauuagacaacuuagcaguacuucacacggcugaagccgguggccgcgcguacaaucaugcgcuuucggaacuaccggaaacgcucgaaacauugcuacuuuuaaccuuacuagcaacuguaaccggggguauauuuuuauuucugaugagugguaaaggaaucggaaaaaugacacuugguauguguugcaucauaacugcaaguauauuacuuugguaugcacaaauacaaccacauuggauagcggcaucaauuauacuugaguucuuucuaauuguacuucuaauuccugaaccggaaaaacagagaacaccacaggacaaccagcuaacauacguaguaaucgcuauuuugacgguaguggcagcaacaauggccaaugaaaugggguuucuagagaaaaccaagaaagacuuugggcucggaaguauaacgacgcaacagcccgaaagcaauauuuuagauauagauuugcgcccugccagcgccuggacauuauaugcugucgcaacgacauucaucacccccaugcuucgacauucaauagaaaacucuucaguaaacguaagucucaccgcuauagcuaaccaagccacuguauuaaugggguuaggaaaaggcuggccucuauccaaaauggauauaggcguuccauuauuagcuauugggugcuacucucaaguuaauccuauaacccugacagcugcguugcuccuguuaguagcacacuaugcaaucaucgggccggguuuacaggcuaaagcaacucgcgaagcucagaagcgugcggcugcuggcaucaugaaaaacccgacgguagacgguauuacugucaucgaccucgacccgauaccuuaugauccuaaauuugaaaaacaauuaggucagguaaugcuucuagucuuauguguuacucaggugcugaugaugcgaacaacaugggcuuuaugcgaggcgcuaacacuagccaccggacccauuucaacacuaugggaaggaaauccuggaagauucuggaacaccaccauugccguaaguauggcgaauauauucagaggcucauauuuagcuggugccggacuucucuuuaguaucaugaaaaauacugcaaauaccagacgugggacagguaauaccggagagacguuaggugagaaauggaaaaaccgcuugaacgcucuagguaaaucagaguuccaaauuuacaagaagaguggaauacaagaagucgaucguacauuagcaaaagaaggaauaaaacgaggcgaaacggaccaucaugcaguaaguagagggagcgccaaacuacguugguuuguugagagaaaucuagugacaccugagggaaaaguugucgaccuaggaugcggacgaggcgguuggucauacuacugcggcggccugaaaaacguaaaggaaguaaaagguuuaacgaagggagguccaggacacgaagaacccauaccuaugaguacuuacggcuggaaucuagucagacuacaguccgguguugauguauucuucacacccccugagaaaugcgauaccuuacuaugugauauaggugaaaguucgccaaauccuacgguugaagcaggcaggacgcuuagagucuuaaacuugguagagaauugguuaaauaacaacacacaguucuguaucaaaguauugaauccuuacaugccaaguguuauugagaaaauggaagcgcuacagagaaaauauggaggggcucuaguuaggaauccacugucaagaaacaguacucaugaaauguauuggguaucuaaugcgaguggcaauauaguaagcagcgucaauaugauaucaagaaugcuuauaaaucguuuuacaaugagacauaagaaagcuacauacgaaccagacgucgacuuagguagcggcacaagaaauauaggaauagaaagugaaacuccaaaccuagauaucauuggaaaacgaauagagaaaaucaagcaagagcacgagacaucuuggcacuaugaccaagaucauccauacaaaaccugggcguaccauggguccuaugaaaccaaacagacaggaucagcaucaucaaugguaaaugguguugucaggcuucugacaaaaccaugggacguaauaccaaugguaacacaaauggcaaugacagacaccacaccuuuugggcaacagagaguuuucaaagaaaaaguggacacacgaacucaagaaccgaaagaaggcacuaagaaacuaaugaagauaacagcugaauggcuauggaaggaguuagguaaaaagaaaacacccagaaugugcacuagggaagaauuuaccaggaaaguaaggucuaacgcagccuugggagcuauuuuuacggaugaaaauaaauggaaaagugcaagagaagcgguagaggauuccggauucugggaacucguagacaaggagaggaauuugcacuuggaggguaaaugugaaacauguguauauaacaugaugggcaagagagagaagaaacucggugaauuuggaaaagcuaaggguucucgcgcuauaugguauauguggcugggagcgagguuuuuagaauuugaagcgcuaggauuccuaaacgaagaucauugguuuagcagggaaaacucccuaucuggcguugaaggugaaggucuacacaagcuaggauauauucuacgcgauguuucaaugaaggaagggggugcaauguacgcugacgacacagccggaugggacacuagaauaacauuagaggaucuuaaaaacgaggaaaugguaacaaaucauauggaaggcgagcacaagaaacuugcagaagcuauauucaaauuaacuuaccagaauaaaguaguccguguacaaaggccgaccccacgugguacagugauggauauuauaucacgccgagaucaaagaggaagcggccaaguugugaccuauggacuuaauacuuuuaccaauauggaagcgcaauuaauaagacaaauggaaggagaagggguuuucaaaucaauacaacagcucacuguaacagaggagauugccgucaaaaacugguuggucagaguaggcagagaacgacuuagccgcauggccaucaguggagacgacugcguugugaaaccauuagacgauagguucgcuucagcacuaacagcucuaaaugauaugggaaaggugcgaaaggauauucaacaaugggaacccaguaggggcuggaacgauuggacacaaguucccuuuugcucccaccacuuucacgaauuaauaaugaaggacggucgaguauuaguaguaccuugccggaaucaggaugaauuaauugguagggcaagaauuucacagggcgcgggauggagucuuagagagaccgcaugucuuggaaagucauacgcgcaaauguggagucuuauguauuuucaucggcgggacuuaagacuggccgcaaacgccaucugcucagcggucccuucacacuggguaccaacaagcagaaccacauggagcauacacgccacucacgaauggaugacaacggaagauaugcugacuguguggaaccgcgucuggauacaggaaaauccuuggauggaagauaaaacuccagucgaaagcugggaagaaaucccuuaucucggaaaacgagaggaccagugguguggaagccuaauaggcuuaacguccagagcaacuugggcgaagaauauacaaacagcgauaaaccaaguacgcagucucaaagguaaugaagaauacacugacuauaugcccagcaugaagagauuucgcagagaagaaggggaagcugggguacuaugguga

SEQ ID NO: 22865 - RNA, 9876 nt, Artificial Sequence
  derived and/or modified CDS sequence (opt6) from DENV-2__JQ955624__SS-prME
acggcaggggugauuaucauguuaaucccuacugccauggccuuucaucugaccacccguaauggagaaccacauaugauuguuucuagacaagaaaaaggaaaaucucuauuguucaaaacugaagauggaguuaauauguguacccuaauggcaauggacuugggagaacuaugcgaagauacuauaaccuauaauuguccacuacuuagacaaaacgaaccggaagauauugacuguugguguaauagcaccuccacuuggguuacauauggcacauguacugcgacaggugaacaccgccgggagaaaagaagcguagcccuagucccacacgugggaaugggauuagaaaccagaacugaaacauggaugucuucugaaggagcauggaagcacgcgcaacggauagaaacauggaucuugagacacccaggguucgcaaucauggcugcuauucuagccuauacuauugguacaacccacuuccaaagaguacugauauuuauauuauuaaccgcuguagccccgaguaugaccaugagaugcauagguauaucaaauagagacuuuguagaaggcgugagcggcgguucaugggucgacauuguuuuagaacaugggagcugcgucacuacaauggcgaaaaauaaaccaacacucgacuuugaacuaaucaaaacagaagcaaaacagccggcaacauuaagaaaguacugcauagaagcaaaguugacaaauacuaccacagcaucuagaugcccgacacagggggaaccaucacuuaaugaggaacaagauaaaagguuugugugcaaacacucuaugguggacagagguuggggaaacgggugcggacucuucggcaaaggagggauaguuacgugcgcaauguuuaccugcaaaaagaacauggaaggaaaaauaguccaacccgaaaauuuagaauacacuauugugguaacaccacauucgggagaagaaaacgcaguuggcaacgauaccggcaaacauggaaaagagauaaaaguaacaccucaaucuaguauaacugaggcagaacucacaggauacgguacuguuacgauggagugcaguccacgaacggggcuugauuucaaugaaauggucuuguuacaaauggaaaacaaagcauggcuuguccaucggcagugguuucuugaccuaccauugccaugguuaccuggugccgacacacaagggucgaauuggauccagaaagaaacauuaguuacauuuaagaauccacacgcgaagaaacaggacguaguaguccuaggaagucaagaaggcgcaaugcacacugcuuuaacuggggccacggaaauccaaaugucgucaggaaacuugcuauuuacaggucaucuuaaaugcagacuacguauggacaaauuacaacucaaagguaugucuuauucuaugugcacagguaaauucaaggucgugaaagaaaucgccgagacucaacacggcacaauuguaguccguguacaauaugagggggauggguccccauguaagauaccauuugaaauaauggacuuagaaaagcgucauguacuaggaaggcugauaaccguaaacccuauaguuacugaaaaggauucuccgguaaauauagaagcagagccgcccuuuggggauaguuacauuaucauaggcguugaaccaggccagcuaaaauuaagcugguuuaagaaagguuccucgauaggccaaauguuugaaacuacaaugaggggugcaaaaagaauggcaauauuaggggacacagcaugggacuucggcucauuagguggcgucuuuacaagcauaggaaaggcuuuacaucaaguauuuggcgcgauauauggagcggcauucucuggagucucuuggaccaugaagauacucauagguguggucauaacuuggauaggaaugaacucuagguccacaucacuaucaguaucacuuguuuuaguaggcguggucacacuuuaccuaggaguaauggugcaagcugauucugguuguguuguuucuuggaaaaauaaggaauugaaauguggauccgggauauucauaaccgauaauguucauacuuggacugaacaauauaaauuucagccagaaagcccaucgaaauuagccuccgcaauacaaaaagcacacgaagaagguauaugcggcaucagaucuguaacgagacuugaaaacuuaauguggaaacagauaacucccgaauuaaaucauauuuuaagugaaaacgaaguaaaacuaacgauaaugacgggagacauuaaaggaauaaugcaagcggggaaaagaucacugcguccacaacccacagaacugaaauauaguuggaaaacguggggaaaagccaaaauguuaaguacugagucgcauaaucaaacuuuucucaucgacgguccugaaacaacagaaugcccaaauaccaaccgagcguggaacucccuagaaguagaagacuacgguuuugggguguucacgacaaacaucuggcuaaaacuaaaagaaagacaagacguauucugcgacucaaaauuaaugucugcagccguaaaggauaaucgugcaguucaugcagauauggguuauuggauugaaucagcucuaaaugauaccuggaagauagagaaagccagcuucaucgaaguuaaauccugccacuggccaaaaucccacacacuauggaguaacgggguauuagaaucggaaaugauaauaccuaaaaacuuugcuggccccgucucacaacauaacuauagaccaggauaccauacacaaacugcaggaccauggcaccuugggaaacucgagauggauuuugauuuuugugagggaacaacagugguagugacugaagauugcggcaauagaggcccuagcuuacguacaacaacagccuccggaaaacuuauuacugaaugguguugcagaaguuguacgcugccuccgcucagauauagaggggaagauggguguugguacgguauggaaauuagaccacuaaaggaaaaagaagaaaauuuggucaauagucuaguuacugccggucacggacaaauagacaacuucucacuaggcauucuagguauggcauuguuucuagaggagaugcugcguacacgagucgguacaaaacaugcaguacuucuggucgcggugucuuuuaugacgcucauaacaggaaacaugaguuuuagagauuugggaagaguaauggucauggucggagcagcaaugacagacgauauuggaaugggugucacuuauuuggcauuacuugcagcguucaaagucagaccaacauuugccgcuggguugcuacuuagaaaacugaccuccaaggaguuaaugaugaccaccauugguauaguccuuuugagucaaucaacaaucccggaaacuauucuugaauuaacggaugccuuagcacuagggaugaugguacuaaaaauuguaagaaacauggaaaaauaucaacuggcugugacaauaauggcaauucucugcguuccuaacgcuguuauucuacagaacgccuggaagguuaguugcacgauauuagcagugguaucuguaucaccacuuuuacucaccucaucacaacaaaaagcggacuggauacccuuagcuuuaaccaucaaaggccucaauccuacugccauuuucuugacaacccuaucacgcacuaacaagaaaagaaguuggccucucaacgaagcaauuauggcugucgggauggucucuauauuagcauccucguuacucaaaaaugacauuccaaugaccggcccauuaguagcugggggcuugcuaacaguauguuauguauuaacaggacgaagugcugaucuggaacuggaacgugccgccgauguaagaugggaagaucaggcggaaauauccggaucaagcccuauauuaucaaucacgauaucagaagauggaaguaugagcaucaaaaacgaagaagaagaacaaacguuaaccauacuaaucagaacaggauuguugguaauuuccggcuuauucccugucuccaucccaauaaccgccgcagcaugguacuugugggaagugaagaagcaacgagcaggaguauugugggaugugccgucaccaccacccguaggcaaagcagaauuggaagacggcgcauauagaaucaaacaaaagggcauccugggauauagccaaauaggugcaggcguauauaaagaagguacauuucacaccauguggcacguuacuaggggagcgguucugaugcacaaggguaagcgaauagagcccucaugggcggacguacgaaaagaucuaauaucauacggggguggcuggaaacuugaaggugaguggaaagagggugaagaggugcaaguauuggcguuagaaccugguaaaaauccuagagcuguucagaccaagccuggguuauucaaaacaaauacaggaacuauaggagcugugagcuuggauuuuucaccagguacuagcggaucgccgauuguugacaagaaaggcaaaguuguaggauuauaugggaauggcguagucacucggucagguacuuacgugagugcaauugcacaaagugagaaaaguaucgaagauaacccggaaauagaagacgacaucuuucguaaaaagcgcuuaaccauaauggaucuccaccccggagcagguaaaacaaaacguuacuuaccggccauaguucgugaagccaucaaacggggcuugagaacauuaauacuagcaccaacaaggguagucgcagcagaaauggaagaagcgcuccggggauuaccuaucagauaccagacuccggccauucgugcugaacacaccggacgugaaauaguggaucugaugugucaugccacuuucacaaugagacuacugucaccaguacgggugccaaauuauaaccugaucauaauggaugaagcgcauuucaccgauccagcaucuauagcagcuaggggauacauuucaacacgaguagaaaugggugaagcggcuggaaucuuuaugacggccacacccccaggcucuagggaccccuucccccagucaaacgccccaauaauggaugaggagcgagaaauuccagaaagaucauggaacucaggucacgaguggguaacagacuuuaagggaaaaacagucugguucguaccaaguaucaaggccgggaaugauaucgcugcuugucuaaggaaaaauggcaagaaaguuauucaacugagucgaaaaacauuugacucugaauauauuaaaacucgaacaaaugacugggauuucguuguaacgacagacauuagcgaaaugggcgcaaauuuuaaggcugaaagaguuauagaccccagacgcuguaugaaacccgugauacucacagauggugaggaaagggucauacuugcuggaccgaugccaguaacgcacucuucugcagcucagcgucguggaagaauaggucgcaaucccaaaaacgaaaaugaucaguacauuuauaugggagaacccuuagaaaaugacgaagauugcgcgcauuggaaagaggccaaaauguuguuggauaauauuaacacaccugaagggauuauucccucuauguuugaaccugagagagaaaaagucgaugcaauagacggggaauauagacuacgaggagaggccaggaagacguuuguggaacuaaugagaaggggugaccuaccaguauggcucgcuuaccguguagcugcugaagguaucaauuacgcagauagacgauggugcuuugacggaaucaaaaacaaccagauauuggaagaaaacgucgagguggaaaucuggacgaaggaaggcgagaggaaaaagcugaaaccuagguggcuagacgcucgcauuuacucugacccguuggcccuuaaagaauuuaaagaguucgcagcaggcaggaaaucacuaacgcugaaucucauaaccgaaaugggacgucucccuaccuucaugacacaaaaagcacgaaacgcguuagauaaucuugcuguucuucauacagcugaagcaggagggcgggcauauaaccacgcauugagugaauuaccagagacuuuagagacucuucuucuccucaccuuauuggcgacgguaaccgguggcauauuuuuauucuugaugucugggaaggguauagguaaaaugacacuaggaauguguugcauuauaacagcaagcauccuauuaugguaugcccaaauucagccacacuggaucgcagccucaauaauauuagaguuuuuccuaauaguacuacuuaucccggaaccagaaaaacaaagaacaccccaggauaaccaauugaccuacgucguuauagcuauauuaaccgucguggcagccacaauggcaaacgagauggguuuucuagagaaaacaaagaaagacuucgguuucggcaguauagcuacccaacaaccagaauccaauauacuggacauagaccuacgucccgcuuccgcauggacauuauaugcaguugcgacuacauuuauaacgccaauguugcgacauucgauugaaaacucgaguguuaauguaagucucacagcuauagcgaaccaagcuacugucuuaaugggauuagguaaaggauggccuuuaaguaaaauggauauaggaguaccguuacuagcaaucggauguuauagucaggucaauccuauaacucugacugcagcacuacuucuauugguggcgcauuacgcaauaauagguccgggauugcaagcaaaagccacaagagaagcucagaaaagagcagcagcaggaaucaugaaaaacccaacgguagauggcauaacuguuauugaucuugauccaauucccuacgaucccaaguucgagaaacaauuaggacagguuaugcuacuugugcuuugcguaacucaaguacuuaugaugagaacaacuugggcacuuugcgaagcucugacauuagcaacagguccaauaucgacacuaugggaggguaauccgggacgcuuuuggaauacuacaauagcugucucaauggccaauauauucagggguuccuaccuagcgggggcuggcuuauuauuuucuauuaugaaaaacacgaccaauacacgaagaggaacugguaauacaggagaaacacugggagaaaaguggaaaaauaggcucaauucccugggaaaaucagaauuucaaauuuacaagagaagcgggauucaagaggucgaucgaacguuagcaaaagaaggaauuaaacgcggcgaaacggaccaccaugcuguaucacguggaagugcaaaacuacgcugguuuguggagagaaauuuaguaacccccgaagggaaagugauggaccuaggauguggacgaggaggauggucauauuauugcgguggucuuaaaaauguccgugaaguuaaaggucuuaccaaaggagguccaggacaugaagaaccaauaccaaugucaacuuauggcuggaauuuaguaagacuccaaucaggggucgacguguuuuucacaccgccagaaaaaugugacacauuacucugugauauaggugaauccagcccgaauccuacaguagaggcaggccggacucuacgaguauuaaaucuuguggaaaauuggcuaaacaacaacacacaauucuguaucaaaguacuuaacccauacaugcccucagucaucgagaaaauggaaaccuuacaaagaaaguauggcggugcccuaguuaggaauccccucucgagaaauucuacccaugaaauguauugggucucuaacgcaucaggaaauauuguuagcucuguaaacaugauaucuagaauguuaauaaacagguucacaaugcgucauaaaaaggcuacauacgaacccgacguugaccucggaaguggaacccggaauauagguaucgaaagugaaaccccuaaccuagauauuauagguaaacgaauagagaaaauaaaacaggaacaugaaacaaguuggcauuacgaucaagaccauccauauaaaacuugggcuuaucacggaucguacgaaacaaaacaaaccggaucggcaucaucuauggugaacggagugguaagauuguuaacgaaaccgugggauguaauuccuaugguaacacaaauggccaugaccgauacaacaccauuuggucaacagcgaguauuuaaagagaagguagauacaagaacucaagagccaaaagaaggaacaaagaaacuaaugaaaaucacagcggaauggcuauggaaagagcuaggcaaaaagaaaacaccaagaauguguacccgagaagaguuuacucguaaagugagaucuaaugcagcucuaggagcaauauuuacugacgagaacaaauggaaaucggccagagaagcuguagaagauucaagguucugggaauuaguugacaaagaaagaaaucuacaccuagaggggaaaugugaaacuugcguauacaacaugaugggcaaacgagagaagaaaaugggagaguucgggaaagccaaaggaagucgugcgauuugguacauguggcuaggagcuagauuuuuagaguucgaggcucuuggauuuuuaaaugaagaucauugguuuucgagggaaaauucuuuaagcggaguagaaggagaaggauuacauaaacuaggauauauacuuagagaagugucuaagaaagaaggaggagcaauguacgcagaugauacugcggggugggauacaaggauaacauuggaagaccugaaaaacgaagaaaugguaacaaaccacauggaaggagagcacaagaaauuagccgaagcgaucuuuaaacuaacuuaccaaaauaaagucguaagaguucaaagaccaacaccacgugguacgguaauggauauuauaucgagaagggaccaaagaggaucaggacaaguuggaacguauggacuuaauacauuuacuaauaugggagcccaauugauaagacaaauggagggugaagguguuuuuaaauccauccagcacuugacaaccacggaagaaguagcaguucaggacuggcucgcaagagucggucgagaacgacuauccagaauggcgauaucaggggaugauuguguaguaaaaccacuugaugaccgauuugcaucugcuuuaacagcacuuaacgauauggguaagguuaggaaagauauacagcaaugggaaccaucacggggauggaaugacuggacccaagugcccuucugcagccaccacuuucacgaacuaauaaugaaagacgggagaguucuuguuguuccuugucgaaaccaagaugaacuaauagguagggcgagaauuagucaaggagcaggauggucacuuagagaaacagcgugucuuggaaaauccuacgcucagauguggucccugauguauuuccauaggagggaccuccgguuagcagcuaaugcaauauguagugcaguaccaucacauuggguaccaacaagcagaacuacuuggaguauccaugcaagacaugaauggaugacgacugaagacaugcugacaguuuggaauagaguguggauacaagaaaauccauggauggaggauaaaaccccgguggaaaguugggaggaaauaccauacuuagguaaaagagaggaucaaugguguggaucguuaaucggcuuaacuucccgugcaacuugggcuaaaaacauacaaacagcuauaaaccaaguuagaucucuuaucggaagugaagaguauacagacuauaugccuucuaugaagagauuuagaagggaagaagaagaagcgggaguauuaugguga

SEQ ID NO: 22866 - RNA, 9876 nt, Artificial Sequence
  derived and/or modified CDS sequence (opt6) from DENV-2__KJ918750__SS-prME
acggcgggaaugaucaucauguuaaucccaacuguaauggcauuucaucuaacuacccgaaauggagaaccacacaugauaguaagucgucaagaaaaaggaaaaagucuacuauuuaaaacaaaagaugguaccaauaugugcacucuaauggcaauggaccuaggugaacuuugcgaagacaccauuacuuacaaauguccguuccuucgacagaacgagccggaagauauugauugcugguguaacucuacaucaaccuggguaacguauggaacguguacaacaaccggugaacaucgacgggaaaaacgaucgguagcauuaguaccacacguagguaugggucuugaaacuagaacugaaaccuggaugagcagugaaggagcuuggaaacaugcucagcgaauagaaauauggauucuaaggcauccagguuucacaaucauggcagcgauuuuggcauauacuauaggaacuacccauuuucaacguguucuaauuuuuauucuacuaaccgcuauagcaccuaguaugacaaugagguguauaggcaucucuaaucgcgacuuugucgaaggaguaaguggaggaagcuggguagacaucguauuagaacauggcagcugcguaacaacaauggccaaaaauaaaccaacauuggauuucgaguuaauuaaaacggaagcaaaacagccagcaacacucagaaaauauugcauugaagccaaacuuacaaacacgacaacggacucacgaugcccgacacaaggagaaccaaccuuaaaugaagaacaagacaaaagauuuguauguaaacauucaaugguugaccguggauggggaaacggaugcggcuuauucggcaaaggagguauaguuacaugugcaauguuuacaugcaagaaaauaaugaaagggaaaauuguucagccagaaaacuuagaauauacgguagugauaacgccucauucaggugaagaacaugccguaggcaacgacacagggaaacaugguaaagagguuaaaauuacaccacagaguagcauaacagaagcggaauugacuggcuacggcacaguaacaauggaguguucgcccaggacgggccuagauuuuaaugaaaugguauuacugcagauggaagacaaggccuggcucguacauagacaaugguuccucgaucugccauuaccguggcucccgggcgcagacacacaaggaucaaacuggauucaaaaagaaaccuuaguuacauucaaaaacccccaugccaagaaacaagacguaguaguucuagguagccaggaaggggcgaugcauacagcacuaacaggggcuacggagauucaaaugaguagugguaaucuuuuauucacuggucaucugaaaugcagacuuagaauggacaaacuucaacucaaaggaauguccuauucuauguguacuggaaaauuuaagguuguaaaagagauugcagaaacacagcacggaacaaucguaauaagaguacaauaugaaggcgacggaaguccauguaaaauaccauuugaaauaauggauuuagagaaaagacauguacuuggucgacuaauuacuguuaaucccauaguuacugaaaaggauagccccgucaauauagaagcugaaccaccuuuuggagacaguuauaucauaaucgguguagaaccuggccaacucaaauugaauugguuuaagaaaggaagcucuaucggccaaaugcuagaaacaacaaugagaggggccaagcgaauggcaauacuaggagauaccgcgugggauuuuggaucacuaggaggaguauuuacgucaaucggaaaagcucuccaucaaguuuuuggagcuaucuauggugccgcuuuuaguggaguaucauggacgaugaagauauugacuggaguuauaauuacauggauagggaugaacucuagauccaccucccucuccguaucccuagucuuaguaggcauugucacucuguauuugggcguuaugguacaagcggauagcggaugcgugguaaguuggaaaaauaaagagcuaaaaugcggaagcggcauuuuuguuacagacaauguacauacauggacugaacaauacaaguuccaaccugaaagcccuaguaaacuagccucagcuauucagaaggcacacgaggaagguaucugcggcauucgaaguguaacaagguuagagaaccugauguggaaacagauaacgccggaauugaaucauaucuugagugagaaugaaguaaaacuaacaauaaugacuggagauauaaaggguauuaugcaaguagguaaaagaucacuuaggccgcagccaacagaauuaagguauaguuggaaaacaugggguaaggcuaaaaugcuaaguacugaauuacacaaucaaacauuuuuaauugauggcccugagacagcagaaugcccaaauacgaaccgugcguggaacagcuuagaaguugaagauuauggguucgguguauuuacaacgaauauuugguuaagauuacgugagaaacaagacguauucugugacucgaaacuaaugucagccgccaucaaagacaaucgugcgguacaugcagacaugggcuauuggauagagagugcacucaaugauacuuggaaaauagaaaaagcaaguuuuaucgaaguaaaaucaugucacuggccuaaaagccacacuuugugguccgaugggguucucgaauccgaaauggugauuccuaaaaauuucgcgggaccgguaucucaacauaauaacagaccuggguaucauacacaaacagcuggaccuuggcaccuggguaaauuggaaauggacuuugacuuuugugaggguacuacaguugugguaaccgaagacugcggaaauagaggacccagucuaagaacgacuacagcaagcggaaaacuuauaacagaaugguguuguagauccugcacguuaccuccacuacguuaucgcggagaagacggauguugguauggaauggagauacgaccguuaaaagaaaaagaggagaauuuggucucaucuuuaguaacggcuggccauggacaaauagauaauuuuucccuuggcauacucggaauggcucuauuccuagaagaaaugcuacggacaagaguugggacaaaacaugcgauacuucuggucgcugugucauuugucacgcuuauaacgggaaauaugaguuuuagggaucucggacgcgucaugguuauggucggagcaacaaugacagaugauauaggcaugggcguaacauacuuggcuuuacuugcugcguuuaaaguaaggccuacguucgcagcgggccuacugcuucguaaacugacuucaaaagaacuaaugaugacaacaauuggcauugugcugcuaucucagaguucaauuccugaaacgauauuagaacuaacugacgcucuggcacuuggaaugauggugcuaaaaauggugaggaauauggagaaguaucaacuagccguuacuauaauggcuauacuaugugucccaaacgccgucauucugcaaaacgccuggaaaguaucaugcacaauccuagcauuggucaguguuucaccguuauucuuaacaucaucgcaacaaaaggcugauuggauaccauuagcauuaaccauaaagggauugaauccaaccgcgauuuuucuuaccacauuaagcagaacaucgaagaagagaucauggccacuaaaugaagcuaucauggcuguagguaugguauccauauuagcaucaucacuacucaaaaacgauauuccuaugacuggaccuuuaguagcaggaggccugcuuacgguauguuauguacuaacugguagaucugccgauuuagaauuagagagagcugcugacgucaaaugggacgaccaggcagagaucucagggucaucgccaauacuuaguauaaccaucagcgaagaugggagcauguccaucaaaaaugaagaagaagaacagacuuugaccauucugaucagaacgggucuccuuguaaucucgggguuauuucccguauccauaccaaucaccgcagcagccugguauuuaugggaaguuaagaaacagagggccggagugcuuugggauguucccucuccuccaccgguggguaaagcggaguuggaagacggagcauacagaauaaaacaaaagggcauacuuggauacucacaaauuggggcuggaguguacaaagaggguacauuccauaccauguggcacguaacaagaggagcaguucucaugcauaagggaaaaagaauagaaccaucaugggcagacguaaagaaagauuuaaucucuuaugguggaggguggaaacuggagggggaauggaaagagggcgaagaaguccaaguacucgcccuagaaccgggcaaaaacccuagggcaguccaaaccaagccaggccuauucaaaacuaacacagggacuauaggagcgguuuccuuagacuucagccccgggacaucagggucaccuauagucgacaagaaagggaaagucguuggauuauacggcaacgguguagugacacgaucuggugcguacguuucagcgauagcccaaacagagaaaucgauugaagacaauccagaaauagaagacgauauuuuucggaagcggagacucacgauuauggaucuucacccgggugccggcaagacaaaaagguauuugccugcuaucgucagagaagcaauaaaaagagguuuaaggaccuuaauucuagcaccaacgagaguuguugcggccgaaauggaagaagcacuuagaggacuaccuauuagauaucaaacacccgccaucagagcggagcacacggguagggagauuguugauuugaugugccacgcaacguuuacuaugagauugcuuagcccaauuagggucccgaauuacaaccuaaucauuauggaugaagcacauuucacagauccugccucaauagcggcgcgaggcuauauaaguacgcgaguagaaaugggcgaagcagcagguaucuucaugacagccacgccucccgguagccgcgaccccuuuccucaaucgaacgcuccaauaauggacgaagaaagagaaauccccgaaaggaguuggaauagcggccacgaguggguaacagacuucaaaggcaaaacaguuugguucguuccuucaauaaaaaccggaaacgacauagcagccuguuugcggaaaaaugguaagagagucauacaacucagucgaaaaacuuuugauucggaauaugucaaaacacguacaaaugauugggacuuuguuguaaccacugauauaucagaaaugggugccaauuucaaagcagaaagagucauagauccuagaagaugcaugaagccgguaauauugacugauggggaagaacguguaauccuugcuggaccuaugccaguuacccacagcagcgcagcacaacggcguggucggauaggucgaaaucccaaaaaugaaaaugaucaguauauuuauaugggagaacccuuagaaaaugacgaagacugugcacauuggaaagaggcuaaaauguuacuggauaacauuaacacaccagagggcaucauuccuucaauguucgaaccggaacgugaaaaaguagaugcaauugauggggaguacagauuacgaggagaagcucgcaaaacauuuguagaucuuaugcgacgcggugaccuuccggugugguuagcuuacaaaguagcugccgaagguauuaauuaugcagauaggagaugguguuuugaugguacaagaaauaaucaaauauuagaagaaaaugucgaaguugaaaucuggacaaaggagggcgaaagaaagaaacuaaagccaagaugguuagaugcucggauauacucagauccacuggcacuaaaagaauuuaaagaauuugcggcaggaaggaaaagccugacacucaacuuaaucacagaaaugggacgccucccaacauuuaugacucaaaaggcccgcgaugcauuagauaacuuagcgguacuacauacggcggaagcaggagguaaggccuauaaucacgcguugagugaauuaccggaaacauuagagacccuuuuacuacuaacccuucuggcuacuguaaccgguggaauauuuuuauuuuugaugucgggcagggggauaggaaaaaugacccuagguaugugcuguauuauaacagcuagcauuuuacuauggugcgcccaaauccaaccacacuggauagcggccagcauaaucuuagaguucuuucuaauugugcuauugauaccagaaccggagaagcaaaggacaccacaagacaaccaauuaaccuacguuaucaucgcgaucuuaacgguaguugcagcaacuauggcuaaugagaugggauuucuagagaaaaccaagaaagaucuaggucuaggaaacauugucacacaacaaccugaaucgaauauauuagacauagaccuucggccagcaucugccuggacauuauacgccgucgcaacgacguuuauuacaccuaugcuccgucauaguauagagaauaguucagucaauaugaguuugaccgcaaucgcgaaccaggccacaguacuaaugggacuugggaaaggcuggccgcucucgaagauggacauuggggucccccuucuggcuauaggguguugcucgcaaguuaauccuaucacuuugacagcggcguuauuucuguuaguagcccauuaugcaauaauaggacccgguuuacaagcaaaggccacaagagaagcacagaaaagggcugcagccgggauaaugaaaaaccccacgguagauggaauuacaguaauagacuuagauccgauccccuaugacccaaaauucgaaaaacaacuuggacaagugaugcuguuaguauugugugugacccaggugcuuauuaugcguacaaccugggcuuuaugugaagcauuaacucuggcaacuggaccaguuagcacgcuaugggagggaaauccuggacgguuuuggaacacgacaauagcuguaucuauggcaaauauauuccgcgguaguuauuuggccggugcaggccuacuauuuuguauaaugaacaacacuacacgcuugagaagaggaacuggccacuuacguaaaacucuaggagauaaauguaaaucaagacuaaauacucuaggcaaaagcgaguuccaaauauauaagaaauccggaauacaggaaguggauaggacccuagcaaaagaagguauaaaacgaggcgaaacugaccaucaugcaguuagcagagguagcgcaaaacuucguugguucguugaaagaaauuugguuacacccgagggaaaaguaguagaccuagguugcggacgugggggcuggucauacuauugugguggacucaaaaacgugagagaggugaaaggccuaacuaaaggcggaccaggacacgaagaacccauuccaaugaguacuuaugguuggaacuuaguaagacuacaauccggaguagauguauucuucauaccuccugaaaagugugacacacuacugugcgacauuggcgaaucaucuccaaauccgacggucgaagcuggucgaacauuacgaguacuuaaucucguggaaaauuggcuuaauaauaauacgcaauuuugcauuaaaguacuuaacccuuauaugccaagugugauugagaaaauggaaaccuuacaacgcaaauacggcggugcacuuguaagaaacccacucucacguaacagcacacacgaaauguacuggguaucaaaugccucagggaauauaguaucaaguguuaauaugauaucaagaaugcugauaaacagauuuacaaugagacacaagaaagcgaccuaugaaccugaugucgauuuagguuccggcacaagaaauauaggcauugaaagcgaaacaccuaaucucgauauaaucggaaaacgaaucgagaaaauaaagcaggaacaugaaaccuccuggcacuaugaccaagaucauccguauaagacgugggcuuaucacgguuccuaugaaacaaagcagacggggucagcauccaguaugguaaauggaguuguaagacuguuaacaaaaccgugggauguaguacccaugguuacacagauggccaugacagauacaaccccauuuggccaacaacgugucuuuaaagagaagguagauacuagaacacaggaaccaaaagaagguacgaagaaacucaugaaaauuacagcugaauggcucuggaaagaauugggcaagaagaaaacgccaagaauguguaccagagaagaguucacgaaaaaggugcgaaguaaugcugcauugggugccauauucacugacgaaaauaaauggaaaucagcacgagaagcaguggaagauggacguuucugggaauuagucgauaaagaaagaaaccuacauuuagaaggaaagugcgaaacaugcguguacaauaugaugggaaaaagggagaagaaacuuggugaguuugguaaagcaaaggguucacgggccaucugguauauguggcuaggagcaagauuuuuggaauuugaagcguuaggauuccucaacgaggaucacugguucagcagggagaauagcuuaucagggguagaaggcgaaggucuacacaaacugggauauauacugagagaaguaucuaagaaggaagggggugcaauguacgcggaugacacugcagggugggauacucguauaacaauugaagauuugaagaaugaggaaaugaucaccaaccauauggccggagaacauaagaaacuugcagaggcgaucuuuaaauuaacuuaucaaaauaaaguaguuagaguacaaagaccaacuccacgcgggacgguaauggauauuauaucccgaagagaccaacgaggaucaggacaaguaggaacauacgguuuaaacacauucacaaacauggaagcgcaauuaauacgacagauggaaggagaagguauauuuaaaaguauucaacaucugacagcaacggaagaaaucgcgguccaagacugguuggccagaguaggaagggaaagacucucccgaauggcuaucaguggggaugauugcguaguaaagccacuugacgauagauuugcuagggcauugacggcauugaaugacauggggaaaguacgaaaagauauucaacaaugggaaccaaguagaggguggaaugauuggacccaagucccguuuuguucacaucauuuccaugagcuaauuaugaaagauggacgcacucuaguuguacccugucgaaaucaagaugaacuuauagguagagcuagaaucucacaaggagccggguggucuuuaagagaaacagcauguuuagguaaaucguacgcgcaaauguggucauuaauguacuuucaucgacgagauuuacgccucgcagcaaaugccauaugcucagcuguuccgucgcauuggguuccuacaucucgaacaacuugguccauacaugcaagucacgaauggaugacaacggaagacaugcuuacuguauggaaccguguuuggauacaagaaaacccguggauggaagauaaaacccccguagagucuugggaggagauaccauacuuagguaaaagggaagaccaaugguguggaagccuaaucggucuuacaagcagagccacaugggcuaaaaacauacaaacagcaaucaaccaaguaaggucauuaauuggcaacgaagaauauacagauuauaugcccagcaugaaacgauuccgacgcgaagaagaagaagcgggaguccuuugguaa

SEQ ID NO: 22867 - RNA, 9876 nt, Artificial Sequence
  derived and/or modified CDS sequence (opt6) from DENV-2__KU517845__SS-prME
acagcaggaauaauuauuaugaugauccccacuguaauugcauuccaccugacaacucgcaauggcgaaccgcacaugauagugucgaggcaagaaaaagggaaaagucuuuuauuuaaaacagaaaauggugucaauaugugcacauuaauggcuauggauuugggcgaacuuugugaagacacaauaacauauaauuguccccuguuaagacaaaaugaaccggaagauauagauugcugguguaauaguacuucagcuuggguuaccuaugggacuuguacagcaacuggugaacauagaagggagaaaagaucaguugccuuaguaccacaugucggcaugggguuagaaacacgaaccgaaacauggaugucuagugaaggagcguggaaacacgcucagcggauugaaacaugggugcuccgccauccuggguucaccauaauggcggccauucucgcauauacgauaggaacaacauacuuucaacguguacuaauauucauucuacuuacagcuguaacaccgucaaugacgaugcguugcaucgggauaucaaaucgugauuucguugaaggggucagcggagggagcuggguagacauaguucuagaacacggcaguugugucacuaccauggcgaaaaacaaaccuacacuagauuuugaauuaauaaaaacagaagcaaaacauccagcaacguuacgaaaauauuguauagaagcgaaauuaacaaauaccacuacugcaucgcggugcccuacucaaggagaaccaagccucaaugaagaacaagacaaacgcuuuguauguaaacacagcaugguagaucgaggauggggaaauggauguggucuauucggaaaaggaggaauagucacuugugcaauguuuacauguaagaagaauauggaagguaaaauaguacaaccggagaaucuagaauauacaauaguuauaacaccacauaguggagaagaaaaugcuguaggcaaugauacaggaaaacacgggaaagaaauuaaaguaacaccgcaaucaucuauuacggaagcugaacugaccggcuacgggacaguuacuauggaauguagcccccgcacaggucucgauuucaaugagaugguacuucuucagauggaaaauaaagcaugguugguacaccgacaaugguuucucgaucucccccugcccugguuaccaggugcagauacucaggguucaaauuggauacaaaaagaaacauuagugacauuuaaaaauccccaugcuaagaaacaagacguggucguccuaggaucacaagaaggagcgaugcauacagcauuaacuggagcuacagagauacagaugucuucuggaaaccuuuuauuuaccggccaccucaaauguaggcuccgaauggacaaacuccaacuaaaagguaugucauacucaaugugcacgggaaaauuuaaaguuguaaaagaaauagccgaaacccaacauggaacaauagucauaaggguccaauaugaaggagacggaagcccaugcaaaaucccauuugaaauaauggaccuagagaaaaggcacguucucggccgguuaaucacgguuaauccgauaguuacugaaaaagacucaccgguaaacauugaggcggaaccaccguucggagauagcuacauaauuauugguguggaaccuggccaacuuaaauuaucuugguucaagaagggcucaaguauaggacaaauguuugaaacaacgaugagaggagccaaaagaauggcaaucuuaggagacacagcgugggacuucggaucucuaggugggguauucacguccauagguaaggcuuuacaucaaguauucggggcaauauacggugcagcauuuucggggguaucauggacaaugaaaauucucauaggagucguaauaacauggauagguaugaacagcagaagcaccagucugucuguaagccucguccuaguaggcgugguaacauuauaccuagggguaaugguacaagcugacagugguugcguaguaagcuggaagaacaaagagcuaaaaugcggaagcggaaucuucauaacagacaacguccacacauggacagaacaguauaaauuucagcccgaaagcccuucuaaacucgcaucagcaauucaaaaagcacaugaagaaggaauaugcggaauuagaaguguaacacgccuugagaauuuaauguggaaacaaauuacgccugaacugaaccauauccuaucggaaaacgaagugaaacucaccauuauggcuggagauauaaaaggcauaaugcaggcaggaaaacggaguuugcgaccccaaccaacagaacuaaaauauucauggaaggcuugggggaaagccaagauguuaucaaccgaacuacauaaccacacauuuuugauugaugguccugaaaccgcagaauguccgaauacaaauagagcguggaacuccuuagaaguagaagauuaugguuuuggcguuuuuacaaccaauauauggcuaaaauuaaaagagcggcaggacgccuucugugacucaaaacugaugucggcagcaauaaaagauaacagggccauucacgcagacaugggcuacuggauagaaucagcuuuaaaugacacuuggaaaauugaaaaggcgaguuuuaucgaaguaaagagcugccacuggcccaaaucacacacacuaugguccaacggcguguuggagagugaaaugauuauaccuaaaaacuuugccgggccagugucucagcauaacuauaggccaggauaccauacucaaacugcaggcccguggcaucuagguaggcucgaaauggauuuugauuuuugugaggggacaacaguagugguaacugaagauugcggaaaucggggucccucgcugcggacuacaaccgcuagcgguaaguuaauaacggaaugguguuguagaucaugcacccuaccaccgcugcgcuauagaggcgaggacggcugcugguacggaauggaaaucaggccguuaaaggaaaaggaggaaaaucuaguaaauucuuuaguaacagcagggcacggccaaaucgauaacuuuucauuaggugugcuggggauggcauuauuuuuggaggaaaugcuaagaacacgaguuggcacaaaacaugccauuuugcuuguugccguuucuuucguaaccuuaaucacggggaacaugaguuucagagacuuagguaggguaauggugaugguaggcgcuacgaugaccgaugauauaggaaugggcgugacguaucuagcuuugcuagcggcuuucaaagucaggccaacuuucgcagcggguuuguuacugcgaaaacucacuucuaaagagcuaaugaugacaacaauaggaauaguccuucuaagucaaucgacaauccccgaaacaauucuagaguuaacagaugcgcuagcucuuggaaugaugguacuaaaaaucguucgaaauauggaaaaauaccaacucgcugucaccaucauggcaauuuuauguguacccaacgcagugauauugcaaaaugcauggaaaguaagcugcacaacauuagccguaguaaguguaucaccauuacuauuaacaucaagccaacaaaaagcugauuggauaccuuuaguauugacaaucaaaggucuuaaccccacagcaauauuccuuacuacauuguccagaacgucgaagaaaagguccuggcccuuaaaugaagcaaucauggcagucggaaugguaucuauccuugcaucgucucuacucaaaaaugauauaccaaugacuggaccgcuaguagccgguggauuauugacugucugcuauguauuaacaggacgcucugcagacuuagaacuagaaagagcagccgaugucagaugggaagaacaggcagaaaucaguggaucauccccaauccuuucuauaacugugucagaagacgguucaaugaguaucaaaaaugaagaggaagaacaaacuuuaacaauacuaaucaggaccggccugcuaguaauuucaggccuuuuucccguaucuauaccaaucacugcugcagccugguaucuuugggaagucaagaaacaaagagccggagugcuaugggauguaccgucuccgccgccuguaggaaaggccgagcuagaagauggagccuauaggaucaagcaaaaaggaauccucgguuacucucaaaucggugcuggcgucuauaaagaaggaacguuccacacaauguggcaugucacaagaggcgcuguacugaugcauaaaggaaagcgaauagaaccaucuugggcugaugucaaaaaggaccugaucucauauggugguggcuggaaguuagagggagaauggaaggagggcgaagagguacagguccuagcacuagaaccagguaagaauccgagggccgugcagacuaaaccgggauuauuuaaaaccaauacaggaacgaucggagcugucagucuagauuuuucaccuggaacaucagguucacccaucguggauaagaaagguaaaguuguaggauuauacgguaaugggguuguaacgaggucggguaccuacguuagcgcuaucgcacaaacagaaaagucuaucgaggacaauccagaaaucgaagaugacaucuucaggaagaaacggcugaccauaauggaccuacaucccggcgccggaaaaacgaaaagguaucucccugcgaucguccgggaggccauaaaaagaggguuaaggacacuaauuuuagcgccuacucggguuguugcagcugaaauggaggaagcacuaaggggauuacccauacguuaucaaacgcccgcaauacgggcagaacauacaggcagagaaauuguagauuuaaugugucaugcgacuuucacuaugaggcuucuaagcccaauucguguaccuaauuacaauuuaauaauuauggaugaagcacacuuuacagauccagcuucaauagccgcaagaggauauauaaguaccagaguggaaaugggagaagcagccgguauauuuaugaccgcgacuccgccuggaagccgcgaccccuuuccacaaaguaaugcaccgaucauggacgaagaacgcgaaauuccagagcguaguuggaacaguggucaugaaugggugacagacuuuaagggaaaaacggugugguucguaccgucuaucaaggccgggaaugacauagcagcauguuuaaggaagaacggcaagaaaguaauacaacucagcagaaaaacauuugauagcgaauauauuaaaacgagaacaaacgacugggacuuuguuguuacuacagauauuucagaaaugggggcgaacuucaaagcggaacgagucaucgacccaagacgguguaugaagccaguuauucuaacggacggagaagaacggguaauacuggcuggaccaaugcccguuacacauucgucagcggcacaacgacgaggacguguuggaaggaaucccaaaaaugaaaaugaucaauauauauacaugggagaaccccucgaaaaugaugaggacugcgcacauuggaaggaagcuaaaauguuacuugacaauauaaauacaccggaagguauaauucccucgauguuugaaccugaaagagaaaaaguggacgcuauagauggagaguaccgguuaagaggcgaagcacgaaaaacauuuguagaccugaugagacguggcgaccugccugucugguuagcauacaggguagccgcggaagggaucaacuacgcagaccgccgcugguguuucgacggggucaagaacaaccaaauuuuagaagaaaaugucgaaguagaaauauggacaaaagaaggggagagaaagaaauuaaaaccaagguggcuagaugcccguauauauucagauccuuuggcguuaaaagaguucaaagaauuugcagccggacgaaagagcuugacacuaaaccuaauuacugaaaugggaagauuaccgacauuuaugacacaaaaagcaagaaacgcacuggauaauuuagccguccuacauacagcagaagcaggagguagagcuuauaaucacgcguuaucggaauuaccagagacauuggagacauuacuuuuauuaaccuuacuagcuacugucacaggcggaauauuuuuguucuugaugagugggaagggaaucggaaaaaugacacugggaauguguuguauaauuacagccucuauacuauuaugguacgcccaaauccagccgcauuggauagcugcaucgaucauuuuggaauuuuuccuuauuguuuuauuaauaccggagccagaaaaacaacguacaccacaagauaaucaacuaacguauguagugaucgcaauauuaacaguaguugcagcaacgauggcaaaugaaaugggauuuuuagaaaagacgaagaaagacuuuggacuaggcagcauugccaaccaacagccugaaagcaacauauuggauauagacuuaagaccugcaucugcuuggacacuguaugcugucgcuaccacguucauaacgccuauguuacgacacucaauagaaaacuccucagucaauguuucacuuacggcgauugcuaaccaggcaaccguacucauggguuuaggcaaaggauggccguuaaguaagauggauauaggcguacccuuacucgcaauaggguguuacucacaaguaaaucccauaacacuaacagcagccuugcuacuuuuaguagcacauuacgcgauaaucgguccaggauuacaagcuaaggcaacgagagaagcacaaaagagagcagcugcgggcaucaugaagaacccaacgguugauggcaucaccguaauagacuuagauccuauaccuuacgauccgaaauuugagaaacaacuaggacaggugaugcuacugguucucuguguaacacaagugcugaugaugaggacgacaugggcacuaugugaagcgcuaacacuugccacgggaccaauaucgacucuaugggaagguaacccagggcgauuuuggaauacaacaaucgcuguaaguauggcuaauauauuucgaggaucguacuuggccggagcaggccuauuauuuucuauaaugaaaaacacagcgaacacacgacgagggacaggaaacacuggcgagacacuaggggagaaguggaaaaauagauuaaaugccuuagggaagucugaguuccaaauuuacaagaaaucaggcauacaagaaguugaucgaacccuagccaaagagggcauuaaacguggcgaaacagaucaccaugcaguuucuagaggcagcgcaaaacuaaggugguucguugagcgaaauuuaguaacgcccgaaggaaaagucguggaccuagggugcggacguggggguuggucauauuauugcggaggacuaaagaauguuaaagaagucaaaggguuaacuaaaggaggaccgggccaugaagaacccaucccuaugucaacauacggauggaaccuuguacggcuucaaagcggugucgacguuuucuucacuccuccagaaaaaugcgacacauuacuaugugauaucggagaaucgucgccaaauccaacagucgaagcagguagaacacuucgaguguuaaaucuaguagaaaacuggcucaacaauaacacccaguucugcaucaaaguguuaaacccuuauaugccuucuguuauagagaaaauggaagcauugcaaaggaaauauggcggcgcgcuaguaaggaauccacuaucaagaaauucaacacaugagauguacugggucucaaaugcaaguggaaauauuguaagcucuguaaacaugauaucaaggauguugauuaacagauucaccaugcgacacaagaaggcuacauacgagccugacguugaucuuggaagugguacaaggaacauuggaauagaaucggaaacucccaauuuagauauuauaggaaagagaaucgagaagaucaaacaagaacacgaaaccaguuggcauuacgaccaagaccacccuuauaaaaccugggcauaccaugggaguuaugaaaccaaacagacugggagcgcgagcagcauggugaacgguguuguacgguuacucacaaagccuugggauguaauuccuauggucacccaaauggcuaugacagauacuacuccuuuugggcagcaaagaguauuuaaagaaaaaguugauacaagaacacaagagccuaaagaagggaccaagaaaauuaugaaaauuacugcagaaugguuguggaaagaacuagguaagaagaaaacuccaagaauguguacgcgagaggaguucacaaggaaaguaagaaguaaugccgccuuaggagcaaucuuuacagaugaaaauaaauggaaaagugcacgugaagcgguagaagauucagguuucugggaguuaguagacaaagagcguaaucuccaucuagaaggaaagugugaaaccuguguuuauaacaugauggguaaacgugagaagaaauuaggagaauuuggaaaggcuaaagguagucgagcgauuugguacauguggcugggagcucgauucuuggaguucgaagccuuaggauuuuuaaacgaagaucauugguucucucgugaaaacaguuugucaggaguggaaggagagggccuucacaaacuaggauauauccuacgagauguaucaaagaaagaaggaggagcaauguacgcugaugauacagcgggaugggauacuagaauaacuuuggaggauuuaaagaaugaggaaaugguuacaucacacaugaaaggcgagcacaggaaacuagcugaagccauuuucaaacuaacauaccagaacaaaguagugagaguacaacggccaacgccccgaggcacuguuauggacauaaucucaaggcgagaucagagagguucaggacaaguagucaccuauggucuaaacacuuucacgaauauggaagcacaguuaauucgucagauggaaggagaaggcguauucaaaucaauccaacagcuuaccguaacagaagaaaucgcagugaaaaauuggcugguccgaguuggcagggaaagauuaucaaggauggcaauaucuggcgaugauugcguuguaaaaccguuagaugaucgcuucgccagugcuuuaaccgccuugaacgauaugggcaaaguacgaaaagacauacaacaaugggaaccgucaagaggcuggaacgauuggacccaaguaccauuuugcucacaucauuuucacgaacuaauuaugaaagauggcagaguccugguagucccaugccguaaccaagacgaacuaauuggucgcgcacguauaagucaaggugcaggauggagucugagggaaaccgcaugcuuaggcaaaucuuacgcccaaauguggucacuuauguauuuccaccgaagagaucucagacuagcagcaaaugcaauauguucugcagucccuucacauuggguaccaaccucaagaacaacauggucaauacacgcgacccaugaguggaugacgacugaggauauguuaacuguauggaacagaguauggauacaagaaaaucccuggauggaagacaaaacaccagucgaaucgugggaggagauuccauacuuagguaaaagagaagaccaauggugcggcucccuaauaggucuuacuucacgagcuacgugggcuaagaacauacaaacagcuauuaaucaaguacggagucuaauaggcaacgaagaguacacagauuacaugccgagcaugaaaagauuuagacgcgaagaggaagaagcaggagugcucugguga

SEQ ID NO: 22868 - RNA, 9876 nt, Artificial Sequence
  derived and/or modified CDS sequence (opt6) from DENV-2__KU517847__SS-prME
acggcaggaauuauaaucaugaugauaccaacuguuauggcguuucauuuaacaacaaggaauggagaaccucauaugauaguaucaagacaggaaaaaggaaaaucacuuuuguuuaaaacagaaaacgguguaaauauguguacucuaauggcgauggacuuaggagaauuaugcgaagauacaauaacuuauaacugcccauuauuaagacagaacgaaccagaagauauagacugcuggugcaacaguacaaguacuuggguaacauauggaacuuguaccgcuacuggugaacauaggagagagaaaagaagcguggcacuugugccacacguagguaugggauuagaaaccaggacggagacuuggaugagcagugagggagcauggaaacaugcacaacggaucgaaacauggguacuaagacauccggguuuuacaauuauggcagcuauucuugcuuacacuauaggcacgacauacuuucaacgggucuugauauuuauccuacuuacugcugucgcuccaaguaugacaaugagaugcauaggaaucucaaauagggacuucguagagggggugaguggcgguucuuggguagauaucguccuggagcaugggagcugcgugacaacgauggcgaaaaacaaaccuacccuagacuucgaauuaauaaaaacagaagcuaaacauccggcaacgcuaagaaaauacuguauugaagcuaaauuaaccaauacuacaacggcuucucgaugucccacacaaggugaaccuucuuuaaacgaagaacaagacaaaagauucguuugcaaacacagcaugguugacagggguuggggaaauggaugcggccuauucgggaaaggaggaauuguuacaugcgcgauguuuacuuguaagaagaauauggaagggaaaauaguucaacccgaaaaccuagaauacacaauaguuauuacuccgcauucaggagaagaaaaugcaguggggaaugacaccggcaaacauggcaaagaaauaaaaguaacaccacaauccucuauaacugaggcugaauuaaccggauacgguacuguaacaauggaaugcucaccgcguacaggacuagacuuuaacgaaaugguuuuauuacagauggagaacaaagcauggcuaguccauagacagugguuccuagauuuaccacuuccuuggcuacccggagcagauacacaaggcucaaauuggauucaaaaagaaacuuuaguuacauuuaaaaauccucaugcgaagaaacaagacgucguaguccuggggucacaagaaggugcgaugcauacugcuuugacgggcgcuaccgaaauacaaaugaguuccggaaaucuauuauuuacaggccauuuaaaauguagauuaaggauggauaaacuacaacuuaaaggaauguccuauagcaugugcaccgguaaauuuaaaguaguuaaagaaauagccgaaacucaacacgggacuauaguaauaagaguucaguaugaaggcgacgguagcccguguaaaauacccuuugaaaucauggaucuugagaaaaggcauguacuaggucgauugaucacagugaacccuauaguaacggagaaagacucaccuguaaauauagaggcagaaccgccuuuuggugauucauauaucauaauaggaguugaaccuggccaguuaaaacuaaguugguucaagaaagggaguucaauaggccagauguuugaaacaacuaugagaggagcaaaacgcauggcgauacuaggggacacugcgugggauuuuggcucccuaggaggcguuuuuacaucaauagggaaagcccuacaucagguauucggugccauauauggagcugcguuuucaggaguauccuggacaaugaaaauucuaaucggaguugucaucacuuggauagguaugaacuccagaucaaccagccuuucaguuaguuugguguuagucggcguagugacacuauacuuggguguaaugguacaggcugacagugguugcguaguuuccuggaaaaauaaagagcuaaaauguggaucaggaauauuuauaacggauaauguacauacuuggaccgagcaauauaaauuucaaccagaaucuccaucgaaacuagcaagugcuauucaaaaagcacacgaagaagggauauguggaauaaggucaguaacacgccuagaaaaccugauguggaaacaaauuacaccggaacugaaucauauucuuacugagaaugagguuaaacuaacuaucaugaccggagauauaaaaggaauaaugcaagcagguaaaagaagccugcguccccaaccgacugaacuaaaauauucuuggaaagcauggggaaaagcuaaaguacucucgaccgaauuacauaaccacacauuucuuauagauggaccugagaccgcggaaugucccaauacaaaucgagcauggaacagucuggaagucgaagauuauggauuuggaguauucaccacaaacaucuggcuuaaauuaaaagagcgccaggacguuuccugcgauucaaaauuaaugucagcagcgauaaaagauaacagagcaguucaugcugauauggguuauuggauagaaagugccuuaaaugauaccuggaaaaucgagaaagccucuuucaucgaagucaaaucaugucacuggccuaagucacacacguuguggaguaaugggguucuagaaucugaaaugauaauaccaaagaauuuugcagguccaguaagccagcacaauuaucgcccaggcuaucacacacagacagcaggcccauggcaucugggacgauuggagauggauuuugacuuuugugaagggacuaccguaguugucacugagaacugcggcaaucgcggaccgucucuacgaacuaccacggcaucaggcaaacuaauaacggagugguguuguagauccuguacauuaccaccgcuuagauaucgaggggaagauggauguugguaugggauggagauuagaccauuaaaggaaaaagaagaaaaccuagucaacucguuaguaaccgcgggucacggucagauugacaauuucucguuaggaguucuaggaauggcacuauucuuagaagaaaugcuccguacaaggguugguacaaagcacgccauacuacuggucgcgguuucauuuguuacucuaauaacaggcaauaugaguuuucgggaccuuggucguguuauggucaugguaggagcgacuaugacagacgauauagggaugggcguuacguauuuagcauugcuggcagcauucaagguuagaccgacauuugcugcaggacuccuucuaagaaaacuaacuucaaaagagcucaugaugaccacuauagggauaguacuacuaagucaaagcacaauaccggagacaauacuagaacugacugacgcccuagcauuaggaaugauggugcucaaaaucguaaggaauauggagaaguaucaguuagcaguaaccaucauggccaucuuaugugucccaaaugcaguuauucuacaaaacgcauggaagguaucaugcaccgcgcuggcaguagucucagucagcccacucuuacucacaaguucccaacagaagaccgacuggauaccccuugcauugacuaucaaaggguugaauccuaccgccaucuuucuaaccacacuuucaagaacuagcaagaaacgauccuggccucuaaaugaggcuauuauggccgucggaaugguuaguauccucgccucaucauuucucaaaaaugacauaccuaugacggggccccuaguugcuggugggcucuuaacugucuguuauguucuaacgggaagaagugcggaccucgaacucgaacgggccgcagauauuaggugggaagaacaagcggaaauuagugguaguucuccaauucucucaauuacuauaagugaagauggauccaugagcauaaagaaugaagaagaggagcaaacccucacaauccugauaaggacuggccuuuuaguuaucucaggacuauuuccugcuucgaucccuauuacagcagccgcgugguaucuaugggaaguuaagaaacaacgagcuggaguacugugggaugugccaucgccgccuccuguaggucgagcagaauuagaagauggagcauauagaauuaaacagaaaggaauacuaggauauucacagauaggagcagggguauacaaagaaggcacguuccauacaauguggcauguuacucgcggugcaguacuaaugcacaaagggaagagaauagaaccaagcugggccgacguaaagaaagaucucaucucauacgguggaggguggaaacuugagggggaauggaaagaaggagaagaagugcaaguacuugcccuugaaccagggaaaaauccaagagcuguucaaacaaaaccgggccuguucaaaacgaacacuggaacuaucggggccguaaguuuagacuucucaccagguacaaguggaucuccuauaguugacaagaaggguaaaguaguuggucuauacgguaaugggguuguaacccguaguggaacauacguuucugcuauugcucaaacugagaagaguaucgaagauaacccggaaauagaagaugacauuuucaggaagaaaagguuaacaauuauggacuuacaccccggugcagguaaaacuaaaagguacuuaccagcaauaguuagggaggccauaaaaagaggguuaagaacguuaauccuugcacccaccagaguaguugccgcggaaauggaagaagcacuuaggggauuaccaauaagguaucaaacgccggccaucagagcagagcauacagggagggaaaucgucgaucucaugugucacgcaaccuuuacaaugcgacuacuaucaccgaucagaguacccaauuacaaccugauuaucauggaugaggcacacuuuacugauccagcaaguauugcagcgcgagguuacauuagcacgaggguagagaugggggaagcagccgguaucuucaugaccgcuacaccaccugguaguagagacccuuuuccacaaaguaaugcaccuauaauggacgaagaaagggaaaucccggaaaggaguuggaacucgggacacgaauggguaacagacuucaaaggaaaaacaguuugguuuguuccaucaauuaaagcuggcaaugauauagcugcgugucuaagaaagaacgggaagaaagucauacaacuuucaagaaagaccuucgauucggaguauauuaaaacuaggacuaacgauugggacuucguuguaacaacagauauaucugagaugggggcgaauuuuaaagcggaacguguuauugacccgagacggugcaugaaaccgguaauccuaacugauggagaagaaaggguaauauuggcaggaccuaugccaguaacccauucaagcgcagcacaaagaaggggaagagucggaaggaaucccaaaaaugagaacgaucaguauauuuauaugggugaacccuuagagaacgaugaagacugcgcgcauuggaaagaagcaaaaaugcuauuagauaauauaaauacaccagaaggaaucauaccaaguauguucgaaccggaaagggaaaaagucgacgccauugacggagaauauagguuaagaggagaagcgaggaaaacguucguagauuuaaugagaaggggcgaucucccugucuggcuagcauacagaguggcggcugaaggcauaaacuacgcugaucgaagaugguguuuugacgguguaaagaauaaccagauucucgaagaaaacguugaaguugagauauggacgaaagagggcgagaggaagaaacuaaaaccgcguugguuagacgccaggaucuauuccgauccgcuggcuuuaaaagaguuuaaagaauuugcggcuggcagaaagucacuuacuuugaacuugauaacagaaauggguagguugccaaccuucaugacucagaaggcgcguaacgcguuggauaaccucgcaguucuucauaccgcagaggcgggaggcagagcauauaaucacgcucuuagcgaacuaccggaaacccuagaaacgcuucuuuuauuaacuuugcuugcuacugugaccggcggcauauucuuguucuuaaugagugggaaaggaaucggaaaaaugaccuuagguauguguugcauaguaaccgcuuccauauuacucugguacgcacaaauccaaccccacuggauagcugcaaguauaauuuuagaguucuuuuuaaucguguugcuaauaccagagccugagaaacaaagaacaccacaagauaaucaguuaacauaugucguaauagccauccugacaguuguagcugcaacaauggcaaacgaaaugggguuuuuagagaaaaccaagaaagacuuuggucuagguagcauaaccacacaacagccugaaucgaauauuuuagauaucgauuuaaggccugcaucugcauggacacuguaugcgguugcaacaacauuuauuacgccaauguugcgacacucuauagaaaauaguucugucaacgugagccuuacagcgauagcaaaccaggcaacaguacugaugggguuaggcaaagguuggccguugagcaagauggacaucgggguaccauuauuagcuauaggaugcuauucucaagugaauccuaucacccuuaccgccgcauuauugcuccuaguugcgcauuacgcuauuauaggaccuggucuacaagcaaaggcuacacgugaagcccagaaacgagcagcugcggguauuaugaagaauccuacgguggaugguauaacugugaucgauuuagacccaauacccuaugauccaaaguucgagaaacaacuaggccaagucaugcuucucguuuuaugugugacccagguauuaaugaugagaacaacaugggcgcucugugaagcauuaacgcuagcgacuggaccaaucuccaccuuaugggaagggaauccggggagauuuuggaacacaacuaucgccguuaguauggcgaauauauuucgagggaguuauuuggcgggcgcuggucuccucuucucaauaaugaagaauacugcaaauacuagaagaggaacugggaauacuggagaaacacuuggggaaaaguggaaaaacagacugaaugcccugggaaagucugaauuucaaauuuauaagaaaaguggcauucaagagguugauagaacucuagcuaaagaaggaauuaaacggggugaaacagaccaucaugccgugucaagaggaucugcaaaacuacgaugguucguagaacgcaaccuuguuacgcccgaagggaaagucguagaucuggguuguggucggggcgguuggucuuacuauugugguggucucaaaaacgucaaagaaguaaaaggcuuaacaaaaggcgggccaggacaugaagaaccaauuccuaugaguacauacgguuggaaccuuguacgcuuacaguccgguguagauguauuuuucaccccgccggaaaaaugugauacccuucuuugcgauauaggcgaaucuucgccuaauccuacaguugaagcgggccggacguuaagaguucuaaauuuaguggaaaacuggcuaaacaacaauacacaauuuugcaucaaagugcucaacccguacaugccgucugugauagaaaagauggaagcucuacagaggagauacggcggugcauugguccggaacccuccaucuaggaacucuacccaugaaauguauuggguauccaacgcaaguggcaauauaguaucaucgguuaacaugauuaguagaaugcuaauuaauagauucacgaugcgacauaagaaagcaacauaugaaccggaugucgauuuaggaagugggacucgaaacauuggaaucgagagugaaguaccaaaucuagacaucauaggcaaacgaaucgagaaaauaaaacaagaacaugaaacaaguuggcauuaugaucaagaucauccauacaaaacaugggcguaucauggcaguuacgaaacaaagcaaacaggcagcgcaagcucgauggugaauggcguuguuagguuacuaacgaagccaugggauguuauaccgauggugacccagauggcaaugacagauacaacaccauucggucaacagcgaguguuuaaagaaaagguagauacccgaacacaagaaccaaaagaaggaacuaagaaauuaaugaaaaucaccgcagaguggcuauggaaagaacugggcaagaagaaaacaccuaggauguguacgcgcgaagaguucacaagaaaaguacgaucaaaugcugcccucggagcgaucuucacugaugaaaacaaauggaaaagugccagagaagcaguagaagauaguggguucugggaauugguagacaaagaacgaaaucuccauuuagaagguaaaugugaaacuugcguauauaacaugaugggcaaacgugagaagaaacugggagaguuugguaaggcaaaagggucacgagccauaugguacauguggcuaggagcacgauuccuagaauuugaagcauuggguuuccuaaacgaggaucacugguucaguagagaaaauucauuguccggaguugaaggggaaggacuccacaaguuagguuacauacuaagggauguuaguaagaaagaagggggugcgauguaugcugacgauacagccgguugggauaccaggauaacccucgaagaucucaaaaacgaagaaaugguaacuaaucauauggaaggugagcauaagaaacuagcagaagcgaucuuuagacuaacuuaucaaaacaaaguaguacgagugcagcggccaacuccgcgaggaacugucauggacauuauaucuaggcgugaucagagaggauccggacaaguuguaacauacggccuaaacacauuuacuaauauggaagcgcaauuaauacggcagauggaaggugaggguguguuuaagaguauucaacaucuaacggcgacagaagaaauugcaguuaaaaauuggcuuguccgaguaggacgcgaaagauugaguaggauggcgauaucaggggaugacugcgucgucaaaccuuuugacgacagauucgcaaaugcuuugacagcuuuaaaugauauggggaaaguaagaaaagauauacaacaaugggaaccgaguagaggauggaaugacuggacucaagugccauuuugcagucaccauuuccaugaacucaucaugaaagaugggcgcguucuaguagucccgugccgaaaccaggacgaauuaauaggccgagcacgaauaucacaaggagcagguuggucgcuuagagaaacagcuugcuuaggaaaaaguuaugcucagauguggucucugauguauuuccaucgaagggaucuuagacucgcagcaaacgcgauuuguucagcugugccuucgcauuggguaccuacaucccguacaacuuggaguauucacgccacacaugaauggaugacuacugaagauaugcuaacaguguggaauagaguuuggauccaagagaauccauggauggaggauaagacaccaguggagucaugggaggaaauccccuaucucgggaagcgagaagaccaaugguguggcucauugaucggucugacaucaagggcaacaugggccaaaaacauccagacagccauaaaccaaguaagaucguuaauagguaaugaagaguacaccgacuauaugcccuccaugaaaagguuccgcagagaggaagaagaggcugguguccugugguaa

SEQ ID NO: 22869 - RNA, 9876 nt, Artificial Sequence
  derived and/or modified CDS sequence (opt6) from DENV-2__JQ955623__SS-prME
acggcagggaugaucauaauguuaauuccaaccgcaauggccuuucaucuaacaacgaggaauggagagccacauaugauaguuucgcgacaggaaaagggaaagucucugcucuucaaaacagaagacggagucaacaugugcacacuuauggccauggaccuaggagaauuaugugaagauaccauaacguauaauuguccacuacuacgacaaaacgaaccagaagauaucgauugcugguguaauucaacaucuacaugggucacuuauggaacaugcacagcuacuggggaacaucggcgagaaaaacggucgguagcacuagugccucauguaggaaugggucuggaaacuagaacagagacguggaugucaucagagggagccuggaaacacgcacagaggauugaaacuuggaucuugcgacacccgggcuucaccauaauggcggcuauuuuagcauauacaauuggaacuacacacuuucagcgaguucucaucuucauccuguuaacagcaguagcaccuuccaugacaaugcgcuguauagggaucaguaaccgagacuucguugagggcgucaguggggggucuuggguagauaucguguuggagcacggcucauguguaacgacuauggcaaaaaacaaacccacuuuagacuuugagcugaucaaaacagaagcuaaacaaccagcaacucuaagaaaauauugcauugaggccaaauugacuaauacaacaacagccuccagaugccccacacaaggagaaccgagucuuaaugaagagcaagauaaaagguucguuuguaaacauagcaugguagauagaggcugggguaauggcuguggccuguucgggaaaggagggauuguaacaugugcuauguuuacuuguaaaaagaauauggaagguaaaaucguacaaccagagaaucuggaauacaccauugucguaacaccucacucaggggaagagaacgccgucgguaacgacacaggcaaacacggaaaagaaauaaaaguuacuccacaaucuuccauaaccgaagcagaauugacugguuaugguacgguaacuauggaauguagcccaagaacaggauuagauuucaaugaaaugguucuccuucagauggaaaacaaagcauggcugguacauaggcaaugguuuuuagauuuaccacuuccuugguugccaggggcagauacacaaggaaguaauuggauccaaaaagaaacauuaguaacauuuaaaaacccucacgcaaaaaagcaagacguaguuguauuggggucacaagaaggagcaaugcacaccgcacuaacuggggcuacagaaauccaaaugaguucuggcaaucuauuauucacgggacauuuaaaaugccgacuccguauggauaaauuacaauugaagggaaugucauacucaaugugcacagggaaguuuaaaguugucaaagagauugcggaaacucaacacgguacgauagucauaagagugcaauaugaaggagauggcucgcccugcaaaauuccuuucgaaauaauggauuuggaaaagaggcacguccuaggaagauuaauaacugucaacccgauuguaaccgaaaaggacucucccgucaauauagaggcugaaccaccauucggagacucauauauuauugugggcguggagcccgggcaguuaaaauugucaugguucaagaaggggagcucaauaggucaaauguuugaaacaacaaugaggggggcuaagcguauggcaauuuuaggugauacugcgugggacuuugguucauuggguggaguuuuuacgucaauugggaaagcgcugcaucaaguguuuggcgcuauauacggugccgcauuuagugguguuucuuggacuaugaaaauauuaauuggugucguaauaacuuggauaggaaugaauucaaggagcacuucauugagcguaagucucguucuuguagguauaguuacacuguauuugggaguaaugguccaggcagacucagguugugucgugucauggaaaaauaaagaacuaaagugcggcucagguauauucaucacagauaaugugcauacguggacagaacaauacaaauuucaaccagaaucuccuaguaaauuagcuuccgcuauccaaaaagcacaugaagaagguauaugcgguauacguucaguaacuagauuagaaaauuugauguggaaacaaauuacuccggaguuaaaucauaucuugagugagaacgagguuaaacuaacgauaaugacaggagauauaaaggggaucaugcaagcagguaaacggagucuaaggccacagccaacagaacuaaaauauucuuggaagacaugggggaaggcgaagaugcuuuccacugagccacauaaccaaaccuuccugauugacggaccagaaaccgcagaauguccaaauaccaauagagcguggaauucgcuagaaguagaggauuacggguuuggugucuuuaccaccaacauauggcucaaauuaaaagaaagacaagacguauucugugauucuaaauuaaugagcgccgcaauaaaggauaauagggccguacaugcagauaugggauauuggauugaaagcgcacucaaugauacauggaaaauugagaaagccucguucaucgaggucaagagcugccauuggcccaaaucccauacauuauggucaaacgguguccuggaaucagaaaugauaauuccuaaaaauuuugcaggaccuguaucacaacacaauuauaggccuggcuaucacacucaaacagcuggucccuggcauuuagggaaacuggaaauggauuucgauuuuugugaaggaacaacugucguagucacugaagacugcggcaauaggggacccuccuugagaacuacuacagcguccggaaaguugaucacagaaugguguugucguuccuguacucuacccccucuuagauauagaggagaggacggauguugguauggcauggaaauacgaccacuaaaagaaaaggaggagaauuuaguaaauucauugguuacggcagggcaugggcaaauagauaauuuuagucuaggaguacuaggaauggcacuauuccuagaagaaauguuaagaacuagagucgguacaaaacacgcuguuuuacucguagcagugucuuuuaugaccuugauaacuggaaacaugucauuuagggaucuagggagaguaaugguaauggucggagcugcaaugaccgaugacaucggaaugggaguaaccuauuuagcauuacucgccgcuuucaaaguuagaccaacguucgcagcaggcuuauuacuuagaaaacuuacaucuaaggaauuaaugaugacgacaauuggaaucguauuauugucgcagucuacgaucccggaaaccauccuagagcuuacagaugcacuugcacucgguaugaugaucuuaaaaauuguaagaaacauggaaaaguaucagcuugcgguaacuauaauggccaucuuaugcguacccaaugccguuauccuacagaaugcguggaaagucucgugcacuauacuugcuguaguuucaguaagcccauuacuuuuaacauccucgcagcagaaagcugauuggaucccauuagcgcugaccauaaaaggauuaaacccaacagcaauuuuuuugaccacccucagucgaacaaacaaaaaaagauccuggccacuuaacgaagcaauaauggcaguagggaugguuucgauacuagcaucaagucuucugaagaacgacauaccaaugacaggaccauugguugcaggaggguugcuaaccguaugcuauguauuaacagguagaagugcugaucuugaauuggaaagggcugcugauguuagaugggaggaucaggcugagauuucggguucgaguccuauucuguccaucacaauaucggaagacggcuccaugagcaucaaaaacgaggaggaagagcagacuuuaacuauauuaauaagaacgggauugcugguaauuucaggccuauuuccggucucuauaccaauaacagcagcugcuugguaucuaugggaaguuaagaagcaacgggcgggcgugcucugggauguaccaucccccccuccuguggguaaagcagaacuggaagacggagcguacagaauaaaacaaaaagguauauugggguacucacaaauaggagcaggaguuuauaaagaaggaacuuuucauacuauguggcauguaacacguggggcuguauuaaugcacaaaggcaaacgaauagagcccucgugggcugacguaaggaaagauuugauuucuuauggugguggcuggaagcucgagggagaauggaaggagggcgaggagguccagguacuagcuuuggagccagggaaaaaucccagagcaguccagacgaaaccuggccuauucaaaacuaauacgggaacaauaggagcuguaaguuuagauuucucgccaggaaccucuggaucgccaauaguggauaaaaaaggaaaaguggugggucuauauggaaacggagucguaacccguuccgguacguaugucucagccaucgcccaaacugaaaaaucuauagaggacaaccccgaaauagaagaugacauauuucgcaaaaaacgacuuacaauaauggaucugcacccgggcgcgggaaaaaccaaacguuacuuaccagcaauuguaagagaggccauuaaaagaggacuuagaacucuaauucuagcuccuacuagaguuguagcagcagaaauggaagaagcguuacggggucuuccuauacgauaucaaaccccagcaauacgggccgagcauaccgguagagagauuguagaucuaaugugucaugcgacauuuacaaugagguuacuuagcccuguucguguaccaaauuauaaucucauaauaauggacgaagcgcacuuuacagaucccgcuaguauagcugcucggggauauauaucgacgagaguagagaugggagaagcggcagguauauuuaugacugccacaccaccggggucuagagacccguuuccccaaaguaacgcgccaauaauggaugaggagcgagaaauacccgaaagauccuggaauucagggcacgaguggguuacagacuuuaaggggaaaacuguuugguuuguccccagcaucaaggcggggaaugacauagcugccugucuuaggaaaaacgguaaaaaaguuauccaauuaucgagaaagacauuugauagugaauauauuaagacaagaacuaacgacugggauuuuguuguaacaacagauauuagcgaaaugggugccaauuuuaaagcugagagaguaaucgacccuaggagguguaugaaaccuguaauucucacagauggagaagaacguguaauccuagcugguccaaugccgguuacacauucuucagcugcucagcguagaggaagaauuggucgaaauccaaaaaaugaaaaugaucaauauauauauaugggagaaccauuggaaaacgacgaagauugugcucacuggaaagaagcaaaaaugcuucuagacaacauaaauacaccagaaggaauaaucccaucuauguuugagcccgaaagagaaaaaguagaugcuauugacggggaauauagauuaaggggugaggcaagaaaaaccuucguagauuugaugcgcaggggagauuuaccugucuggcuagcauacaggguagcagcagaagggauaaauuacgcggauaggcgaugguguuuugacggaaucaaaaauaaucaaauuuuagaagaaaacguggaaguugaaaucuggacgaaggaaggugaaagaaaaaaacuuaaaccgcgaugguuagaugccagaauuuacucagauccguuagcccuuaaagaauucaaagaguuugcggccggacguaaaucauuaacacuaaaucugauuacagaaaugggaagauuaccuacauuuaugacacaaaaagcucgcaacgcacuagauaauuuagcuguguuacacaccgcagaggcggguggacgcgcauauaaccaugcacuuucggaauuaccagagacacuagagacacuccuacuucuaacacuuuuagccacagugacaggaggaauuuucuuauuccuaaugagugggaagggcauuggaaagaugaccuuggggaugugcugcauuauaacugcuagcauacuucuaugguacgcgcaaauacaaccacauuggaucgcagcaagcauaauucuugaauucuuuuuaauaguguuacuaauaccugagccugaaaaacaacgcacgccucaagacaaccaauuaaccuaugucgugauugcaauacuuacaguaguugcagcuacuauggcgaacgaaaugggguuuuuagagaagacuaaaaaagauuuuggacucggaagcauagcuacgcaacaacucgaaaguaauauacuagacauugauuuacguccagcaagugcauggacacuuuacgcaguagcgacuacauuuauaacgccaauguuacgacacaguauagaaaacuccaguguaaaugugucacucacagccauagcuaaucaggcaacuguauuaauggggcuaggaaaagguuggccccuaagcaaaauggacauaggcguuccauuacuagccauugguugcuacucacaaguuaacccaauaacguuaacugcugccuugcugcuacuuguagcccauuaugcuauaauaggccccggguuacaggcgaaagcuacccgagaagcacaaaaaagggcugcagcagguaucaugaaaaauccaacuguagaugggauaaccguaaucgauuuagaccccauaccuuaugaucccaaauucgagaaacaacuagggcaaguaauguuacugguauuaugcguaacgcaaguacuaaugaugcguacaacgugggcuuuaugugaggcguugacacuugcgacaggaccuauaagcacccuuugggaaggcaaccccggucgauuuuggaauacuacgaucgcugugucgauggccaauauauuccgaggcaguuaccucgcaggagcaggcuuacuuuucuccauuaugaaaaacacuacuaacacaagacgugguacagggaacacaggugagacucuaggggaaaaauggaaaaaucgccugaauucucuagggaaaagugaauuccagauuuauaagagaaguggaauucaagaaguagauagaacacucgcuaaagaagggauuaagcgaggugaaacagaucaucacgcgguaaguaggggaagcgccaaacuaagaugguuugucgaacggaaucuagugacacccgaggguaaaguaguugaccuugguugugggcgaggaggauggucuuacuacuguggaggccuuaaaaauguaagagaaguaaaaggucuuacaaaaggagggccuggucaugaagaaccuaucccgaugaguacguauggauggaauuuaguaagacuccaauccggcguugacguauuuuuuacucccccagagaaaugcgacacuuuauugugcgauauuggugagaguuccccaaacccaacggucgaagcugggagaacccuacgaguauuaaauuugguugaaaauugguugaauaaugacacccaguucuguaucaaaguacuaaauccguauaugccuucaguaauagaaaaaauggaagcguuacagaggaaauaugguggugcacuaguaagaaauccacuaaguaggaauucaacacaugaaauguauuggguaucaaacgcuagcggcaauauaguaaguuccgucaauaugauuagucguauguuaauuaacagauuuacaaugaggcacaaaaaagcaacauaugaaccagacguggaucuaggaucgggaacucguaauauagguauagaaagugaaacaccaaaccuagauauaauuggcaaaagaauagaaaaaauuaaacaagaacacgagacaaguuggcacuacgaccaggaccauccauauaaaacuugggcuuaccaugguucauacgaaaccaaacagacgggcucugcgagcucaauggugaacggaguaguacgacuacucacaaaaccgugggauguaauacccauggugacacagauggcuaugacagauacaacacccuuuggccagcagagaguauucaaagaaaaggucgacacacggacgcaagaaccuaaagaaggaaccaagaaacuaaugaagauaaccgccgaaugguuauggaaagaguuaggcaaaaaaaagacuccucgaauguguacaagggaagaguuuacuagaaaaguaaggucgaacgcagcauuaggagcaaucuuuaccgaugagaauaaguggaaaagugccagggaagcuguagaggauucucgauuuugggaacuugugaacaaagaacgaaaucuacaccuugaagggaaaugcgagacuuguguauauaauaugauggguaagagagaaaaaaagauaggugaauuugggaaagcuaaagguucaagggcaauaugguacaugugguuaggugcaagauucuuagaauucgaggcauuaggauuuuuaaaugaagaccauugguuuagucgagaaaauagucuuagcggaguagaaggagaaggccuucacaaauuaggguauauauugagggaggugucaaaaaaagaagguggugcuauguacgcugaugauaccgcagggugggauaccaggauuacucuugaggauuuaaaaaaugaagaaauggucacuaaccauauggaaggcgaacauaagaaguuagcagaagcuauauuuaaacuuacuuaucagaauaaaguagucagaguucaacguccaacuccgagggggaccgugauggauauaauaagcagacgcgaucaaagagguucuggucaggucgggaccuacggucuaaacacuuuuacaaauaugggagcacaacuaauucgccaaauggagggcgagggaguauucaaaggaauccaacaucuaacagcaacugaagaaacggccguacaugauugguuggcaaggguaggacgugaaagauuaucgagaauggcaauaucaggggaugacugcguuguaaaaccguuggaugauagguuugccagcgcacuuacugcccugaaugacaugggaaaaguucggaaagacauacaacaaugggaaccgucaagaggcuggaaugacuggacacaaguaccguuuuguagccaucacuuccacgaauuaauaaugaaagauggacggguucugguaguuccaugcagaaaccaggaugaauuaauaggcagggcacgaauaucacaaggagccggauggagucugagagaaacagcgugucuuggaaaauccuaugcucaaauguggucccuuauguauuuccaucguagagauuugcgacuagcggcuaaugccauuuguucagcgguaccuucucauuggguccccacuucaagaaccacaugguccauccacgcaaggcaugaguggaugaccacggaagacaugcugacuguguggaaucgcguauggauacaagaaaauccguggauggaagacaaaacuccuguagagaguugggaagaaauccccuaucuagggaagagagaagaucaauggugcggaagcuuaaucggccucacuucaagagcaacuugggcgaagaauauucagacagccauuaaccagguacgcucacucauagguucagaggaauauacagacuacaugccaaguaugaaaagauucagacgggaggaagaagaagcagguguauuaugguga

SEQ ID NO: 22870 - RNA, 9876 nt, Artificial Sequence
  derived and/or modified CDS sequence (opt6) from DENV-2__KR779782__SS-prME
accgcagguaucauaauaaugaugauuccaaccguaauggcauuucaucuaacgacucggaauggagaaccucacaugauagugucaagacaggaaaaaggaaaauccuuauuauucaaaaccgaaaaugggguaaauaugugcacgcucauggcgauggacuugggugaacugugcgaagacacuauuacuuauaacuguccucuuuuacgucaaaacgaaccugaagacauugacuguuggugcaacaguacuuccacguggguaacauacggaacauguacggcaacuggagaacauagaagagaaaaacguucaguugcgcuagugccacacgucgguaugggguuagaaacacgcacagaaaccuggauguccuccgagggugcauggaaacaugcacaaagaauugagaccuggauauuaagacacccaggauuuacaauaauggcugcuauacuagcauacacgauaggaacaaccuacuuucagagaguacuuauauuuauucuucuuacggccgucacaccauccauggcuaugagaugcaucgggauuucaaauagagauuucguugaagguguaucuggaggcaguuggguugauauaguauuggagcauggcagcugcgugaccacuauggccaaaaacaaaccuacacuagacuucgaauuaaucaaaacugaagcaaaacacccagccacauugagaaaauauugcguggaagcuaaacuaacuaauacuacgacagccagccgauguccaacacaaggagaacccucauugaacgaagaacaagauaaaagguuugucugcaaacacuccaugguugacagaggguggggaaacggaugcggccuauucggaaaagggggaauaguuacaugugcuauguucacaugcaagaaaaauauggaagguaaagugguacaaccggagaauuuagaguauacaauaguaauaacaccgcauuccggugaggaaaaugcaguugggaaugauacaggaaaacauggcaaagagauuaaagucacuccacaaaguucaaucacugaggccgaauuaacaggguaugguacuguaacuauggaguguucuccgagaaccggacuagauuuuaaugaaaugguccuucuacaaauggaaaacaaagcaugguuagugcaccgacaaugguuuuuagauuugccucucccaugguugccgggugcggacacgcaggggaguaacuggauucaaaaagaaacacuuguaacguuuaaaaacccacaugccaagaaacaagauguggugguacucgguagccaagagggagcuaugcacacugcauuaacuggugccacagaaauacaaaugucaucuggaaaucugcuguucacuggacaccugaaauguagacucaggauggacaaacuacaacuaaaaggaaugagcuauagcaugugcaccgggaaauuuaaaguaguuaaagagauagcagaaacucaacaugguacaauagugauaagaguacaauaugaaggagauggcuccccuugcaaaaucccauuugaaauaauggaucuagaaaaacgacauguauuggguagacuaauaacugucaauccuauaguuacugaaaaggauagucccguuaacauagaggccgaaccuccuuucggagauaguuauauaauaauagguguagaaccugggcaguuaaaacucucuugguucaagaaaggaaguagcauaggccaaauguucgagaccaccaugagaggcgcaaagaggauggcaauauugggggauacagcaugggauuuuggaagucuagggggaguauucacaaguauugguaaagcacuacaucaaguauuuggcgcaauauauggugcugcauuuucugguguaaguuggacgaugaagauauugauaggagugguaauaacauggauagguaugaacucacggucaaccagcuugucaguuagucugguauuggucgguguuguuaccuuguauuuaggagucaugguucaggcugacaguggaugcgucguguccuggaaaaacaaagaauuaaaauguggcucuggaauauucauaaccgauaauguccauacguggacugaacaauauaaguuucaaccugaaucuccaaguaaguuagccagugcaauacaaaaggcucacgaacaaggcauuugcggaauaagauccgucacuaggcucgaaaacuuaauguggaaacaaauaacgccagaauuaaaccacauauugacggaaaaugaaguaaaacuaacgauaaugaccggugacauaaaaggcaucaugcaagcagguaaacgcuccuuacgaccacaaccuaccgaacuaaaauacucauggaaggcguggggcaaggcuaaaauguugucuacagaacuccacaaccauacauucuugaucgauggaccugaaacagcagaaugccccaacaccaauagagcauggaauagcuuagagguugaggauuacggauucgguguuuucacgacuaauaucugguuaaaauugaaagaaagacaggauguauucugcgacucuaaacuaaugucagcagccauuaaagacaauagagcagugcaugcagacauggguuauuggauagaaucugcacuaaaugacacauggaaaauagaaaaagcaaguuucauugaaguaaagucaugccauuggccuaaaucgcauacauuauggagcaacggggucuuagaaagugaaaugauuauucccaaaaauuuugccgguccggucucacagcauaacuaccggccaggguaccauacucagacagccggaccuuggcacuuaggucgcuuagaaauggacuuugauuuuugcgaaggaacaacagugguaguaacagaggauuguggaaauagagggccgagucugcguacuacgacggcaucaggaaaauuaauaacagagugguguugucggaguugcacgcucccaccacuccgauaccguggcgaagauggguguugguaugguauggaaauuagaccucuaaaagaaaaagaagagaauuuagugaacagcuuaguaacugcaggacauggucaaaucgauaacuucagcuuagggguucucggaauggcccuauuuuuagaggaaaugcuaagaacgcggguggguacgaagcaugcuauucuauuaguagcaguuucuuucgugacuuuaauaacagguaauaugucauuccgugauuuaggcagggucaugguaaugguaggagcgacaaugacugaugauauagguaugggcguuaccuaucuagcacuacuugcagccuuuaagguuagaccgacuuuugcugcuggacuacuuuugaggaaauuaacgaguaaagaacucaugaugacgacaauugguauaguacuccuaucgcaaucaacaauaccagaaaguauuuuggagcugaccgaugcauuagcccuuggaaugaugguacuaaaaauuguaagaaauauggaaaaauaucaauuggcgguuacaauaauggcaaucuuaugugucccuaacgcaguaauacuacaaaacgcauggaaagugucgugcacaacauuggcaguagucucugucucuccuuuacuucucacaaguucacaacagaaagcagauuggauaccguuagcuuuaacaauuaaaggucugaaucccacggcgaucuuuuugacuacuuuaucgagaacauccaagaaacguagcuggccacuaaaugaggcaauuauggcaguaggaaugguuucaauacuagcgaguucucugcucaaaaacgacauaccaaugacaggaccccuaguagcggguggcuuauuaacaguuugcuaugugcuaacuggaagaagugcagacuuagaauuagagcgcgcagcugauguuagaugggaggagcaagcagaaauuucaggcucaaguccaaucuuaucuauuacuauuucagaagauggcucaaugucaauuaaaaacgaagaagaagaacaaacacuaacaauacucauuaggacaggucuucucguaauuuccggucuauuucccguaucaauaccuauuacggccgccgccugguacuuaugggagguuaagaaacaacgagcaggaguauuaugggauguuccaagcccaccuccaguggggaaggcagaacuugaggauggagcauacagaauaaaacaaaaaggcauucucggcuauagccaaaucggugcaggaguauacaaagaagggacauuccacacaauguggcacguuacccgcggggcaguauugaugcauaagggcaagcgaauugagccuucaugggcugauguuaagaaagaucucauaagcuauggggguggauggaaacuagaaggugaauggaaagaaggagaggaaguacaaguuuuagcgcuugagccaggcaaaaauccaagagcuguucaaaccaagccaggucuauucaagacuaauacuggcacaauaggagcgguaucucuagauuucucaccuggaacaagcgggagcccuauuguagauaagaaagggaaaguaguuggacuauacggaaauggagucgugacacguucaggcacuuaugugucagccauagcucaaacagaaaaaucuauagaagauaauccagaaaucgaagaugacaucuuuaggaagaaaagacuaacaauuauggaccuucaucccggugccgguaaaacgaaaagauaucugccggcgauaguccgagaggcaauuaaacgcggucuuagaacccuuauucucgcaccaacacgaguggucgcggcagagauggaagaggcuuuacgaggacuucccauaagauaucaaacuccugcaauacgagccgaacacacggguagagagauuguagaucugaugugccaugcaaccuuuacaaugcgacuauuaucaccaaucagaguaccgaacuauaaccuuaucauaauggaugaggcacacuuuacggacccagcauccauugcagcacgagguuauaucaguacaaggguagaaaugggugaagcagcaggaauuuuuaugaccgcuacgccaccugggaguagggauccuuuuccgcagucuaacgcaccaauaauggaugaagagagggaaauuccagaacgaucuuggaacucgggacacgaauggguaacagauuuuaaagguaaaacaguaugguuuguccccucaaucaaagccggaaaugacaucgcagccugcuuaagaaagaacggaaagaaaguaauucaacuaaguaggaaaacauucgauagugaauacauaaaaacuaggacgaacgauugggacuucguaguaacuacggacauaucggaaaugggcgcgaacuuuaaagccgaacguguaauagauccgcgcagauguaugaagccgguaauccuuacagauggagaggagaggguaauacuagcaggaccaaugccgguuacucacucuagcgcugcacaaagacgaggcagagucggccgaaauccgaaaaaugaaaacgaucaauacauauauaugggcgagccauuagaaaaugacgaggauugugcacauuggaaagaagcaaagaugcuacuggacaauaucaacacuccagaaggaaucaucccaucaauguuugagccagagagggaaaaaguagacgcaauagauggggaauauagauuacggggugaggcaaggaaaacguucguugaucuaaugagaagaggcgaucuuccuguaugguuagccuaucggguagcagcugaagggauaaacuaugcagacaggcgauggugcuucgauggagucaaaaauaaucaaauauuagaggagaacguagaaguggaaaucuggacuaaagaaggagaaagaaagaaauuaaaaccgcgguggcuagacgcaaggaucuauucagauccacuagccuuaaaggaauuuaaagaauuugcggcaggacgcaaaucacucacgcucaauuuaaucacagaaauggggagauuaccaacuuuuaugacacagaaagcuaagaacgcacuagacaaccuagccguauuacacacggcagaagcuggagguagagcauauaaccacgcgcuuucugaauuaccagagacuuuagaaacgcuucuacuacuuacuuuacucgcaacaguaacaggaggcauauuucuauucuuaaugaguggaaaagggauaggaaaaaugacauuggggauguguuguaucauaacagccagcauccuguugugguaugcacaaauucaaccucacuggauugcagccucuaucaucuuggaguucuuuuuaauaguuuuauuaauacccgaaccagagaagcaaagaacaccacaagauaaucaauugacuuauguagugaucgcaauacuuacuguuguggcggcgacuauggcaaacgaaaugggauucuuggagaaaacgaaaaaggauuucgguuuaggcagcauaacgacacagcaaccagaguccaacauucucgacauagaccugagaccagcaucugcguggacacucuaugcaguagcaacuacguucauaaccccaaugcuacgucacaguauagaaaacucgucagugaacguuagcuuaacagcgauugccaaucaagcuacuguucuaaugggucuuggcaaaggauggccccuuucaaagauggauauaggcguaccauuacuagcaauaggcugcuacucccagguaaauccaauuacgcuuaccgccgcauuguuacuccugguagcgcacuaugcaauaauaggacccggacuacaggcaaaagcgacaagagaagcacagaaaagggcggcagcuggaauaaugaagaacccgacugucgauggaaugacaguaauagauuuagauccaauaccguacgauccuaaauucgaaaagcaauugggucagguaauguugcuaguacuaugcguaacccaaguacuaaugaugagaacaacaugggcacucugcgaagcacuuacauuggcaacagguccaauuuccacacuuugggaggggaauccuggaagauuuuggaacacuaccaucgccgugagcauggcuaacauauuuagagguagcuacuuagccggcgccgguuuguuauucucaauuaugaagaauacagcaaacacacguagaggcacugguaauacaggcgaaacuuugggcgaaaaauggaaaaaccgacugaaugcacuuggcaaguccgaauuucagauauauaagaaauccggcauccaggaaguagaucgaacacuugccaaagaagguauaaaaaggggugaaacggaccaccacgcaguuucaagagguagcgcaaaauuacgcugguucguggaacgaaaucuagugacgccggaaggaaaaguaguugauuuagguuguggcagaggggguuggagcuacuacuguggcggccucaaaaacgugaaagagguuaaaggccuuacaaaaggugguccuggacaugaagaaccgauaccaaugaguaccuauggauggaacuuagucagacuacaaagcggcguagauguuuucuuuacaccaccagagaaaugcgauacacuccucugcgacauaggugaauccagcccaaaccccacugucgaagcuggucguacauugagaguccugaauuuaguugaaaauugguugaauaauaacacucaguuuugcauuaaaguuuugaaucccuauaugccaucggugaucgagaaaauggaagcguuacagagaaaauaugggggugcccuagugcgcaauccucuaucacgaaauucuacgcacgaaauguacuggguaucgaacgcgagugguaauauaguaaguucaguaaauaugauuagucgaauguugauuaaucgauuuacaaugaggcacaagaaagcgaccuacgaaccugauguagaccuagggaguggaaccagaaauauagggauagaaucugagaccccaaauuuagauauuauuggcaaaaggauugagaaaauaaaacaagaacacgagacuagcuggcacuacgaccaagaucacccauacaaaacgugggcauaucacggauccuacgaaaccaagcaaaccggaagugcuucaucaaugguaaauggagucgugaggcuuuuaacgaaaccaugggauguuauuccaaugguaacccaaauggccaugaccgauacaacaccuuucggacaacaacgaguauucaaagaaaaaguggauaccaggacucaagaaccuaaagaggguacaaagaaauugaugaaaaucacugcugaaugguuguggaaagagcugggcaaaaagaaaacuccaagaauguguacuagagaagaauuuacacguaaaguuagaagcaaugcagcauuaggggcaauauuuaccgacgagaauaaauggaaaucugcucgugaagcaguggaagauuccggauucugggaacucgucgacaaggaaagaaaucuacaucuagaaggcaaaugcgagacuugcgucuauaauaugaugggaaaacgagagaagaaacuuggggaguucgggaaagccaaagguagucgagccauaugguauauguggcuuggagcaagauuuuuagaauuugaagcacugggauuucugaaugaagaucauugguuuucgagagagaacucauuaucaggcguugagggggaaggacuacacaaacuuggguacauccuuagagacguaucuaagaaagaaggcggugcaauguacgcugacgacacggccgguugggacacucguauaacuuuagaagaucuuaaaaacgaagaaauggucacaaaccauauggagggggaacauaagaaacuagcugaagccaucuucaaauuaaccuaucaaaacaagguuguccguguacagaggcccacuccacgagggaccguaauggauauaaucucaagaagggaccagcgggguucaggccaaguaguaacuuacgguuuaaauacauucacaaauauggaggcacaauuaauuagacaaauggaaggcgaaggagucuucaaaucuauccaacaacuuacaguuaaagaagaaauugcuguuaaaaauuggcuaaucagaguaggacgagaacgauuaucacgaauggcgauaucgggcgacgauugcgucgugaaaccacuugaugacagguucgcgucggcacucacagcucuaaaugauauggguaaaguaagaaaagauauacaacagugggaacccucccgaggguggaacgauuggacgcaagugcccuuuuguucccaccacuuucaugaguugauaaugaaagauggacgcguacucguaguucccugucgcaaccaggaugaacugauaggcagagcucgcauaagccagggagccggauggagcuuaagggaaaccgcaugcuuagguaaaucauaugcucaaauguggagucugauguauuuccaccgaagggauuugcgacuagcugcaaaugcaauaugcuccgcuguuccaucucacugggugccuaccagucgaacuacguggagcauacacgcaacacacgaauggaugacuacagaagacaugcucacaguguggaacagaguguggauacaagagaacccguggauggaagauaagacuccuguugagucgugggaagaaauacccuaccuuggaaaaagggaagaccaguggugugguucauugauuggucuaacaaguagagcaacaugggcgaaaaauauacaaacugcuauaaaucagguaagaucucugauugguaaugaggaauacacagauuacaugccaucaaugaagagauuuagacgagaagaagaggaggcaggggugcuaugguaa

SEQ ID NO: 22871 - RNA, 9876 nt, Artificial Sequence
  derived and/or modified CDS sequence (opt6) from DENV-2__KM279608__SS-prME
acagcugguaucauuauuaugaugauaccgacaguuauggcauuccacuugacuacaaggaauggagaaccacacaugauaguaagucgacaagagaaaggaaaaucauuacuuuuuaaaacagaaaauggaguaaauauguguacauuaauggcgauggaucuaggugaauuaugcgaggauacaauaacauacaacuguccauuguuaagacaaaaugagccagaagauauugauuguugguguaauucgacuaguacauggguaaccuauggcacgugcacagugacaggagagcaccgucgcgaaaaacgcaguguagcguugguaccucauguaggaaugggucuugagacgagaacagaaacauggaugaguucugagggggcauggaaacaugcucaacgaauugaaacuuggauauugcgucauccaggguucacgauaauggcugccauccuugcguauacaauagggaccacauaucugcagcgaguucuuaucuuuauacucuuaacagcaguaacgcccagcauggcaaugcgauguauaggcauuaguaaucgggauuuugucgagggugucagcggugguucauggguagauauaguuuuggaacacgguuccuguguaaccacaauggcgaaaaacaagccaacauuggacuuugaacucauuaaaacagaagcaaaacacccagcuacauuaagaaaguauuguguagaagcgaaacuuacaaauaccacuacagcgagcagauguccaacucaaggagaaccaucucuaaacgaagagcaggauaaaagauucguauguaaacauucaaugguagauagagguuggggaaauggaugcggucuuuucggaaaaggcggcauaguuacuugugcaauguucacauguaaaaaaaauauggaggggaaagugguacaaccagagaauuuagaauauacaaucguaauaacaccgcauucaggagaagaaaaugcaguagguaacgauaccgguaaacacggaaaagaaauuaagguuacgccccaaagcagcauaacggaagcugaauuaacaggguacggaacaguaaccauggaaugcucgccaaggacagggcucgacuucaaugaaaugguacuuuuacaaauggaaaauaaggccugguuagugcaccgucagugguuucuggaucuaccauugccguggcuuccaggagcagauacacagggauccaauuggauccaaaaggagacccucgucacuuucaaaaauccacaugcaaaaaagcaggauguuguuguacuggggucgcaagagggggccaugcacacagccuugaccggagcaacugagauccaaaugaguagcggaaauuuauuauucaccggucaucuaaagugccggcuacggauggacaaauuacagcuuaaaggaaugaguuauucuaugugcacaggcaaauucaaaguagucaaagaaauugcagagacacaacauggaaccauuguaauacggguacaauaugaaggggacggcucaccauguaaaauccccuuugaaauuauggacuuagaaaaaagacaugugcucggccgauugauaacggucaacccaauugugacagaaaaagauaacccagugaauauagaggcagaaccgccauucggagauuccuauauaauaauaggaguugaacccggacaacuaaaacuuucgugguacaaaaaagggucaucgauaggacaaauguucgagacaacaaugagaggagcaaaaagaauggcaauacuuggagauacggcgugggacuuuggaagucugggggggguauuuacuagcauagguaaagcgcuacaucagguauuuggugcuauuuacggggcggccuuuucgggagucuccuggacaaugaaaauacuaaucggaguugugauaacauggauaggaaugaacuccagaaguacuucauuaucaguaagccuaguacucguuggaguuguuacucuauauuugggggugaugguacaggcggacagugguugcguuguuagcuggcgaaacaaagaacuaaaaugugguucugggaucuuuauuacagauaaugugcacacauggacugagcaguacaaauuccaaccagaaucuccuagcaagcuggcaucagcaauucaaaaggcgcacgaagagggcaucugcgguauaagaucagugacacgacuagaaaaccugauguggaaacaaauaacgccagagcuaaaucacaucuuaacagaaaacgaaguuaaauugacuauaaugacaggggauauuaaagguaucaugcaggcggguaaacgaagccuucgcccgcagccaaccgaacugaaauacaguuggaaagcuuggggaaaggcaaaaauguugucaacagaacuucauaaucauaccuuucucauugauggcccagaaacggcagaguguccuaacacuaaucgagcauggaauucccuagaaguagaggacuacgguuuugguguguucacaacgaacauauggcucaaacuaaaggaacgacaagauguuuuuugcgauaguaaguuaaugucugcagcaauuaaagauaaucgggcaguacaugccgacaugggauauuggauugaaucggcauuaaacgacacauggaaaaucgaaaaagcaagcuuuauagaaguaaaaucgugccacuggccuaaaucacacacucuuuggagcaauggaguacuggaaucugaaaugauaauuccaaaaaauuuugccgguccugucucccagcauaauuaccguccuggguaccauacccaaacugccggaccuuggcauuuaggucgauuggaaauggacuucgauuucugcgaagggacaaccguaguaguuacugaggacugcgguaaucgggguccaagccuaagaacgaccacagcgucuggaaaacuuauuacagaauggugcugcagaucaugcacacugccgccguuaagauaucggggcgaggauggaugcugguacgggauggagauucgaccuuugaaagagaaagaagagaaucuaguaaauucacucguaaccgccggacauggccaaauagauaacuucucauuggguguacucgguauggcauuguuucuggaagagaugcuacgcacgagagucggaacaaaacaugcgauauuguugguggcuguaucauucgugacuuuaauaacggguaauaugucauucagagauuuaggaagggucaugguuaugguaggugcuacuaugacagacgacauaggaaugggaguaacauaucucgcccuacuugcagcauucaagguccguccuacauuugcagccggcuugcuucuucgaaaacuaacgaguaaagaauuaaugaugacaaccaucgguauaguauuacugucacaaaguacgauaccagaauccauucucgagcuuacagacgcacuggcauuggggaugaugguacucaaaaucguuagaaacauggaaaaguaucaauuagcggugacuauaauggcuauauuauguguuccgaacgcuguuauacucgaaaacgcuuggaaagucuccuguacuacgcucgcaguuguuaguguaaguccucuuuuacuaacgucuagucaacagaaagccgacuggaucccgcuugcacuuacaauaaaaggccugaauccaacagcuauuuuuuuaacuacuuugaguagaaccuccaaaaaacggaguuggccacuaaaugaagcaauuauggcaguaggcauggugagcauacuagcaucaucucuacugaagaacgacauaccgaugacagguccuuuagucgcuggaggacuacuaacggucugcuaugucuuaacaggucguagugcagaccuugaacuugaaagggcagccgacguacggugggaagaacaagccgaaauaucugguucaagcccgauauugaguauaacaauuucagaagaugggucaaugaguauaaaaaaugaagaagaagaacagacauugacuauacuaauacgaacgggacuccucgugaucagcgguuuauuuccaguaaguaucccaauaacggcugccgccugguacuuaugggaagucaaaaaacagagagcgggagucuugugggauguacccuccccgccgccggucggaaaggccgagcucgaagacggggcauaccgaauaaaacaaaaagggauauuagguuauagccaaauaggagcgggaguguacaaggagggcacguuucauacgauguggcauguuacgagaggagcuguuuuaaugcauaaaggaaagagaauagaaccuucuugggcugauguaaaaaaagaccucauaagcuacggcggcggcuggaaacucgaaggagaauggaaagaaggugaagaaguacaaguacuagcuuuggagccggguaaaaauccucgggcgguccaaacgaaaccaggucuuuuuaaaacaaauacaggcaccauuggagcagucucucuagauuuuucuccuggaacuuccggaaguccuauaguggauaaaaaagggaagguaguugguuuauaugguaauggagugguaacuagaucagggacauacguaucugcaauagcucaaacggaaaagucaauugaggauaacccggaaaucgaagaugauauauuccgaaaaaaacgacuaacaauaauggaucuucauccaggugcuggaaagacgaaaagauauuuaccugcaauuguacgagaagcgauaaaacguggacugaggacauuaauacuagcgccaacaagaguuguugcagcggaaauggaagaggcguugcguggacugccuauaagauaucagaccccagccauucgggccgaacauacagguagagaaauugucgauuugaugugccaugcaaccuucacuaugagauuauuaaguccuauucgagucccaaacuacaaucuuauaauaauggacgaggcucacuucacagauccagccuccaucgccgcacgagguuacauuagcacuaggguagaaaugggagaagcagcaggaauuuuuaugacagccacaccaccuggaucacgggacccuuucccccaaucaaacgcgcccaucauggaugaggaacgagaaauaccagaacgcaguuggaauucuggccaugaguggguaacggauuucaaaggaaaaaccgucugguucgucccaaguauaaaagcggguaaugacaucgcagcaugcuuacggaaaaacgguaaaaaaguaauacaauugucacguaaaacguuugacuccgaguauauuaaaacucgaacuaacgacugggauuuuguaguaacaacagacauaucugaaaugggagccaauuuuaaagcagaaagagugauagacccaagacgcuguaugaaacccguuauucugaccgacggagaagaaagagugaucuuagcaggcccaaugccaguaacucauagcucugcugcccagcgcagaggacgugucggcagaaacccgaagaacgaaaaugaucaauacaucuacaugggagaaccucucgagaacgacgaagauugcgcacacuggaaagaagcaaaaaugcucuuggauaacauuaauacaccugaaggaauuauuccaaguauguuugaacccgaacgagaaaaaguagaugcuauugauggggaauauagguuaaggggugaggccagaaagacguucguagaucucaugcguagaggagaccucccagugugguuggcuuauaaaguagcugcggaaggcauaaauuacgcugaccgccgguggugcuuugauggugugaaaaauaaccaaauuuuagaagaaaauguugaagucgaaauauggaccaaagaaggagagcgaaaaaaauuaaagccuagaugguuagaugcgcgcauuuauagcgacccauuagcgcucaaggaguucaaggaauuugcagcaggaagaaaaucauuaacucucaaucucaucacagaaaugggcagauuaccaacauucaugacucagaaggcuaagaaugcacuagauaaucuagcaguacuccauacagcagaagcaggagguagagcauauaaucaugcacuuagugaacuuccagaaacacucgaaacccucuuauuacuaacauuauuagccacaguaacugguggaauauuucuauuucuuaugagcgggaaagggauuggaaagaugacucuagguauguguugcauaauaacugccucuauauuacuaugguacgcacagauacagccccauuggaucgcugcaucaauuaucuuggaauucuuucuaauugugcuacuuauuccagaaccagagaagcagagaacaccccaagacaaucaauuaacauacgugguuauagccauauuaacuguaguggcugcaacuauggcaaacgagaugggauuucucgaaaaaacaaaaaaagauuuuggucuggguuccauaacaacucagcaaccagaaucaaauaucuuggauauagaccugagaccugcaucugcauggaccuuauacgcuguagcaacgacguuuauaaccccaauguugagacacucuauagaaaauaguuccguaaauguuucauuaacggcaauugccaaccaagcaacagucuugaugggcuuaggaaagggcuggccccucucuaagauggacauuggaguuccguuacuugcaauagguugcuacagucaaguaaauccaauuacauuaacagccgcauuacuuuuguugguugcucauuacgcaauaaucgguccugguuuacaagcuaaagcuacaagggaggcgcagaagagggcugcagcugguaucaugaaaaauccaacaguggacgguauaacagucauugaucuggauccaauaccauaugauccuaaauuugagaaacaacuuggucaaguaauguuauuaguguuaugugugacucaaguauuaaugaugaggacaacaugggcacucugugaggcucuuacucuagcgacaggccccauuuccacuuugugggaaggaaacccuggccguuuuuggaauacuacuaucgcaguaaguauggccaacauauuuagagguucguauuuagcaggugcaggguuacuauuuagcauaaugaaaaauacggccaacacgagaaggggcacugguaacacgggcgaaacuuuaggcgaaaaauggaaaaaucgacugaaugcuuugggaaaauccgaguuucagaucuauaagaagucaggaauucaggagguugauaggacucuggcaaaagaaggaauuaagagaggcgaaacagaccaccaugccguuaguagggggucagccaagcuuagaugguuuguagaacgaaaccugguuacuccggaagguaagguuguggauuuaggaugugguagaggaggauggucuuauuauuguggaggacugaagaaugucaaagaagucaaagguuuaacgaagggaggacccggacaugaagaaccaauaccaaugucuacauauggauggaaucuuguuagacuucaaucgggcguagauguauuuuucacuccaccagagaagugugacacauuauuaugugauaucggggaauccaguccgaacccaacaguugaggccgggcggacuuuaagagucuuaaaucuaguagaaaacuggcuuaauaacaacacgcaguucuguauaaaaguucugaauccuuacaugccaagcguuaucgaaaaaauggaagcuuugcaaagaaaauauggaggugcacuugugagaaauccauugagccguaacucuacccaugaaauguauuggguaucuaacgcuucaggaaacauaguaucuaguguuaauaugauaucaagaaugcuaauuaaccguuuuacaaugcgccacaaaaaagcuacuuacgaaccugauguugaucugggaagugguacacgaaauauagguaucgaaucagagacaccaaauuuagacaucauagggaagagaaucaaaaaaauaaagcaagaacaugaaacaucauggcauuacgaccaagaucaucccuacaagacgugggcauaucauggaucauaugaaacaaaacaaacaggaucggcaucuucgaugguaaauggcguaguucgucuucuuacaaaacccugggauguaauaccaaugguuacucaaauggcuaugacagauacgacgcccuuuggucaacaacgcguauuuaaagaaaaaguagauacacgaacacaagaaccuaaggagggcacgaaaaaauuaaugaaaauaacagcugaauggcuuuggaaagaacuaggaaaaaagaagacgccuagaaugugcacacgagaagaauuuacccggaagguucguucuaaugcggcuuugggagcaauauuuacagaugaaaacaaauggaaaagcgcacgcgaagccguggaggauagcgguuuuugggaauuaguggauaaggagagaaauuuacauuuagaaggaaagugugaaaccugcguguacaauaugaugggaaaaagagagaaaaaauuaggugaauuugguaaagccaaagggucuagggcaaucugguauauguggcucggugcaagauuccuagaguuugaagcauuaggcuuuuuaaacgaagaccauugguucucgagagaaaacagcuuaagugggguggaaggggagggacuccauaagcuaggguauauccucagggacguaagcaaaaaggagggaggagcaauguacgcugacgacacugcaggaugggacacacguauaacauuagaagacuuaaaaaaugaagaaaugguaacuaaccauauggaaggcgaacacaaaaaauuagccgaggcaauauucaaauuaacauaccaaaacaaaguagugcguguacaaagaccuacaccgcgcgggacuguaauggauaucauuucuagacgcgaccaacgagguaguggccaaguagugacuuacggauugaacacuuuuacgaauauggaggcacaacucauccgucaaauggaaggugaggggguauuuaaaucaauucaacagcuaacgguaaaggaagaaauagcaguuaaaaauuggcuaauacgggucgguagagaaagauuaucucggauggcgauuuccggagacgauugcguuguuaagccuuuagaugaucgauuugcuagcgcauuaacagcccucaacgauaugggaaaaguucgcaaagauauacaacaaugggaaccaucucgaggauggaacgauuggacccaagugccauucuguucgcaucauuuccaugaacuaauuaugaaagacgggagagugcuaguaguuccauguagaaaccaagacgaacuuauagggagagcuagaauuagccagggcgccggauggaguuugcgggaaacagcuugcuuaggaaaaucauaugcucaaaugugguccuuaauguauuuccaucguagagacuugagacuagcggcuaaugcaauaugcagugcaguuccaucacauuggguucccacaagcagaaccacaugguccauacacgcaacucacgaguggaugacgacugaggacauguuaacaguuuggaaucgugucuggauacaggaaaacccuuggauggaagauaagacaccgguagagucgugggaagaaauaccauauuugggaaaacgagaggaucaauggugcgggagccuaauagguuuaacaucuagagcaacaugggcaaaaaauauucagacagcaauaaaucaagucaggucucuaauagguaaugaagaauauacggauuacaugccaucaaugaagcgauucagaagggaagaggaagaggcugguguucucugguaa

SEQ ID NO: 22872 - RNA, 9876 nt, Artificial Sequence
  derived and/or modified CDS sequence (opt6) from DENV-2__KM279605__SS-prME
acugcagggauuauaauaaugaugauaccaacagucauggccuuucacuuaacgacccgaaauggugaaccacauaugauugucucaaggcaggaaaaaggcaaaucucuccuauucaagaccgagaacggcgucaacauguguacuuugauggccauggacuuaggagaguugugugaagauacuauuacauauaacuguccgcuauuaagacaaaaugagccagaagauauagauuguuggugcaacucuacaaguacauggguaacauauggcacuuguacagcuacgggagaacaucgaagggaaaaacgcaguguagccuugguuccucauguagggaugggccuggaaacaagaacagagacuuggaugaguagugagggagccuggaaacacgcccaaaggauagagacauggauacuaagacacccggguuucacuauuauggcagcaauauuggcauacaccauagguacaacguacuuucaaagggucuuaaucuuuauucuccuuacagcgguaacaccuucuauggccaugagaugcauugggauaucaaaccgcgauuucguugaagguguaagugguggaucguggguagauauaguacuagaacacgguagcugugucacaaccauggcaaaaaauaaaccuacacuagacuucgagcugauuaaaaccgaggccaaacauccagcaacacuuagaaaauacuguguagaagcuaaguuaacaaauacaacaacagcaucaagauguccuacacaaggugaacccagcuugaaugaagagcaggauaaacgguuuguuugcaaacauucaaugguggauagaggguggggaaacggcugugggcuauucgggaaaggaggaauaguaaccugugcaauguucacuugcaaaaaaaauauggaaggaaaaguaguccaaccggaaaacuuagaauauacgauugucaucacaccacacucaggcgaggagaacgcuguuggaaacgauaccgguaaacaugguaaagaaaucaagguaacgccacagaguucaauuacagaagcggaauuaacgggguacggaacagucacaauggaaugcaguccucgcacuggauuagauuucaaugaaaugguucuccugcaaauggaaaauaaagcauggcuaguacaccgucaaugguuccuagaccucccucugccgugguuaccgggagcugacacgcaagguucuaacuggauucaaaaagaaacucuuguaacauuuaaaaauccucaugcaaagaaacaagaugucgucgugcuagguagucaagaaggugcaaugcauacagcacugacaggagccaccgagauucagaugucuagcgggaaucuacucuuuacaggccaucuaaagugucgacugcgcauggauaaacuccaauuaaaaggcaugagcuacaguauguguaccggcaaguuuaaaguuguaaaagaaauugcagaaacacaacacggcacaauuguaauaagaguccaauaugaaggagauggguccccauguaaaauaccuuuugaaauuauggauuuagagaaacgacauguacuggggagguugauaaccgucaauccaauagugacagagaaagauaauccugucaauauagaagcggaaccaccguuuggugauaguuacauuauaauaggagucgaacccggacaacuuaaauuaaguugguuuaaaaaaggcaguucaauagggcaaauguucgaaaccaccaugcggggcgcuaaacguauggcuauauugggugauaccgcaugggauuuuggcucacuaggaggcguauuuacgucuauaggaaaagccuugcaucagguauuuggugcaaucuacggcgcugcguuuaguggagucagcuggaccaugaagauucucauaggaguaguuauaacauggauuggaaugaacaguagauccacgucauugagcgugagcuuaguucuaguagguguugugacacuauauuuagggguaaugguucaagccgacuccggauguguugugagcuggaagaacaaagagcuaaaguguggaaguggcaucuucauuacugauaacgugcauacuuggacugaacaauauaaauuucagccagagagcccgucuaaauuggcuucggcgauacaaaaagcucacgaagagggaauauguggaauacggagcguaacaaggcuugaaaaccucauguggaaacaaaucaccccagaacuaaaucauaucuuaacggaaaaugaaguaaaauuaacaauaaugacuggcgacauaaaaggaauuaugcaagcugguaaaagaucccuaagaccucagccuacugagcuaaaguacaguuggaaggcgugggguaaagcaaaaauguuaaguacagagcuccauaaccacaccuuuuuaauagauggcccggagacagccgaaugcccuaauacuaaucgugcauggaacucccuagaaguagaagauuacggguucgguguuuucacuacaaacaucuggcuaaagcuuaaagaacgacaagacguauuuugugacucuaagcuaaugucagcagcuauuaaagauaauagagccguucaugcugauaugggcuacuggauagaaagugcucuaaaugacacauggaaaauagaaaaagccucauucauugaagugaagaguugccauuggccuaaaagucauacauuauggagcaauggaguauuagaaagcgaaaugauaauaccaaaaaauuucgcaggccccguaagucagcauaauuaccgaccggguuaccauacacaaaccgcugggccguggcaccugggucgcuuggaaauggacuucgauuuuugcgaggggacuacuguagucgucacggaggauuguggaaaucgaggaccaagucuucggacaacgacagcuucgggaaaauugauuacugaauggugcugccggucuugcacuuuacccccacuacgcuaccgaggugaagauggauguugguaugguauggaaauucgaccacucaaggagaaagaggaaaacuuagugaauucucucguuacagcaggacauggucaaauagauaauuucucucuugguguuuuaggcauggcauuauuucuagaagagaugcuuagaaccagggucggaacaaagcaugccauacuauuaguugccguaucauuuguaacacugauuacaggcaacaugucauucagggaucuuggcagagucaugguaauggugggagcaacaaugaccgaugauauaggcauggguguaacuuaccuugcacuucuagcagccuuuaaaguacgacccacauuugcagccgggcugcuacuaagaaaauuaacaaguaaagaauuaaugaugaccacuaucggcauuguucuauuaucacaaucaaccauaccugaaucgauacuugagcucacugaugcacuagcacuaggcaugaugguccuaaaaauaguaagaaauauggaaaaauaucaacuagccguuaccaucauggccauucuuuguguuccaaaugcuguaauuuuagaaaacgcauggaaagucagcuguacgacucuggccguuguuagugucucgccucuucuucucacaucuucucaacaaaaagcggacuggauuccgcuagcucuaacaaucaaagguuuaaaccccacggcgauauuccugacaacucuaucacguacuagcaaaaaaagaagcuggccauugaacgaggcaauaauggcaguaggaaugguaagcaucuuagcauccuccuuauugaaaaaugacaucccaaugacaggaccacuaguagcaggcggacuauugacaguaugcuauguucuaacgggaaggucugcagacuuagaauuagaaagagcagcugacguacgaugggaggaacaagcggagaucuccggaucuaguccgauucugucgauaacgauaagcgaagacggcucgauguccauaaagaaugaagaagaagaacaaacccuaaccauauuaauaaggacagguuuauuaguuauaaguggauuauuccccguauccauaccuauuacagccgcagcgugguaccuaugggaagucaagaaacaaagagcaggaguucuaugggacguacccaguccaccuccugucggcaaagcagagcuggaagauggggcguaucguauuaaacaaaaaggcauuuugggcuacucccagauaggagcaggggucuauaaagagggaaccuuucacacgauguggcauguuacaagaggcgcaguucuaaugcauaaagguaaacggaucgaaccauccugggcggauguuaaaaaagaucuaauuuccuacgggggaggauggaaauuggaaggagaguggaaagaaggcgaagagguacaaguauuagcccuugaacccggaaaaaauccccgugcuguacaaacuaaaccgggcuuguuuaaaacaaauacaggcacaauaggugcuguuaguuuggauuuuuccccagguacaucugggaguccaaucguagauaaaaagggaaagguaguaggcuuauauggaaacgguguuguuacaagaagugggaccuauguuuccgcuauugcucaaacugaaaaaucaauugaagauaaucccgaaaucgaagacgauauauuucgaaaaaaacgcuuaacgauaauggacuugcacccaggagccggaaagacgaaacgauauuuacccgcaaucgugcgugaggcaauuaaaagaggccuacguacccuaaucuuggcaccaacaagaguaguugcagccgaaauggaagaagcauugcguggguugccgauacguuaccaaacuccagcaauaagagccgagcauacagguagggaaauuguagaccuaaugugucaugcaacauucacaaugcgucuacuaaguccaauacgugugccuaauuacaaccucaucaucauggaugaagcgcacuucacagaucccgcuagcauagccgcaagagguuacauaucuacaaggguagaaaugggcgaagccgcgggaauuuuuaugacggcuacaccaccuggcagucgagacccuuuuccgcaaaguaaugcuccuauuauggaugaagagagagaaauaccagaaagaaguuggaauucgggacaugaaugggucacagauuuuaaaggaaaaacaguaugguuuguccccuccauaaaagcuggaaaugauauagcugcuugccuacgaaaaaacggcaaaaaaguaauucagcucucacgaaagaccuucgauagugaauauauaaaaacaagaaccaaugauugggacuuugucguaacuacagacauuucagaaaugggggcgaauuucaaagcugaacgcguuauagauccccgucgcuguaugaaaccaguuaucuugacugauggagaagaacgaguuauacuagcaggaccgaugccaguuacccauagcagugcggcucagagacgaggccgcgugggaaggaauccaaagaaugaaaaugaucaauacauauauaugggugaaccuuuggagaaugaugaagauugugcacacuggaaagaggcuaaaauguuauuagauaauauuaauacaccagaagggauaauuccaucuauguuugaacccgagcgugagaaaguagacgcuauagacggagaguauagauugagaggagaagcuagaaaaacauucgucgaccuuaugagaagaggagaucucccaguuugguuagcguacaaaguagcagcagaagggauuaauuaugcagacaggcguuggugcuucgacggagucaaaaauaaccaaauacuagaagaaaacguugaagucgagaucuggacuaaagaaggggaaagaaagaaguugaagccuaggugguuagaugcacgaaucuauuccgauccgcucgccuuaaaagaauuuaaagaauucgccgcaggucgaaagucucugacacuaaaucuuauaacugaaaugggaaggcuuccaacguucaugacacagaaagcgaaaaaugcacuugauaacuuagcaguguugcacacagcagaggcagguggacgagccuacaaccaugcacuuagugaauugccggagacuuuggagacauuacuauuguuaacguuauuagccacugucacgggggguauuuuccucuuuuugaugagcgguaaagguauagggaaaaugacgcuaggaaugugcugcaucauaacggcaucaauacuauuaugguacgcgcagauucaaccacacuggauugcugcuaguauaauacuagaauucuuucugauuguauuacuaauaccagaaccggaaaagcagcguacaccccaagauaaccaacuaacauauguggucauugcaauucucacuguaguagcagcaacuauggcgaaugaaauggguuuuuuagaaaaaacuaagaaggauuucggacuagguucaaucaccacacaacaaccggagagcaacauccuugauauagaccuuagaccggcaagugcguggacacuguaugcaguagcuacaacauucauuacuccuaugcuuagacacucaauugaaaacucauccguuaauguaucacuaacagcaauugcuaaccaagcuaccguacuaaugggauuaggaaaaggguggccacuaagcaagauggauauuggcguuccauuacuagcuauaggauguuacucgcaaguuaacccaauuacgcuaacugccgcacuuuuacuauuagucgcucacuaugccaucaucgguccaggucuccaggcaaaagccacgagagaagcacagaaaagagccgcagcuggaauuaugaagaauccuacugucgaugggauuacaguuaucgaucuagauccaauuccuuaugacccaaaauuugagaaacaacuaggacaggucauguuauuaguacuuugugucacccagguacugaugaugaggacaacgugggcucuaugugaggcacugacacuagccacaggaccuauuagcacauugugggaagguaaucccggcagauuuuggaauacaacaauugccguuuccauggccaacauuuuucgugguucauacuuagcgggugcaggauugcuauucucaauaaugaaaaacacugcgaauaccagaagaggaaccgguaacaccggugaaacacuaggcgaaaaguggaaaaauagauuaaaugcauuaggaaagucugaauuccagauuuauaaaaaaucaggaauccaagaaguggacaggacuuuagcgaaagaagguauaaaacgaggagaaaccgaucaucacgcuguaucacgagguucagcuaaauugcgcugguuuguagaacgcaaucuuguaaccccugaagggaagguagucgauuuaggauguggaagaggagguuggagcuauuauugugggggucuaaaaaacgugaaagaaguaaagggauugacuaaaggugggccuggacacgaggagccaauaccuaugucaacauauggguggaaucuagugcgauuacaaaguggaguagacguuuuuuucacucccccugaaaagugcgauaccuugcuaugugauaucggggagaguucuccgaauccgaccgucgaagcuggaagaacuuugagaguucuaaaucucguugaaaacugguuaaauaacaauacacaauucugcauaaaagugcugaauccuuacaugccgucaguaauagaaaaaauggaggcucuccaaagaaaguacgggggugcucuaguacguaacccuuuaagcagaaauucaacucaugagauguacuggguuaguaaugccucuggaaauauuguaucaucgguaaauaugauuaguagaauguuaauaaaccgauucacuaugaggcacaaaaaagccacauaugagccggauguugaucuuggguccgguacuagaaauauaggcaucgagucggagaccccaaacuuagauauuauuggaaaaagaauagaaaaaauuaagcaggaacaugaaaccaguuggcauuaugaucaagaucaccccuauaagacgugggcuuaucacgguagcuaugaaacaaaacagacagggucugccuccuccaugguuaaugggguaguaagacugcuaaccaaacccugggaugucauacccauggugacccaaauggcaaugacggauacaacuccauuuggucagcaaaggguauuuaaggaaaaaguggauacacgaacucaagaaccgaaagaaggaaccaaaaaguuaaugaaaauuacugcggagugguuauggaaagagcuugggaagaaaaagacgccacgaauguguacccgcgaagaauuuacucgaaaagugcggucaaaugcggcauuaggugcaauauuuacagacgaaaauaaguggaaaucugcacgagaggccguagaggauuccggauucugggaacuaguagacaaagaacgcaaucuacauuuagagggaaagugcgaaacaugcgucuauaauaugaugggcaaaagggagaaaaagcuaggagaauuugggaaagcuaaggguucucgagcaauaugguacaugugguuaggagcaagauuuuuagaauucgaagcccugggauuucucaaugaagaccacugguuuagccgagaaaacuccuuaagcgguguugagggcgagggacugcacaaauuagguuacaucuuaagagaugucagcaaaaaagaaggaggagccauguaugcggaugauacugccggcugggacacacgcaucacccuggaagauuuaaaaaaugaggaaauggugacuaaucauauggaaggagaacauaagaaacuagcagaagcuaucuuuaaauugaccuaucaaaauaagguaguccguguccagcggccuacgccgagagguacgguaauggauauuauaagcagaagagaucagagggggagcggucaaguaguuacauacggacuuaacacuuuuacgaauauggaggcacaacucauucggcaaauggagggagagggaguauucaagucaauucagcaauuaacgguaaaagaagaaauagcgguaaagaauuggcuuauacgggugggcagagaaagacuuucacgaauggcaauuaguggagaugauuguguaguaaaaccacuagaugaccgauucgcuagugcacugacagcacuuaacgauauggguaaaguaagaaaagauauacaacaaugggagccaagcagggguuggaaugacuggacacaaguaccguucuguucgcaucacuuccaugaacuaauuaugaaggauggcagaguacuuguuguuccauguaggaaccaagaugaauuaauuggcagggcgcgaauaucacaaggugcuggauggucacugagagaaaccgcaugcuuaggaaagaguuaugcccaaauguggucguuaauguacuuucaucgaagggauuuaagacuggcugcuaaugcgauuugcagcgcaguuccgucucauuggguaccaacuaguaggacaacguggaguauacacgcaacgcaugaauggaugacaacagaagacaugcuuaccguauggaaucgcguauggauacaagaaaaucccuggauggaagacaaaacuccuguugaauccugggaagaaauacccuauuuaggaaagagggaggaccaauggugugguucuuuaauuggucuaacuucaagagcgacgugggcaaaaaauauucagacagccauaaaucaggucagaucacuuauagguaaugaagaguauaccgacuacaugccaucuaugaaacgcuuuaggcgugaagaagaagaagcaggugugcuaugguaa

SEQ ID NO: 22873 - RNA, 9876 nt, Artificial Sequence
  derived and/or modified CDS sequence (opt6) from DENV-2__KM279609__SS-prME
acggcaggaauuauuauaaugaugauaccuaccgugauggcuuuucaccuuacaaccagaaauggagaaccccauaugauuguuagucgacaagaaaaaggaaaauccuuacuguuuaaaaccgaaaauggaguaaauauguguacauuaauggcaauggaccuaggugaacuaugugaggacaccauaaccuacaacugcccuuuauugcgacaaaaugaaccagaagauauagacugcuggugcaauagcaccaguacauggguaaccuauggaacauguaccgcaacgggggaacacagacgagaaaaacgaaguguagcacuggucccgcauguagguaugggacuugagacaagaacggaaacuuggaugucuucagaaggagcauggaaacaugcacaacgcaucgaaaccuggauucuaaggcaucccggauuuacaauaauggccgccauucuagccuacacuauagguacuacuuacuuucagagaguucuaaucuuuauuuuacuuacggcaguaacgccuucgauggcuaugcgauguauuggaauaucaaaucgcgauuuuguugaagguguuaguggaggguccuggguagauauaguccuagaacaugggucuuguguaacaacuauggccaaaaauaaaccuaccuuagacuucgagcuaaucaaaacagaagcuaaacacuuagcgacacuacgaaaauauugcguugaagcaaaacugaccaauacaacaacagcgucgagauguccaacccagggagaaccguccuuaaacgaagaacaggacaaacgauuuguuugcaaacauaguaugguagaucgaggaugggguaauggauguggauuauuugguaaaggaggaaucguuacgugugccauguuuacauguaagaaaaauauggagggaaaaguagugcagccugaaaacuuagaauacacuauuguaauaacaccccacucaggagaagaaaaugcaguagguaacgauacagguaagcaugguaaagagauaaaagucacgccucaaucgaguaucacggaagcggagcucacagguuacgggacugugacaauggaauguucuccgcgaacuggcuuggauuucaacgaaaugguguuacuucaaauggagaauaaggcauggcuuguucauagacaaugguuuuuagauuugccuuuacccugguuaccuggagccgacacgcagggaucaaauuggauucagaaagaaacucuaguaacguucaaaaacccacacgcaaagaaacaagauguuguaguacucggaucacaagagggggccaugcacacggcacuuacuggugccacagaaauacaaaugucgucaggcaaucuguuauuuacaggccauuuaaaauguagauugaggauggacaaauuacaacuuaaaggaauguccuauagcaugugcacuggcaaauuuaaaguaguaaaggaaauagcugaaacacagcacggcaccauagucauacggguacaauaugaaggcgauggauccccaugcaaaauuccauucgaaauaauggauuuagagaaaagacauguacucggcagacuaauaaccguuaacccgauaguuacagaaaaggauucgccaguuaauauagaagccgaacccccuuuuggagacagcuacauaauaaucggggucgaaccagggcagcuuaaauugucgugguucaaaaaggguuccaguauaggccaaauguuugagacgacuaugagaggagcuaaaagaauggccauacuaggagauaccgccugggacuuuggaucacuaggaggaguuuucacuucuauaggaaaggcacuacaucaagucuuuggagcaauuuauggagcugccuucagcggaguguccuggacaaugaaaauacugaucggaguugucaucacauggaucgguaugaauagucggagcacaagucucucuguuagcuuaguguuaguaggaguuguaacucuauauuuaggcguaaugguacaagcagauagcggauguguagucuccuggaagaauaaagaauuaaaaugcgguuccgggauauuuauuacugauaauguacacacguggacagaacaauauaaauuccagccagagucaccaaguaaauuagcaagugcuauucagaaggcgcacgaggaggguaucuguggcauucggucaguuacucgccuagaaaauuugauguggaaacaaaucacgccagaacuaaaucacauauuaacagagaacgaaguaaaacuuaccauaaugacaggagauauaaagggaaucaugcaagcugggaagcggucauuaagaccacaaccuacagaauugaaauauaguuggaaggcuuggggaaaagcaaaaaugcuauccacugaacugcauaaucacacuuuucuaauagaugggccggaaaccgccgaauguccgaauacaaauagggcauggaacucuuuagaaguagaggacuacggauuugggguauuuacgacaaauauaugguugaaauugaaagaacgacaagauguauuuugugauaguaagcucaugagcgcagcaaucaaagauaaucgcgcgguucacgcagacauggguuacuggaucgaaucggcacuaaaugauacguggaaaauagagaaagcaaguuucauagaagucaaaucaugccauuggcccaaaucacauacauuauggaguaauggaguauuagaaagcgagaugauaaucccgaagaacuucgcaggaccuguaucacaacacaauuauaggcccgguuaccauacacaaacggcagguccauggcaucuuggacgauuagagauggauuuugauuuuugugaagguacuacuguuguugugacagaggauuguggaaauagggggccaaguuugagaaccacaacagcgucagguaaguugauaacagaaugguguuguaggagcugcacguugccgccauugagauauaggggcgaagacggcuguugguauggaauggagauaagaccccuaaaagaaaaagaagagaacuuaguuaacucgcuaguaacugcaggacauggacaaauagacaacuuuagccugggaguauuagggauggcauuguuucuugaagaaaugcuccguacccgaguaggaacaaaacaugcuauuuugcuagucgcagugucauuuguaacacucauaacgggcaauaugucauuccgagaucucggacggguaauggucauggugggcgcgacgaugacugaugauauaggcauggguguaacauaucuggccuuacuagcagcuuuuaaaguaagaccuacuuuugcagcuggcuuguuauugagaaagcucacaaguaaagagcuuaugaugacaacuauugggauaguccuauuaagucaguccacuauaccagagucuauauuagagcuaacagacgcgcuugcuuuagguaugaugguauuaaaaauuguaaggaauauggaaaaauaccaguuagcaguuacaauuauggcaauauuaugugugccuaacgcaguuauauugcaaaaugcauggaaaguuucaugcacaacccuagcugucguaucuguuucaccauuauugcugacaaguucccaacaaaaagcagacuggauuccauuagccuuaacaauaaagggguuaaacccaacggcuauauucuugacaacccucucgagaacaagcaagaaaagaaguuggccucuuaaugaagcaauaauggccguugguauggucucaauucuugccucuucuuuacugaagaacgauauaccaaugacaggcccucugguugcuggcgggcuucuuacagucuguuacguauuaacggggagaagugcagaucuagaauuagaaagagcugcagacguaaggugggaagaacaagcggaaauuucagguagcucuccgauacuaucaaucacaauaucagaggacgguaguaugucaaucaaaaacgaagaagaagaacaaacuuuaacaauauuaaucagaacgggacuuuuaguaaucucuggucucuuuccagucucuauaccaaucacugcugcugccugguaccugugggagguuaagaaacaacgagcaggaguucuaugggauguaccaucaccgccgccaguaggaaaggcagaacuggaagacggagcauacagaauaaagcaaaaaggcauucuuggcuacagccaaaucggggcgggugucuacaaagaagguacuuuucacaccauguggcacguuacuagaggcgcaguacuaaugcacaaagguaaacgcauugaaccuucuugggcugaugugaagaaagaccuuauuucguacggaggaggauggaagcuggaaggggaauggaaagaaggagaggaagugcaaguauuagcgcuagagccgggcaaaaauccuagagcaguucaaacaaaaccugguuuguuuaaaacaaacacuggaaccauuggagcgguuagucuagauuucaguccaggaaccucuggaucaccuauugucgacaagaaagguaaaguagucggacuuuacggcaaugguguaguaacacguucgggaaccuauguauccgcuauagcgcaaacagagaaaaguauagaagacaauccugaaauagaagaugauaucuuucguaagaaacgacuuacuauaauggaucuucauccgggagcugguaaaacaaaaagauauuugccggccauaguuagagaagcaauaaaacgaggccuacgaacguuaauccuugcaccaacaagaguuguggcagcagagauggaagaagcucuacgggggcuuccuaucagauaccagacaccagcaauaagagcugaacacacaggacgugaaauaguggaucucaugugccacgcuaccuuuacaaugagauuacuaaguccaauccgugugcccaacuauaacuuaauuauaauggacgaagcccacuucacagacccagcuucaaucgcagcucgggguuacaucaguacuaggguugaaaugggagaagcagcggggaucuuuaugacugcgacaccaccuggauccagagacccauuuccacaaagcaaugcacccaucauggaugaagagagagaaauaccagaacgcucauggaauaguggccaugaaugggugacugauuuuaaggguaaaaccguaugguuuguuccuaguauuaaagccgguaaugauauugcggcaugccuuaggaaaaacggcaagaaaguaauacaauugucuaggaaaacauucgauagugaauauauuaaaacgaggacuaacgacugggauuucgugguaaccacagacauuagugagaugggugcaaauuucaaagcagaaagagucauagauccgaggagauguaugaagccgguaauacuuacagauggcgaagaaagaguaauauuagccgguccuaugccuguaacccacucgucagcagcucaacgaagagguaggguggggagaaauccuaaaaacgaaaacgaucaauacauuuauaugggcgaaccacuggaaaacgaugaagauugcgcucauuggaaagaagcaaaaaugcuacuugauaauaucaacacaccugagggcaucaucccuucaauguuugaaccagagagagagaaaguagaugccaucgacggugaauauagguuacggggcgaggccaggaagacauuuguugaucuaaugagaagaggugauuuaccaguaugguuggcguaccguguagcagccgaaggaauaaacuacgcggacagaagaugguguuuugauggugucaaaaauaaucaaauauuagaagaaaauguagaaguagaaauuuggacuaaagaaggagaaagaaagaaacuaaaaccacguuggcuagaugcuagaaucuauucagacccuuuggcccuaaaagaauuuaaagaguuugcugcgggccgaaaaucucugacuuuaaaucuaauaacagaaauggggcgcuuaccgacguuuaugacacagaaagccaaaaaugcgcuugauaaucuagccguucugcauaccgcagaagcgggaggacgugccuacaaucaugcauuaucggagcuacccgaaacauuggaaacauuauugcuacuaacccuguuggcgacggucacaggcggcauauuucuauuuuuaaugagcgggaaagguauaggaaaaaugaccuuagggaugugcugcauaauaacggcuucuauauuguuaugguacgcacaaauucagccccacuggauagcugcuucaauaauucuagaguucuuuuugauaguauuacuuauaccagaaccggagaaacaaagaacuccgcaagauaaucaacuaacauaugucguaauugcaauauuaacuguuguagcggcaacgauggcaaacgaaauggguuucuuagagaaaacuaagaaagacuuuggccuuggauccauaacuacacagcaaccagaaucaaauauacuggauauagauuuaagaccugccuccgcauggacauuauaugccguggcaacuacauuuauuacaccaaugcuaagacacaguauagaaaauuccucagugaauguuagucuaacagccauugccaaucaagcaaccguacuuaugggacuuggaaaaggguggccucugagcaaaauggacauagguguaccgcuauuagcgaucggaugcuacagucaaguuaauccaauaacacucaccgcugcacuauuacuacucguugcgcauuacgcgauuauagggccaggcuuacaagccaaggcaacaagggaagcgcagaaaagagcagccgcagguaucaugaagaaccccacaguggacggaaugacuguaauugacuuagacccgauaccauaugauccaaaauucgaaaaacaacucgggcaaguaauguuauugguauuaugcguuacacaagucuugaugaugcgaacaacaugggcuuuaugugaagcguuaacacuggccacuggacccauuagcacguuaugggaaggaaacccuggacgguuuuggaauacaacgauugcaguuaguauggcuaauaucuuccgcgggaguuauuuagcuggagcgggcuuauuguuuucaauaaugaagaacacugcaaacacacgacgugggacuggaaacacgggagagacauuaggugagaaguggaaaaacagacuaaaugcccuuggaaaaucggaguuccaaauauauaagaaaucagguauacaagaaguugaccgaacucuagccaaagaagguauuaaaagaggggaaacagaccaucaugcugucucgagaggaucagccaaauugagaugguuuguugagagaaaucuaguaacccccgaaggcaaaguaguagaucuaggcuguggaagaggugguuggaguuauuauugugguggacuaaagaacgugaaagagguaaaaggucuaacaaaaggugguccgggacacgaagaaccaaucccuaugaguaccuauggcuggaacuuaguccgacuccaaagcggcguagaugucuucuuuacaccaccagagaaaugcgauacauugcugugugauauuggagagucuucaccuaauccgacugucgaggcuggaagaacucuacgaguacugaauuuaguagaaaacuggcuaaauaacaacacacaauuuuguauaaagguguuaaauccguacaugccaaguguaauagaaaagauggaggcucuccaaagaaaauauggaggugcauuagucagaaacccucuaucgaggaauaguacacaugaaauguacuggguaucgaacgcuuccggaaauauuguuucaaguguuaacaugauaagcagaaugcuaauaaaucgcuuuacgaugagacauaagaaagcuacuuaugaaccggauguugaccuaggaagcgguacuaggaacauaggaauugagagugaaaccccaaaccuagacauuauaggaaaacgaauugaaaagauuaaacaggaacaugaaacaucauggcauuacgaucaagaucaucccuacaagaccugggcguaccauggaucauacgaaacuaagcaaacugguagugcaucuuccaugguaaauggaguuguacguuuacuaacaaagccuugggacguaauuccuaugguaacccagauggcaaugaccgauacuacccccuuugggcaacagaggguuuucaaagaaaaaguagauacucgaacucaggaaccaaaagaagggaccaagaaacuuaugaaaauaaccgcagaauggcuguggaaagaguuaggaaagaagaaaacgccaagaauguguacaagagaagaauuuacaagaaaaguuaggaguaacgcggcuuuaggagcuauuuuuacagaugaaaauaaguggaaaagcgcuagagaggcuguugaggauucuggauuuugggaauuagucgauaaagaacggaauuuacauuuagaagguaaaugcgagacuugcguuuacaauaugauggguaaacgagaaaagaaauuaggagaguuugggaaggccaaaggcucacgcgcaauaugguacauguggcucggcgcucgguucuuggaauuugaggcgcuagguuuccuaaacgaagaucacugguuuucacgugagaauaguuuauccgggguugaaggugaaggauuacauaaacuuggguacauuuugagggauguuucuaaaaaggaagguggagcaauguacgcagacgacacagcagguugggauacuagaauaacucuugaggaccucaaaaacgaggagaugguaacgaaucauauggagggugaacacaagaaguuagcagaagcaauuuuuaaauugacauaucaaaacaaagugguaagaguucaaagaccaacgccgagagggaccgugauggauauuaucucaagacgugaucaaagaggcagcggccaaguaguaacuuaugguuuaaacaccuucacaaauauggaagcucaauuaauuaggcaaauggaaggggaggggguauuuaaaaguauucaacaauuaacggucaaagaagaaauugcaguuaaaaauugguuaaucagaguagggagagagagguugucaagaauggcgauaucgggugacgauugcguagucaaaccacuugaugaucgcuuugcgucugcguugacagcacugaaugauauggggaaaguacgaaaggauauccaacaaugggagccuagccgcggauggaaugauuggacacaaguaccauuuugcucacaccauuuccaugaacugauaaugaaagauggccgagucuugguuguaccauguagaaaucaggaugaacuaauugguagagcucguauaucacaaggugcuggguggucacugcgcgagacugcuugccuuggaaaaaguuaugcgcaaauguggagucuaauguauuuucacagacgugaucuaagacuggcagcaaacgcuauuugcucagcagucccaucacauuggauccccacaucacgaacgacauggucuauccacgcaacacacgaguggaugacgacagaagacaugcuaacaguauggaacagaguuuggauacaagaaaacccuuggauggaagauaagacuccgguugaaucgugggaagaaauuccguaucuagggaaaagagaagaccaguggugcggcagccucaucggccuaacuagccgagcaacuugggcuaagaacauucaaacugcuaucaaccaaguaagaaguuuaauugguaaugaggaauauacugauuauaugccguccaugaaacgauuucguagagaagaagaagaagccgguguacuaugguaa

SEQ ID NO: 22874 - RNA, 9876 nt, Artificial Sequence
  derived and/or modified CDS sequence (opt6) from DENV-2__KM279607__SS-prME
acugcaggaauuaucauaaugaugaucccuacaguuauggcuuuucaucuuacaacaagaaacggugaaccacauaugauuguaucgaggcaagaaaaaggaaaaucacuucucuucaaaacugaaaauggaguaaacauguguacauuaauggcaauggacuuaggggaacugugcgaagauaccauaaccuacaauuguccuuuguuaagacaaaacgaaccagaagauauugacuguugguguaacucuacuucuacaugggugacauaugggacaugcacagcaacgggagaacauagacgugagaaacggucaguagcauuaguaccacacgugggaaugggauuggaaacccgaacagaaacuuggaugaguucagaaggagcauggaaacaugcucaacggauugagaccuggauuuuaagacauccaggauucacgauaauggccgcaauucuugcuuauacuauagguacgacuuauuuacaacgaguauuaauuuucauucuucuuaccgcuguaacaccgucaauggccaugagguguauugguauuucaaaucgggauuuuguagaagguguaucaggaggauccuggguagacauuguacuagaacaugggucaugcguuacuaccauggccaaaaacaaaccaacacuagauuuugaauugauaaaaacagaagcaaaacauccagcuacgcuaagaaaauauugcguggaagcaaaauuaacgaauacuaccacagccucuagaugcccaacgcagggugaaccuucacuaaaugaagaacaggauaaaagguucguauguaaacauucaauggucgauagaggguggggcaacggauguggacuauuuggaaaaggagguauagucacaugugcaauguuuacaugcaagaaaaacauggaggggaaaguuguacaaccagagaacuuggaauacacaaucgugauuacuccccauucaggagaagaaaacgcugugggaaacgauaccggcaaacacgggaaagaaauaaagguuacaccacaaucaucaauuaccgaagcugaacuuacagguuacggaacuguuacaauggaaugcucacccaggacgggcuuagauuucaaugagaugguucuauuacaaauggaaaacaaagcgugguuagugcauagacagugguuuuuggaccucccuuuacccuggcucccuggagcagauacacagggaucuaacuggauacagaaggaaacacuuguuacuuuuaagaauccacaugccaagaaacaagacguuguggucuuggguucacaggaaggugccaugcauacugccuuaacgggggcaacugaaauccaaaugagcucaggaaauuugcucuuuacugggcacuuaaaaugucgacugcgaauggauaaacuacaacugaaagguaugucuuacucuauguguacagguaaauucaaaguggugaaggaaauugccgaaacucaacacggcacuauugugauuagaguucaguaugaaggugacgguagccccuguaaaauuccauucgaaaucauggacuuagagaaaagacacguacuuggacgacuaauaacaguuaauccaaucgugacagaaaaggauaaucccguuaauauagaagcugagccucccuucggcgacaguuauauaaucauuggcguagagccagggcaacuaaaacuuucaugguauaagaaagggaguagcauaggucaaauguuugaaacaacuaugcgaggagcaaaaagaauggcaauacuuggggauacugcaugggauuuugguucacuagguggaguauuuacuucaaucgguaaagcccuacaccaaguguuuggugcaauuuauggagcagcuuucucaggagugucuuggacaaugaaaauauuaaucggaguuguuauuacauggauuggaaugaacucccguucaacgucauugaguguuagcuuagucuuggucggaguugugacauuauacuugggcguaaugguucaagcagacagugguugugucgugaguuggaaaaauaaagaauuaaaaugcgguuccggaaucuucauuacggauaacguucauacguggacagaacaauacaaauuccaaccagaauccccuucaaaacuugcaucagcaauccaaaaggcacaugaagaagggauauguggaauaagauccguaacacgauuagaaaaccuuauguggaaacaaaucacaccggaacuaaaccacauucuaacugagaacgaagucaaacuaacuauaaugacaggcgacauaaaaggaaucaugcaggcagggaagagaucucuucgaccucagccaacagaauugaaauauucguggaaagcgugggggaaagcgaaaaugcuaaguacggaguuacauaaccauacauuuuuaauagacgguccagaaaccgcagaaugcccaaauacaaaucgggccuggaacucucuggaaguugaagauuauggauucggaguauuuacaacaaacauauggcucaaacuaaaagagcgucaagacguauuuugugauagcaaacuaaugucagcggcaauaaaagacaaucgagcaguacaugccgacauggguuauuggauugagagcgcuuuaaaugacacuuggaagauagagaaagcgucauucaucgaggugaaaaguugucauuggccuaaaagccacacuuuaugguccaacggggucuuggaaagugaaaugauaauacccaaaaauuuugcagggccaguuucacaacacaacuacagaccgggguaucauacccaaacugcaggaccuuggcaccuuggucgccuagagauggauuucgauuuuugugaagggacuaccguugucguaacggaagacugugguaaccgcggaccaagccuucgaacaaccacagcgucggggaagcucauuacggaaugguguugucggagcugcacguuacccccucuuagguacaggggugaagauggauguugguaugguauggaaauacggccccuaaaagaaaaggaagaaaaccuugugaacagccucguaacagcaggccacggccaaauagauaauuuuagucuuggcguuuuagggauggcacuguucuuggaagaaauguuaagaacaagagucggaacgaaacacgcgauuuugcuaguugcugugagcuuuguaacacuuauuacagguaauaugaguuuucgagacuuagggagaguaaugguaauggugggagcgaccaugacagacgacauaggaaugggagucaccuacuuagcauuacuagcugcuuuuaaaguaagaccaacuuucgcggccggacuguugcuucguaaauugacauccaaagaguugaugaugacuaccaucgguauaguauuacucagccaaagcacaauaccagaaucaauacuagaacuaacggaugcucuugcuuugggaaugaugguacuaaaaauaguucggaauauggagaaguaucaauuagcuguaacaauuauggcuauauuaugcgucccaaacgcuguuauuuuagaaaaugcuuggaagguaucuuguacaacacuggcuguaguuaguguaagcccucuacuuuugacaucaucccaacagaaagccgacuggauaccacuugccuuaacgauaaagggauugaacccuacggcaauuuucuuaacaacuuugucgagaaccucuaagaaacguucauggccuuuaaaugaagcuauaauggcggugggcaugguaucuauuuuagccaguucuuugcugaaaaaugauauaccaaugacggggccacuugucgcaggagguuugcucacaguguguuacguucuaacaggaagaucugcagauuuagaauuagaacgagcugcugauguuagaugggaagaacaagcagagauuaguggaaguaguccaauccuaaguauuacaauaagcgaagauggaucaaugucaaucaaaaacgaagaagaagaacaaacuuuaacaaucuuaauccggacagggcuauuaguaauuucaggccuauuucccguaucuauuccgauuacagcagcggcaugguaucucugggaagugaagaaacaaagagcuggcguuuuaugggaugugccgagcccaccuccagugggaaaagccgaauuagaagacggcgcauauagaauaaagcagaaaggaauauuaggauacagucaaaucggggcaggaguuuacaaggaaggaaccuuccauacaauguggcauguaacccggggugcugucuugaugcauaaagggaaaaggauugagccuagcugggcugacgucaagaaagaucugauaucauacgggggaggcuggaaacuugagggcgaauggaaggaaggagaagaaguucaaguccuggcucuagagccugggaaaaacccaagagcugugcaaacgaaacccggauuauucaaaacuaauacagggacaauaggggcaguauccuuagauuucaguccagguacuucuggaucuccaauuguagauaagaaaggaaaaguaguaggcuuauaugguaacgguguaguaacgagaaguggcacauauguuucagcaauagcacaaacggagaaaagcauugaagacaauccagaaauagaagaugauauauuucgcaaaaagcggcugacaauuauggaucuccaucccggagcuggaaaaacaaaaagauacuuaccagcgauaguacgcgaggcuauaaaacgaggguuaaggacguuaauacucgcaccaacgagaguagucgcagcugaaauggaggaggcacuuagaggauugcccauucgauaccaaacgccugcgauacgggcugaacauaccggaagggaaauaguagaccuuaugugccaugccacauucaccaugagauuacuaucgccaauaagggugccgaauuauaauuugauuauaauggacgaagcccauuuuacugacccggcauccauagcggcaagaggauacauuucaacaagggucgaaaugggagaggcagcgggaauauuuaugacagcgacuccaccagguaguagagacccauuuccucagucgaaugcuccaauuauggaugaggaaagagagauaccagagaggaguuggaacucuggacaugagugggucacugacuucaaaggcaaaacaguuugguuuguaccaucaauuaaggcugguaaugacauugcagcauguuuacgaaagaacggaaagaaggucauacaguuaaguagaaaaacauucgacucggaguacauuaaaacucgaacgaacgacugggauuuuguaguaacaacugacauauccgaaaugggugcaaauuucaaggcggagcgggugauagaccccagaaggugcaugaaaccgguaauauugacagauggggaagaacgaguaauauuggcugggccaaugccagucacacauagcucugcggcacagcguagagguagaguggggcgcaauccgaaaaaugagaaugaucaauauauuuauaugggugaaccccuagaaaaugaugaggauugugcacauuggaaagaagccaaaaugcuguuagauaauauuaauacgcccgaagggauaaucccaaguauguuugaaccagaaagagaaaaaguagacgcaauugauggagaauaccgacuacgcggagaagcgaggaagacauuugucgacuugaugcguaggggagacuuacccguauggcuggcauacaaagucgccgcagaagguauuaacuacgccgauagacgaugguguuucgacggggugaaaaacaaucagauccuugaggagaauguagaaguagaaauauggaccaaggagggagaaaggaaaaagcugaaaccgagaugguuagacgcaagaauauauucagauccacuagcuuugaaagaauuuaaagaguuugcagcaggaagaaaaucauuaacuuuaaauuuaaucacugaaaugggacgucuaccaacauuuaugacccaaaaagcuaagaaugcauuagauaaucuagcaguguugcacacggcagaagcgggaggucgagcauacaaucacgcauugagugaacuaccggaaacauuggaaacguuacuacuauuaacuuuguuagcaacuguaaccggcgguauuuuucuuuuucuuaugagugggaaaggcauaggaaaaaugacgcuagguauguguugcauaauaacagcgucuauccuccuaugguacgcacagauacaaccacauuggauagcugccagcauuauuuuggaguucuuucuaauaguauuacucauaccugagccugagaaacaacgaacgccacaggacaaucaacucacuuaugucguaauugcuauacuaacugugguagcagccacaauggcuaaugaaaugggauuccucgaaaagacuaagaaggacuucggacuaggcucaauuacgacucagcaaccagaaaguaacauauuggacauagauuuaagacccgcaagcgcauggaccuuauaugcuguagccacaacuuucauaacaccgauguuacgucauucuauugagaacucaaguguaaauguaagucuuaccgcaauagcuaaucaagcaacuguucucaugggccuagguaagggguggccacuaucaaagauggauaucggcgugccucuauuagccauagguuguuauagccaagucaauccuauaaccuugaccgcugcauuacuacugcuaguagcacacuacgcgauaauugguccaggucuccaggcaaaggcaacaagggaagcacaaaagcgagcugcagcgggcauaaugaaaaauccuacuguggacggaauaacgguuaucgaucuugacccaauaccauaugauccaaaauuugagaaacaauuagggcaagugauguuacuuguacuaugcguaacgcaaguauuaaugaugcguacaaccugggcuuuaugugaggcacucacauuagccacaggucccauaucaacacugugggaggggaaccccgggcguuuuuggaauacaacaaucgcagucucgauggccaauaucuuucguggaucguacuuagccggagcaggcuugcuauuuucuauaaugaaaaauacggcuaauacccgaagagguaccgggaauacaggggaaacacuaggagaaaaguggaagaauagauuaaacgcacuuggaaaaucagaauuucagauauauaaaaagucuggaauacaagagguagacagaacauuagcgaaggaaggcauuaaacgaggcgaaacagaucaucacgcugucucacgaggaucugcgaaacuaaggugguuuguagaaagaaauuuaguaacacccgagggaaaaguuguugaccuaggaugcggacgaggaggauggagcuacuacugugguggccuuaaaaacguaaaggaaguaaaagggcuaaccaaagguggcccgggccaugaggaaccaaucccaauguccaccuauggauggaauuuaguaagauuacaaaguggaguggauguauucuuuacuccucccgaaaaaugugauacauuacuaugcgauauuggagaaucaagucccaaucccacaguagaagccggccggacguuaagagucuugaaccuuguagaaaauugguuaaauaauaacacacaauuuuguauuaaaguucuuaacccauacaugcccucggucauagagaaaauggaggcuuuacaacgcaaauauggaggcgcacuuguaagaaacccacugucuagaaauaguacgcacgaaauguacuggguaagcaacgcauccgguaauauaguaucaucaguuaacaugauuagucgcaugcuaauaaauagauuuacuaugcgacacaagaaagcuacuuaugaacccgacguagacuugggaucgggcacucguaacauaggcaucgaaagcgaaacgccaaacuuagauauaaucggcaaaagaauugaaaagauaaaacaagaacaugagaccucguggcacuacgaucaagaucauccauauaagacgugggcauaucauggaagcuaugagacuaaacagaccggaagcgcuaguucgaugguaaacgguguugugaaauuacugacaaagccaugggacgugauaccgaugguaacacaaauggcgaugaccgauacuacuccauuuggccaacaaagaguguuuaaagaaaaaguagauacuagaacacaagagccaaaggaggguacuaagaaacugaugaaaauaaccgcagaguggcucuggaaagaacuuggcaagaagaaaacgccuagaauguguacucgagaagaguuuacacguaaagugcgaagcaaugcagcguuaggugcuauauucacagaugaaaauaaauggaaaucugcaagagaagcuguugaggauucuggauucugggaauuaguggauaaggaacgaaauuuacauuuggaggguaaaugcgaaacauguguuuacaacaugauggguaagcgugagaagaaauuaggcgaauuuggcaaagcaaagggaagcagagcaaucugguauauguggcugggagcgagguuuuuagaauuugaagcucuagguuucuugaaugaagaucauugguucucacgagaaaacucacugucagggguagaaggugaaggguuacacaagcucggguauauccuaagagaugugagcaagaaggaaggaggcgcaauguaugcagaugauacagcuggaugggauacaagaaucacucuggaagaucuaaagaacgaagaaaugguuacgaaucauauggagggugaacauaagaaauuagcugaggcaauuuuuaaacucacguaccaaaacaaaguaguaaggguucaaagacccacaccucgggguacaguuauggacauuauaaguaggagagaccaaaggggaaguggucagguugucacauacgguuuaaacacuuuuacgaacauggaagcacagcucaucagacagauggagggagaaggaguauucaagaguauccagcaguuaaccguuaaggaagaaaucgccgucaaaaacugguuaaucagaguuggccgcgaacgcuuaaguagaauggccauaaguggggacgacugcguagugaaacccuuagaugaccgauuugccucugcgcugacggccuugaacgacaugggaaaaguaagaaaagauauacaacagugggaacccucaagaggauggaacgacuggacccaagucccauuuugcagucaucauuuccaugaguugauaaugaaggauggaagaguuuuggucguccccuguagaaaucaggacgaacuaauaggcagagcuaggauaucccaaggcgcaggauggaguuuaagggaaacagcgugucuaggcaaaucauacgcacaaauguggucccucauguauuuucacagacgcgacuugagauuagcggcaaaugcuauuugcucagccgucccaucccacuggguaccaacgaguagaacaaccuggucuauucacgcgacacacgaauggaugaccaccgaagauauguuaacgguauggaauaggguauggauacaagagaacccauggauggaagauaaaacaccaguagagucaugggaagaaauuccguauuuagggaaaagggaagaucagugguguggcagcuugauuggacuaacuucaagagcgacuugggccaagaauauacagaccgcaauuaaccaaguacgaagucuaauagguaaugaagaauacacagacuacaugcccucaaugaaaagauucagacgggaggaagaagaagcgggaguauuaugguag

SEQ ID NO: 22875 - RNA, 9876 nt, Artificial Sequence
  derived and/or modified CDS sequence (opt6) from DENV-2__KM279606__SS-prME
acugcugguaucaucauaaugaugauucccacaguaauggcguuccacuugacgacaaggaauggcgaaccacauaugauagugucgcgacaagaaaaagggaagucacuacuauucaaaacagaaaacggagugaauaugugcacccuaauggcuauggaccuaggggaauuaugcgaagauacuaucacuuacaacugcccauuacuaagacaaaacgaacccgaagacauagauuguuggugcaacaguacaaguacauggguaacauaugguacauguaccgcaacgggagaacacagaagagaaaaaagaaguguggcauuagucccgcauguaggaaugggccucgagacaagaacagagacauggaugucaucagaaggagcuuggaaacaugcccaacgcaucgaaaccuggauacugcgacacccgggauucacgauaauggcggcaauauuagcguauacuaucggcacaacauauuuucagagaguguuaaucuucauccuauuaaccgcuguuacuccauccauggcuaugcgauguauagguauaaguaacagagauuuugucgaaggagugucaggaggaagcuggguagauaucguauuagaacauggaaguugcguuaccacgauggcaaaaaauaaaccaacccuggacuucgaguugauaaaaacugaagcaaagcauccagcuacuuuaagaaaguauuguguagaggcuaaguugacgaacaccaccacagcaucgagaugccccacacagggugaaccaagccucaacgaggaacaagauaaaagauucguauguaaacauucaaugguggacagaggaugggguaauggguguggacuauuuggaaaaggcggcaucguaaccugugcuauguucacauguaaaaaaaacauggaaggaaaagucgugcaaccagaaaaucuagaauauacaauuguuauaacgccacauaguggcgaggagaaugcaguugggaaugauaccgguaaacaugguaaagagaucaaaguuacaccacaaucuaguaucacugaagccgaauuaacuggauauggcaccguaaccauggaguguucaccaagaacuggucucgauuuuaacgaaaugguucuccuacaaauggaaaauaaagcauggcuuguucaucggcagugguuccuugacuuacccuugccuuggcucccuggcgcugacacacaagggaguaauuggauucagaaggagacgcuaguuaccuuuaaaaauccucacgcaaaaaaacaggacguaguaguacuaggaagccaggaaggggcgaugcauaccgcacucacaggggccacagaaauacaaaugucaucugguaaccuucuuuuuaccggacaucuaaagugccgauuaagaauggacaaauuacagcuaaaaggaaugaguuacuccaugugcacaggaaaguuuaagguaguaaaagaaaucgcggaaacucaacacgggacgauagugauaagaguacaauaugagggugacgguucaccuugcaagauuccuuucgaaauaauggaccucgaaaaaagacauguguuaggccgccugauaacggugaaucccauaguuacggaaaaagauaaucccgugaauauagaagcugaaccucccuucggggacagcuauaucaucaucgguguugaacccggucaacuuaagcuaucgugguacaagaaaggaagcucaauaggacagauguuugagacgacuaugagaggcgcgaaaagaauggcuauucuaggagacacagcaugggauuuugggucacuagggggcguauucacaagcaucggcaaagcuuuacaucaaguauucggcgccauuuauggagcagccuucucugguguuucauggacgaugaaaauucuaauuggugucguuauaaccuggauagguaugaacaguagaucaaccucacucucuguaagccuaguccucguagggguaguaacauuauauuuggguguaauggugcaagcagacucuggauguguagugagcuggaaaaauaaagaacugaaaugcggaagcgggauuuucauuacugauaacguccacacauggaccgagcaauauaaguuucagccugagaguccgucaaaacuugccagugccauucaaaaagcccacgaggagggaauuugcggcauacguaguguaacucgcuuggaaaaccuaauguggaagcaaauaacgccagaacugaaucauauucucacugaaaacgaaguaaaacucacaauaaugacaggugauauuaaaggaauaaugcaagcagggaaacguucacuaagaccccaaccaacagaacugaaauacucuuggaaagcaugggguaaagcaaaaauguuaucaacugaacuacacaaucauaccuuucuaaucgacggacccgaaacagccgaauguccaaauacaaaccgggcauggaacaguuuggaaguagaggauuacggguucggcgucuucacgacaaacauauggcuaaagcuaaaagaaagacaagacguauuuugcgauaguaaauugaugagcgccgcgauuaaagauaacagggcuguacaugcugauauggguuauuggauugaauccgcacugaaugauaccuggaaaauagaaaaagcuucguuuauagaaguuaaaucaugucacuggcccaagagccacacucuguggucaaauggagugcuugaaagcgaaaugauaauaccuaaaaauuuugcgggacccgucagucagcacaauuacagaccgggauaucauacucaaacugccgggccauggcaucuagguaggcuugaaauggacuuugauuucugcgaggggacaacaguagugguaacagaagauugcgggaaccgugggccuagccucaggaccacaacagcaucggguaaauuaauuacagaauggugcugucggagcugcacuuuacccccucugcgauaucgcggagaagauggcugcugguacggcauggagauucggccccuaaaggaaaaagaagagaauuuaguaaauucguuaguuacagcuggacauggucaaauugauaauuuuuccuuaggcguccuugguauggcccuauucuuagaggaaaugcuaaggacaaggguaggaacgaaacacgcaauacuacugguggcuguaucauuugugacucuaauuacgggaaauaugucauuuagggaucuugggcggguaauggugauggugggugcgacaaugacugacgacauagguaugggaguaacauaucuggcacugcucgcagcguucaagguacgcccuacauucgcagcaggacuauuauuaaggaaacuuacaucaaaagagcuuaugaugacaacuauaggaauaguacuuuugucacagucaacaauaccagaaagcauacuagaauuaacggaugcacuugcgcuugguaugaugguacuaaaaaucguuaggaacauggaaaaauaucaauuggcagucacaaucauggcgauucucugugucccaaaugcuguaauucuugaaaacgcauggaaagucagcuguaccacacucgccgucgucaguguuagucccuugcugcuaaccucuucacaacaaaaggcagacuggaucccguuagcacugacaauuaaagguuuaaauccuaccgcaauauuccuaaccacucuaucucgcacgaguaaaaaacggagcuggccccuaaacgaggcuauaauggcgguaggaaugguauccauauuggccaguagccugcuaaaaaacgacauaccuaugacaggaccguuaguagcgggaggccuauugacugucuguuauguguuaacaggaaggagugcugacuuagaauuggaaagagcugcugaugucaggugggaagaacaagcagaaaucuccggcagcucgccuauuuugucuauaacuauaucagaggacggcucuaugucaaucaaaaacgaagaagaagaacaaacguuaaccauacuuauacggacgggauuguuagucauaagcgggcuauuuccuguauccaucccgauaacagcagccgcgugguaccuaugggaaguaaaaaaacaaagagccgguguauuaugggacguuccaucuccacccccaguggguaaagcugaacucgaagacggagcguacagaaucaaacaaaaaggaauuuugggguacucgcaaaucggagcagguguauauaaagaggguaccuuucacacaauguggcaugucacacgaggagcgguucugaugcauaaagguaaacgaauagagcccucuugggcugauguaaaaaaagauuuaauuagcuauggaggcggguggaaauuagaaggugaguggaaagagggugaggaaguucaaguuuuagcccuagaaccuggcaaaaacccuagggccguccagacuaagccaggacuauucaaaacuaacacagguacgauuggugccguaucauuggacuuuagccccggaaccucugguagucccauaguagauaaaaaaggaaagguuguaggauuauaugguaacggaguggugacuagaucaggcacuuacguaucagccauugcccagacggaaaaguccaucgaagauaauccugaaauagaagaugauauuuuuagaaaaaaaagacuaacgauuauggaucugcacccaggagcgggcaagacaaaacguuacuuaccggcgaucguuagagaagcaauuaagagagguuuacgaacacugauucuggcuccaacaagagucguagccgcggaaauggaagaagcucuaagaggacuaccaauccgcuaucaaacuccagcuaucagagcagagcacacaggacgagagaucguggauuugaugugucacgcaacuuuuacuaugagguuacuauccccaauuagggucccgaauuauaaucugaucauaauggaugaagcacauuuuacggaucccgcauccaucgcggcaagaggauauauaucgacgagaguggagaugggugaagcugcgggaauauucaugacagcuaccccuccaggcucgcgugacccguuuccacagucgaaugcgcccauaauggacgaagaacgagaaauuccugaaaggucauggaacucuggacaugaaugggugacggauuucaaaggaaaaacaguuugguuuguaccaucaauuaaagccggaaacgacaucgcugccugucugcggaaaaaugguaaaaaagucauacaauuaucuagaaagacguuugacucggaauauaucaaaacuaggacgaaugauugggauuucguugucacgacagauauuagugagaugggagccaacuucaaggcagaaagaguaaucgauccaagacgauguaugaaaccuguaauacuaacagauggcgaagaaaggguuauucuagcagguccuaugccgguaacacauagcagugcggcucaacgaagaggcagaguaggaagaaacccaaaaaacgagaacgaccaauauauauauaugggagaaccacuggagaacgaugaagacugcgcucauuggaaagaagccaagaugcuuuuggacaacaucaauacgccagagggaauaauaccuaguauguuugaacccgagagagaaaaagucgacgcgaucgauggugaguauagauuaagaggggaggcacggaaaaccuucguagaucuuaugcgaagaggcgaucuucccguuugguuagcguacaaaguugcugcagaagggauuaauuacgcagacagacgcuggugcuuugauggggucaagaacaaucaaauauuagaagaaaacguagagguugaaauauggacgaaagaaggagaaagaaaaaaacuaaagcccagaugguuagacgcaaggaucuauucugacccuuuagcauuaaaagaauuuaaagaauuugcugcaggaaggaaaucgcuuacccuuaaucucauaaccgaaaugggaagauuaccuaccuucaugacacaaaaggcuaaaaaugcuuuagauaaucuagccgugcugcacaccgcagaagcugguggaagagcauacaaccaugcacuaucugaauuaccggaaacacuagagacuuuacuccugcuaacuuuauuagcaacugugaccggaggaauauuccucuucuuaaugucgggcaaagguauaggaaagaugacgcuugggaugugcuguaucauaacggccucaauauugcuaugguacgcacagauacagccccacuggauagcagcuuccauaauuuuagaauucuuccuuauaguguugcuaauaccggaaccugaaaaacagagaacuccgcaagauaaucaguuaacauauguuguaauugcaaucuuaaccguagucgcugcgacaauggcaaaugaaauggguuuuuuggaaaaaacgaaaaaagauuucggcuuaggcagcauuacgacccaacagccugaaucuaacauauuagauauagacuuacguccugcaagcgcguggacauuauacgcuguggcaacaacauuuaucacucccauguuaaggcacucuauagaaaauagcaguguuaauguaucgcuuacagcuauagccaaucaagcuacagugcugaugggacuugguaaaggauggccccucucuaaaauggacauaggagugccauuacuugcaaucggauguuauucucaaguuaauccaauaacucuuaccgcugcgcuacuucuauuagucgcacauuaugcuauaauaggcccuggacuucaagccaaagcuacacgugaggcucaaaaaagggcagcagccgguauuaugaaaaacccgaccguagauggaaucacugugauagauuuggauccaaucccauaugauccuaaauuugaaaagcaacuuggacaaguaauguuacuugucuuauguguaacacaaguauuaaugaugcgcacuacaugggcguuaugcgaggcauuaacucuagcuacggggcccauuucgacgcuaugggaaggcaauccaggcagauuuuggaacaccacaauugcaguaucaauggcaaauauauucagaggaagcuaucucgcaggcgccggguuacuuuuuuccauuaugaaaaauacagcgaauacuagacgagguacugguaauacgggagaaacccucggagaaaaauggaaaaauagacucaacgcucuaggaaagagcgaauuccaaauauauaaaaaaagugggauacaagagguagacagaacuuuagcaaaagaagguauuaagcgcggcgagacagaucaccaugcagucucacgcggaucggccaaguugagaugguucguagaaagaaacuuaguaaccccggagggcaaaguugucgaccucggcugcggaagagguggguggucuuauuauuguggcggacuaaagaacguaaaggaaguaaaaggccucacaaaagguggaccaggucacgaagaaccaauaccgaugucaacuuacggauggaaccugguaagauuacaaaguggagucgauguauucuucaccccaccugaaaaaugcgauacacuucuaugugauauuggggagagcaguccaaauccaacaguugaagccggaagaacacuucgcguacuaaaccucgcggaaaauuggcuaaauaauaacacucaauucuguauaaaaguauugaacccuuacaugcccucuguaauagagaaaauggaagcguuacagagaaaguauggcggcgcucucguaaggaauccacuaucaagaaacagcacacacgaaauguauuggguuucuaacgccucugggaauauuguguccagugucaauaugauaucuagaauguugauuaauagauucacaaugagacacaagaaagcaacguaugaaccagacguggauuugggaucgggaacaagaaauauagguauagaaucugagacacccaaccucgacaucaucggcaaaagaauagaaaaaauuaaacaagaacaugagaccaguuggcauuaugaccaggaccauccguauaaaaccugggcauaccauggaucauacgagaccaaacaaacagguucagccagcuccaugguaaauggagucguacgccucuuaacaaaaccaugggacguaauaccaaugguuacacaaauggccaugacggacacuacgccauuuggacagcaaagaguguuuaaagagaaaguggacacacgaacacaagaaccuaaagaaggaacgaagaaacuaaugaaaauaaccgcagaauggcuauggaaagagcuagggaagaaaaaaacgccacgcauguguacuagagaagaauuuacccgcaaagucagaaguaacgcagcacucggagcaaucuuuacagacgagaauaaguggaaaucagcacgggaggcaguagaagauagugguuuuugggaauuaguagacaaagaacguaaucuucaccuagaagguaaaugugaaacaugcguuuauaauaugauggguaaaagggaaaaaaaacuaggagaauucggaaaagcaaaagguucgagagcuauuugguacauguggcuaggagcucgcuucuuagaauuugaagcccuaggauucuuaaaugaggaccacugguuuaguagggaaaauaguuugagcggaguagaaggggaaggccuccacaaacugggauauauacucagggacguaucgaaaaaggaggguggcgcaauguaugcugacgauacugcaggaugggacacuagaauaacacuggaagacuuaaaaaaugaagaaauggucacgaaucauauggaaggggaacacaagaaauuagcagaagcaauuuuuaaauuaacauaucaaaacaaaguuguuagaguacaacgcccaacuccacggggcacuguaauggacauaaucucaagaagagaccaacguggaucggggcaagucguuaccuauggucuaaacacuuuuacuaauauggaagcgcagcucauaagacaaauggaaggagagggaguauuuaaaucaauucaacaacugacggugaaggaggaaauagcgguaaagaacugguuaauaaggguagguagagaacgucuuagcagaauggccaucuccggagaugacugugucguaaaaccacucgaugauagauucgcuucagcucuaacggcguugaacgauauggguaagguaagaaaagauauucagcagugggaaccuucuaggggauggaaugauuggacccaaguuccauuuugcagucaucauuuucaugagcuaauaaugaaagauggcagaguguuaguuguccccugucgcaaccaagacgagcuuauuggcagagcgcgaauuagccaaggagcuggcuggagccuuagagaaacugcuuguuuagggaaaucguaugcacagauguggucgcuuauguauuuccaccgacgggaucuaagacuagcagcuaacgcaauauguagcgcagugccuagucacuggguaccaacaucacguacuaccuggagcauccaugcaacucacgaauggaugacaacggaggauauguugaccguuuggaacagagucuggauccaagagaacccauggauggaggauaaaacgccaguggaaucaugggaagaaauuccuuaucuuggaaagcgugaagaccagugguguggaucccuaauuggauugacaucgagggcgacaugggcaaagaauauacaaacugcuauaaaucaaguucgcucacuuauugguaaugaagaauauacagacuacaugccaaguaugaaaagguuuagaagggaagaagaagaagcuggagugcuaugguga

SEQ ID NO: 22876 - RNA, 9876 nt, Artificial Sequence
  derived and/or modified CDS sequence (opt6) from DENV-2__JN851113__SS-prME
acugcugggauaauaauaaugaugauaccuacuguaauggcauuucauuuaacuacaaggaauggugaaccacauaugauaguuuccagacaagaaaaaggcaaaucuuuauuguucaaaaccgaaaacgguguaaauauguguacauuaauggcaauggauuuaggcgaacucugcgaagauacaauaacauauaacuguccauuacugagacaaaacgaaccagaagacauugacuguugguguaauucuacauccacguggguaaccuacgggaccugcacagcaaccggugaacauaggagagaaaaacguucuguagcauuaguaccacacguugggauggggcuagaaacaagaacagaaaccuggaugaguucagaaggagcauggaaacaugcgcaacgaauugagacuuggauacugagacacccagguuucacaauuauggccgcaauacuugcauauacuauugguaccaccuacuuucaaaggguucugauauucauucuucuaacugcugucaccccuucaauggcuaugagauguauaggaaucucaaaccgugacuucguugaagguguaagcgggggaucguggguugacauuguuuuagaacauggcuccugcgucacuacaauggcuaaaaauaaaccaacccuggacuucgaauuaauaaaaacugaagcaaaacauccagcaacccuacgaaaauauugcguagaagccaaauuaacgaauacuacaacagcgucacgauguccuacucaaggggagccaagucucaaugaggaacaagacaaacgcuucguuugcaaacacaguaugguggaccgcgguugggguaaugguugcggacuauuugggaaaggagggaucguaaccugcgcaauguucacauguaagaaaaauauggaaggaaaaguaguucaaccagaaaaccuagaauauacaauuguuauaacaccucauucaggagaggaaaaugcaguuggaaaugacacgggaaaacaugguaaagaaauuaaaguuaccccacagucuucgauuacagaagcagaguugacuggauaugguacaguaacaauggaauguucaccacguacgggacuagacuuuaaugaaaugguucuucuacagauggaaaauaaagcaugguuaguacaccgucaaugguuucucgaccuuccucuaccaugguuaccaggcgcagauacgcaagguagcaauuggauucaaaaagaaacauuggugaccuuuaaaaacccgcaugccaagaaacaagacguaguggucuuggggucacaagaaggugcaaugcacacagcguugacuggggcaacagagauacagaugucuagugguaacuuacuauuuacaggucaccugaaaugcagacuuagaauggauaaacuacaauugaaaggcaugagcuacucuauguguacugggaaauucaaaguaguuaaagaaauugcagagacucagcacggaacgauagugauacgaguucaauaugaaggagauggcagcccaugcaaaauaccuuucgagaucauggaucuagagaagcgacauguccucggacgacuaauaacugugaauccaauagucacggagaaagauagccccgucaauaucgaagcagaacccccauuuggugauagcuacauuauuauagguguagagccuggccaacuaaaacuaucuugguucaagaaagguucguccauaggacaaauguucgagacgacaaugcguggggcuaagaggauggcuauuuuaggagauaccgccugggauuuuggaucauuaggcggaguauucacgagcauuggaaaagcucuacaucagguauucggagcaauauauggugcagcauuuaguggcguaucauggacgaugaaaauauuaauuggugucguaaucacguggauugggaugaacucuaggaguaccucacugagcguaucguuaguacuugugggaguagucacccuuuaucuuggugugaugguccaagcggauagcgguuguguagucucuuggaaaaacaaagaacuuaaauguggaucggguaucuucauuacugauaauguccauaccuggaccgaacaguauaaauuccagcccgaaagcccuucaaaauuagcaagugcaauacaaaaggcacaugaagaagggaucugugguauuagaaguguaacgcgacuggaaaaccuuauguggaaacaaauaacucccgagcuuaaucauaucuuaacugaaaaugaaguuaagcuaacaauaaugacuggcgauauaaaagguauaaugcaggcagggaaaagaagucuaaggccgcagcccacugaauuaaaauauucauggaaagcauggggaaaagccaaaaugcuaucgacggagcuucacaaccacacguucuuaauugaugggccagaaacagcagaauguccaaauacaaauagagcauggaacagucuugaaguagaagauuaugguuuuggcguguuuacuaccaauauaugguuaaagcuaaaagaacgucaagacgucuucugugauaguaaacuuaugagugccgccauuaaggacaauagagccguacaugcugauauggguuacuggaucgaaagugcauuaaaugauacuuggaagauagagaaggcaucauucaucgaagugaaaucgugccauuggccgaaaagucacacgcuaugguccaacggcguacuugaaagcgaaaugauaauucccaaaaauuuugcagguccugucucacaacauaauuauaggccaggauaccauacgcaaacugcuggaccguggcaucucggaagacuagaaauggacuuugauuucugcgaaggaacaacaguaguaguuacugaagacuguggaaauagaggaccgucacuucgcacuacaaccgcuuccgguaaguuaauuacugaguggugcugcagaagcuguacacuaccgccacuaagauauagaggcgaagaugguugcugguaugggauggagauaagaccucugaaggagaaagaagagaacuuaguuaauagcuuaguuacugcaggacauggucaaauugacaacuucucacucgggguauuagguauggcacucuucuuagaagaaaugcuccgaaccagaguaggaacaaagcacgccauacugcucguugcuguuaguuuuguuacucuaauaacagguaauaugaguuuuagagauuuaggacggguaaugguuaugguaggagccacaaugaccgaugauauuggaaugggagucacauacuuagcauuauuagcagcguuuaaaguaagaccuacuuucgccgcaggguuauuguuaaggaaguuaacuucaaaagagcuuaugaugacgacuauaggcauuguuuuauugucacaauccacuauacccgaaucaauccuggaguuaacugacgcacucgcgcuugguaugaugguguuaaaaauaguaaggaauauggagaaauaucaguuggccguuacaauaauggcaauucucugcguaccuaaugcugugauccuccaaaacgcguggaagguaagcugcaccaccuuagcuguuguuagcguaaguccacuauuguuaacaucuagucaacaaaaagcagauuggauuccccucgcucuaacuauaaaaggccuaaaccccacugcgauauuuuuaacaacucugucucgaacgucgaagaagagaucguggccacuaaaugaagcaauuauggcaguugguauggugaguauacucgcuagcucccuacugaaaaaugacauuccaaugacgggaccgcuaguagccgguggacuauugacgguauguuacguguuaaccgggcgaagugcggaccuagaacucgaacgagcagcugacgugaggugggaagaacaagcugaaauuaguggaucaucaccaauccuaagcauaacaaucagugaagaugguucuauguccaucaaaaaugaagaggaagaacagaccuuaacaauucuaauacguaccggcuugcuuguaaucucaggccuauuuccugugucaauucccauaacugcagcagcuugguacuuaugggaagucaagaaacaacgcgcuggagucuuaugggaugugcccagcccgcccccgguuggaaaagcugagcuagaagacggagcauauagaaucaaacagaaaggaauccuuggcuacucccaaaucggagccgguguauauaaagaaggaacguuccauacaauguggcauguuacaagaggagcuguccuaaugcacaaaggaaagagaauugagcccucaugggcugaugucaagaaagaccuaauaagcuacggaggaggauggaaacucgaaggggaauggaaggaaggcgaagaaguucaaguacuagccuuagaaccuggaaagaacccaagggcuguccagacaaaaccuggucuauuuaagacaaauaccgguacuaucggagcaguaaguuuagauuucagcccgggcacuucaggaagcccaaucguugauaagaaaggaaagguaguagguuuguacggaaacggagugguuacucgauccggaacguacgucucagcgauagcacaaaccgaaaaaucaauugaggauaauccagaaauagaggaugacauauuccguaagaaaagacuaacaaucauggaccuacauccuggggcaggcaaaacuaaaagguauuugccagcaauuguacgugaagccauuaaaagaggacucagaacucuaauucuagccccuacacggguaguggcugcagaaauggaagaagcucuaagagguuuacccaucagauaucaaacgccagcgauccgagccgaacacacugguagagagauaguagauuuaaugugccacgcaaccuuuacaaugcgccuccuuucgccaauucguguaccaaacuacaaucuaauuauaauggacgaggcucauuucaccgacccagcaucuauagcagcccgaggguacauaucaacaagaguggaaaugggggaagcggccgggauuuuuaugacagccacaccaccugggucuagggauccauucccccagaguaacgcacccauaauggaugaggaaagagaaauucccgagagaaguuggaacucuggccaugaaugggucacagacuucaaaggaaaaacaguaugguucguacccaguauaaaagcagguaaugacaucgcagcaugucuucguaaaaacgguaagaaaguuauccaacucucucggaaaaccuuugacagcgaauauauaaaaacucguaccaaugauugggauuuuguaguaaccacagauauuucggaaaugggagcgaacuucaaagcagaacgaguaauugacccucgucgauguaugaaaccugugauacuuaccgacggugaagaaagggugauuuuagcuggacccaugccuguuacacacagcucugccgcccagagaagaggcaggguaggcagaaacccuaaaaaugaaaaugaccaauauaucuacaugggugaaccgcuagagaaugaugaagauugcgcucauuggaaagaagcgaaaauguugcucgacaauauaaauacuccggaaggaauaauaccuuccauguucgaaccagaacgugaaaagguagaugcuaucgacggagaauacaggcugagaggugaggcuagaaagacguuuguagauuuaaugagacggggugaucuacccguuuggcuugccuaucguguagccgcugaagguauaaauuacgcggauagacgauggugcuuugacggagucaaaaauaaucaaauucuugaagaaaauguagaaguggagauauggacgaaggaaggggaaaggaagaaacuaaagccuagaugguuggaugcaagaaucuauagcgacccccuugcuuugaaagaauuuaaggaauuugcagcaggcaggaaaagccuuacacuuaauuuaauaacagaaaugggacgucugccgacauuuaugacgcaaaaagccaaaaacgcucuagauaaucuagcagucuugcauacggcggaagcaggagguagagcauacaaccaugcucucucugaauuacccgagacucuagaaacacuccuacuuuuaacguuauuggcaacaguaacaggagguauauuucucuuuuuaaugagcggcaaggguaucgguaaaaugacauuagggauguguugcaucauuaccgccaguauacucuuaugguacgcucaaauccaaccacauuggauagcggccagcauuauuuuagaguucuuucucauuguuuuacuaauaccggagccagaaaaacaacgaaccccgcaggacaaucaacucaccuacguagucauagcaauauuaacuguugucgcugcaacuauggcuaaugaaaugggguuuuuggagaaaaccaagaaagauuuuggauuggguuccauaacgacucaacaacccgaaaguaacaucuuggacaucgauuugagacccgcgucagcauggacguuauaugccguugcaacgacuuuuaucacgcccauguuacgacacaguauagaaaacaguucgguaaauguaucgcuaaccgcuauugcaaaucaagcuacaguacugaugggauugggaaaaggauggccacucucaaagauggauauaggcguaccccuguuagcuauagguuguuacagucaagucaauccgaucacuuuaacagcagcccugcuucuccuuguugcccauuaugcaaucauaggaccaggcuuacaagcaaaagcaacucgugaagcucagaaaagagcagcagcgggaaucaugaaaaaucccacgguagacggaaugacaguaauugauuuagacccaaucccauacgaccccaaguucgaaaaacaacugggacagguuauguuauuaguccuauguguuacacaaguuuugaugaugaggacaacuugggccuugugcgaggcgcuuacacuugcgacuggaccgaucucaacauuaugggagggaaauccaggacgguuuuggaauacuacuaucgccguaaguauggccaauauuuuucgcggaaguuaucuagcaggcgccggauuacucuuuucaaucaugaaaaacacagcuaauacgcgaagaggaacagguaauacaggggaaacacuuggggagaaauggaagaaucgucucaaugcgcuuggaaagucagaauuucagauauacaagaaaucaggaauccaagaaguugaccgaacucuagcuaaagaaggaauuaagaggggugagaccgaucaucaugcuguuucacgagguuccgcaaaacuacgaugguuugucgaacgcaaucuaguuacuccagagggaaaagucguagaccuuggcuguggacggggugguuggucuuacuauugcggagguuuaaagaauguuaaggagguuaaaggauugacuaaaggcggcccgggacaugaggaaccaauacccaugucuacauacggauggaauuuagugagacugcaaagcgguguugacguuuucuucacuccgccggaaaaaugugauacauuauuaugugauauaggggaauccucaccuaacccaacaguagaagcuggaaggaccuuacgcguguuaaaucuuguggagaauugguuaaacaacaacacucaauucuguauuaagguucuuaacccauauaugccuucaguaauugagaaaauggaagcacuucaaagaaaguacggcggugcgcuuguuaggaacccuuuaucccguaauucaacccaugaaauguacuggguaagcaacgcaaguggaaauauaguuucuucugucaauaugauaagcaggaugcucaucaauagauuuacaaugagacauaagaaagcaacauacgagccagacgucgaccuagggagcggcacucgaaacauagggauugaaucagaaacaccuaauuuagacaucauagggaaaaggauugagaaaauuaaacaagaacaugaaacaaguuggcauuacgaucaagaucacccuuauaaaacgugggcauaucauggcaguuacgaaacuaagcagaccggcagcgccuccucaaugguaaacgggguaguucgacuuuugacaaaaccuugggacguaauaccgaugguuacgcaaauggccaugaccgacacaaccccuuucggucaacaacguguguuuaaagaaaaaguugauacacggacgcaagaaccaaaagaaggaacaaagaaauugaugaaaauaacugcagaauggcuuuggaaagaacuugguaaaaagaaaaccccaaggaugugcacucgugaagaguuuacgaggaaaguccggucaaaugcggcccuaggugcaauuuuuacugaugaaaacaaauggaaaucagcacgugaagcaguagaggacagugguuucugggaauuaguagacaaagaaaggaaucuucaccuugaggggaaaugugaaacgugcguauacaauaugaugggaaagagagaaaagaaacuaggagaguucgguaaagcuaaagguucacgcgccauuugguacaugugguugggugcuagauuuuuagaauuugaagcguugggguuucuaaaugaggaucauugguucagcagagaaaauucauugucaggaguagaaggugagggacuucauaaauuagguuauauacuacgggaugucagcaagaaagaagguggagcgauguaugccgaugacacugcugguugggacacuaggauaacauuagaggaucugaaaaacgaggaaaugguuacuaaccauauggagggugagcacaaaaaguuagcugaagcgauuuucaaguuaacauaccagaauaagguuguaagaguccaacgaccaacaccacgaggcacaguaauggauaucauuucacgcagggaucagcgaggaagcgggcaaguugugacguacggcuuaaauacguucaccaauauggaagcgcagcuaauacgacaaauggaaggagaaggagucuuuaaaucaauacaacaacuuacugucaaggaagaaauagcggucaagaacugguuaaucagagucggacgagaaagacuaucccgaauggcgaucaguggagacgauugcguuguaaaaccacucgaugauagguuugccucagcacugacagccuuaaacgauauggguaagguaagaaaagauauucagcaaugggagccaucacgaggcuggaaugauuggacacaaguuccauuuuguagccaucauuuccaugaauuaauuaugaaggacggucgcguauuagugguaccuugcagaaaccaggaugaacuaauaggacgcgcaagaauuagucagggagcuggauggucccuaagagaaaccgcauguuugggaaaaagcuacgcacagauguggucacucauguacuuucaucgaagagauuuaagauuagcggcaaacgcaauuuguagugccguucccucgcacugggugccaacgagucguacaaccuggaguauucaugcaacacacgaauggaugacuacagaggacaugcuaacuguauggaaucgcguauggauccaagaaaaucccuggauggaagacaaaacgccaguggaaucuugggaagaaaucccauauuuaggaaagagagaagaucagugguguggauccuuaauuggacuaacaucucgagccacgugggccaaaaacauacaaaccgcaaucaaucaagugcggucauuaaucgguaacgaagaguauacugauuacaugccuucuaugaaaagguuucgccgugaggaagaggaagcagggguacucugguga

SEQ ID NO: 22877 - RNA, 9876 nt, Artificial Sequence
  derived and/or modified CDS sequence (opt6) from DENV-2__GU370050__SS-prME
acagcagggaucauuauaaugaugauuccaacuguaauggcauuucaccuuacaacacgaaauggagaaccucacaugauuguuucaagacaggaaaaagguaaaucgcuuuuauuuaaaacagaaaauggaguaaacaugugcacuuuaauggcuauggacuugggagaauuaugugaagacacuauaaccuauaacuguccuuuacucagacaaaaugaacccgaagacauagauuguuggugcaauucaacaucaacuugggugacauacggaacauguacagcaacgggagaacaccgacgugagaaaagaucuguugcuuugguuccccacguuggaaugggccuggaaacaagaacugaaaccuggaugagcucugaaggggcuuggaaacaugcacaacgcaucgaaacauggaucuugaggcacccugguuuuacaaucauggcagcaauucuagcguauacgauaggaacgaccuacuuccagcggguauuaauuuuuauuuuauuaaccgcagucaccccaaguauggccaugagauguauagggaucagcaaucgcgacuuuguugaaggaguaucuggaggaaguuggguagauauaguguuggaacaugggucguguguaaccacuauggcuaaaaauaaaccuacacucgacuucgaacuuauuaaaacggaagcuaaacacccagcgacccucagaaaauacuguguagaagcgaaacugacaaacacuacaacggcaagccgaugccccacgcaaggggaaccgagcuuaaacgaagaacaagauaagcgcuuuguauguaaacauucuaugguagacagggguugggguaacggauguggucuuuucggaaaaggaggaauaguaaccugugcuauguucaccuguaagaaaaauauggaagguaagguugugcaaccugaaaacuuagaauauaccauaguaauaacaccacacucgggagaagaaaaugcagucggaaacgauacuggaaaacacggaaaagaaauaaagguuacuccacaaucaaguauaacugaagcagaacuaacaggauauggaacaguaacuauggagugcagcccuaggacugggcucgacuuuaacgaaaugguacucuuacaaauggaaaauaaggcaugguuaguucacaggcaaugguuucuugaucuucccuuaccguggcuaccaggagccgacacgcaggguagcaauuggauacaaaaagagacauuaguuacauuuaaaaauccacacgcaaagaaacaggauguaguggugcuaggaagucaagaaggagccaugcacacagcacuuacgggcgcuacagaaauacaaaugaguaguggcaauuuguuauucacaggucauuugaaaugccgccugcgaauggacaaacuacaauugaagggcaugucauacucaauguguacggggaaauuuaaagugguaaaagagaucgcagaaacucaacauggcacaauaguuauccgaguucaauaugaaggagauggcucgccauguaagauaccauucgaaauaauggaccuagagaaaagacaugugcuugguagguuaauaaccguuaauccaaucguaacggaaaaagauucuccggucaacauagaggcagagccaccauucggagacaguuauauuauaaucggaguugaacccggucaguuaaaauuaaguugguuuaaaaagggaucaucuaucggccaaauguucgaaacuacaaugcgaggugccaaacgaauggcuauuuuaggcgacaccgcaugggauuucggaagccuuggcggcguauucacgucaauaggaaaagcauugcaccaaguauucggagcaauauauggagcagcauuuagcggaguaucguggacuaugaaaauucuaauugggguagucauuacauggaucgguaugaacaguagaagcacuagcuuaagugugagccugguacuugucggagugguaacauuauauuuaggugugaugguccaggcggacaguggaugcgugguaucauggaaaaacaaggagcucaaauguggaagugggaucuucauaacagauaauguucauaccuggacugaacaauauaaauuucaaccugaaaguccuucaaaacuugcguccgcaauacagaaagcucacgaggaaggcauuuguggaauuagaaguguuacacgauuagaaaaccuaauguggaaacaaauuacaccugaacugaaucauauuuuaacagaaaacgaaguaaagcucacuauaaugacaggagauauaaaaggaaucaugcaagcgggcaaacgaaguuuacgaccacaaccgaccgaacucaaauauaguuggaaagcauggggaaaggcuaagaugcuaucaacugaauuacacaaccauacuuucuugaucgaugguccagagacugcagaauguccaaacacgaauagagcauggaacucauuagaaguagaagacuacggauuuggagucuuuacgacuaacauauggcuuaaacuuaaagagaggcaagauguauuuugugauucuaaauugaugucggcagcgauuaaagauaauagagccguacaugcugauaugggauauuggauagaauccgcucugaacgacacguggaaaauugaaaaggcaucauuuauagaaguuaaaaguugccauuggcccaagucccacacacuauggucuaauggugucuuagaaagugaaaugauaauaccgaaaaauuucgcaggaccagugagucaacacaauuaucgcccaggguaccauacucaaacugcagguccuuggcaucuaggaagauuagaaauggauuucgacuuuugugaagggacgacagucguuguaacagaagauuguggaaauagaggacccaguuuaagaacaacuaccgcaagcgguaagcuaauaaccgaaugguguuguagaucauguacuuuaccgccucuacgauaccgcggagaggacgguugcugguaugggauggaaauacggccacuuaaagagaaagaagagaacuuaguaaacagccuaguuacugcgggacaugggcaaaucgauaauuucucuuuagguguucuaggaauggcacuguuucuggaagaaaugcuacgaacaagagugggaacgaaacaugcaauuuuauugguagcaguuucauucguuacauuaauuacgggaaauauguccuucagggacuuaggaagggugaugguaaugguuggagccacaaugacggacgacaucggcaugggugucaccuauuuagcuuuguuagcagcauuuaaaguaagacccacauuugcggccggucuucuguuacggaaacuaacuuccaaggagcuaaugaugaccacaauaggaauaguacucuugucucagucuacuaucccagaaagcauccuagagcuuacagaugcguuagcacuuggaaugaugguacuuaagauugugaggaacauggaaaaauaccaauuggcaguuacaauuauggcaauucuuuguguccccaaugcagucauucuacagaaugcuuggaaagucucauguaccacacuugcgguuguuucaguuucuccccuuuuguuaacgagcagucaacaaaaagcagacuggauucccuuggcacuuaccauuaaggggcugaauccaacagcgauuuuucugacaaccuuaagcaggacgucuaaaaagcgcuccuggccauuaaaugaagccauuauggcgguuggcauggucucaauauuagcaucaucgcucuugaaaaacgacauuccaaugacagggccacugguugcggguggacuuuuaacuguaugcuaugucuuaaccggacguagugcagaccuagaacuggaacgagcagcggaugugcgaugggaggaacaagcugaaaucucaggaucaucacccauuuuaucaaucacaauaagugaagauggaagcaugaguaucaaaaacgaggaagaagaacaaacauugacaauccuaaucagaacuggacuguugguuaucucagggcuauucccuguaucgauuccuauuaccgcagcggcaugguaucuuugggagguaaagaaacaacgcgccgggguacuaugggauguaccaagcccuccuccagucgggaaggcggaauuagaagauggagcauacagaauaaaacaaaaagguauuuugggguauagucaaaucggggccggagucuauaaagaagggacguuccauacgauguggcacgucacccguggagcagugcuuaugcauaaagguaaaaggauugaaccgucaugggccgacgucaagaaagaucuaauaagcuaugguggaggcuggaaacuagagggggaauggaaggagggagaagaaguccaaguacuagcguuggaaccaggcaaaaauccucgagccgugcaaacgaaaccaggucucuucaagaccaacacgggcacgauaggagcugucucgcuggacuuuuccccagggaccaguggaucgccuauaguagacaagaaaggcaagguaguggguuuguauggaaacggaguaguaacuagaucagggacuuaugugucagcuauagcacaaacggaaaaauccauagaagacaauccagaaauagaagaugauauuuucaggaagaaacgucugacaauaauggacuuacaucccggcgcugggaaaacaaaacgauauuuaccagcuauaguuagggaagcgauaaaacgaggauuaaggacccuuauuuuagcaccuacaagagucguagcugcagaaauggaagaagcccugagaggucuaccaaucagauaucaaacgccagcaaucagagcagaacauacaggaagagagauuguggaucucaugugccaugcuacauuuacuaugagauuguuauccccuauuagaguuccuaauuacaauuugauaauuauggaugaggcucacuuuacagaucccgcuagcauagccgcaagagguuauauaaguacuagaguagaaaugggugaggcagcagguauauuuaugacugcuacgccgccuggaagucgugauccauucccccaaagcaaugcaccuauuauggaugaagaacgggaaaucccagagagaucauggaacucaggucacgaauggguuacugacuucaaaggaaaaacuguuugguuuguaccuucgaucaaagcuggaaacgauauagcugcuugucuuaggaaaaauggcaagaaaguaauacaacucagccguaagaccuucgacucugaguacauuaaaacuagaacgaacgauugggacuuuguaguuacuacggauauaagugaaaugggugcgaauuucaaagcugaaaggguaaucgauccaaggcgaugcaugaagccaguaauauuaaccgauggggaagaaaggguuauacuugcugguccaaugcccguaacacauucgucagcggcacaaagacgggguagaguagggcgaaacccuaaaaaugaaaaugaucaauauauuuauaugggugagccuuuggagaaugacgaagauugugcucacuggaaagaagcaaaaauguuacuugacaauaucaauaccccagaaggcauaauuccuuccauguucgaacccgaacgagaaaaaguggacgccauagauggcgaauacagguuacggggugaagcaaggaaaaccuucguggaccuaaugagacgaggagacuuaccgguuuggcucgcuuaucggguagcugccgaaggaauuaauuacgcggacaggagaugguguuucgauggagucaaaaauaaccaaauacucgaagaaaauguagagguagaaauauggacaaaagaaggagaaagaaagaaacuuaaaccuagauggcuagaugcucgaauauauucggauccacuugcacuuaaagaguucaaagaguucgcugcuggacgcaaaucauugaccuuaaaucuaauuaccgagauggguagacuaccaacguuuaugacucaaaaggccaaaaacgcccucgacaaucuagcaguacuacauacagcagaggccggaggacgagcguauaaucaugcucugagcgaacuaccagaaacgcucgagacacuacuacuacuaacacuuuuggcaacagucaccggagguaucuuccucuuucuuaugagcggaaagggaaucgguaaaaugaccuuagguauguguugcauuauuacagcaagcauacuccuuugguaugcacaaauccaaccucacuggaucgccgcgucaauuauucuagaguucuucuuaauaguccuguugauaccggagccugaaaaacaaagaacaccacaggauaaccaacucacauacguagucauugcuauacuuacuguaguagcggcuacuauggccaaugaaaugggauuucuugagaaaacaaagaaagacuuuggacucggaagcauaacaacacaacagccagaaucaaauauucucgacaucgaucuaagaccugcuagcgcauggacauuguacgcgguagcuacuacguucauuacgccuauuuuaagacacucaauugaaaauucuucuguaaacguuucacuaaccgcgauagcuaaucaagcgacgguuuugaugggacuaggaaaaggauggccucuaucaaaaauggacauuggaguaccauuauuggcgaucggcuguuauucucaagucaauccuauaacuuuaacagcggcuuuacuucuauuaguagcucauuaugcaauuauaggacccggauuacaagcaaaggcaacccgagaagcucagaaaagagcagcggcugggauaaugaagaaucccacggucgauggaaugacagucauagacuuggauccgaucccauaugauccuaaauuugaaaaacagcuaggccaagucaugcuauuaguucuuuguguuacucaaguacucaugaugcguacaacgugggcucuaugugaggccuuaacauuggcaacugggccaauuucaacucuaugggagggcaauccaggccguuuuuggaacacuacuauagcgguuucaauggcuaacauauuccgcggaucauaucuugcuggggcaggacuguuguuuucuaucaugaaaaacacggcuaauacgagaagagguacuggaaacacaggagaaacucuuggagaaaaauggaaaaauaggcuaaaugcauugggcaaaucugaauuucagauauauaaaaagaguggaauccaagagguugauagaacccuggccaaagaagguauuaaaaggggagaaacagaucaccacgcaguuucucgagguagugcaaaacucagaugguucguugaaaggaaucuuguaacuccagaggggaaaguugucgaucuggguugcggcaggggaggauggucguacuauugcggaggguugaaaaauguaaaggaagugaaaggauuaacaaaaggagguccgggucaugaggaaccaauacccaugucaacuuacggguggaauuuggucagauugcaaucggguguugaugucuucuuuacacccccggaaaagugcgauacccuucuaugugauauaggugaaaguucuccaaacccuacuguagaagccggacgaacuuugagaguucuuaaucuggucgaaaauuggcuaaauaacaacacacaauuuuguaucaaagucuuaaauccauauaugccaucggugauugagaagauggaggcguuacaaagaaaguauggaggugcauuaguccguaacccacugucaagaaauuccacgcaugaaauguauugggucaguaacgccaguggcaauauaguuucaucugugaauaugauaaguagaaugcugauaaauagauucacuaugcgucauaaaaaggcgacuuacgaaccagauguagaccucgggagcgguacuaggaacauaggcauagaaucugagacgcccaauuuggauaucauuggaaaacggauugagaaaauuaaacaagaacacaaaaccucuuggcauuaugaucaagaucacccuuauaaaacaugggcguaccacgggucuuacgaaacuaagcagacaggguccgcaagcaguaugguuaacgggguuguccgacuacuuacaaagccuugggauguaauacccauggugacucaaauggcgaugacggacacuacgccauuuggacaacaaagaguauucaaagaaaagguugauacucggacacaagagccaaaggagggaaccaagaaacuaaugaagauaacagcagaauggcuguggaaagaauuagguaagaagaaaacucccagaauguguaccagagaagaguucaccagaaaagugagauccaaugcagcuuugggagcgauauuuacagacgaaaauaaauggaagucggcccgugaggccguugaagauuccggauuuugggaguuaguagacaaggagagaaaucuacacuuagaagggaagugcgaaacuugcguauauaacaugaugggaaaaagagagaagaaacuaggagaguucggaaaagcaaaggggucucgggcaauaugguacauguggcuuggagcuagauucuuagaauuugaggcauuaggauuccuaaaugaggaucauugguuuagcagggaaaacucuuuaaguggcgucgaaggagagggccuacauaaauuagguuauauauugagagacgugucgaagaaagaaggaggggcgauguacgcagacgauacagcuggcugggauacaagaauaacccuugaggaucucaaaaaugaagagaugguaacuaaccacauggaaggugaacauaaaaaguuagcagaggcgaucuuuaggcugacuuaucagaacaaaguaguucguguacaaagaccaacccccagaggaaccguaauggauauaaucaguaggcgagaucaacgcgggaguggucaagugguaacauauggauuaaauacuuuuaccaauauggaagcgcaacugauaaggcaaauggagggugaagguguuuuuaaaucuauacaacaacucaccgucaaagaagaaauagcagucaaaaacuggcuaauaagaguagggagagaaagauuaucacguauggcaaucucaggagaugauuguguagugaaaccguuggaugauagauuugcgucggcacuaacagccuuaaaugacauggguaaagugagaaaagauauucaacaaugggagccaucgaggggguggaaugauuggacacaaguaccauuuugcucucaccauuuccaugaacucauaaugaaagauggacguguuuuaguaguuccuugccgaaaccaagaugagcuaauuggacgagcuagaauuucccaaggugcuggcuggagcuuaagagagacagcaugucuagguaaaucauaugcgcagauguggagccuuauguacuuccaucgacgggaccuacguuuagcagccaaugcaauuuguuccgcaguuccgagccacuggguaccgacuucaagaaccacuuggagcauccacgcuacccacgaauggaugacaacagaggacauguugacuguauggaauagaguauggauccaagaaaaucccuggauggaggacaaaacgccaguggaaucaugggaggagauaccuuaucuaggcaagcgagaggaucaaugguguggauccuuaaucgguuuaacauccagagcuaccugggccaaaaauauacaaacagcuauuaaucagguaagaucacuaauuggaaacgaagaauauacugauuauaugcccaguaugaagcgguuucggagggaggaagaggaggcaggcguacuaugguaa

SEQ ID NO: 22878 - RNA, 9876 nt, Artificial Sequence
  derived and/or modified CDS sequence (opt6) from DENV-2__JN851129__SS-prME
acagcaggaauuauuauaaugaugauaccaacagucauggcauuccaucuaacaacaagaaacggggaaccccauaugauaguaucaaggcaagaaaaaggaaaaaguuuacucuucaaaacagaaaauggaguuaauauguguacauugauggcuauggacuugggagaacuaugugaagauacaauaacguacaauugcccgcugcuccgccaaaacgaacccgaagacauagacugcugguguaacucgacgucuacauggguaacauauggaacguguacggcaacaggagaacaccgacgcgagaaacgaagugucgcacucguuccucacguaggaaugggauuagaaaccagaacagaaacguggaugucaagcgagggggcauggaaacaugcacagcgcaucgaaacauggguuuuaagacacccaggauucacaauuauggcugcaauacuugcauauacaaucggaaccacauauuuccaaaggguauuaauauucaucuuacuaacggcaguagcaccaaguaugaccaugcgcugcaucggaaucaguaaccgggacuuuguagaagguguaucuggaggcucauggguagacauuguccuagaacacggaaguuguguuaccacaauggccaaaaauaaaccaaccuuagauuucgaguuaauuaaaacagaagcaaaacacccugcaacucuacggaaauauugcauugaggcuaaauuaacaaauaccacaacugcuucuagauguccgacccagggugaaccaucccuguccgaggagcaagauaaacguuuuguaugcaaacauucaaugguugacaggggauggggaaacggguguggcuuguuugggaaaggagguauuguaacaugugcaauguuuacauguaagaaaaauauggaaggaaaagugguacaaccagaaaaucuugaauauacaauugugaucacaccgcacucgggagaagaaaaugcagucgguaaugauacugguaaacacgguaaagagaucaaaguuacuccucaguccagcauaaccgaagcugaauugacuggauacggcacaguuacuauggaauguucaccccgcacugguuuggauuuuaaugagaugguucucuuacaaauggaaaacaaagcaugguuaguacauagacaaugguuucuggauuuaccauuaccauggcuaccaggugccgauacccaagguucaaauuggauacaaaaagaaacacuggucacguuuaaaaauccccaugcaaagaaacaagauguuguugucuugggcagucaagagggagcuaugcauacagcccucacgggcgcaacugagauucagaugaguagugggaauuugcuguucacugggcaucuaaaaugcagauuacggauggauaaacuacaacuaaaaggaaugaguuauuccauguguacagguaaauucaaaguuguaaaagaaauugcagaaacacaacauggaacaauuguuauucgaguacaauacgagggggauggcucaccuugcaaaauccccuuugaaauaauggauuuagagaaacgucauguucuuggcagacucauuaccgugaaucccauaguuacagagaaagauucaccuguuaauauagaggcagaaccgcccuuuggugauucauacauaauuauaggcguggagccgggccaacuaaaacuaucuugguuuaaaaagggcucauccauuggacaaauguuugagaccacaaugagaggagcaaagagaauggcaauucucggggauacagccugggauuucggaagucugggaggagucuuuacgucgauugggaaagcacuucaucaagucuucggagcuauuuacggugcugcuuucucgggugucucuuggaccaugaaaauccucauagguguagucaucacauggauaggaaugaauagucguaguacaagucugagcguuagccuaguauuaguugguguagugaccuuguaccuuggugucaugguucaggcugauucaggaugcguuguaucauggaaaaacaaagagcuuaaauguggaucagguauuuuuaucaccgacaacguccauacuuggacagagcaauauaaguuccaaccugaaucaccaucaaaacuagcgagcgcuauacaaaaagcacacgaagagggcauauguggcauucguucaguuacccgcuuggagaauuugauguggaaacaaauaacaccugaauuaaaucacauacuaucagaaaacgaaguuaaacugacaauuaugacgggugacaucaaaggaauuaugcaagcggguaaaaggagucucaggccccaaccuacggagcuaaaauauaguuggaaggcuugggguaaagcuaaaauguugucaaccgaacuacacaaucauacguuucucauugauggaccagaaacggcagaauguccuaauacuaaccgggcauggaacucauuagaaguagaagacuaugguuucggaguuuuuacaacaaauuuauggcuuaagcugaaggaaaggcaagacguauuuugcgauaguaaauuaaugucggcagcuauaaaagauaaccgggccguucacgcagauaugggguacuggaucgaaagugcuuuaaaugauaccuggaagauugagaaagcaaguuucauagaaguaaaaucuugucauuggccaaaaagccacacauuguggucgaacgggguauuggaguccgaaaugauaauacccaaaucuuuugcaggcccaguaucccaacauaacuaccgaccgggauaucauacucaaaccgcggggccuuggcaccuagguagacuagagauggauuucgacuucugugagggaacuaccgucguuguuacagaagauugcggcaauagaggcccaucacugagaacaacuacggcuucggguaaacuaauuacagaauggugcuguagaucuugcacguugccuccacuaagauauagaggggaagacggauguugguacggcauggaaauacgcccguuaaaagaaaaagaggaaaaccuaguuaauagucuaguuacggccgggcauggacaaaucgauaauuuuuccuugggaguguuaggaauggcuuuauuccuagaagaaaugcucagaacuagagugggaacuaagcaugcuauacuucuaguagcagucucuuucguuacguuaauaacaggaaacaugucauuuagagaucuaggaagaguaaugguuauggucggugcuacaaugacugacgauauaggcauggggguuacguaucuagccuuguuggcugcuuuuaaaguuagaccuaccuucgcagcaggcuuauuacuaagaaaacucacaucaaaagaacuuaugaugacaacuauaggcauagucuuacuuucccaaagcacgauaccugaaacaauauuagaacugacugaugcccuagcacuuggaaugaugguacucaaaaucguaaggaauauggagaaauaucaauuagcuguaacgauuauggcuauacuauguguaccaaaugccguuauauuacaaaacgcguggaagguuucauguaccacccuugccgucguauccgugucaccauugcuauugacauccagucagcagaaagccgauuggauaccguuggcucuaacaauaaaaggucuuaauccaacagcaaucuuucuaacuacacuaucucgcacaaguaagaaaagaagcuggccacuuaaugaggcuauaauggcgguaggcauggugaguauucuugcaucaagucuucuuaagaacgauauucccaugacaggacccuuaguagccggagggcuacuaacagucugcuacguacugacaggaagaucugcagaccuagagcuagagcgugccgcugaugucagaugggaggaacaagccgaaauauccggaucaucaccuaucuugagcaucacaauaagcgaagacggauccaugaguaucaaaaaugaagaagaggaacaaacauuaacaauauuaauuaggacaggccugcugguuauuagcgguuuauuccccgucucuauaccgauaacggcagcugcaugguauuuaugggaagucaagaaacaacgagcaggaguauuaugggauguaccaucaccgcccccgguaggaaaagccgaauuggaagacggugccuauagaauaaaacagaaaggcauauugggauacucccaaaucggagcaggaguuuacaaagaaggaacauuccauacaauguggcacguaacuaggggagcuguauugaugcauaaaggaaaaaggaucgagccgucaugggcggacguaaagaaagauuugaucucauacggugggggauggaaacuugagggggaauggaaggaaggggaggaaguacaaguucuugcccuagaaccggguaaaaacccuagagcuguacaaacuaagccaggauuauuuaaaaccaacaccggaaccauuggagcugucagucuggacuuuagccccggaacaucagggucacccauaguggauaagaaaggcaaggucgucggccucuaugggaacggaguagucacuagaucaggaacguauguauccgcaaucgcucaaacugagaaaaguauagaagacaauccagagauagaagaugauauuuuuagaaagaagagacuuacgauuauggaucugcacccaggagcagguaaaacuaaaagauaccuuccagcuauaguacgagaagcaauaaaaagaggauuaagaacacuaaucuuagcccccacacguguuguagcugccgagauggaagaggcauuaaggggucugccuauacguuaccaaacaccagccauaagggcagaacacacgggaagagaaauaguagauuuaaugugccaugcaaccuuuacaaugagacuguuaaguccaauccgaguaccaaacuacaacuuaauaauaauggacgaagcacacuuuacugauccagcuucaauagcagcucgaggauacaucagcacaagaguagaaaugggugaagccgcugguauauucaugacugcgacgccaccugguucaagggacccauucccucagaguaacgccccuauuauggacgaagaacgggaaauaccagaacgcaguuggaacaguggucaugaauggguaacagauuuuaaaggaaaaacugucugguucguaccgucaaucaaagcagguaaugacauugcagcguguuugaggaaaaacggcaagaaaguaauccagcugucgaggaaaacauucgauucugaauacauaaagacuaggacuaacgacugggauuuuguaguaacaacggacauuuccgaaaugggagcaaauuuuaaggcagaacggguaauagauccuagaaggugcaugaaaccaguuauacuaaccgauggcgaagaacgcgugauucucgcuggaccuaugccuguuacucauaguagugcugcucaaagacgaggaaggguaggucguaaucccaaaaaugaaaaugaucaauacauuuacaugggugaacccuuggagaacgacgaggacugugcccacuggaaagaggcgaaaaugcuauuagauaacaucaacacuccagaaggcauaauaccuucaauguuugaaccggagcgugagaagguagaugcgauagauggagaguacagacuacguggugaagcuagaaagacauucguagauuuaaugagaaggggugaucuaccuguauggcuagcuuaucgaguagcagcggaaggaauuaauuaugcagauagaagauggugcuuugauggaauaaagaauaaucaaauauuagaagagaaugucgagguugaaauauggacuaaagaaggugagagaaagaaacuaaaaccucgauggcuggaugcgcgaauuuauucugauccauuggcacuaaaagaauuuaaagaguuugcugcgggcaggaaauccuugacacugaaccuaauaaccgagauggguagauugccaacguuuaugacacaaaaagcccguaaugcgcuagauaaucuagcgguauuacauaccgcggaggcgggaggcagagcauacaaucacgcccuaucagaacuuccagaaacacuagaaacccuuuuauuacuuacauuacuugcaacggugacuggaggaaucuuccuguuuuuaaugaguggcaaaggaauagggaaaaugaccuuggguaugugcuguaucauaacagcaucuauacuucuaugguacgcacaaauacaaccccauuggauugcggcaaguauaauacuugaguucuuucuaauaguauuacugauuccggagccagaaaaacaaagaacaccacaagauaaucaacugacguacguagucauagccauuuuaacaguaguagcugcuacaauggcuaaugagaugggauuccuugagaaaacuaagaaagacuuuggacugggaucuauuacaacucaacagcccgaaucaaauauacuagauauagacuuaagaccggccagugccuggacucuguacgcuguagcuacuaccuuuauaacgcccauguuacgacauaguauagaaaacaguucaguaaacgucucgcuaacggcuauagccaaccaagcaaccgucuuaauggguuuagggaagggcuggccguuaaguaagauggauauaggaguuccauuacuggcgauaggguguuauucacagguaaauccuauaacauuaacggcugcacuucuucuccuaguugcacauuaugcaaucauaggaccuggacuacaagcgaaggcgacccgagaagcacaaaaacgggccgcggcuggcaucaugaagaacccgaccgucgaugggauaaccguaauugaucuagauccgauuccguacgauccgaaguuugaaaaacaacuuggacaaguuauguuacuugugcuuuguguuacacaaguccuuaugaugcggacuacaugggcguuaugugaagcgcuaacccuagcuaccggaccgauaaguacauugugggagggaaauccagggagauucuggaauacaacaauagcuguauccauggcgaacauauucagaggcagcuaccuggcuggugcaggccuccucuuuaguauuaugaaaaacaccgcgaacacgaggcgagguaccgguaacacuggagagaccuuaggugaaaaguggaagaacaggcugaaugcauuagguaaaucugaguuccaaauuuauaagaaaucaggcauacaagaagucgaccgaacucuggcuaaggaaggaauuaaacgcggagaaacagaucaucacgcugugucgcgagguucagcaaagcugcggugguucguagaaagaaauuuagucacaccggagggaaaaguaguagacuuagggugugguagaggagguuggucauacuacuguggaggccuaaagaauguaaaagaaguaaagggauuaacgaaaggaggcccaggacaugaagaacccauacccaugagcacguaugguuggaauuuaguucgccuccaauccgguguagauguauuuuucacacccccugagaagugugacacucuauuaugugauauaggggaaucaucaccaaauccaacagucgaagcaggaagaacacuacgaguccucaacuuaguggaaaauugguuaaacaacaacacucaauuuugcaucaaaguucuuaacccguauaugcccucagugauagagaaaauggaggcuuuacaacguaaauacggaggagccuugguacgcaauccguugucacguaacagcacucacgaaauguacuggguuaguaaugcgucaggcaauauaguaagcucagucaauaugauaucaagaaugcuuaucaacagguucacuaugcgccauaaaaaggcgacauaugagccagauguagaccuaggaucgggaacccgaaacaucggaaucgaguccgaaacaccaaaccuggauauuauagggaagaggauugagaaaauuaaacaagagcacgagaccucauggcauuaugaccaggaucauccauacaagacuugggcuuaccacggcucauaugaaacaaaacaaacaggaucugcuuccucaaugguaaauggagucguaagauugcuaacuaagccuugggauauaauaccuaugguaacucaaauggccaugacggauacaaccccuuucggacaacaacgaguauucaaagaaaaaguagacacaaggacccaggaaccuaaagaagggaccaagaaacuaaugaaaauuacagcggaaugguuauggaaagaacuuggcaagaagaaaacuccuagaaugugcacacgugaggaauuuacacgcaaaguacguucuaaugcagcauuaggugcaauauucaccgacgaaaacaaguggaagagugcaagagaagcagucgaagauaguggauucugggaacugguagauaaagaaagaaaucuacaucuggaaggcaagugugaaacaugcgucuauaacaugaugggaaaaagagagaagaaauuaggagaguucggcaaggcuaaaggaagccgagcuauuugguauauguggcuaggagcgcgauuuuuagaguucgaagcacucggauuucuaaacgaagaucacugguuuagccgggagaauaguuuaucaggaguagaaggagagggacugcauaaacucggauauauauugagagauguaagcaagaaggaaggcggcgcaauguacgcagaugauacagccgguugggauacacgaauaacguuagaagauuugaaaaacgaggaaauggugacaaaucauauggaaggagagcacaagaaacuggcagaagcgauauuuaaacuaacguaucaaaauaaaguaguacgaguacaaaggcccacuccgagagguacagucauggauaucauuaguagaagggaucaaagggguucaggacaaguaguaacauauggacuaaauacguuuacuaauauggaggcucaguugauacgccaaauggaaggcgaggguguguuuaaaaguauacaacagcuaaccgucacugaagaaaucgcgguaaagaauuggcuaguacgagugggacgugaaagacucaguagaauggccauaucaggugacgauuguguagugaaaccacuugacgaccguuuugcgagugcuuuaaccgcuuuaaaugauaugggcaaaguaagaaaagacauucaacaaugggaaccaucucggggauggaaugauuggacccagguaccauucugcucgcaucacuuucaugagcuaauuaugaaggaugguagaguauuaguuguaccauguaggaaccaagacgaguugauaggacgcgcaagaauuagucaaggagcggguuggucucuacgcgaaacugcuugcuuggguaaaaguuaugcccaaauguggagccugauguacuuccauagacgagauuuacgucuagcagcaaacgcaauauguagcgcaguaccaagccacuggguacccacaucacggaccacaugguccauccaugccacacacgaauggaugacgacagaagacauguugacuguauggaauagagucuggauucaagaaaacccuuggauggaagauaagacccuaguggaauccugggaagaaauuccauaucuuggaaaacgugaagaucaguggugcggaucguugauuggacuaacaagucgugcuacgugggccaaaaauauccaaacagcaauaaaucagguaagaucacuaaucggaaaugaagaauauacugauuacaugccaagcaugaaaagguucaggcgugaagaagaagaagccggagucuugugguga

SEQ ID NO: 22879 - RNA, 9876 nt, Artificial Sequence
  derived and/or modified CDS sequence (opt6) from DENV-2__JN851128__SS-prME
acagcugguauuauuauaaugaugauucccacuguuauggcuuuucauuuaacaacuagaaauggagaaccccacaugauugugucaagacaagaaaaaggcaaaucauugcuauuuaaaacugaaaauggcguaaauaugugcaccuugauggcgauggaccucggugaauugugcgaagauacaauuaccuacaauugcccauuacuaagacagaaugaaccggaagacaucgacugcugguguaauuccacaaguacaugggugacuuacggaaccugcacugcgacaggugaacauaggagagagaaaaggucaguggcgcugguaccgcauguggguaugggacuagaaacuaggacagaaacuuggaugagcuccgaaggcgccuggaaacacgcccagagaauugaaaccuggguguuaagacacccugguuuuacaauuauggcugcuauucuagcauauacuauaggcaccacauauuuccaaagaguacucauuuuuauauugcuuacagcaguagccccgucaaugacaaugagaugcauuggcauaaguaaucgagauuucguugaaggaguauccggugggucuuggguagacauagucuuagaacauggaagcugugugacaacuauggcgaaaaacaaaccuacccucgauuucgaacugaucaaaacagaagccaaucacccggcuacguuaagaaaauauugcaucgaagccaaacuuacaaacacuaccacagcaucacggugcccgacacaaggcgaaccgagccugagugaagaacaagauaaaagauucguauguaaacacuccauggucgacagaggauggggaaacgggugcggacuauucgguaaaggcggaauagucacaugugcaauguuuacauguaagaaaaauauggaaggaaaagucgugcaacccgaaaaccuagaauacaccauuguuaucacaccucauucaggagaggaaaaugcaguugguaaugacacuggaaaacaugguaaagaaauaaaaguaacaccucaaaguucuaucacugaggcagaacuaaccggguacggcacaguaaccauggaauguaguccacguacaggguuggacuucaaugaaaugguucuucuucaaauggaaaauaaagccugguugguucacaggcaaugguuccuagauuuaccacuacccugguugccuggagcagauacgcaaggcucuaauuggauacagaaagagacucugguaacguucaaaaauccacaugcgaagaaacaggaugugguaguauuagguagccaggaaggcgccaugcauacggcacuuaccggugccacugagauacaaaugucuagcggaaauuuacuauuuacaggucaccuuaaauguagacugaggauggauaaacuacaacuaaaagggaugaguuauucaauguguacaggaaaauucaaaguaguuaaagaaaucgcugaaacacagcacgguacgauaguuauacgaguacaauaugaaggagauggaagucccuguaaaauaccauucgaaauaauggacuuagagaaaagacaugugcuaggacgauugauaacagugaauccaauagugacagagaaagauagucccgugaauauugaagcugaaccaccuuucggugauucauauauaauaauaggcguagaaccuggacaacuaaaacuaucuugguucaagaaaggaucgucaauagggcaaauguuugaaacaacuaugagaggagcgaaaagaauggcgauacuaggcgacacagcaugggacuuugguaguuuagggggcguuuuuacauccauugguaaagcccuucaccaaguauucggagccauauacggagcugcguucuccgguguuaguuggaccaugaaaauauuaauuggaguagugaucaccuggauugguaugaacucgagaucaacaagucuauccgugagccuaguguugguaggugugguaacauuauaucugggcguaaugguccaagcugacucagggugcguuguaucauggaaaaacaaagaacuuaagugcgguagcggaauuuucauuacagauaauguacauacauggacggaacaguauaaauuucaaccagaaucacccaguaaauuagcgagugccauacaaaaagcacaugaagaagggauaugugguauuagaagugugacaagauuagaaaaucuaauguggaaacaaauaacaccugaacuaaaucacauacuuucugagaacgaaguaaaauuaacaauuaugacaggcgacauuaaaggcauaaugcaggccggaaaacguucucuuagaccgcaaccaacagagcuaaaauacucuuggaaagcaugggggaaagcuaagaugcuuagcacagaauuacacaaccauacauuucucauagaugggccugagacugcugaauguccaaacacaaaucgagcuuggaauagccuagaaguagaagauuacggauuugggguguucacuacaaaccuguggcuaaaacuuaaagaacgacaagacguauuuugugacucaaagcucaugagugcagcaauaaaggauaacagagcaguacaugcagacauggguuauuggauugagucagcaaucaacgauacauggaaaauagaaaaagccaguuuuaucgaggucaaaagcugucauuggccaaagucacauacacuauggucaaacgggguauuagaaucggagaugauaauuccgaaaaacuuugccggaccgguaucgcaacauaauuacagaccagguuaccauacucagacugccgguccauggcauuuaggaagguuggaaauggauuuugacuuuugcgaagguacaacgguuguagucaccgaggacugcggaaacagaggacccuccuuacgaacuacaaccgcaagugggaaacucauaacugaguggugcugccggaguuguacccuaccaccccugagauacaggggugaagacggcugcugguaugguauggaaauucgaccucuaaaagaaaaggaagaaaaccuagucaacagucuaguaacagcaggacacggccaaauugacaauuuuucacuuggcguauuaggcauggcguuauuucucgaagaaaugcuaaggacccgagucggaacgaaacaugcuauucuuuuaguagcaguuucuuuugucacacuuauuaccggcaauaugucuuuccgagaccuagggaggguuaugguuaugguaggggcuaccaugaccgaugacauuggaaugggagucacuuaucuagcucuuuuggcagcauuuaaaguaaggccuacguuugcagcuggauuacuacuaagaaaauuaacaucaaaagaauuaaugaugacuacaauagguauaguccuucuaucacaaaguaccauaccggagacaauacuugaauugacagacgcacuagccuuaggaaugaugauccucaaaauuguacgcaauauggaaaaauaucaacuagcuguaacaaucauggcuauuuuguguguuccgaacgcuguaauacuacaaaaugcuuggaaggucucauguacgacucuugccgucguaucuguaucacccuuauuauuaacaucgucacaacaaaaggcugauuggauaccgcuagcucuaacuauaaaagguuuaaaucccaccgcaauuuuucuaacaacguuaagcagaacaaguaagaaaaggaguuggccacuaaaugaagcaaucauggcuguagguaugguuagcauccuugccucaagccuccugaaaaaugacauuccgaugacaggaccccuaguggcugguggccuccuuacuguauguuacguccucacaggaagaagugcugaucucgaauuagaaagagcagccgauguacggugggaagaacaagcugagauaagugggucaucuccuauccuaagcauaaccauaagcgaagacgguucaaugucaauuaaaaaugaggaggaggaacagacacuaacuauacuuaucaggacuggacucuuaguaauuagugggcuuuuccccguaaguauuccaauaaccgcagcggccugguacuuaugggaagucaagaaacaaagggcuggcguccuaugggacgugcccucgcccccaccgguagggaaagccgaauuagaagauggagccuauagaauaaaacaaaaaggaauacuaggauauucgcaaauuggugcaggcgucuauaaagagggaacauuucauacgauguggcaugugacuagaggugcaguacuaaugcacaaagguaaacgaauagaaccuucaugggcagacgugaagaaagaucugaucagcuaugggggcggauggaaacucgagggggaauggaaagaaggagaggaggugcaagugcuggcuuuagaaccagguaaaaauccccgugcuguacaaacuaaaccuggacucuucaagaccaauacggggacuaucggagcagucagcuuagacuuuucaccggggacaaguggaucaccuauuguugauaagaaagguaaaguaguugggcuauauggaaacgggguaguuacuagaucagguacuuauguuucugcuauagcccaaacagagaaaaguauagaagauaacccagaaauagaggaugacauauuccguaaaaagagauuaacuaucauggauuuacauccaggagcagggaaaaccaagagguaccuuccggcuaucgucagagaagcaauaaaacguggacuaagaacacugauuuuggcuccuacaagaguaguggcggccgaaauggaagaggcguuaagaggauuaccaauaagauaccagacaccagcaaucagagcugagcacacagguagagagauaguugacuuaaugugccaugcaacauuuacuaugcgccuucuuaguccaauaagaguuccuaacuauaauuugauuauaauggaugaagcucacuucaccgaucccgcaucuaucgcggcucgcgguuauauaucgacaagaguagaaaugggggaagcugccgguauuuucaugacagcaacucccccaggaagcagagacccguuuccccaaucaaacgcgcccauuauggaugaggaaagagaaauccccgaaaggaguuggaacucuggucaugaaugggucaccgauuuuaaagguaaaacggucugguucguacccuccauaaaagcggggaacgauauugcagcguguuuaagaaagaauggcaagaaaguuauccaacuaucaaggaaaacuuuugacagugaauauauuaaaacccgaacuaaugauugggauuuugugguaacaacggauauuagcgagaugggcgcuaacuucaaggcugaaagaguuaucgacccaagacgaugcaugaaaccugucauacuaacugauggugaagaaaggguuaucuuggcgggacccaugccgguaacccauagcagcgccgcacagagacguggaagaguaggacgcaacccuaaaaaugaaaacgaucaauauaucuauaugggcgagccacuugaaaacgaugaagauugugcucauuggaaggaagcuaaaauguuacuugacaauaucaacacaccagagggaauaauaccgucaauguucgaaccggaaagagagaagguagaugcaauugauggugaauauagacucagaggagaggcaaggaaaacauuuguagaucuaaugagacgcggcgaucuuccuguuuggcuagcuuaucggguggcggccgaagguauuaauuacgccgaucgcagaugguguuuugacggagucaaaaauaaucagauccucgaagaaaacguggagguagagauauggacuaaagaaggagaacgaaagaaauuaaagccucgauggcuugacgcaagaaucuauucggacccacucgcucuaaaagaauuuaaagaauuugcggcuggccgaaaaucuuuaacauuaaaucuaauaaccgaaauggggagacuaccaacauucaugacacaaaaagcacgaaacgcucuggauaaccucgcuguucuacauacugcagaggccgguggacgugcuuauaaucaugcucuuagcgaacuaccggaaaccuuagaaacccuauuacuccugacacuauuggcuacuguaacagggggaauauucuuauuccuaaugucaggaaaggguauaggaaaaaugacuuuagguaugugcugcauaauaacagcuucaauacuucuuugguaugcucagauccagccucauuggauagcggccaguauaauuuuagaguucuuucugauuguacuauuaauaccagaaccugaaaagcagcgaacgccacaagauaaucaauuaacauacguaguuauagcgauacucacagucguagccgcaaccauggcgaaugaaaugggguucuuagagaaaacuaagaaggacuucggauuaggcuccauuaccacacaacaaccggaaagcaacaucuuagauaucgaucuaagaccugccagcgccuggacauuauaugcagucgcgacuacauuuauuacaccuaugcucagacacaguaucgaaaacucaagcgucaacguuucuuugacagcaauagcaaaucaagcaacuguacuaaugggcuuagguaaaggauggccacuuucgaaaauggauauaggcguaccucucuuggcaauaggauguuauagucagguaaacccaaucacauuaacagcagcauuguuacuauuaguagcgcauuacgccauuauuggcccagguuuacaagcgaaagcaacaagagaagcgcaaaaacgugcagcugcagggaucaugaagaacccaaccguagacggaauaacuguuauugaucuugaucccauuccuuaugauccaaaguuugaaaagcaguuaggccaagugauguuacuuguacuaugugucacccaaguguuaaugaugcggacaacuugggcacuuugcgaagcacugacuuuagcaacuggucccauuucaacauuaugggaaggcaacccaggucgcuucuggaauacaaccauagcaguuucaauggccaacauuuuccgagggagcuacuuagccggugcagguuuauuauucucuauaaugaagaauacggcaaacacgcgacgagguacgggaaacacaggugagacucuuggagaaaaauggaaaaauagauugaaugcucucggaaaaucagaauuucaaauauacaagaaauccggaauacaagagguggaccgaacuuuggccaaagaaggaauaaaaagaggagaaacugaccaccaugcaguaaguagaggaagugcgaaauuacgcugguuuguagaaagaaaccuagugacccccgagggaaaggugguugauuuaggcugugggagaggcgguuggucuuauuacuguggaggucugaaaaaugucaaagaaguaaagggcuugacgaagggcgguccaggccacgaggaacccauaccuaugucuacuuacggguggaaucucguucgacuacaaucgggaguggacguauucuucacuccuccagaaaaaugugacacucuacuaugugacauaggggaaucaaguccaaauccaaccgucgaagccggcagaacacucagaguccuaaaucuuguagaaaauuggcuaaauaacaauacgcaguucugcauaaagguguugaauccguauaugccuucaguuauagagaaaauggaagcccuucagagaaaguaugguggagcacuuguucgaaacccguuaucuaggaauaguacacaugaaauguacuggguaucuaacgccucaggaaacauaguuucauccguaaauaugauaucuaggauguuaauaaacagguucaccaugcggcauaagaaagcuacauaugagccggacguggaccuuggaagugguacacgcaauauaggcauagaaagcgaaacaccuaacuuggauauaauagggaagaggauagagaaaauaaaacaggagcaugagacuagcuggcacuaugaucaggaucauccuuacaaaacaugggcauaucacggaaguuaugaaacaaagcaaacaggaagugcaagcaguaugguaaauggugucguacgauugcuaacuaaaccaugggauauaauuccaaugguaacgcagauggcgaugaccgauaccacgccauuuggucaacaacguguauuuaaagaaaaggucgauacuagaacgcaagaacccaaagaggguacuaagaaauugaugaaaaucacagccgaguggcuuuggaaagagcuagguaagaagaaaacgccuagaauguguacacgagaagaguuuacaagaaaaguuaggaguaacgccgcauugggagcuauauucacagacgaaaacaaauggaaaucagcacgcgaagcaguagaagauagugguuucugggaacuggucgacaaagaacgaaauuuacaucuugaagggaagugugagacauguguauauaacaugaugggaaagagagagaagaaacuaggugaauuuggaaaagcgaaaggaucuagagcgauuugguauauguggcuaggagcucgcuuuuuagaguucgaggcacugggguuucugaaugaagaucauugguucaguagagagaacucucucaguggaguugagggugaaggccugcauaaacuuggguacauauuacgagaugugagcaagaaagaagggggagcuauguaugcagacgacaccgccggaugggauacuaggauuacacuugaagauuugaagaacgaggagaugguuacgaaccauauggaaggagagcauaagaaauuagccgaggcuauauuuaagcugacauaccagaauaaaguuguucgcguccaacguccaacuccaagaggaacuguuauggacauaauaucucguagagaccaaagaggaucaggacaaguaguuacauacgggcucaauacauuuacgaauauggaagcacaauuaauacgacaaauggaaggagaggguguauucaaauccauacagcaacuaaccguaacagaagagauagcagucaaaaauuggcucgugcgggugggaagagaaagauuaagucgaauggccaucucaggugaugacugugucgucaagccuuuagacgauagguucgcgucagcccuaacggcgcuaaaugacaugggcaaaguaagaaaagauauucaacaaugggagccauccagagguuggaaugauuggacccaaguuccauucugcucucaucacuuucaugaauuaaucaugaaagauggaagagucuuggucguuccuugcagaaaucaagaugaauugauagguagagcuagaauaagccaaggcgcugggugguccuuacgggagacagcuugcuuaggcaagucauacgcccagauguggagccugauguacuuucaccggagagaccuuagguuggcugcaaaugcaauauguagugcaguaccaagccauuggguaccgacuucgcguacuacauggucuauucaugccacccacgaauggaugacgacugaagauaugcuaacuguguggaaucgaguguggauucaggaaaauccuuggauggaggauaaaaccuuggucgaaucaugggaagaaaucccauauuugggaaaaagggaggaccaauggugcgguucucuaauuggucuaacuagccgggcuacuugggcgaaaaacauacagacugcaaucaaccaagucaggucauuaauuggaaacgaagaguacacugacuacaugcccucaaugaaacguuuccgaagagaagaagaagaagccgguguccuaugguaa

SEQ ID NO: 22880 - RNA, 9876 nt, Artificial Sequence
  derived and/or modified CDS sequence (opt6) from DENV-2__JN851130__SS-prME
acggcagguauaauaauaaugaugaucccaacgguaauggcauuucauuuaacgacacgaaauggcgaaccucacaugauagugucacgccaagaaaaaggcaaaucauuauuguucaaaaccgaaaacggcguuaacauguguacauuaauggcaauggaccugggagaacuuugugaagacaccauaacauauaauuguccuuuauugcgacagaacgaaccggaagacauugacugcugguguaacagcaccagcacuuggguuacauauggaacuuguaccgcaacaggggaacaccggcgcgagaaaagaucaguggcccuaguaccacacguuggaaugggucuagaaacaagaacagaaacauggaugagcagcgaaggagcauggaaacaugcacaaaggauagaaacgugggugcuacgacacccggguuuuacgaucauggcagcuauuuuagcauacacgauaggaacaacauauuuucagagagugcuaauauuuaucuuacuuacagcaguagcaccgaguaugacgaugcgguguauaggaauauccaauagagacuuuguagaaggaguuaguggaggcucauggguggauauagucuuagaacacgguuccuguguuacaacuauggcuaaaaauaaaccaacacucgauuucgaacuuauaaaaaccgaagcaaaacacccagcuacucuaagaaaauacuguauagaagccaaauuaacaaauacgacgacagccagcagauguccaacacaaggagaaccgucguugaaugaagaacaagauaaaagauucgucuguaaacauucgaugguagauagagguugggguaacgguuguggccuguuuggaaaagggggaauuguuaccugcgcaauguuuacauguaagaaaaauauggaagguaaaauugugcaaccugaaaaucucgaguacacaauugucaucaccccucauucuggugaagaaaaugcaguagguaaugacacaggcaaacauggcaaagagaucaaaguaacaccucaaucaucaauuacagaagccgaauuaaccgguuaugguacggugacaauggaaugcucgccuaggacgggauuggacuucaaugaaaugguucuccugcagauggaaaauaaggcuugguugguucacagacagugguuccuagaccuaccacucccuugguugccuggagcagauacacaaggaucuaauuggauacaaaaagaaacucugguaacauuuaagaauccacacgcgaagaagcaagauguaguuguauuaggaucgcaggaaggagcgaugcauacagcccuaacaggcgcaacggaaauacaaaugucaucuggaaaucuauuguuuacuggacaucugaaauguagauugaggauggacaaguuacaguugaaagguauguccuauagcauguguacugggaaauuuaaaguaguuaaggaaaucgcagaaacucaacaugguaccauagucauaaggguacaauacgagggugacggaaguccguguaagauuccauucgaaauaauggauuuagagaaaagacauguacuggggcgacugaucacaguaaauccaauagugacagaaaaagauagccccgucaauaucgaagcagaaccaccauucggagacaguuauauuauaauugguguugaaccaggacaguuaaaacuaucgugguuuaaaaaggguuccuccauuggacaaauguuugagacaacgaugcgaggugccaagaggauggcaaucuuaggugacacugccugggacuuugggagcuuaggaggaguuuucacguccauagggaaagcauugcaccagguuuuuggagccauauacggagcugcauuuucugguguaucauggacuaugaaaauucugauaggagucguaauuacauggauaggaaugaauagcaggagcaccucuuugucugugagcuugguacuuguaggaguaguaacccuauaccuagguguaaugguacaagccgacucagguugugucgucagcuggaaaaauaaagagcugaaaugugguucugguauuuuuaucacagauaacgugcacacguggaccgagcaauauaaguuucaacccgaaagcccuucgaaacuugcgucagcaauacaaaaggcgcaugaggaagguaucugcggaauuaggaguguuacgagacuagagaacuuaauguggaaacaaauuacaccggaacuuaaucacauucucucagaaaacgaaguaaaacuaacaaucaugacaggagacauuaaagggauaaugcaggcuggaaaaaggucauugaggccucaacccacugagcuaaaauacaguuggaaaacauggggaaaagcuaaaaugcuuucuacugaacuacacaaccauaccuuuuugauagacggaccugaaacugcagaguguccaaauaccaauagagcuuggaacucgcuagaaguagaagacuacgguuucggaguauucaccacgaauauaugguuaaaacucaaagagagacaagauguguuuugugauaguaaauuaaugagugcugcuauuaaagacaauagagcaguacacgcagacaugggauacuggauugaaagcgcccuaaacgauacauggaaaauagaaaaggccagcuuuauagaaguuaaaaguuguuacuggccuaaaucccauacacuauggucaaauggaguauuagaaucagagaugauuauacccaaaaacuuugccggucccgugagucaacauaacuacaggccaggauaccauacccaaaccgcagggccguggcaccucggaagacucgagauggauuucgauuucugcgaagguacaacaguggugguaaccgaagauugugggaacagaggccccucacuaagaacaacuacggccucugggaaguuaauuaccgaauggugcugccguucauguacucuaccaccucuucgauacagaggagaggauggauguugguacggaauggagauuagaccacuuaaagagaaggaggaaaauuuaguuaauuccuuaguaacugcaggccauggucaaaucgauaauuuuagucuaggggucuuagggauggcccuauuucuggaagaaaugcuuaggacucgaguagguacaaaacacgcaauucuauuaguugcuguuucuuuuguuacucugauuacgggcaauaugagcuuuagagaucuugguaggguaaugguaaugguuggcgcaacuaugacugaugacauugggaugggggucacuuauuuggccuuauuagcagcuuuuaaaguuaggcccacauucgcagcaggauuauugcuaagaaaguuaacgucuaaggaacucaugaugacaaccauugguauaguccuucuaucccagucgacaaucccggaaacgaucuuagaauuaacagaugcccuggcguuagggaugauggcuuugaaaaucguuagaaauauggaaaaauaccagcuagccguaaccauaauggcaauauuauguguuccuaaugcggucauacuacagaaugcguggaaggucucuugcacuacccuagcaguuguuagcgucaguccacuacuguugacaaguagucaacaaaaagcugauuggaucccguuggcauuaacuauaaaaggacuaaacccaaccgccauuuucuugacuacauuaucaagaacaucuaagaaaagaucuuggccacuaaaugaagcaauaauggcuguaggaaugguguccauuuuagccagcagccuauugaagaacgacauacccaugacugguccgcuggucgcuggaggacuguuaacaguguguuauguuuugacagggaggagcgccgaucuagagcuggagcgagcugcagaugucagaugggaagaacaagcugaaauaaguggcucuaguccaauacuuucgauaacaauaucugaagacggcucaaugucaaucaaaaaugaagaagaggaacaaacauuaaccaucuuaauccguacugggcuccuaguuauaaguggauuguuuccuguuucuauaccaauaacugcggccgcaugguacuuaugggaaguaaagaaacaaagagcgggagugcuuugggaugucccuuccccaccaccaguaggaaaagccgaacuagaagauggcgcguauaggauaaaacagaagggcauauuaggauacagucaaauuggagcugguguauauaaggaaggcacuuuucauacaauguggcacguaacacggggcgcuguauugaugcauaaggguaaacguauugaaccauccugggccgaugucaagaaagaccuaauuaguuacggaggagguuggaaacuggagggcgaauggaaggaaggagaagaaguucaaguucuggcccuagaaccugguaagaaucccagagccgugcaaacaaaaccaggcuuauucaagacaaacacagggacaaucggugcuguaucacuugauuuuagucccggcaccucaggaagcccuauugucgacaagaaaggaaaaguaguuggccuguauggaaauggggucguaacuaggucuggaacauauguaucggcaaucgcgcaaacggaaaagucuauugaagauaacccagagauugaggacgauauauuuaggaagaaaagacuaacaauuauggauuugcacccaggagcagggaaaaccaaacgcuaucuuccagcgauagugagggaagcgauaaaaaggggacuaagaacacuaauauuggcuccaacuagagucguagccgcagaaauggaggaggcuuuaaggggcuuaccaauaagauaucaaacuccggcuauucgggcugaacauacggggagagaaauaguugaucuaaugugccaugcuacuuuuacaaugagacuauuaucgccaauaaggguacccaacuacaaccuaauaauuauggaugaagcucauuuuacggacccggccaguaucgcugccaggggauacauuucaacgagaguugaaaugggcgaagcagcaggcaucuucaugacagcaaccccacccggcagcagagacccguuuccucaaucaaaugccccaauuauggacgaggaacgggaaauuccugaaaggucauggaauagcggacacgaguggguuacggauuucaaagguaaaacaguuugguuugucccguccauaaaagccggcaaugacauagcggccugccuacguaaaaaugguaaaaagguaauccaauuaagccgcaaaacauucgacagcgaguauauaaaaacacgaacuaaugacugggacuuugucguaacgacagacauaucagaaaugggagcaaacuucaaagcggaacgaguuaucgacccucggcguuguaugaaaccagugauacuuacagauggagaggaaagaguaauccucgcggggccuaugcccguuacucauucauccgcggcacaacggcgggguaggguugggcguaaccccaaaaaugaaaacgaucaguauauauacaugggugagccccuagaaaaugacgaagauugugcucauuggaaagaggcuaaaauguuacuagauaacauuaauacccccgaaggaauuauaccaaguauguuugaacccgaacgcgagaaaguagaugcuauagauggggaguauagacuccgaggagaagcucgaaaaacauuuguugacuugaugaggagaggagauuugccuguaugguuggccuaucguguagcugcagaagguauaaauuacgccgaccgacgaugguguuuugacggcguaaagaauaaucagauccuugaagaaaauguugagguagagaucuggacuaaagaaggugaaaggaagaaacucaaaccacgauggcuugaugcuagaauauacagugauccauuagcauuaaaggaguuuaaagaauuugcagcagggagaaaaucucuaacguuaaaccuaauaacugaaaugggaagauuaccaacguucaugacccaaaaggcacggaaugcacuugacaaucuugcaguuuugcacacugcugaagccggugguagagcuuauaaucaugcauuaagcgaauuaccagagacacuagaaacacuccugcuuuuaacauuauuagcuaccguaacgggaggaauauuccuuuuccugaugucuggaaaaggcauuggaaaaaugacgcuaggcaugugcugcauuauaacugcgucaauccuccuuugguacgcacagauccaaccucacuggauagcagcaucaauaauucuggaauuuuucuugaucguccuguugauuccagaaccagaaaagcaacggaccccacaggauaaccaauuaacauaugugguaauagcuaucuugacuguuguggccgcgacgauggcuaacgaaaugggguuucuagagaaaaccaaaaaggauuucgggcuagggucgauuacaacccagcaaccggaaagcaauauccuugacauagaucuuagaccugcgagcgccuggacacuuuaugcuguugcuacaacuuuuauaacaccuauguugaggcauucgauagaaaauucaagugucaacguauccuuaaccgcuauagcaaaucaagcaacgguacuuaugggauuggguaaagguuggccauugucgaaaauggauauaggcguaccgcuauuagcaaucggauguuacucucaaguaaaucccauaacacucacugcagcgcuguuacuuuugguggcacauuaugcaauaauagggccaggauugcaagcaaaagcgacaagggaggcccagaaacgugcugcggcuggaauuaugaaaaauccaaccguagacggcauaaccguaauugaccuagauccaauaccguaugauccuaaguucgaaaaacaacuaggccaaguaaugcuucuagucuuauguguaacgcaaguauuaaugaugcguacgacaugggcacuaugugaagccuuaaccuuagcaacaggaccaauuaguacucuuugggaagguaauccaggaagauuuuggaauacgacuauagccguaaguauggcaaacauuuucagaggaaguuaucuggcaggagcgggucuacucuucucaauaaugaaaaacacggccaauacaagaaggggcacaggcaauacgggcgaaacgcucggagagaaguggaagaaccguuuaaaugcacuagggaaaucagaguuccaaauauacaagaaaagcgggauccaagaaguagaucgcacacucgcuaaagaagggauuaaaagaggggaaacggaccaucaugcaguuagcagggggagcgcaaaauuacgcugguucguggaacguaacuuagugaccccagaaggaaaagucguagaucuagguugcggccgggguggguggaguuacuacugcggagggcuuaaaaauguaaaagaaguaaaaggacuaacuaaggguggaccaggccaugaagaaccaauaccaaugaguaccuacgguuggaaccuaguuagauuacaaaguggaguagauguauuuuucacaccgccggaaaaaugugauacuuugcuuugcgauauuggcgaaaguucaccuaacccaacuguggaggccggaaggacauuaagagucuuaaacuuaguugaaaacuggcuaaacaacaacacacaguuuuguauaaagguauuaaacccauacaugccuagcguaaucgagaaaauggaagcucuacaaagaaaauacggcggagcgcuuguucggaauccucugagcagaaauucaacucaugaaauguacugggucagcaaugcaagcggaaacauaguaagcagugugaauaugauaagucguaugcuaauaaauagguucacuaugaggcacaagaaggcaacuuacgaaccugauguggauuuagggagugguacucgcaauauaggaaucgaaagugaaauuccuaaucuugauauaauagguaagcguaucgagaaaauuaagcaagaacaugaaacguccuggcacuacgaucaggaucauccguauaaaacaugggcauaccacggaagcuaugagacaaaacaaacaggcucugcaagcucaauggucaauggggugguacgcuuacucacgaaaccaugggacguaauucccauggugacccaaauggcgaugacagauacaacucccuuuggucaacaaagaguguucaaagagaaaguagauacacgaacacaagaaccaaaagagggcacgaagaaauuaaugaaaauaacugcagaguggcuuuggaaggaacuagguaaaaagaagacaccccgaauguguacaagagaagaguuuacucgaaagguaagaaguaacgcagcccuaggagcuauauucacggaugaaaacaaguggaaaucugcccgugaagccguggaggauaguggauuuugggaauuaguagacaaagaacguaaucuucaucuagagggaaaaugcgaaacgugcguauacaauaugaugggaaaacgggagaagaaacuaggugaguucgguaaggcaaagggaaguagagccaucugguacauguggcuaggcgcaagguuuuuagaguucgaggcuuugggauuucugaacgaagaucacugguucucacgggaaaauaguuugucuggaguagagggagagggauuacacaaauugggauauauuuugcgggauguuucgaagaaagaagguggcgcaauguaugcagacgacacagcggguugggauacaagaauaacccuagaagaucuaaagaacgaggagaugguaacuaaccauauggaaggggaacauaagaaacucgcagaagcaauauuuaaacucaccuaccaaaauaaaguaguuaggguacagagaccaacaccgagaggaaccguaauggauauuauuagcagacgagaucaaagaggaagcgggcagguaguaacuuauggccucaauacuuucacaaauauggaagcucaguuaauacgucaaauggagggagaaggcguuuuuaaaucuauacagcaacuaacagugacagaagaaauagcugucaaaaauugguuaguacguguugguagagaacgacugagccguauggccaucuccggagacgacugugucguuaaaccuuuagacgaccgcuuugccucugcucuaaccgcccuaaacgauauggggaagguacgcaaagauauucagcaaugggaaccuagcagagguuggaaugauuggacucaaguacccuucuguucacaccauuuucaugaauuaauaaugaaagacggaagaguucuuguaguucccuguagaaaucaggaugaacugauuggacgagcaagaaucucacaaggugccggcuggucgcuuagagaaaccgccugcuuagggaaaagcuacgcucaaauguggagcuuaauguauuuucaccgucgcgaucuaagauuggccgccaaugcuauaugcagugcgguaccaucccacuggguaccaaccaguagaacaacauggucgauacacgcaacgcaugaguggaugacuacagaagauaugcuaacaguguggaaccgugucuggauacaggaaaaucccuggauggaagauaaaacaccgguagagucuugggaggaaauaccauauuuagguaaaagggaagaucaguggugugguucauugauaggauuaacuucaagagcuacuugggcuaaaaauauucaaacagcaauaaaucaaguaagaucauugauagguaacgaagaauauacugauuauaugccauccaugaagagguuccgaagagaagaagaagaagccgguguauuaugguaa

SEQ ID NO: 22881 - RNA, 9876 nt, Artificial Sequence
  derived and/or modified CDS sequence (opt6) from DENV-2__JN851125__SS-prME
acggcagggauaauuauaaugaugauacccacaguuauggcguuccaucucacgacgagaaauggggaaccacauaugauaguaucacgucaagaaaaagggaaaucauuauuauucaaaaccgaaaaugggguaaauaugugcacauuaauggccauggacuuaggggaacuuugugaagauacaaucacauacaauuguccacuccugaaacaaaaugaaccagaagacauugacuguuggugcaacucaacaaguaccuggguaacguauggaaccugcacagcaacaggagaacauaggagagaaaaacgaucuguagcauuaguaccccacguagguaugggauuagaaacacgaacugaaaccuggaugucgucagaaggagcguggaaacaugcacagaggauugaaaccuggguuuuaagacauccaggcuucacuguaauggcagcuauauuagcauauacgauuggaacgacauauuuucaaagaguacuuaucuuuaucuuauuaacugcuguagcaccaaguaugacgaugagauguauugguauauccaaucgcgauuuuguagaaggagucaguggaggcucauggguagacaucguucuugaacaugguaguugcgugacaacgauggccaaaaauaaaccuaccuuagacuucgaacuaauaaaaacugaagcgaaacaccccgcuacucucagaaaauacugcauugaagcgaaacuuacuaauacaacuaccgcuucacgguguccgacacagggcgaacccagucuuaacgaagaacaagauaaaagauuuguuugcaaacacucuaugguagauagaggaugggguaacggauguggccuauuuggcaaaggagggauaguaacaugugcaauguucacuuguaagaaaaauauggaagggaaaguagugcagccggaaaaccuagaauacacgauagucauaacuccacauaguggggaagaaaaugcgguggggaaugacacagggaaacauggaaaagaaauaaaaguaacaccacaaagcaguaucacggaggccgaacuuacagguuaugguacugucacgauggaguguagcccacgaacagggcuggacuuuaaugaaaugguucuauugcaaauggagaauaaagcauggcucguacauagacaaugguuuuuagaccuuccgcucccguggcuaccaggagcugauacccaagguucgaacuggauucaaaaagaaacuuuggugacuuuuaaaaauccacaugccaagaaacaggacgugguuguacucggcagucaggaaggagcuaugcauaccgcuuuaacaggugcuaccgaaauacaaaugucaucagggaaccuauuauuuacaggucauuuaaaaugucggcuaagaauggacaaauuacagcuaaaagguaugucauacaguaugugcacaggcaaauuuaaaguuguuaaagagauagcugaaacgcagcaugguacuauugugauaaggguucaauaugaaggugauggaucgccguguaaaauuccuuucgaaauaauggauuuagaaaaacggcauguccuuggacgacuaaucacgguaaauccaauaguaacggagaaagacucucccgugaauauugaagcagagccaccauucggggauucauauauaaucauuggaguggaaccaggccaacugaaacucucaugguucaagaaaggaaguagcauuggucagauguucgaaacaaccaugagaggagcaaaacguauggcuauauuaggagacacugcuugggacuuugguucccuagguggugucuucacaucuauugguaaagcucuccaccaaguuuucggagccauauacggagcugccuucucaggggucagcuggaccaugaaaauacuaaucgguguaguaaucaccuggauuggaaugaacucucguaguacaucgcuaucgguaucccuaguacucgucggcguagucacgcuguaucuuggaguuaugguccaagcagacucaggaugugugguuaguuggaaaaacaaagaauugaaauguggaaguggaauuuuuauaacagauaacguacauacuuggacagaacaauauaaauuucagccugaaaguccgaguaaacuugcuucugccauucaaaaagcacacgaagaaggcauuuguggaaucagaucugugacaagauuagagaauuuaauguggaaacagauaacaccagaauuaaaccacauuuugucagaaaacgaaguaaaaaugacaauaaugacaggagacauuaaagguauuaugcaagcagguaaacggucgcuaagaccgcaaccaacggaauuaaaauacucauggaaggcuugggguaaagcgaaaaugcuuucaaccgaauugcacaaucauaccuuuuugauugauggaccagaaaccgcagaauguccaaauaccaacagagcauggaacucucuggaaguagaagauuacggauucggcguuuuuacuacaaauauaugguuaaaacuuaaagaaaggcaagaugugagcugcgauucgaaacuaaugucugccgcaaucaaagauaacagagcaguucaugccgacaugggcuacuggauugaaucagcuuuaaaugauaccuggaagaucgaaaaagcgucauucauagaaguaaaaucaugucauuggccaaaaagucauacucuguggagcaacggcgugcucgaaagugaaaugauaauuccgaaaaauuuugccgguccaguaagucaacauaauuacagaccuggauaucacacccagacagcugguccauggcaucuagggagauuagaaauggacuucgauuucugugaaggcacuacuguagugguaacugaagauugugguaacagaggcccgucucuaagaacaacgacagcuuccgguaaauuaaucacagagugguguugucggucauguacuuuacccccauugcgguacagaggagaagacggauguugguauggaauggaaauacgacccuuaaaagaaaaagaagagaauuugguaaauagccuaguaacugcaggucauggacaaauagacaacuuuagucuaggcguccuaggaauggcucuauuuuuagaagagauguuaaggacuagaguuggaacaaaacaugcaauacuuuuaguagcagucucuuuugucacuuuaauaacugguaauaugucauuucgcgaucuaggucgggucaugguaaugguaggugcaacuaugacagacgauauaggcaugggagugaccuaucuugcccucuuagccgcuuucaagguaagaccaacguuugcagcuggcuuguuacuaagaaaacuaacuuccaaagaacuaaugaugaccaccauuggaauaguuuuauuaucccaauccacaauuccggaaacuauacuagaacuuacagacgcucuugcauuagggaugauggugcuaaaaguagucagaaauauggaaaaauaucaacucgcuguuacaauaauggcaauacuauguguaccaaacgcuguuaucuugcaaaaugcuuggaagguauccugcacuacucuagcagucguuucugucuuuccucuacuauuaacaucaucccaacagaaagccgauuggauaccuuuagcccugacuaucaagggauuaaacccaacugccauauuccucacaacuuuaagucgaacaagcaagaaaaggagcuggccucucaaugaggcgauaauggcuguuggaaugguaucaauucuagcgucaucucugcugaaaaacgacauaccaaugacuggaccuuuaguagccgguggacuguugacugucugcuacguacuaacagggcgcucugcagaccuagaacuagaacgagcggcagacguucguugggaagaacaagcagaaaucagcggaucaaguccuauccuaucgaucacuauaucggaagauggguccaugucaauaaagaaugaagaggaagaacaaacacuuacaauacucauacgaacaggguugcuuguaauuucuggucuauuuccuguuucaauaccaauaacggcagcagcaugguauuuaugggaagucaagaaacaaagggccggcguccugugggacguaccuucaccuccuccaguagggaaagcagagcuagaagacggugcuuaucguauaaaacaaaaagggauccuuggcuacagucaaaucggugcuggcgucuauaaagaaggcacuuuucauaccauguggcacgugacaagaggugccguacuaaugcauaaagguaaaagaauugagcccagcugggcagacgucaagaaagaucuuaucucuuauggaggaggcuggaaguuagaaggugaauggaaagaaggcgaagagguccaaguucuugccuuagaaccagguaagaacccucgggcaguacaaacaaaaccgggucucuucaagacaaauacaggaacuauaggugcaguuucauuggauuuuucaccuggaacaucagggucuccaauaguggauaagaaaggaaaagugguuggucucuacggaaacggcgucgucacuagaucagggacguauguaucugcaauugcacaaaccgaaaaaucaauugaagacaacccagaaauugaggaugacauauuucgaaagaaaagauugacuauuauggauuuacauccuggagccggaaaaacuaaacguuaccuaccagcgauaguacgagaggcaauuaaacguggccuacgaacgcuaauccuagcccccacgcggguaguagcugccgagauggaagaagcauuaagaggacuacccauaagauaucaaaccccugcuauacgagcugaacacacugggcgcgaaauuguugauuugaugugccaugcgacauuuacgaugcgauuauuaucaccuauacggguaccgaacuacaaucuuauaauaauggacgaagcacauuuuacagacccagcuucaauugcagcucgagguuacauaucaacacguguagaaaugggagaagcggccgggauauucaugacggcuacaccucccgguaguagagaucccuuuccgcaaucuaaugcaccaaucauggacgaagaacgagaaauuccugaacgauccuggaacucuggacaugagugggugacugauuucaaaggaaagacaguaugguuugugccaagcauuaaagccggaaaugauauagcagcauguuuacguaaaaaugggaagaaagucauacaauuaucaagaaaaacauucgauucggaauacauuaaaacacguacaaaugacugggacuuugucguuaccacugauauaagcgaaaugggagcgaauuucaaagcugaacgaguaauugauccacggcgcugcaugaaaccuguaauccuuacugauggagaagaacgagucauccuggcaggaccaaugcccguaacucacucauccgcagcgcagcgaagaggacguguaggccgaaauccuaagaaugaaagcgaccaauacauuuauaugggggagccacuugaaaacgaugaagacugcgcgcauuggaaggaagcuaaaaugcuauuggauaauauuaauacgccagaggguauaauaccuucaauguuugaaccagaaagagaaaaaguagacgcaaucgauggcgaauacagauuacgaggagaagcaagaaaaaccuuugucgaucuaaugagaagaggagauuuacccgucugguuagcauacagaguugcggcugaagguauuaacuacgcagacagacguuggugcuucgacggugucaagaauaaucagauauuagaggagaacguugaaguugaaauuuggacuaaagagggugaaagaaagaaacuaaaaccacggugguuggaugcgagaaucuacuccgauccauuagcauuaaaagaguucaaggaguucgcagcuggaaggaaaucauuaacacuuaaucuaaucacggaaaugggaagacuccccacauucaugacacaaaaggccagaaaugcacuugacaauuuagccguacuacauaccgcggaagccgguggucgagcuuacaaucaugcacuuucagaguuaccugaaacguuggaaacuuuacuguuacuaacauuacuagcgaccguaacuggaggcaucuuccuguuccuuaugucugguaaagguauugggaaaaugacgcucgggaugugcuguaucauuacugcaagcauacuauuaugguaugcccaaauacaaccccacuggauagcagcgagcauaauacuggaguucuuccugauugucuuacuaauaccagaaccugaaaaacagcgcacaccucaagauaaucaauugacguaugugguaauagcaauuuuaacgguaguagcugcuaccauggcaaaugaaauggguuuucucgagaaaaccaagaaagauuuuggcuugggaucuaguacuacccaacaacacgaaaguaacauucuugacauagauuuaagaccugcuagcgcuuggacgcuauaugcuguggccacaacauucauuaccccuauguuaagacauagcauagaaaauucaagcgugaauguuagccucacggccauagcaaaccaagcuaccguuuugaugggucuagguaaaggguggccgcucaguaagauggauauaggagucccacugcucgcuauagguuguuacucgcaaguaaauccaauaacccuaacagcagcuuuauuaucgcuggucgcacauuacgccauaaucggucccggccugcaggccaaagcaacaagggaagcucaaaaacgagcagcagccggaauuaugaagaaucccacaguugacgguauaacuguaaucgaucuagauccuauaccuuaugaccccaaauucgaaaagcaauuaggucagguaauguuauugguccuauguguaacacaaguauugaugaugagaacaacuugggcuuuaugcgaagcauugacguuggcaacggguccaauaucgacucuuugggaagguaacccaggaagguucuggaacacaaccauagcggucuccauggcuaacaucuuccgagggucauacuuagccggagccggauuauuauucaguauaaugaagaacacugcaaacacacggagagggacuggaaacaccggcgaaacauugggugaaaaauggaaaaauaggcuuaacgcacugggcaaaagcgaguuccaaauuuauaagaaaucgggcauucaggaaguugauagaacauuagcuaaagaggguaucaagagaggagaaacugaucaucaugcaguaucuagaggaucagcgaaauuacggugguuuguugaacgcaaucuaguaacuccagaggggaaaguaguagacuuaggcugcgguagaggugguuggaguuauuauuguggaggguuaaagaauguuaaagaaguaaaagguuugaccaaaggagguccaggucacgaagaaccuauaccuaugucaacguacgguuggaacuuaguaagauuacagagcggaguagaugucuuuuucacaccgcccgaaaaaugcgauacauuauuaugugacaucggugaaucaucgccaaauccuacgguugaagccggccgaacccuacgcguacuaaauuuggucgaaaacugguuaaacaauaauacucaauucugcaucaaaguacuuaacccauacaugcccaguguaauugagaaaauggaagcauugcagcguaaauauggaggggcucuagugcguaacccuuuaucuagaaacagcacccaugagauguacuggguguccaaugcaucagggaacaucguuucuucggucaacaugauuucgcguauguuaauaaacagguuuaccaugagacauaagaaagcaaccuacgaaccagaugucgauuuggggucggguaccagaaauauaggaauagaaagugagacaccuaauuuagacauuauugggaaaagaauugaaaagauaaaacaagaacacgaaacaaguuggcauuacgaccaggaccaccccuacaaaacgugggcuuaucauggcucauacgaaacaaaacagaccggcuccgcgagcaguauggucaauggcguaguaagauuacuuacuaaaccaugggauguaauuccgaugguaacccagauggccaugaccgacacuacaccuuucggacaacaacgcgucuucaaagagaaaguugacacacgaacucaagaaccuaaggaaggcacgaagaaacucaugaaaauaacagcagagugguuauggaaggagcuagguaagaagaaaacaccccgaauguguacacgagaggaguuuacacgaaaaguacgauccaaugcagcccuuggugccaucuucacagaugaaaauaaauggaagagugcgagggaggcuguugaagacucuggauuuugggaacucguugauaaagaacguaaccuccaucuugaagggaagugcgagacgugcguguauaauaugauggguaagagagagaagaaauuaggagaguucggaaaagcgaaaggcucaagggcuauuugguauauguggcuuggugcuagauuucuugaguucgaagcguuaggauuuuugaaugaggaucacugguuuucgcgugaaaacucacucaguggcguagaaggcgaaggacuacacaaacuaggcuacauauuaagggauguaaguaagaaagaagggggagcuauguaugcugacgauacggcugguugggacacgagaaucacacuugaagaccugaagaaugaggaaauggucacaaaccauauggagggagaacauaagaaauuagcagaagcuauuuucaaacuuacauaucaaaauaaaguagugagaguccagcgaccaacaccucgugguaccguuauggacauuauaaguagacgugaccagcgcggaucuggccaaguuguuaccuacggacuaaacacauuuacgaauauggaagcucaauuaauucgacaaauggaaggugaaggggucuuuaaaucuauccaacaauugacagccacagaagaaauagccgucaaaaauugguuaguuaggguagguagagaaagauugucgaggauggcuauaucgggagaugauuguguggugaagcccuuagaugauagauuugccagugcauuaacugcacucaacgacaugggcaagguacguaaagacauacaacagugggagccuucaagaggguggaacgauuggacucagguacccuuuugcagucaccauuuucacgaacuuauuaugaaagaugguagaguccuaguugucccaugcaggaaucaggaugagcuaauugguagagcacggaucucccagggugccgguuggagucugagagaaacagcuuguuuaggaaaaucuuaugcucagauguggucguugauguacuuucacaggagggauuugagauuagcggcaaaugcaauauguucagcuguaccaucccacuggguacccaccucacggacgacguggaguauacacgccacucaugaguggaugacaacggaggacauguuaacaguauggaaccgagucuggauacaagagaauccuuggauggaagauaaaacaccaguagagagcugggaagaaauucccuauuugggaaaacgagaggaccaauggugcggcaguuuaauagguuugacaagcagagcuacaugggcaaagaacauccaaaccgcuauaaaucaagugaggucacuuauaggaaaugaggaauacacagauuacaugccaaguaugaaacgguuccgucgugaagaagaagaggcaggcgugcuuugguaa

SEQ ID NO: 22882 - RNA, 9876 nt, Artificial Sequence
  derived and/or modified CDS sequence (opt6) from DENV-2__JN851123__SS-prME
acagcagggaucaucauuaugaugauacccaccguaauggcauuucauuuaacuacuagaaauggagaaccgcacaugaucguaucccgucaagaaaaaggaaaaucucuucuguuuaaaaccgaaaacggcguaaauauguguacuuuaauggcgauggaucucggcgaacuaugugaagauacaauaacuuauaauuguccacuacuaaaacaaaaugaaccggaagauauugauugcuggugcaacaguacgucgacauggguaacauacgggacuuguacagcaacgggugaacaccguagagagaaaagaucaguagcauuaguuccucaugucggaaugggauuagaaacacgaaccgaaacguggaugagcuccgaaggugccuggaaacaugcucaaagaauagagacguggguucuccgccauccuggcuucacaauuauggcagcuauauuggcauauacgauagggacgacauauuuccaacgagugcuaauauucauauuauuaacugcaguagcuccaucaaugacaaugagauguauuggcauuuccaaccgugacuucguagaaggaguuagcggagggaguuggguagauauaguuuuggaacauggaaguuguguaacaacgauggcuaaaaacaaaccaacucuggauuuugaguugauaaaaacugaagcaaaacauccugcuacacuaaggaaauacuguauagaagcaaaauuaacaaauacaaccacagcaucgcggugucccacacagggugaaccaucacuaaaugaggaacaagacaaacgcuucguguguaaacauucuaugguagauaggggauggggaaauggaugcggauuguucggaaaaggagggauuguaacaugugccauguuuacauguaagaaaaauauggaaggaaagauuguccagccagaaaaucuugaauacacaaucguaauaacaccacacuccggagaagaaaaugcuguagggaacgauacaggcaaacacggaaaagaaauaaaagucaccccucaaaguucuauaacagaagcugaguuaacugguuauggaacuguuacuauggaauguucaccaaggacgggccucgacuucaacgaaaugguauuacuucagauggaaaauaaagccugguuaguucacaggcagugguuucuagacuugccguuaccaugguugccgggagcggauacacaagguaguaacuggauccaaaaagagacauuagucacauuuaaaaacccgcaugccaagaaacaagauguaguaguccugggcucccaggagggugcaaugcauacugcguugacgggagcgacagagauccaaaugucuucaggaaacuugcucuuuacagggcacuuaaaauguagauuaagaauggauaaacuacagcuaaaaggaaugucauacucaaugugcacaggaaaauuuaaaguugugaaagaaauagcugaaacccaacaugguacuaucguaaucagagugcaauaugagggagaugguuccccaugcaaaauaccuuuugaaauaauggauuuagagaaaagacauguguugggacguuugauuacuguuaauccaauaguaacagagaaagauaguccuguaaauauugaagcagagccaccguuuggagauagcuauaucauuauagggguagagccaggccaauugaaauuaucuugguucaagaaagguagcaguauaggacagauguuugagaccacaaugcgaggcgcaaaaagaauggccauuuuaggggauaccgcaugggacuuugguagccuaggagguguuuuuacuucaauagggaaagcacugcaucaaguauucggggcgaucuacggugcggcauucagcgguguaucauggacuaugaaaaucuuaauuggaguagugauaacguggaucggaaugaacucucggagcacuuccuugagcgucagucuaguguuggucgguguugugacccuauauuuggguguaaugguacaagcugauagcggaugcguugucucauggaaaaacaaagaauuaaagugcggaagcggaauuuucauaacggauaauguucauaccuggacagagcaguauaaauuccaaccggaaaguccuaguaaacucgcaucagccauacaaaaagcccaugaggaaggaauaugcggaauacggagcguaaccagauuagaaaacuuaauguggaaacaaauaacuccagagcuaaaucauaucuuaagugaaaacgaaaucaaauugacaauuaugacaggagauauaaaaggaauaaugcaagcagggaaaagaagucuaagaccgcagccuacggaauuaaaauacuccuggaaggcaugggggaaggcuaaaaugcucuccacugaacuccacaaucacacguuuuugauugaugguccugaaacggcagaauguccuaauacgaauagggcguggaacucgcuagagguugaagauuacgguuuuggaguuuuuacaacuaacauaugguuaaaguuaaaagaaagacaggacgucuuuugugacucgaaauugaugagcgcugcaauaaaagacaacagagcugugcaugcugauaugggauauuggaucgaauccgcauuaaaugauacguggaaaaucgaaaaagcaucguucaucgaaguaaaaucuugccacuggccaaaaucucacaccuuguggagcaauggaguauuagaaucugaaaugauaauuccgaaaaauuucgcuggacccgucagccagcauaacuauaggccaggcuaccauacacaaaccgcgggaccguggcauuuaggaagguuagaaauggauuucgauuuuugugaggguacgacgguaguuguuacagaagauuguggaaaucgaggcccguccuuaagaacaaccaccgcaucugguaaacucaucacagagugguguugcagguccuguacacuacccccuuugagguacaggggcgaagauggaugcugguaugguauggaaauucguccguuaaaagaaaaagaggagaauuugguaaacuccuuaguuaccgcgggacauggacaaauagacaauuuuagucugggcguauuggguauggcauuauuucuugaagaaaugcuacguacccgggucgguacaaaacacgcuauacugcugguggcugugucauuuguuacgcucauaacagguaacaugucuuuucgugaucuagggcggguaaugguuaugguuggugcuacgaugacagacgacaucggcaugggagugacauaucuugcacuucuagcagccuuuaaaguaaggccgaccuucgcagccggacuuuuguugcgcaaauuaaccucaaaagaacucaugaugacaacgauaggaaucguucuucuaucccaaaguacuauaccugagaccauacuugaacuaacugaugcauuagcacucggaaugaugguccuuaagauagugagaaacauggagaaguaucaguuagcagucacaauuauggcaauccuuugugucccgaacgcaguaauccugcaaaaugcauggaaaguuucuuguacaacgcucgcagucgugaguguuagccccuuguuacugaccucgagccaacagaaagcagauuggauuccccuugccuuaaccauaaaaggauuaaauccaacagcuauuuuccuaacgacgcuaagcagaacaaguaagaaacguagcuggcccuugaacgaggcuauuauggcugucggcaugguaaguauucucgccucaucguuauuaaagaaugacauuccaaugaccggcccccucgucgccgguggacuacuaaccgucugcuauguacucaccgggagaucagcagauuuagaacuagaacgagcagcggauguacguugggaagaacaagcggagauuucagguucgucaccaauuuuauccauaacuauaagugaagacggcagcaugucgauaaagaaugaagaagaagaacagacccucacaauacuaauuagaacaggccugcucgugauuucaggguuauucccagugucuauaccaaucacagcagcggcuugguauuuaugggaagugaagaagcagagggcuggaguuuugugggauguaccgagcccgcccccagugggcaaagcagaauuagaggacggagcguaccguauuaagcagaaagguauucucggguacucccagauaggcgcggggguauacaaagagggaacauuucacacaauguggcacguaacacgaggagcuguacuuaugcauaaagggaaacggauugagccaucaugggcggacgucaagaaagacuugauaucauacggcggcgguuggaaacuggagggcgaguggaaagaaggagaggaaguacaaguacuugcacuagaaccggggaagaacccacgugccgugcaaacuaaaccuggcuuauuuaaaacgaauacuggcacaauaggcgcaguaucauuagacuuuagccccgguacaagugguagcccuauaguugacaaaaagggaaaaguaguuggacuguaugguaacggaguagugacaagaucugguacauauguuucagcuauugcacaaaccgagaaaagcauagaagauaaccccgaaauagaggaugauauauucaggaagaaaagacucacaauaauggaucuacauccuggggcggggaaaacuaaaagguauuuaccagcuauaguuagggaggcaauuaaacguggauuaagaacccugauacuagccccuacgcguguuguugcagcugaaauggaagaagcucucagagggcuaccaauacgauaucaaacaccagcgauacgagcagaacauacaggcagagagaucguagauuugaugugucacgcgacguuuaccaugaggcuacuuaguccaaucagaguuccaaauuauaacuugaucauaauggacgaggcgcauuuuacugauccugcgucaauagcagcaagaggauacauaagcacaagagucgaaaugggagaagcagccgggauauuuaugaccgcgacaccgccaggcucuagggauccauuuccucaaucuaaugcuccuauaauggacgaagaacgugaaauuccggaaagaucauggaacucaggacacgaauggguaacugacuuuaaagggaaaacuguaugguucgucccaagcauaaaggcggggaaugacauugcagcauguuugaggaaaaaugguaagaaaguaauucagcuaucccgaaaaaccuuugacagcgaguauaucaaaacaaggacuaaugauugggauuucguagugacaaccgacauauccgaaaugggagccaauuuuaaagcagagagaguaauagacccaagacggugcaugaaaccagugauccugacugauggagaagaacgaguuauccuagcuggcccgaugccggucacccacucgucggccgcacaaaggaggggucgcguagguagaaaucccaaaaaugagaacgaccaauacauauacaugggagaaccgcuugaaaacgaugaagacugcgcgcacuggaaggaagccaaaauguugcuagauaacauaaauacacccgaaggaauuauaccauccauguuugagccugaacgagaaaaaguggaugcaauagacggagaauaucgacuaagaggggaagcaagaaaaacguuuguagauuuaaugcgcagaggagaucuaccuguaugguuagcauaucguguugcugcagaagguauaaauuacgcagauagaaggugguguuucgauggaguuaaaaauaaucaaauauuagaggaaaacguagagguagaaauauggacaaaagaaggagaaaggaagaaauuaaagcccagauggcuagaugcaagaauauauucagauccacuagcgcuuaaagaguucaaagaguuugcagccggcagaaagucccugaccuuaaacuuaaucaccgaaauggggaggcuacccacauuuaugacacaaaaagcgagaaaugccuuagacaauuuggccgugcuacauacagcggaagcgggaggucgagcuuauaaucacgcacuaagugaacuuccugaaacguuagaaacacugcuucuuuugacauuauuagcaacggugacaggagguauauuccuuuuucuaaugucaggaaaagggaucgggaaaaugacacuuggaauguguuguauaauaacggcuucgauacuauugugguaugcacaaauucaaccucauuggauagcugcaaguauuauccuggaguucuuucuaauuguuuugcuuauuccagaaccggaaaaacagagaacaccacaagacaaucaacuaaccuacguagugaucgcgauauuaacuguaguagcagccacaauggcuaaugagaugggauuucucgagaaaacuaagaaagauuuuggacuagguaguauaacaacucaacagccugaaucaaacauucuugauauugaccugaggccagcaucagccuggacucuauacgcaguagcgacaacuuuuauaacucccaugcucaggcauagcauagaaaauucaucugugaauguaagucuuacagcaauugcgaaucaagcuacaguucuaauggguuuaggaaaaggauggccucucuccaagauggauaucgguguuccauuauuagcuauaggaugcuauucacaggucaacccgauaacauuaacagcugcguuguuauuacuuguugcccacuacgccaucauagguccuggcuuacaggcgaaagcaacgagagaagcucagaaaagagcagccgcuggaauuaugaaaaauccaacuguugacggaauuacaguuauagauuuagaucccauacccuacgauccgaaauuugaaaaacaauuaggucagguaaugcuauuaguuuuauguguaacgcaagugcuaaugaugagaacaacgugggcacuaugcgaagcguuaacuuuagcuacaggaccaaucagcacacuaugggaagggaauccagguagguucuggaacaccaccauagcaguuaguauggccaauauuuuuagagggagcuaccuagcgggcgcuggacuccuguuuucgauaaugaaaaauaccgcgaacacaaggagagggacugggaauacgggagaaacauuaggcgaaaaguggaaaaaucgccuuaacgcgcuaggaaaauccgaauuucagauuuauaagaaaagcgguauccaagaaguugaucggacguuggccaaagaagguauaaaacgcggagaaacagaccaucacgcagugucacgagguagugccaaauugagaugguucauagagagaaauuuaguaacaccugaaggaaaaguaguagauuugggauguggacgaggaggcuggaguuacuacugcggaggacuuaaaaauguuaaagaagucaaaggucuaaccaagggugguccuggacaugaagaaccaauuccgaugucuacuuauggauggaaucuaguacgguugcaaucgggugucgacguauucuuuacgccgccagaaaaaugcgauacuuuauugugugauauuggugagucuaguccgaacccuaccguugaggcugggagaacauugaggguucucaaccugguggagaacugguuaaauaacaauacacaauuuuguaucaaaguacuaaauccuuauaugccaaguguuauugagaaaauggaggcuuuacaaagaaaauacggaggagcucuaguuagaaacccauuaucuaggaacaguacacaugaaauguauuggguuucuaacgcuucuggaaauauuguuaguucuguaaauaugauaucaagaauguuaauaaaccgauuuacuaugagacacaagaaagcaacguaugagccagauguggaccugggauccggaacacguaacauagguauugagagcgaaacuccaaaccuagauauaauagguaagcguauagaaaagauaaaacaagaacaugaaacgucauggcauuaugaccaagaucauccguacaaaacgugggccuaccaugggucauacgaaacuaaacagacaggcuccgcaucaucgauggucaacgguguggugcguuuacuaacaaaaccuugggaugucauuccgaugguuacccaaauggcaaugacggauaccacuccauucgggcaacaacgaguauucaaagaaaaggucgacacgagaacacaagagccaaaggaaggaaccaaaaagcuaaugaagaucacugcugaguggcuuuggaaagaacuagguaagaagaaaaccccgcguauguguacccgagaggaguucacacgaaaaguaagguccaacgcagccuuaggcgcuauauucacugacgaaaauaaauggaagucugcaagagaagcaguagaagauaguggauuuugggaacuuguggauaaagaaaggaaccuacaucuagagggcaaaugugaaacaugcgucuauaacaugaugggaaagagagagaagaaacuaggagaauuuggcaaagcaaaagguagucgagcaauuugguacauguggcuaggagcacguuuucuagaguucgaggcacuaggauuucuaaacgaagaccauugguucucaagagaaaauucacuuagugguguagaaggugagggacuccauaaauuaggauauauucuacgggaugugucgaagaaggaaggaggagcuauguaugcagacgacacggccgguugggauacuaggauaacauuagaagaccugaagaaugaagaaaugguaacaaaccauauggaaggcgaacauaagaaacuagcagaagccaucuucagacuaacauaucaaaauaaaguaguaagagugcaaagaccaacuccaagaggaacaguuauggacauaauuucaaggagagaucaaagggguucaggacaaguagugacuuacggauuaaauacauucacuaacauggaggcccaauuaauccgacaaauggaaggugaggguguauuuaaaaguauacaacaucucacgguaacugaagaaauagcugugaaaaacugguugguacgaguaggcagagaacgauuaucccgaauggcaauuaguggggaugauugcguaguaaaacccuuagaugaccgcuucgcaucagcuuuaacagcgcuaaaugauaugggaaagguacguaaagauauacaacaaugggagccgucacguggcuggaaugacuggacucaaguaccauucugcucgcaccauuuucaugaacuaauuaugaaagaugggagaguacuugucguaccaugccgaaaccaagaugaauugauugguagagcaaggauuucccaaggcgccggauggucgcugcgugaaacagccugcuugggaaaaucauacgcacagauguggagccuaauguauuuccaucggagagaucucagauuggccgcgaaugcaauuuguucagcugugccgagccacuggguaccgacaagucgaacuacauggagcauccaugccacucacgaguggaugaccacugaagauaugcugaccguauggaauagaguuuggauucaggaaaacccauggauggaggauaaaacuccaauugaaucuugggaagaaauaccauacuuaggaaaaagggaagaucaauggugcggaagucugauaggguuaacaucaagagcaacuugggcgaaaaacauacaaaccgccauaaaccaaguccgaucacuaauaggaaacgaagaguacaccgacuauaugccuucaaugaaaagauucagaagagaagaagaagaggcaggaguauugugguaa

SEQ ID NO: 22883 - RNA, 9876 nt, Artificial Sequence
  derived and/or modified CDS sequence (opt6) from DENV-2__JN851118__SS-prME
acagcggguauuauaauaaugaugauaccuacaguaauggcauuucaucuaacaacaagaaacggugaaccacacaugauuguuuccaggcaggaaaaaggaaaaagucuucuauucaaaaccgaaaauggagucaacauguguacccucauggcaauggacuuaggggaauugugugaagauacuauaaccuauaauuguccccuauuaagacaaaacgaaccugaagauauagacuguugguguaauagcacgucaacuuggguuacuuaugggaccugcaccgcuacgggagaacauaggcgggaaaaacgcucgguugcauuaguuccacacguaggaaugggacuagaaacccgaacugaaacguggaugagcucugaaggagcauggaaacacgcccaacgcauagaaacauggauauuaagacaccccggauucacuauaauggccgccauacuugcuuauacaauugguacaacauauuuccaacgaguucuaaucuuuauuuuacugacagcuguaacuccuucaauggcgaugagaugcauaggaauuucgaacagagauuuuguugaaggagugucagguggaaguuggguugauauaguuuuagaacaugguaguugcgucacuacgauggccaaaaacaaacccacgcuagacuuugaacugauaaaaacugaagcuaaacacccugcaacccuuagaaaauauugugucgaagccaaauuaacaaacaccaccacagccagcagaugcccaacccaaggugaacccucgcucaacgaagaacaagacaaacguuucguauguaaacauucuaugguugauagggggugggggaauggauguggcuuguucggcaaagguggaauaguaacuugugcuauguucacguguaagaaaaauauggaagggaaagucguccaaccugaaaaucucgaauauacaauaguaaucaccccacauaguggagaggaaaacgcagucggcaaugauaccgggaaacaugggaaggaaaucaaaguuacaccacaaaguucaaucacugaagccgaacuaacuggauauggaaccgucaccauggaauguucaccaagaacuggccucgauuuuaaugaaaugguuuuguuacaaauggaaaauaaagcauggcuuguacaccggcaaugguuuuuagauuugccauugccuuggcuaccuggugccgauacacagggaagcaacuggauucagaaagaaacacuugugaccuuuaagaauccacaugcuaaaaagcaggacguaguagugcuaggaucccaagaaggcgcaaugcacacagcucugacaggugcaacugaaauucaaaugagcagcggcaaccuacuauuuacaggucaccuaaagugcagacuaagaauggauaaacuucaguuaaaggguaugagcuacaguaugugcacaggcaaguucaaaguaguaaaggaaauagcggaaacacaacaugggacaaucguaauaagaguucaguacgaaggagauggcagcccauguaaaauuccuuuugaaauaauggaucuagagaaaagacauguguuaggacgacucauaacuguuaauccuaucguuacugagaaagauucgcccgucaauauagaggcagaaccuccguuuggagauaguuacaucauuaucgguguugaaccaggacaacuaaaauugucaugguucaagaaaggcaguucaauagggcaaauguucgagacuaccaugcgcggagcgaagaggauggccauucuuggugacacagcaugggauuuuggcagccuaggcggaguauucacuucaauuggaaaagcauuacaccagguguucggagcuauuuauggggcagcauuuucaggaguuucauggaccaugaagauacuuauaggagucguaauaacauggauuggcaugaacucgcguagcacaucucuaucaguuagcuuaguucuggucggaguaguaacuuuauaccugggagugaugguccaagcagacagugguugcguaguuucauggaagaacaaggaauuaaaaugugggaguggaauauuuauuacagacaacguacauacauggacagaacaguauaaauuucaaccggagucaccauccaaguuagcuagugcgauacaaaaagcucaugaagagggaauaugugguauucggucugucacucgacuagaaaaucucauguggaaacaaauuacgccagagcugaaccauauccucacagaaaacgaaguuaaacuuacgauuaugacaggugauaucaaaggaaucaugcaggcaggcaaacguucuuuacgaccacaaccgacugaauuaaaauacucuuggaaggcuugggggaaggcuaaaauguuaucuacggaacuacauaaccacacguuucugaucgacgggcccgaaacugccgaaugcccuaacaccaauagagcuuggaacagucuagagguagaagacuacggauucggaguuuuuacaacaaacauuuggcugaaauuaaaagaacgacaagauguguucugcgauuccaaauuaaugagcgcagcuauuaaagauaacagagcaguacacgcagacaugggauacuggauagaauccgcacuaaaugauacauggaaaauagaaaaagcuaguuuuauugagguaaaaaguugucauuggccaaaaucucauacauuauggagcaacggaguacuggagagcgagaugaucauaccuaaaaacuucgcgggcccugugucacaacauaacuaucgaccaggauaucauacccaaacagcaggcccguggcaccuuggaagacuagaaauggauuuugauuuuugugaaggcaccaccguuguaguaacagaagacugcggcaacagagggccgaguuuaagaacgacaaccgccagcgguaaguuaauaaccgaauggugcuguaggucaugcacacuaccaccccucagauacagaggcgaagauggauguugguacggaauggaaauuagaccauuaaaggagaaggaagagaaccuaguaaauagucuaguaaccgcuggacauggacagauugacaauuuuucucuaggaguacuugggauggcacuauuucuagaagagaugcuaagaacucgaguaggaacaaaacaugcaauauuauuaguagcuguaucauucguaaccuuaaucacugggaauaugagcuucagagauuuagggaggguaaugguaaugguaggcgcuacuaugaccgacgauauuggaaugggugugacuuacuuggcauuguuagcagcauuuaagguuagaccgacauuugcagcaggauuauuauuaagaaaauugacuuccaaggaacuuaugaugaccacgauaggaaucguauuauuaagccaaucaacaaucccugagagcauucuagagcucacugaugcucuggcacuagggaugaugguauuaaaaauagugagaaacauggaaaaguaccaauuagcuguaacaauaauggcaaucuugugcgucccgaaugcagugauacuacagaaugccuggaaagugaguuguacaacacucgcuguuguaaguguaaguccauuauuacuuaccucaagucaacaaaaagccgauuggaucccacuagcucucacuauaaaaggccucaauccaacugcgauauuccucacaacgcuaagucgcacaaguaagaaaaggucauggccccuuaacgaagcaauaauggcggucggaaugguaucaauucuagcaagcucucuucuaaagaacgauauaccgaugacugggcccuuaguugcgggaggacugcuaacaguguguuacgugcuuacuggaaggucugccgauuuagaacuggagcgagcagcggauguacgaugggaagaacaggcagaaauuagcggaaguagcccuauucugucaauaacuaucucagaagaugggaguaugagcaucaaaaacgaagaagaggaacaaacuuuaacaauucugauccggacgggucuacuugugauaaguggucuguuccccguaaguauuccaauaacagcugccgcaugguaccuaugggaagucaaaaagcaaagggccggugucuuaugggauguuccuucaccucccccagugggaaaagccgaacuugaagauggagcuuaucgaaucaagcagaaggguauacuagguuauagucaaaucggugccgguguauauaaagagggcacauuccauaccauguggcacgugaccaggggagccguacuuaugcauaaagggaaaagaauagaaccauccugggcagacguaaagaaagauuugauaucuuauggaggaggauggaaacuggaaggagaauggaaagaaggagaagaaguacagguucuggcgcuagagccaggaaagaacccucgggcagugcaaacaaagccuggccuuuucaaaacaaacaccggaacuaucggcgcgguuaguuuagacuucucuccugggaccagcgggaguccgauagucgacaagaaagguaagguaguaggacuauauggcaauggcguaguaacuagaagugguacuuauguaucugcaaucgcgcaaacagagaaaucgauagaagauaacccagaaaucgaagacgauaucuuccguaagaaaaggcuaacaauaauggaccuccauccgggcgccgggaaaacaaaacgauaccuuccggccauuguaagagaagccauuaaaaggggccugcggacucuaauauuagcaccaacgagaguuguagcggcagaaauggaggaagcauuacgcggacuucccauacgguaucaaacuccugcaauaagagccgaacauaccgguagagaaauaguagaucuaaugugucacgccacauuuacaaugcgccuucuuucccccauacgaguuccaaacuauaaucuaauuauuauggacgaggcacauuucacagauccggcaucaauugccgcucgcggauacauaucaacaagaguggaaaugggcgaagcagcugguaucuuuaugacugcgacaccuccaggcuccagagauccauuuccccaaaguaaugcgccaauaauggacgaggaacgugaaauaccggagcguucuuggaacucaggucacgaaugggucacagauuuuaagggcaaaacgguaugguuuguaccaucaauaaaggcaggaaaugacauugcagccugucuaaggaaaaaugguaaaaaggucauccaauuaagucgaaaaacuuucgauucugaguauauuaaaaccagaacaaaugacugggacuuuguaguaacuacugauauaucagaaaugggagccaauuucaaggccgagagaguaauagacccaagaagguguaugaaaccugugauauuaacagauggugaagaacgagugauucuagccggacccaugccuguuacgcauucuagcgcugcccaacgcagagggagagugggacgaaaucccaaaaaugaaaaugaucaguauauuuauaugggggaaccgcuugaaaacgaugaagauugugcgcacuggaaagaagcuaagaugcuacuugacaauauuaauacgccagaaggaauaaucccuaguauguuugagccggaacgcgaaaagguggaugcaaucgacggggaauacagacugcgaggggaagcccguaagacauuuguugaucuuaugaggaggggugauuuaccugugugguuagcauaccgaguggcugcugaagguaucaacuacgcugauagaagaugguguuuugacggaguuaaaaauaaccaaauuuuagaggagaauguagaaguugaaauauggacgaaggaaggugagcggaagaagcuaaaaccuagauggcuugaugcaaggauuuauucagauccacucgcucucaaagaguucaaagaauuugccgcaggccgaaaaucccuaacccuaaaccucauuacagagauggguagguuaccaacguuuaugacgcaaaaggcuaagaacgcacuagacaaucuagcaguacuucacacugcugaagcagggggcagagcguacaaucaugcucuaucagaauugccugaaacacucgaaacccugcuacuacuuacccuauuagccacagugacaggcgggauauuuuuauuuuuaaugucgggcaaaggaauaggaaaaaugacacuggguauguguuguaucauuaccgcuuccauacuguugugguaugcgcaaauucaaccucacuggauagcggccucaauaauauuagaguucuuccugauaguacuacuaauaccagaacccgaaaagcaaaggacuccucaagacaaucaauugacauacguagugaucgcaauccuuacugugguggcagcuacuauggcaaacgaaauggguuuccuugagaaaaccaaaaaggauuuuggauuaggaucaaucaccacacaacaaccagagaguaacauacuagauauagaccuuaggccagcaucagcauggacgcuauaugcgguggcaaccacguuuauuacaccuauguuacgucauuccauagagaauaguuccguaaauguaucucugacagccauugcaaaucaagccacuguucuaaugggacuaggaaagggauggccuuuaucaaaaauggacauaggcguuccuuuauuggccauuggguguuacucucagguuaauccaauaacguugaccgcugcauuauuacugcuaguugcacacuacgcaauaauaggacccggcuugcaagcaaaagcuaccagagaagcacaaaaacgggcugcagcuggcauaaugaaaaauccaacgguagaugggaugacagucauagauuuagauccaauuccguaugacccgaaauucgaaaaacaacuaggccaagucauguuacuggucuuaugugucacucaagucuuaaugaugcguacaacaugggcuuugugugaagcucuuacauuagccacaggaccuauaaguaccuugugggaggguaauccugguagguucuggaacaccacuauagcaguaucaauggcuaacauauuccgcgguagcuauuuggccggugcaggauuacucuucaguauaaugaagaauacggcaaacacacgcagagguaccgguaauacgggagaaacgcucggugaaaaguggaaaaauagacuaaacgcacugggaaaaucggaauuucaaauuuauaagaaauccgguauucaggaagucgacagaacccuagcaaaggaagguaucaaacgaggugaaacagaucaccacgcgguuuccagaggaucagcaaaauuacguugguuuguagaacguaaucuuguaaccccagaggguaagguugucgaccucggaugugguagagggggauggaguuauuacuguggaggcuugaaaaaugucaaagaaguaaaaggccuaacgaaagguggaccaggccaugaagaacccauacccaugagcaccuacggauggaaccuagucagacuccaaucgggaguagauguauucuuuacuccacccgagaaaugugauacuuuauuaugugacauaggugaauccucaccaaauccuaccguggaagcggggagaacucugcggguguuaaaucucgucgaaaauugguugaacaacaacacgcaauuuugcauaaaagucuugaacccauauaugcccaguguaauugagaaaauggaagccuuacaaagaaaguacgggggcgcgcuaguucgaaacccauuauccagaaauucuacacacgaaauguauugggugucgaacgccaguggcaauaucgucuccucugucaauaugauaucuaggaugcugauuaaucgguuuacuaugcgacauaagaaagccacuuaugaaccggacgucgauuuaggaagcggaacaaggaacauagggaucgagucagaaaccccgaacuuagacauaaucgguaaacguauagagaaaauuaaacaagaacacgaaacaagcuggcauuacgaucaagaccacccuuauaaaacgugggcguaucauggaucauaugaaacaaaacaaacagguuccgcuucuucaaugguuaaugggguuguuagacuguuaacaaagccgugggaugugauaccaaugguaacccaaauggcaaugacagauacuaccccauuuggacaacaaagggucuucaaagaaaaggucgauaccagaacucaagagccaaaagaaggaaccaagaaacuuaugaagauaacagcggaauggcuauggaaagaacuuggcaagaagaaaacaccaagaaugugcacccgagaggaguuuacccgaaaaguacgcuccaaugcagcgcucggagcuaucuuuacugaugaaaauaaauggaaaucugcaagagaggcgguugaagauucagguuucugggagcucguagacaaagaaagaaacuuacaucuagaaggcaaaugcgaaacgugcguguauaauaugaugggaaaacgggagaagaaacuaggcgaguuugggaaagccaaaggcagcagagccauuugguacauguggcuuggagcucgguuccucgaguucgaagcguugggcuuucugaaugaagaucacugguucaguagggaaaauagucugucagggguugaaggggagggccuacacaaacuaggauacauacuaagagacguaagcaaaaaggaagguggggcaauguacgcagacgauaccgcuggcugggauacucguauaacucuagaagaucuaaagaaugaggaaauggugacaaaucauauggaaggggaacacaagaaacuugcugaagcuauuuucaaacucaccuaucagaacaaaguaguaaggguccaacggccaacacccagaggaacuguuauggauauuauaagccgaagagaucaacguggaucaggucaaguaguaacauauggacuaaauacauuuaccaauauggaagcucaacuuauaagacaaauggaaggagaagguguauucaaguccauccaacaguuaacgguaaaagaagaaauugcuguaaagaacugguugauuagggucggaagagaacgacuaaguagaauggcgauauccggggaugauuguguuguuaaaccccuagacgauagauucgcgagugcacuaaccgcacuaaaugauauggguaaagugagaaaagacauucagcagugggaaccgucaagggguuggaaugauuggacgcagguuccauuuugcucacaucauuuucacgagcuaaucaugaaagaugguagaguacugguagucccgugucguaaucaagaugaacuaauaggucgcgcaagaaucagccaaggcgcaggauggucccuacgagaaacugcauguuuaggaaaaaguuaugcacaaauguggagcuuaauguacuuucaucgaagggaccucagauuagcagcgaacgcaauauguucggcuguuccuucgcauuggauaccaacuucaaggacgacauggucgauccaugcaacucaugaguggaugacgacugaagauauguugaccguauggaaucgaguauggauacaagaaaauccuuggauggaggacaaaacaccgguagagucuugggaggaaauacccuacuugggaaaacgugaagaccaauggugugggagcuugauuggacuaacaagucgcgccacaugggccaagaauauacaaacugccauaaaucaaguaagaaguuugauuggaaaugaagaauacacagauuauaugccauccaugaaacgauucagaagagaagaagaagaggcuggagucuuaugguga

SEQ ID NO: 22884 - RNA, 9876 nt, Artificial Sequence
  derived and/or modified CDS sequence (opt6) from DENV-2__JN851124__SS-prME
acugcugguauuauaaucaugaugauaccgacggucauggcauuccacuugacuacuagaaacggagaaccgcacaugauuguuagucgacaagaaaaaggaaaaucccuccuauuuaaaacugaaaacggugugaauauguguacauuaauggcaauggauuugggagaauuaugugaagacacaauaacauauaacuguccguuacuaaaacaaaacgaacccgaagauauagauuguuggugcaauagcaccuccacuuggguuacuuacgggaccuguacagcaacaggagaacacagaagagagaaaagaagugucgcguugguuccccauguaggaaugggauuagaaacaagaacagaaacauggaugaguagugaaggcgcguggaaacacgcacaaagaauugaaacuuggguaaugagacaccccggauucaccguaauggcagcuauacuugcauauacgauugguacaacauauuuccaaaggguucucauuuuuauccucuuaacagcaguagcaccaagcaugacuaugagaugcauuggaaucucuaauagagauuuuguagaagguguaucuggagguucauggguugauauugucuuggagcacggaucuugugugacaacuauggccaaaaacaaacccacgcucgauuuugaauuaaucaaaacagaagcgaaacacccugcaaccuugcgcaaauacuguaucgaagcaaaauugacuaacacuaccacagcaucccgaugcccaacucaaggagaaccuaguuuaaaugaagaacaagauaaaagauuuguuuguaaacauucaaugguagauagaggguggggaaacggaugcggacuuuuuggaaaaggaggaaucgugacgugugcaauguucacaugcaagaaaaauauggaaggaaaaguaguacaaccagaaaacuuagaauacacaaucgugauaacgccacauucuggcgaagaaaaugcaguagguaacgauacaggaaaacauggaaaagaaauuaaaguuacgccucaaucaucaaucacugaagcagaauugaccggcuacggaaccguuaccauggaauguucuccacgaacugggcuagacuuuaacgaaauggucuuacuacagauggaaaauaaagccuggcucguacauagacaaugguuucuggacuuaccccuuccguggcuaccuggagcugauacacaaggaucuaacuggauccagaaagaaacuuuagugacauuuaaaaauccacacgcuaagaaacaagaugucguuguuuugggcucacaggaaggugcaaugcacacugcacugacaggcgcaacagaaauucagaugucaaguggaaaccuacuauuuacagggcaccucaaauguagacuucguauggacaaacuccaauuaaaaggcaugaguuacaguaugugcacagguaaauucaaaguuguaaaagagaucgcagaaacacagcauggcacaauugucauaagagugcaauacgaaggagacggcuccccguguaaaauccccuucgagauaauggacuuggagaaaaggcauguauuaggcagacuuauuacuguaaaucccauaguuacugaaaaagacucuccaguuaacauagaagcagaaccacccuucggcgacagcuacauaaucauaggcgucgaaccaggacaauuaaaauugucgugguucaagaaaggcucaucuauaggucaaauguucgaaacaacaaugaggggugccaaacgaauggcaaucuugggugacacagcaugggacuuuggcagcuuaggagggguauucacuucuauuggaaaagcacuacaccaaguauuuggggcgauauacggggcggcauuuagcggggugagcuggacuaugaaaauucucauuggaguuguaauuacuuggaucggaaugaacucgcgguccaccucacucucuguaagucuaguuuuaguuggaguuguaaccuuauaucuuggggucaugguccaagcggacaguggauguguaguuuccuggaaaaauaaagaacugaaauguggcuccggaaucuuuauuacagacaauguucacacuuggacugaacaauauaaauuccaaccugagucaccaaguaaacuagccagugcuauacaaaaagcacaugaagaaggcauauguggaauccgaagugucacacgucuagagaaccucauguggaagcaaauaacaccagaacuuaaucacauccuuucagaaaacgaaguaaagaugacaauaaugacaggggauauaaaagguauaaugcaagcgggcaagcguucacuaagaccucagccaacagaguuaaaauauucauggaaagcauggggaaaagcuaaaaugcuaagcacggaauugcacaaccacacauuuuuaauagaugggcccgaaaccgcggaaugcccgaacacaaauagggccuggaacagucuugaaguagaagauuacggauucggagucuuuaccacaaauauauggcuuaagcuaaaggaacgccaagacgugaguugugacagcaaauuaaugagcgcagcgauuaaagauaauagggcuguccaugcagauaugggauauuggauagagucggcacucaaugauacuuggaagauagaaaaagcaucuuuuaucgagguuaagucuugccacuggcccaaaucacauacacuauggaguaaugggguguuagaaucggaaaugauaauacccaaaaacuuugcuggucccguuucucaacauaacuauagaccagguuaucauacccagaccgcaggaccguggcaccucggaagacuugaaauggauuucgauuucugcgagggaaccacaguuguuguaacugaagauugugguaauagaggaccaucuuuacgaacgacgaccgcuucuggaaaacugauaacugaauggugcugcagaucaugcacuuuaccuccauuaagauaucgaggagaggacgguuguugguaugguauggaaauacgcccccuaaaggaaaaagaggaaaaucuaguaaauagucugguaacugcgggacauggacagauagauaauuuuagcuuaggaguucucggaauggcacuauuuuuggaagaaauguugagaacacgcguagguacgaagcacgcaauauuguuaguugcugucucguuuguuaccuuaaucacaggaaacaugucauuucgugacuuggguagaguaaugguaauggucggugcaacaaugacagaugacaucggcaugggaguaaccuaucuagcacugcuggccgcauuuaagguucgcccgacuuuugcagcaggauuguuacuacgaaaacuaacaagcaaagaauuaaugaugaccacaauagguauaguucuauuaucucaaucaacaaucccagaaacaauauuggagcuuacagacgcucuagcauugggaaugaugguguuaaaaguaguaagaaacauggaaaaauaucaacuggcgguaacuauuauggcuauauuaugugucccgaacgcaguaauccuccaaaacgccuggaaaguuagcuguacaacuuuagcaguuguuucuguuagcccguuacuccuuaccucaucccaacaaaaggcugauuggaucccacuugccuuaacaauuaaagggcucaacccuaccgcaauauuuuuaacaacacucucaagaacaaguaagaaacgauccuggccucuaaacgaggcuaucauggcaguagguauggucucgauacuagcuucaucauuacugaaaaaugauauaccuaugaccgggccuuuagucgcugggggacuuuuaacaguaugcuauguuuuaacaggacgcucagccgaucucgaacuagaaagggcggcugauguacgcugggaagaacaagccgaaauaucugguucuucuccgauacuaaguauaacaauuagcgaggaugggagcaugagcauuaagaacgaagaagaagaacaaacuuuaaccauucuuauucgaacuggauugcucguuauuucagggcucuuuccagucaguauccccauaacagcagccgcuugguaucuuugggaagugaagaaacaacgggcaggcguccucugggaugucccuucuccaccaccaguugggaaagcugaauuagaggauggcgcauaucgaaucaaacaaaaaggaauauuggguuauagccagauaggcgcaggcguuuacaaggaaggaacuuuccauacuauguggcacgugacacggggugcgguauuaaugcauaaagggaaaaggauagaaccuagcugggcggaugugaagaaagauuuaaucaguuacggugguggauggaaauuagaaggugaauggaaagaaggagaagaaguacaaguacuggcgcuugaaccuggcaaaaauccccgggcuguccagacaaagccaggacucuucaaaacuaacaccggaacaaucggagcagucucauuagauuuuucaccaggaacgucugguucaccuauaguagauaagaaggguaaaguuguagggcuauauggcaacgguguaguaacuagaucuggaaccuacguaucagcaaucgcacagacugaaaaaucuauagaagauaauccggaaaucgaagaugauauauucagaaagaaacgccuaacaauaauggaccuccacccgggggcgggcaagacuaaacgauacuuacccgcaauaguuagagaagccaucaaacgagggcugcggacuuuaauauuagcgccgacucguguggucgcagcagagauggaagaagcauuacgcggauugccgauacgauaccagacaccggcaauuagagccgagcacacugggcgagaaauuguagaucucaugugccaugcuacguucacaaugcgccucuuauccccgauccgaguuccaaauuauaaucugauuaucauggaugaagcacacuuuacggauccugcaaguauagcggcgcggggguauaucaguacucgaguggaaaugggagaagcugcaggaauauucaugacagccaccccaccaggaucacgagauccauucccucaaaguaaugcaccaauuauggacgaagaacgagaaauaccagagcgaucguggaauagugggcaugaauggguaacugacuucaagggaaaaacugucugguuuguuccauccauaaaagcaggcaaugacauagcagccugccuaaggaaaaacggcaagaaaguaauacaauuaucgcguaaaaccuuugauucagaauacauuaaaacuagaacgaacgauugggauuuuguaguaaccacugauauaucagaaaugggagccaauuuuaaagcugaaagaguaauagacccgagacguuguaugaaaccagucauauugacugauggagaagagagagucauacuagcaggucccaugcccguaacucauucuagugcagcacaacgacgaggacgcguaggccggaaucccaaaaacgaaagugaucaauacauauauaugggagaaccccuggaaaacgacgaggauugugcacacuggaaagaagcaaaaaugcuacuagauaacaucaacacccccgaagguauaauuccuucuauguucgagccagaaagagaaaaagucgaugcaauugacggagaauacagauugagaggagaagcacgaaagacauuuguugaucuaaugagaagaggggauuuaccgguaugguuagcuuaccgagucgcagcagaagguaucaauuacgcugacaggcgcugguguuuugauggcgugaaaaauaaccagauauuagaggaaaauguagagguagaaauauggacaaaggagggagaacgcaagaaauuaaagccuagauggcucgaugcccgcauauauucugacccguuggcucuaaaagaauuuaaagaauuugccgcaggucgaaaaucucucacccugaaucugaucacagaaauggguaggcuccccacauuuaugacccaaaaggcgagaaaugcauuagacaauuuagcuguccuacauacugcagaagcuggcggacgagcguauaaucaugcauuaagcgagcuaccugaaacccuugaaacauuguuacuacuuacacuguuagcgacaguaacagguggaauauucuuauucuugaugagcggcaaaggaaucgguaaaaugacauuaggaaugugcugcaucauaacugcuucuauucugcuaugguaugcccaaauacaaccccauuggaucgcugcaaguauaauacuagaauuuuuccucauaguauugcuaaucccugaacccgagaagcaaagaacaccucaagacaaccagcuaacguacgucguuaucgcaaucuuaacuguaguagcugcaacaauggcaaaugagaugggcuuccuagagaaaacuaagaaagauuucgggcuaggaagcucaaccacacaacaacacgagaguaauauuuuggacauagacuugcguccagcaagcgcguggacucuauaugcgguggcgacaaccuucauuacaccuauguuaagacacagcauagaaaauucaagcguaaaugucagucucacggccauugccaaccaggcaacuguuuuaaugggcuuagggaaaggauggccacugaguaagauggauauaggcgugccucuacuggccaucggaugcuacucccaaguuaacccgauaacacucacugcugcacuccuaagccuagucgcccauuaugccaucauaggaccagguuuacaggcgaaggcaacuagagaagcacagaaaagagcggcugccgguaucaugaagaauccaaccguggacggaaucacgguaauagaccuagaucccauuccauaugauccuaaauuugaaaaacaacuaggacaagucaugcuauuaguacucugcguuacucagguacugaugaugcgaacuacaugggcucuaugcgaagccuuaacucuagcaaccggacccauaaguacacucugggagggcaaucccgguagauucuggaacacaaccauagcagucagcauggcaaauauauuucgcggaaguuaccucgccggggcgggacuguuguucuccauaaugaagaauacagcuaauacgcgccgaggaacaggcaauacuggugaaacucugggagaaaaauggaagaaucgacuaaacgcauuaggaaaaucggaguuccaaaucuacaagaaaucggggauccaggagguggaucggacccucgcaaaagaaggcauuaaacgaggcgaaacugaucaccaugccguaucaagagguagugcuaaauuaagaugguucguggaacguaaucuuguaacgccggaaggcaagguaguugaccuaggcuguggaaggggcgguuggucauauuauugcggcggccuaaagaauguuaaagaaguaaaagggcuaacaaaagguggaccuggucaugaggaaccaauccccaugagcacuuaugguuggaauuuaguuaggcuucaaucgggcguugauguauucuuuacgccaccagagaaaugugacacguuauuaugcgacaucggugaaucaucaccgaaucccacuguugaggcagggagaacuuuaagaguacugaauuuggucgagaauuggcuuaauaacaauacucaauucugcauaaaagugcuaaauccuuauaugccaaguguuaucgagaaaauggaagcacugcaacgcaaauacggaggugcguuaguuagaaauccacugagcagaaauucaacacacgagauguacugggucucaaacgcgagcggaaauaucguuucuuccgugaacaugauaucgaggaugcuaauaaacagauuuaccaugagacauaagaaaguaacuuacgaacccgacgucgaccuaggcagcggaacuagaaacaucggaaucgagagugaaacccccaacuuagacauaaucggaaagcguaucgaaaagauuaaacaggagcacgaaacgucuuggcauuaugaccaggaucaccccuauaaaaccugggcauaccauggcucguaugagacgaaacagacugguuccgcguccucgauggucaaugguguggucagacuuuuaacuaaaccaugggacguaauucccaugguuacucagauggcgaugacagacacaacaccauuuggucagcaaagaguauucaaggagaaaguagacacccgaacccaagagccuaaagaagggacuaagaaauuaaugaaaauuaccgccgaauggcuuuggaaagaacuuggcaagaagaaaacuccuagaaugugcacgagggaagaauuuacucgaaagguacgaagcaacgcugcucuuggugccauauucacagacgaaaacaaguggaaaagugcuagagaagcuguugaagauucagguuuuugggagcuaguggacaaggaacggaacuuacaucuagaggggaaaugcgaaacaugcguauauaauaugaugggaaaaagagagaagaaacuaggagaauuugguaaagcaaaaggaucccgcgcgaucugguauaugugguuaggagcaagauucuuagaguucgaagcauugggcuuuuuaaaugaagaccacugguuuucccgggaaaacagccucucuggcguagaaggugaaggguuacacaaguuggguuauauacuucgagauguaucuaaaaaggaaggaggagcuauguaugcagacgacaccgcaggaugggauacucgcaucacucuagaagauuuaaagaacgaagaaauggucacaaaccauauggaaggggaacacaagaaauuagcagaagccauauuuaagcuaacguaccaaaauaaaguuguacgaguccaaaggccaacaccaagaggaacuguaauggacauaauaucccgaagagaccaacgaggcuccggccaaguuguaacauacgguuugaauacuuuuaccaacauggaagcccaauuaauaaggcagauggaaggggaagguguauuuaagucgauacaacaacugacagcuacggaagaaauagcggucaaaaacuggcuuguaaggguuggaagagaacgacugucacgcauggcaauaagcggcgaugauuguguugucaaaccauuagaugacagauuugcgagugcguuaacagcucuaaaugauauggguaagguacgaaaagauauucaacaaugggagccaucaagagguuggaaugauuggacccagguuccuuucugcucacaccacuuucaugaauuaauaaugaaagauggacgaguacuugugguacccugucgaaaucaagaugaacuuaucgguagggcucggauuagucaaggggccgguuggucauugagggaaacagcauguuugggaaagagcuaugcccagauguggucauuaauguacuuccauagaagggacuuaaggcuagcggcuaacgcaauauguuccgcaguuccaucgcauuggguuccgacaagccgaacuacguggaguauacaugcuacacaugaauggaugacuaccgaggauaugcugacuguauggaaucgaguuuggauacaagaaaauccuuggauggaggauaagacaccuguagaguccugggaggaaaucccauacuuggguaaacgagaagaucaaugguguggaucucuaauaggauuaacaaguagggcaaccugggccaaaaacauacaaacagcaauaaaucaggucaggagcuuaaucggaaacgaagaauacacagauuauaugccuucuaugaaacgauuuagacgagaagaagaagaagccgguguguugugguaa

SEQ ID NO: 22885 - RNA, 9876 nt, Artificial Sequence
  derived and/or modified CDS sequence (opt6) from DENV-2__JN851114__SS-prME
acagcugggaucauaauaaugaugauacccacagugauggccuuucaccuaaccaccagaaauggagaaccucacaugauagucucaagacaagaaaaagggaaauccuuauuguucaaaacagaaaauggagucaauaugugcacucuuauggcuauggacuuaggagaauugugcgaagauacuauaacauacaauugcccucuauuaagacaaaacgaaccggaagauauagauuguuggugcaauagcacuucaaccuggguaacauauggcacauguaccgcaacaggcgaacacagacgcgaaaaacgaaguguggcucuuguuccucaugugggaaugggacuagaaacgcgaacugaaacauggaugucaagcgaaggagccuggaaacaugcacaaagaauagaaaccuggauucuaagacauccuggcuuuacaauaauggcggcuaucuuagcauauacaaucggaaccaccuauuuccaacgaguccuaauuuucaucuuguugacagcaguaacuccaagcauggcaaugagauguauuggcauuuccaacagagauuuugucgaaggaguuucuggaggcucguggguugauauaguacuagaacauggcaguuguguaaccacuauggcuaaaaauaaaccgacucuagacuuugaacuuauaaaaacugaagcaaaacaucccgccacuuuaagaaaauacugcgucgaagcaaaacuuacuaacacuacaacggcgaguagguguccaacccaaggugaaccuucccuuaaugaggagcaagacaaacgguucguuugcaaacacagcauggucgaccguggauggggcaaugguugcggguuauucggaaaaggggguauuguaaccugcgcaauguuuacaugcaagaaaaauauggaagguaaaguuguucaaccggaaaaucuagaauauaccauugugauuacaccacacaguggcgaagaaaaugccguaggaaacgauacuggaaaacacgguaaagaaauaaaaguuacuccucaaucaaguauaacagaagcugaacuaaccgguuacgguacuguaacuauggaauguaguccaagaacuggccuggauuuuaaugaaaugguuuuauugcaaauggaaaauaaagcgugguugguacaccggcaaugguuuuuagaucuuccauuaccuuggcuaccaggugcagacacgcaagguucaaauuggauccaaaaagaaacgcuaguaaccuucaaaaacccacaugcuaagaaacaggauguuguaguucugggaucacaagaaggagcgaugcacacagcacucacuggcgcaacugaaauacaaaugaguucuggcaaucuucuguuuaccgggcaucuaaaauguagacuacguauggauaaauuacagcucaaaggcaugucuuacucgaugugcacgggaaaauucaaaguuguaaaagagaucgccgagacucaacaugguacuaucguaauucgagugcaauaugaaggagacggcucgccaugcaaaauuccguucgaaauaauggaccuggagaaaagacauguccuagggcgauugauuacuguuaacccgaucgucacggaaaaagauaguccuguuaacauagaagcugaacccccguucggggauucuuauauaauuauagguguggagccuggacagcugaaacuaucaugguuuaagaaaggaaguucuauuggacagauguucgaaacaacgaugcgcggagcaaaaagaauggcuauccucggagacacugccugggacuucggcucuuuaggcggggucuuuacauccauagguaaagcacuucaucagguuuuuggcgcaauauacggagcagcguucucaggagucagcuggacuaugaaaauauuaauugguguggugauaaccuggauaggaaugaacucacgaaguacgagccugagcgugagccuaguauuagucgggguggucacucuguaccuggguguaaugguucaagcggacuccgguugcguaguaucauggaaaaacaaagaacuuaaauguggauccgguauauucauaacagacaauguacauacauggacagagcaguauaaauuccaaccugagucaccaucaaaacuagccagcgccauccaaaaagcacacgaagaaggaauuugcgguauccgaagcguuacgcgauuagagaacuugauguggaagcaaauuacgccugaacuuaaccauauucucacagagaacgaagugaaauuaaccauaaugaccggggauauuaagggaaucaugcaggcuggcaaacgaucucuacgaccacaaccaacggaauuaaaguacucguggaaggccuggggaaaagcuaaaaugcugucaaccgaacuacacaaucacacauuucuuauagaugggccggaaacggcagaaugcccaaauacuaacagagccuggaacucacuggaaguagaagauuaugguuucggcguauucacgaccaacaucuggcugaaacuuaaagagcgacaggacguguucugcgacagcaaacucaugucugcugcaauuaaagauaacagagcaguucaugcugacaugggauacuggauugaaagugcucuuaaugauacuuggaaaauugagaaggcaaguuucaucgaaguuaaaucuugucauuggccgaaaagccauacacuguggaguaacgguguccuggagucagagaugauuauaccgaaaaauuucgcggggccugucucccaacauaauuacagaccaggcuaccauacucaaacugcaggcccauggcaucuaggcagacuagaaauggacuuugauuuuugugaaggaacaacuguuguaguaacugaagauugcggaaaucgagggccuuccuuacgaacaacuacugcgucuggcaaguugaucacagagugguguugucgaaguugcacuuugcccccucuacgauacagaggugaggauggaugcugguauggaauggaaauaaggccacuuaaggaaaaagaagaaaaccuuguaaauagccuaguaacggcaggucacggucagauugacaauuuuucucuagguguauuaggcauggcuuuauuucuugaggaaaugcucagaacacgugucgguaccaaacacgcuauauuacuuguagcugugucauuuguaacauuaaucacgggaaacaugucguuuagggauuuagggaggguuaugguaaugguaggugcaacaaugacggaugacauagggauggggguuaccuacuuagcucuacuugcagcuuucaaagugcgaccaacauuugcagcugguuuauuauuaagaaaacuaacaaguaaagaauugaugaugacaacaaucgggauaguacuauugucacaguccacuauaccagaaaguauacucgaacuuacagaugcgcuagcacugggaaugaugguguugaagauagucagaaacauggaaaaguaccaacuugcggugacaauuauggcgauucuaugcguuccuaacgccgucauacuacaaaacgcauggaaaguuaguugcacaacucuugcuguaguaagugugaguccacugcuacuaacaaguagccagcaaaaagcagacuggauaccuuuagcacucacaaucaaaggguuaaauccaacugcuaucuuccucacaacgcuaagucgcacaaguaagaaacgaucuuggcccuugaacgaagcuauaauggccgucggaaugguuucaauauuagcguccagucuauuaaagaaugacauaccaaugacuggaccauuaguggcaggaggauuauuaacaguguguuacguauugacagguagauccgcagaucuagaacuagaacgagcggccgauguacggugggaagaacaggccgagauuagugggucaucuccuauauuaaguauaacaaucuccgaagacggaaguaugucuauuaagaaugaagaagaggaacaaacauuaaccaucuuaauacggaccggacuuuuaguaauaucagguuuauuuccaguaaguaucccgaucacugccgcagcaugguaucuuugggaaguuaagaaacaaagagcuggugugcuaugggaugucccuucucccccaccgguagagaaagcagaauuggaggauggagcauaccggauaaaacaaaaaggaauccuaggcuacagucaaauuggggcgggggucuauaaggaaggcacauuucacaccauguggcacguaacccguggagcaguuuuaaugcauaaggguaagcgaauugaaccuagcugggccgaugucaagaaagaucuaauuaguuacggcgggggauggaaacuagaaggagaauggaaagaaggcgaagaaguccaaguacuggcacuugagccagguaaaaauccucgagcaguucagacaaagccagggcuauucaaaaccaacaccggaaccauuggugcuguaucccuugacuuuucuccagggaccagcggauccccaauuguagauaaaaaggggaagguuguaggccuuuauggaaacgggguaguaaccagaagcggaacguaugucuccgcuaucgcacaaacggaaaagucuauagaggacaaccccgaaaucgaagacgauauuuucaggaagaaacgccugacaaucauggaccuacauccaggugcggguaaaacuaaaagauaccuacccgcaauagugcgagaagcaaucaaaaggggccuacgaacgcuuauauuagcaccgacccggguuguugcagcugaaauggaagaagcacuuagaggccuaccaaucagguaccagaccccugcaauaagagcagagcauaccggcagagaaauuguagauuugaugugccaugcaacguuuaccaugagacuccucagcccaaucagagugccaaacuauaaucuuauaauuauggaugaagcccacuuuacagacccagcgucgaucgcggccaggggauacauaagcacacgcguagaaaugggugaagcagcuggaauuuuuaugacagccacucccccagguucuagagauccuuucccgcaaagcaaugcuccuauaauggacgaggaacgggaaauaccagaacguuccuggaacucaggccaugaauggguaacagacuuuaaaggaaaaacaguaugguucguaccauccaucaaagcagguaacgauauugcagccugucuacguaaaaacggcaagaaaguaauccaauuaucgaggaaaacauucgauucugaauacauuaaaacucguacaaaugauugggauuucguagucacaaccgauauaucagaaaugggugcuaauuuuaaggcagagagaguaauagacccuagaagauguaugaagccuguaauccuaaccgacggagaagaaagggucauacucgccggaccgaugcccgucacgcacagcucagcugcgcaacgacgaggcagaguuggacgaaacccuaaaaaugaaaaugaucaguauauauauaugggagagccauuagaaaacgacgaagauugugcacauuggaaagaggcaaagauguugcuagacaacauuaauacaccagaaggaaucauaccuaguauguuugaaccggaaagagaaaaaguugaugcaaucgauggcgaguacaggcuccgaggggaggcgagaaagaccuuuguggauuuaaugcguagaggagauuuaccgguguggcuagcauauaggguagcagcugaggggaucaauuacgcggacagaaggugguguuucgacggcguaaagaauaaucaaauacuggaagaaaauguagaaguagaaauauggacaaaagaaggagaaaggaagaaauuaaaacccagauggcucgacgccaggauauacucagacccauuggcuuuaaaagaguuuaaagaguucgccgcaggccguaaaucauuaacauuaaauuugaucacagaaaugggacgccuaccuacauuuaugacucagaaagcuaagaaugcguuggauaaucuagcuguacuacauacagcggaagcugguggccgagcauauaaucaugcucugagugaauuaccagaaacauuagaaacauuauuauuauuaaccuuacuagcuacaguaacaggcgguauauucuuauuuuuaaugagugguaaaggcauagguaaaaugacacuagggaugugcuguauuauuacugcaaguauccucuuaugguacgcucaaauacaaccacauuggauagccgcuuccauuaucuuagaguucuuuuugauuguacuccugauaccggaaccagaaaaacaaagaacgccacaagauaaucaauuaacauacguuguaauagcgauauuaacggucguugcagcuacuauggcuaaugaaauggguuucuuagaaaagaccaagaaagauuuuggucucggaagcaucaccacgcaacagccagagucuaacauacuggauaucgauuuaagaccugcaagugcuuggacucuauacgcgguagcaacgacuuucauaacgccaauguuaagacacucgauugaaaauucaucaguaaaugugagccuuacagcaauugcuaaccaagcgaccguacuuaugggguuaggaaaggguuggccacucucaaaaauggauauuggagugccauuauuagcaauagguuguuacucccaagugaacccuaucacauugacugcugcuuuacuucuuuuaguagcccacuaugccaucauuggaccagggcuucaagcuaaagcuacaagagaagcgcagaaaagagcagcagcugguaucaugaaaaacccuacagucgauggaaugaccgugauagauuuggaucccauuccuuacgauccuaaauuugaaaagcaacuaggucaagucauguuauuaguucugugcguuacgcaaguacucaugaugcgaacaacuugggcuuugugcgaagcccucacauuagcuacuggaccaauaagcacgcuuugggaaggaaacccaggacguuucuggaauacaacgauagcaguuucuauggcgaacauuuuuagaggaagcuauuuagcuggcgcaggacuacuauuuucaauaaugaaaaauacagccaauacccgaaggggaacagguaauacaggagaaacguuaggugagaaauggaaaaacagacuuaaugcauuaggcaaaucugaauuucaaaucuacaagaaaucaggcauucaggaaguggaucggacgcucgccaaagaagguaucaagagaggggaaacagaccaucaugcagugucuaggggaagcgcaaaguugagaugguuuguggaacgcaaucuaguaacaccagaagguaaagucguagauuuaggauguggucguggaggauggagcuauuauugcggugggcuaaagaauguaaaagagguuaaagguuuaacaaaaggaggaccaggacaugaggagccaaucccuauguccacuuauggauggaauuuagugagguugcagucugguguugacguauuuuucacaccuccagaaaaaugcgacacauuacuaugugauauaggggaaaguucuccaaauccaacuguagaagcaggucgcaccuuaagaguuuuaaaucugguggaaaauuggcuaaacaacaauacucaauuuuguauaaaggugcuaaauccuuauaugccgucugucauagagaaaauggaggcucuacagagaaaauacgguggcgcucuuguacguaacccauugucaagaaauaguacucaugaaauguacuggguuucgaaugcguccgggaauauaguaucaagcgucaacaugaucucaagaaugcuaauaaacagauuuaccaugcgacacaaaaaggcgaccuacgaaccagauguagauuuaggcucgggaacaagaaauaucggaauagaaagugaaacccccaauuuggacauuauaggaaaaaggauagagaaaaucaaacaagagcaugaaacgagcuggcacuacgaucaagaccaucccuacaagacaugggcuuaucacggaucuuaugaaacaaaacaaacuggaucggcuuccaguaugguuaaugggguaguaagacuacuaacaaaacccugggauguuaucccgaugguaacacaaauggcaaugacggauacgacuccauuuggccaacaacgaguguucaaagaaaagguagacacgagaacucaggaaccaaaagaagguacuaagaaacuaaugaaaauuacagcagaaugguuguggaaagaacuaggcaagaagaaaacgccacgaaugugcaccagagaagaguucacucggaaagugagaaguaacgcugcauuaggugccauauuuaccgaugaaaauaaauggaaaagcgcaagggaggcuguugaagauucagguuucugggaauuaguagauaaagagagaaauuugcauuuagagggaaaaugcgagacuuguguauauaacaugauggguaagagagagaagaaacuaggagaguuugguaaagcaaaggguucacgugcuauaugguauauguggcuuggugcacgauucuuggaguucgaggcucuaggauuucuaaacgaagaccauugguuuucgagagaaaauagccuaagcggugucgagggugaaggcuuacauaaacuaggcuacauccuccgcgauguaucgaagaaagaaggaggggcaauguaugcugaugauacagcaggaugggauacacgcauaacgcuugaagauuugaagaaugaagaaaugguuacaaaucauauggaaggagaacacaagaaauuggcugaagccauuuuuaaacuuacuuaucagaauaaaguaguccguguccagcgaccaacaccgcgagggacuguaauggauauaaucagccgacgcgaccaaagagguucuggacaaguaguaacuuacggccucaacacuuuuacgaacauggaagcccaacuaauaagacaaauggagggagaggguguuuuuaaaucgauucaacaacuaacaguuaaagaagagaucgccguaaagaauugguuaauccgcgugggaagggaaagguuaucccgaauggcaauaagcggugacgauugcguuguuaaaccacuagacgaucgauuugccagcgcauugacagcacuaaaugauaugggcaagguucgaaaagauauucaacaaugggaaccuagcagaggcuggaaugacuggacacagguaccauucuguucccaucauuuucacgagcuaauaaugaaagauggcagagugcuggugguaccauguaggaaccaggacgagcuaaucgguagagcaaggauaucacagggagcgggauggucacucagggaaacagcaugccuaggaaaaaguuaugcacagauguggucacucauguauuuucacaggagagaucuaagacuggcggcaaaugcaauaugcucugcaguaccaucucauuggguaccaacuucacguacuacauggagcauucacgcaacacacgaauggaugacaaccgaggacaugcuaacugucuggaaucgaguuuggauacaagaaaauccauggauggaagauaaaacuccagucgaaagcugggaggaaauaccuuacuuggggaaaagagaagaucaauggugcggaagucucauagguuuaacaaguagagcuacaugggccaaaaauauacaaacugcaauuaaucaaguaagaucccuaauagguaacgaggaguacaccgacuacaugcccaguaugaaacgauuucggcgagaagaagaagaagccggaguuuuaugguga

SEQ ID NO: 22886 - RNA, 9876 nt, Artificial Sequence
  derived and/or modified CDS sequence (opt6) from DENV-2__JN851126__SS-prME
accgcugggauuaucaucaugaugauaccaacuguuauggcauuccaucuaaccacuagaaauggggaaccacacaugauuguaagucggcaagaaaaagguaaaucacuacuauuuaaaaccgaaaaugggguuaauauguguacucucauggcaauggaucucggagaacugugcgaagacacuauaacguauaauugcccgcuacuuaaacagaaugaaccugaagacauagauuguugguguaacagcaccucaacauggguuacauacggaacauguacugcgacaggagaacacagacgagagaaaaggucgguagcguugguaccacacguuggaaugggucuagaaacaaggacagaaacguggauguccucagaaggggcuuggaaacaugcacaacguaucgaaaccuggguauuacgacauccuggauuuacaauaauggcagcuauauuggcuuacacgauagggaccaccuacuuccaaagaguacuaaucuuuauauuauuaacugcaguagcaccaucaaugacuaugagauguaucggaauuagcaacagagacuuuguagaagguguuagcggugguucauggguagacauaguucuagaacaugggucuuguguaacaacuauggccaaaaauaaacccacauuagauuuugaauuaaucaaaaccgaagcuaaacacccagcuacucuaaggaaauacugcauagaagcaaaauugacuaauacaaccacggcaagucgaugucccacgcaaggugaaccuaguuuaaaugaagaacaagacaaaagguuuguauguaaacauaguaugguagaccgggguugggguaauggaugcggauuauuuggaaaaggcgggauaguaacaugcgcaauguucacauguaagaaaaacauggaaggaaaaauuguacaacccgaaaaucuugaauauacuauaguaauaaccccucacaguggcgaagaaaacgcgguuggaaacgacacaggaaaacacgggaaagaaauuaaaguaacgccgcaauccaguaucacugaagcugaacuaacuggcuauggcacggugacaauggaaugcucaccaagaaccggauuggacuuuaaugagaugguguuacuacaaauggaaaacaaagcaugguuaguucacagacaaugguuucuugaucuaccauuaccauggcuccccggcgcugacacucaaggaaguaacuggauacaaaaagaaacguuaguaacauuuaaaaacccacaugcuaagaaacaagauguaguugucuuagguucacaagaaggagccaugcacaccgcauuaacaggagcgacagaaauccaaaugaguagcgguaacuugcuauucacugggcaccucaaaugucgucugcgaauggauaaauuacaacuaaaagggaugaguuauagcaugugcaccggaaaauuuaaaguggugaaagaaauagccgagacacaacauggaaccaucguaauacggguccaauacgagggagaugguuccccguguaaaauuccauucgaaauaauggauuuagagaaaagacacguguuaggcagacucauaacaguaaauccuauuguaaccgaaaaagacucacccguaaauauagaagccgaaccaccuuuuggcgauucauauauaaucauugggguggaaccuggucaauugaaacucaguugguucaagaaaggaaguucuauaggacaaauguuugagacaacaaugagaggagcuaaaaggauggcaauccuaggggauacugcaugggacuuugggagucuugggggagucuuuacuucaauagggaaagcacugcaccaagucuuuggugcgauuuauggagcagcauuuucaggcguaucguggaccaugaaaauuuuaaucgggguuguaauaacauggauagguaugaacaguagaucgacgagucugucaguaucacuuguacuugugggcguugucacacuauacuuaggcguaaugguucaagcugacagcgggugcgugguaucauggaaaaacaaagaacucaaauguggcuccgguauuuucauaacagauaauguacauacauggacugaacaguacaaguuccagcccgaauccccgaguaaauuagcaucagcuauacaaaaagcacacgaagaaggaauauguggcaucagaucaguaacacgauuagagaauuuaauguggaaacaaauaacgccagaauuaaaucauauauuaucugagaacgaaauaaaauugacuaucaugacaggggauauaaaaggaauaaugcaagccgggaagagaagccuucgaccacaaccaacugaauuaaaauacuccuggaaagcaugggguaaagcuaaaaugcuuaguacugaauuacauaaccauacauuuuuaaucgauggacccgaaacugcagaaugccccaacacgaaccgggcauggaacucccuagaaguagaagacuacggauucgggguauuuacuacaaauaucugguuaaaauugaaagaaaggcaggacguauucugcgauucaaaacuuaugucugcagcuauuaaggauaaucgagcaguacaugcagauauggguuauuggauagaaagugcacuaaaugauacauggaaaauugaaaaagccuccuuuauagaaguaaaaucuugucauuggccuaaaucacauacguuguggucaaauggaguucuagaaucagagaugauuauaccgaaaaauuucgcaggaccaguaucccaacacaauuaucggccuggauaucauacacaaaccgcaggaccguggcauuuaggaaggcuggagauggacuuugauuucugcgaaggaacaacaguaguagucacugaggacugcgguaaccguggacccagucugcgaacgacgacagccaguggaaaacuuauuacugaaugguguugccgaagcuguaccuuaccaccguuaagauacagaggugaggaugggugcugguaugguauggaaauuagaccuuuaaaggaaaaagaagagaauuugguuaauagucuagugacugccgggcauggccagauagauaauuucucgcucggaguuuuaggcauggcacuauuuuuagaagagaugcuccgcacaaggguggggacaaaacacacuauccuucuaguggcaguaaguuuuguaacccuaauuacuggaaauauguccuuucgagauuuaggacgggugguaguaauggugggggcaacaaugacggacgauauaggaauggggguuacguacuuagcauuacuugcagcguucaaaguaagaccuacuuuugcagcagguuuauuguugagaaaauuaacgagcaaagaauuaaugaugacgacuauagggaucguuuugcugucucaauccaccaucccagaaacgauauuagaacucacugaugcauuggcccuagguaugauggugcuuaaaauagucaggaauauggaaaaguaucaauuagcuguaacuauuauggcaauuuuguguguaccaaaugcggucauacuccagaacgcauggaaagugucguguaccgcacuugccgugguuuccgugucaccacuauuauuaacaucaucacaacaaaaagcggacuggaucccacuugcacuaacaauuaagggcuuaaauccaacugcuauauuuuuaacaacucuaaguagaacuucuaaaaagagaaguuggccuuugaaugaggcaauuauggcagugggcaugguaucuauacuagcaucuucacuccucaaaaaugacaucccaaugacuggaccguuaguggcagggggauuacuaacgguaugcuacguacuuacuggucgaagugcggacuuagaacuggaaagagcagcagauguccggugggaggaacaagcagaaauaagcgggagcucaccuauucuaucaauaacuauaucagaggauggaucuaugucuauaaagaacgaagaggaagaacaaaccuuaaccauauuaauaagaacaggucuauuaguaaucaguggucuguuuccugucaguauucccauaacagcugccgcuugguaccuuugggaagugaagaaacaaagagcgggaguauuaugggauguaccuagcccaccaccaguuggaaaagcagaacuugaagacggggcuuaccgaauaaagcaaaaagguauacuuggcuauagccagauuggcgcagggguauauaaagaaggaacuuuucacacaauguggcauguuacaagaggugcaguacuaaugcauaaagggaaaagaauagagccaucuugggcugacguuaagaaagaucuaauuucauacggaggaggguggaagcucgagggggaauggaaagaaggcgaggaaguacaaguccuagcacuagaacccggcaaaaauccacgggcggugcaaacgaaaccagggcuauuuaaaacaaauacaggaacuauuggagcugucagcuuagauuuuagcccaggaacaucaggaaguccaauaguagauaagaaaggaaaaguagugggucuauauggcaacggaguagugacaagaagcggcaccuacgucagcgccauugcucaaaccgagaagucuauagaggauaaucccgaaauagaagaugacauauucaggaagaaaagacucacaauaauggaccuacacccaggagcaggcaagacuaaaagauacuuacccgcaauagugagggaggccauuaaacgcggguuaagaacuuuaauuuuagccccgacacgagucguggcagcagagauggaggaagcccuaagaggucuaccgauacgauaucagaccccggcgauaagggcugaacauacugguagagaaauuguagaucuaaugugucaugcaacauuuaccaugagacuauuauccccuauucguguccccaacuacaacuuaaucaucauggacgaggcacacuucacagauccagcaaguaucgccgcgagaggcuacaucaguacuagaguugaaaugggugaagcugccggcaucuucaugacugcuacacccccgggguccagagacccauucccacaauccaaugcgccuauaauggacgaagaaaaggaaauacccgaacgaucuuggaauaguggacacgaauggguuacagauuucaaaggcaagacagugugguuuguaccgucuauaaaagccggcaaugauaucgcugcauguuuaaggaaaaauggcaagaaagucauacaauuaagcagaaaaacuuuugacuccgaauauauuaaaaccaggacaaaugauugggauuuuguagucacaacugauauuucugaaaugggugcgaauuucaaggcugaacgaguaaucgauccacgacgaugugucaaaccaguaauucuuacagacggagaagagagaguuauauuggcagggccgaugccaguaacacauaguucugcagcgcagcggagagggaggguuggucgaaaucccaaaaacgaaaacgaucaguauauuuacaugggagagccucuagaaaaugacgaggacugugcccauuggaaagaagcaaaaaugcuccucgacaauauuaacacacccgaagggauaauaccaagcauguuugaaccggaacgagagaaaguagacgcgauagauggcgaauauaggcugcguggugaagcgagaaaaacauuuguggaucucaugcggcgcggagaccuccccguguggcuggcuuacagggucgcagcugaaggaauaaauuaugcugaccguagguggugcuucgauggagucaaaaauaaucagauacucgaagaaaauguagagguggaaauauggacuaaagaaggugagcggaaaaagcuaaaaccucguugguuagacgcuagaauuuauagcgacccucuggcccuaaaagaguucaaggaauuugccgcugguagaaaaucacuaacccucaaccucauuacggagaugggaagauuaccgaccuucaugacucaaaaagcgcgaaaugcccuggauaacuuagcaguucuacacacugccgaggcaggcggccgugccuauaaccacgcuuuaagcgaacugccagaaaccuuagaaacccuauuauuguuaacacuucuagcaaccgucacugguggaaucuuuuuauuucugaugucuggaaaagguauugggaaaaugacacuagguauguguugcauaauaaccgcuucaauauuacuaugguacgcacaaauacagccacauuggauugccgcuagcauuauuuuagaauuuuuccugauagucuugcuaauuccggaaccagaaaaacagcggaccccucaagauaaccaacuaacuuacgucguuaucgcuauacuuacaguuguagcggcgacuauggcaaaugagaugggcuuucucgagaaaacaaagaaagacuucggauuagguucaauaacaacgcagcaaccagagaguaacaucuuagauaucgaucugaggcccgcguccgcuuggacgcuuuaugcgguugccacaacuuucauaaccccaaugcuccgacauucuaucgaaaacucaucugugaauguaucccuuacugcaauagcgaaccaggccaccguacuuaugggauuggggaaaggauggccguugaguaaaauggauauuggaguaccacuacuagcgauuggaugcuauucgcaaguuaacccaauaacuuuaacugcugcccugcuacuuuugguagcucauuacgcaauaauaggcccaggcuuacaagcuaaagcaacucgagaggcucagaaacgagcagcggcaggaauaaugaaaaauccaacaguagacggcauuacggugauugaccuagacccuauuccauacgacccuaaauuugagaaacaauuaggccagguaaugcugcugguauuaugugugacucagguucuaaugaugagaacaacuugggcauuaugugaagccuuaacucuugcuacagggccuauaucgacuuuaugggaagguaacccuggcagguuuuggaacacuacaauagcaguuaguauggcaaauauauuucgugggagcuaucuugccggugcaggacuauuauuuagcauuaugaaaaauaccgcuaauaccaggcgagguaccggaaauacaggugaaacauugggagagaaguggaagaauagauuaaacgcuuugggcaaaucagaguuucaaacauauaagaaauccggaauccaagagguagauagaacccuugcaaaagaagguauuaaacgcggagaaacugaucaccaugcagucagucgcgguucagccaaacuaagaugguuugucgaaaggaaucugguaacuccugaaggaaaaguagucgaucuugguugcggucgcggaggauggagcuacuacuguggaggacuuaaaaacguuaaggaaguaaaaggucugaccaagggcggucccggacaugaggaaccaauaccaaugucaacguacggauggaauuuaguucgcuuacaauccgggguagaugucuuuuucacgcccccugagaaaugcgacacacuucuuugugacauuggagaaagcagccccaaccccacagucgaagcgggaagaacucugcgcguacuaaaccuaguugagaauugguugaauaauaauacccaauucuguaucaaaguucugaauccauauaugcccagcguuauugagaaaauggaaaccuuacaaaggaaacaugggggagcuuuaguaagaaauccacuuucaaggaacucaacacaugagauguauuggguuagcaacgcuucugggaacaucguaagcagcguuaauaugaucaguaggaugcugauaaaucgauuuacaaugaggcacaagaaagcaacguacgaaccugaugucgaucuugguuccggaacuagaaauauaggaauugagucagaaacuccuaacuuagacauuauuggaaaacgaaucgaaaagauuaaacaagaacacgaaacaaguuggcauuaugaccaggaccacccauacaagacaugggccuaucacggcucauaugaaaccaaacaaaccggcucagcgagcucuauggucaauggaguaguaaggcuauugacaaaaccuugggauguaauuccaauggucacccaaauggcaaugaccgauacaacaccguucggacaacaaagaguauucaaagaaaaaguugacaccagaacucaagaaccuaaagaggguaccaagaaacugaugaaaauaaccgccgaaugguuauggaaggaauuggguaaaaagaaaaccccacgaauguguacuagagaagaguuuacacggaaaguacguucuaaugcugccuuaggggcaauauuuacugaugaaaacaaguggaagucagcaagagaagccguagaagauucaagguuuugggaacugguagacaaagaacgcaaccuacauuuggaaggaaagugugagacuuguguauacaacaugaugggcaagagagagaagaaacuuggcgaauuuggaaaagcaaaaggauccagggcgauuugguacaugugguuaggcgcuagguuucuagaguucgaagcacuaggguucuugaaugaggaucauugguucuccagagaaaacagucucaguggaguggaaggggaggggcuacacaaauuggguuauauccuacgggauguaaguaagaaagaaggcggugccauguacgccgaugauacugcaggaugggauacucggauaacauuagaagaccuuaagaaugaggagaugguaacuaaucacauggaaggggaacauaagaaauuggcagaggcaauuuuuagacuaacuuaucaaaacaaaguuguuaggguacaacgaccgacuccuaggggcacuguaauggacauaauuucaaggcgcgaccaaagagguaguggccaaguaguaacauauggguuaaauacauuuaccaauauggaagcgcaacuaauacgucaaauggagggagaaggaguauuuaaaaguauccaacaucuuacagugaccgaggagauugcaguuaaaaauugguuaguccgugucggccgggaacgacuuaguagaauggccauaagcggggaugauugcguuguaaagccacucgacgacagauuugccagugcgcucacugcguugaaugauauggggaaaguaagaaaagauauucaacagugggaacccagccgcggauggaaugauuggacucaagucccguuuuguucccaccacuuucaugaauugauuaugaaggacggacggguuuuaguaguaccgugucgaaaucaagaugaacuaaucggaagggcuagaauaucacaaggugccggauggucucuacgcgaaacggcaugucuuggaaaaucauaugcacaaauguggagucuaauguacuuucauaggagagaucuuagguuggcagcuaacgcaauaugcucagcagugccgucacacuggguucccacuucccgaacaacauggucaauccacgccacgcaugaauggaugacaacugaagauauguuaacuguuuggaacagaguauggauccaagaaaacccauggauggaagacaaaacgccaguugaauccugggaagagauccccuauuuggguaaaagagaggaucaguggugugguucucuaauaggacugacaagucgagcaaccugggcaaagaacauucaaacagcgauuaaucaagucaggucacuuaucgguaacgaagaauauacagacuacaugcccaguaugaaaagauuuaggcgcgaagaagaggaggcagggguucugugguaa

SEQ ID NO: 22887 - RNA, 9876 nt, Artificial Sequence
  derived and/or modified CDS sequence (opt6) from DENV-2__JN851121__SS-prME
accgcugguauuauuauuaugaugaucccaacuguuauggcauuccauuuaacuacuagaaacggugaaccccauaugaucgugagucgacaagaaaaaggaaaaaguuuacuguucaaaacagaaaaugggguuaauauguguacgcuaauggcuauggauuugggggaauuaugugaagauacuaucacguacaauuguccacuacuacgccaaaacgaacccgaagacauagacuguuggugcaauagcaccagcaccuggguaacauauggaaccuguacagcaaccggggaacacagaagagagaaacgaaguguggccuugguuccccauguaggaaugggacuagaaacgagaacggagacguggaugagcucagaaggagcuuggaaacaugcacagagaauugaaacguggauucuuagacauccgggcuuuacgauuauggcggcuauuuuggcauacacuauuggaacgacauauuuucagagaguacuaaucuuuauacuauugacagcaguaacaccuagcauggcaaugagauguauagguauaagcaacagggacuucguugaaggaguaucuggagguaguuggguugauauaguacuugaacauggaucuuguguaacuacuauggccaaaaacaaaccuacauuagacuuugagcuuauaaaaacugaagcaaaacauccagcaacgcuacgaaaauauugcguagaggcaaaauuaacuaauacuacaacagcaucacgauguccuacucaaggcgagccuuccuugaaugaagaacaggauaaaagauucguaugcaaacauucuaugguugacagaggauggggcaauggauguggccuuuuugggaaaggugggauugucacaugugccauguuuacguguaagaaaaacauggaaggaaaaguaguccaaccugagaaccuagaguauacaauagucaucacgccacauucuggcgaagaaaaugcaguuggaaaugauaccggaaaacacggaaaagaaauaaaaguaaccccgcagucaagcauaaccgaagcggagcucacaggcuacggaacagucacgauggaauguuccccaaggacaggauuagauuuuaacgagaugguacuucuacagauggagaauaaagcgugguuaguccauagacagugguucuuggaucuuccucuuccaugguuaccgggcgcugauacacaagguucuaauuggauucagaaagaaacauuaguaacuuuuaaaaauccucaugcuaagaaacaagauguuguaguccugggaucacaagaaggggcaaugcauacugcguugacuggugcaacggaaauacagaugucguccgguaauuuauuauuuaccggccaucuuaaauguagacuucgaauggauaaacuacaauuaaaagggaugagcuauaguauguguacugguaaauuuaaaguagucaaagaaauugcagaaacacagcauggcacgaucgugauacguguacaauacgaaggagacgguagcccauguaaaauaccguuugaaauuauggaucuugagaaacggcacguguuggggcgauuaauaacugucaacccgauaguaacugaaaaagauagcccagucaauauugaggcggaacccccuuuuggagauucguacauaauuauuggcguagagccaggacaacugaaacuaucuugguucaagaaaggaaguucaauuggacaaauguuugagacaacaaugagaggagcaaaacgaauggccauucucggagacacggcgugggacuucgguagccuuggugguguauuuacaaguaucgguaaagcauuacaucaggucuucggggcaaucuauggugcagcauucucaggcgucucauggacaaugaaaauucuaauaggcgucguaaucacuuggauuggaaugaacagccggagcacuucccucucagucaguuuaguacucguaggaguggucacauuauaucuuggggcuaugguccaagccgacucagguugcguuguaucauggaaaaauaaagaacucaaaugcgguaguggcauuuuuauaacagacaacguucauacauggacugaacaauauaaauuucagccggaaucaccgagcaaacuagcgucugccauccaaaaagcccaugaagaagggauaugugggauucgcaguguaacgagauuagaaaaccuuauguggaaacaaauaacaccagaauuaaaucauauacuuacagagaacgaaguaaaauugacaauaaugacaggcgauauaaaagguauaaugcaggcugguaaaaggagcuugagaccgcaacccacggaacuaaaauauagcuggaaggcuuggggaaaagcgaaaaugcuaucgaccgagcuucacaaccauacauuccuaauagacggaccagaaacagccgagugcccgaauacaaauagagcauggaacucucucgagguugaagauuauggauuuggcguauuuaccaccaauauuuggcuaaaauuaaaagaacgccaagauguauuuugugauagcaaacuaaugucagcagcuauaaaagacaauagagcgguucaugccgacaugggcuauuggauugagagcgcauuaaaugacacuuggaaaaucgagaaagcaucguuuauagaaguaaagagcugucacuggccuaaaucgcauacucuuuggucuaauggaguauuggaaucggaaaugauaauacccaaaaacuuugccgguccaguuucucagcauaauuaucgaccgggguaccacacucaaacggccgggccguggcauuuagggagacuagaaauggauuucgacuuuugugaggguacgaccgucgugguaacagaagacuguggaaauaggggcccuucacuaagaacgacaacugcuagcgguaaacuuauaacagagugguguugccguagcuguacguuaccuccauuaagauauaggggugaagauggcugcugguauggcauggaaauucguccccuuaaagaaaaggaagagaaucuuguaaauagucuaguaacggcaggccauggucaaauugauaauuucucacuaggcguauuagggauggcacuauucuuggaagagauguugcgcacuagggucgggacaaaacaugcaauuuugcuaguugcagugucuuuuguaacccuaauaacagguaacaugucauucagggaucuagggaggguuaugguuaugguuggggccacaaugacggacgauauaggaauggggguaacuuaucuggcucucuuagcagcauucaagguucgcccaacauuugcagcuggccuccugcuuagaaaauuaacaucgaaggaauuaaugaugacgacgaucggcaucguacugcuaucccagucaacaauaccggagagcauacucgaauuaacggacgcguuagcuuuagguaugaugguauugaaaaucguucgcaacauggaaaaauaccaacuagcuguuacuaucauggccauauuaugugucccaaaugcaguaauauugcagaacgccuggaagguuaguugcacuacccuggcgguugugaguguuaguccauuacuacucacaucaucucaacaaaaggcugauuggauaccucuugcacucacuauaaaaggauuaaacccaacugcaauauuucugacuacacuuagucguaccaguaagaaaagaagcuggccacuaaacgaagcaauaauggcagucggaauggucagcauauuagccuccaguuugcugaaaaacgauaucccaaugacaggcccccuaguagcaggcgggcuacuaacgguuuguuauguauuaacagggagaucggcagaccuagagcuagagcgugcagcggacguucgaugggaagaacaagccgaaauaagcgggagcucgccaauuuuaucgauaaccauuucggaagacgggagcaugucuauuaaaaacgaagaggaagaacaaacauuaacuauuuugauucgaacaggccuguuagugauaaguggucuauuuccgguaucgauuccaauuacagccgcagcgugguaucuaugggagguaaagaagcaacgggccggaguuuuaugggauguaccaucuccuccaccaguagggaaagcagaacucgaagacggugcuuaucgaauuaaacagaaagguauccuggguuauagccaaauaggggcaggaguguauaaagaaggcacauuucacaccauguggcauguaacacguggggcggucuuaaugcauaaagggaaacguaucgaaccuagcugggcugaugugaagaaagaccucauaaguuauggagguggauggaaauuagaaggugaguggaaggaaggugaagagguacagguguuagcauuagaaccugggaaaaacccacgugccgugcagacaaaacccggccuauuuaaaacgaacacugggacaauaggugccguauccuuagauuuuuccccuggaacuagcggaucaccaauagucgauaagaaaggaaaaguaguaggucuuuauggaaacggagugguaacacggucaggaacauacguaucagcgauugcucaaacugagaaaucaaucgaagacaacccagagauugaagacgacauauuuaggaagaaacggcuuacaauaauggauuuacauccgggagcuggaaaaacuaaaagauacuuaccagcaauagugagagaggcaauuaaacgaggauugagaacacuaauucuagcaccaacacgagucguggcugcugaaauggaagaagcucuacgcgguuuaccgauaagauaucaaacuccagcaauucgagcggaacacacuggucgagagauugucgauuugaugugccaugcuaccuuuacuaugcgauugcuauccccaauuaggguaccaaacuauaaucucauuauaauggacgaagcacauuuuacggacccggcguccauagcggcaagaggcuauauaucuacaagaguggaaaugggcgaggccgcaggaauuuucaugaccgccaccccacccggaagccgugauccuuuuccccaaucuaacgccccuauaauggaugaggagcgcgagauuccggagagauccuggaauagcggacaugaaugggucacagacuucaagggaaagacuguaugguuuguucccucgauuaaggccggaaacgacauugcggcgugccucaggaaaaacggcaagaaagucauacaacuuucuagaaagacauucgacucagaauauaucaaaacaagaacaaaugacugggauuuugucguaacaacggauauaagcgaaaugggagcaaauuucaaggcagagagagucauagauccaagacgauguaugaagcccguuauacucacagauggggaagaacgcguaauuuuagcagggcccaugcccguaacgcauuccucagcagcccagagacggggaagagugggacguaauccaaagaaugagaacgaucaauacauauauaugggugaacccuuagaaaaugacgaagauugcgcacauuggaaggaagcuaaaaugcuucuagauaauaucaacacacccgaggguauaauaccgucuauguucgaacccgagagagagaaagucgaugcuauugacggcgaguacaggcuacgaggagaagcacgcaaaaccuucguugaccuaaugagaagaggggauuugccaguguggcuugcauaccgcgucgcugcugaaggaauaaauuaugccgaucgaaggugguguuuugaugggguaaagaauaaucaaauucuugaggaaaauguagaagucgaaaucuggaccaaagaaggagagaggaagaaacuuaagccuagauggcucgaugcuaggauauauuccgauccccucgcauuaaaagaauuuaaagaguucgccgccgggcgcaagagcuugacuuuaaacuuaauuacagaaaugggacggcuuccaacauuuaugacgcagaaagcuaaaaaugcauuagacaaucucgcuguuuugcacaccgcagaggcaggagggcgagcguacaaucacgcgcuuagugagcuaccagaaaccuuagaaacucuacuuuuauugacacuauuagcaaccguuacaggagggauuuuucuguuucucaugagugggaaaggaauuggaaaaaugacuuugggaauguguuguauuauaacggcaagcauccuuuuaugguaugcgcaaauucagccucacuggauagcagcuaguauaauucucgaguucuuuuuaaucguccuguugauaccugagccggaaaaacaacggacgccgcaggacaaccaguuaaccuaugucguaauugcaauauugacgguugucgcagcaacaauggcuaacgaaaugggauuuuuagagaaaacgaagaaagauuucggucugggaagcauaacaaaucaacaaccugaaucaaacauauuagacauagaucuaagacccgcguccgcguggacacucuaugcagucgcaacgacuuucauaacucccauguuacgccauuccauagaaaauucaucaguaaaugucagcuuaacggcaauagcuaaccaagcaacaguauuaaugggccuagggaaaggauggcccuuaucuaaaauggauauuggcgugcccuugcuugcaaucgguuguuacucacaaguaaacccuaucacacuaacagcugccuuacuucuacuuguugcacauuacgcgaucauagggccaggauuacaagcuaaagccacccgugaagcccaaaaacgggcugcagcugguauaaugaaaaacccgacaguagauggcaugacuguuauagacuuagauccuauaccauaugauccuaaauucgaaaaacaauugggacagguaauguuauuaguccuuugcguaacacagguacuaaugaugagaacaacaugggcauuaugugaagcacuaacauuagcaacuggaccaauaucuacccucugggaaggaaauccgggcagauucuggaauacaacaauagccguaucaauggccaacauauuuagagguucauaucuugcuggugcaggauuguuguucagcaucaugaaaaacacggcaaauacuaggcguggaacagggaauacuggugaaacacugggggaaaaauggaaaaauagguuaaaugcacuuggaaagucagaauuucaaauauauaagaaaaguggcauucaggaagucgauagaacucuugcaaaagagggaaucaaacguggagaaacagaucaucacgccgugucaagagggucagcuaaauuacguugguucguggagcgaaacuuagugacaccagaggguaaagugguugaccuuggaugcggacgcggcgguuggagcuacuacuguggugguuugaaaaauguaaaggagguuaaaggacuaacuaaaggugguccaggucaugaggaaccaauaccuaugagcacauauggauggaauuugguacgacuacaguccggaguugauguauucuuuaccccuccagagaaaugugauacucuccuuugugacauaggcgagagcucgcccaauccaacuguagaagcgggacgaaccuugaggguguuaaaucuugucgaaaauuggcucaacaacaacacucaguuuugcauaaaaguuuuaaacccauacaugccuucuguaauugagaaaauggaagcacuucaacgcaaguacgggggugcucuugucagaaacccauuaagcagaaauuccacacaugagauguacugggucagcaaugcuucugguaauauuguaaguucaguuaauaugauaaguagaauguuaauaaaucgauuuaccaugagacauaagaaagcaacguaugaaccugacguugacuuaggaagcggaaccagaaauauaggaaucgagucagaaacacccaaucuagacaucauagguaaacgaauugagaaaauuaaacaagagcacgaaacuucuuggcacuacgaccaagaccacccauauaaaacaugggcauaucaugguucuuacgagacgaaacagacagguucggcauccucuaugguaaacggaguaguuagauuguuaacaaaaccaugggacgucauaccaaugguaacacaaauggccaugacagauacuacaccuuucggacaacagaggguuuucaaagaaaaagucgauacuagaacucaagaaccuaaagaagguacaaagaaacuaaugaaaaucacagcagaaugguuauggaaagagcucggcaaaaagaaaaccccaagaauguguacacgggaagaguucacuaggaagguacggaguaaugcagcacuaggugccauuuucacagaugagaacaaauggaaaagugcucgggaagcaguugaggacucagguuucugggaguuaguggauaaagaaagaaaccuacauuuagaaggcaaaugcgaaacaugcguauauaauaugaugggaaaacgggagaagaaacugggugaguuugguaaagcaaaaggcagucgagccauaugguacauguggcugggcgcuagauuucucgaauuugaagcucuuggauuucucaaugaggaucacugguuuucccgagaaaauucguugagcggaguggagggugaagggcuucacaagcuaggauacauucuaagggauguuaguaagaaagaaggaggggcaauguaugcagaugauacggcagguugggauacaagaauaacacucgaggacuuaaagaaugaagaaaugguuacaaaccauauggaaggagaacauaagaaauuagcugaagcaauauucaaacuaacuuaucaaaacaaaguagugagaguucaaagaccgacuccgcgagguacuguuauggacauuauaaguagaagagaucaacgaggcucaggacaggugguaacauacgggcuuaacacuuuuacaaauauggaggcucaacuaauaagacaaauggagggugaagguguuuuuaaaucuauacaacaauuaacagugaaagaggaaauugcagucaaaaauugguuaauaagaguaggucgggagcgccugucucggauggcgaucuccggagaugauugcguaguuaaaccucucgaugacagauuugcuucggcauugaccgcguugaacgacauggggaaaguccgaaaagauauacaacaaugggaaccaagcagaggcuggaacgacuggacacaagugccguucugcagucaucacuuccaugaacuaauaaugaaagacggacguguucuagugguaccauguagaaaccaggaugaacuaaucgggcgcgcucguauaucucaaggcgcaggcuggaguuuaagagagacugcaugccuugguaaaucuuaugcacaaauguggucacugauguacuuucauagaagagacuuacgacuugcagcaaaugcaauaugcagcgcuguaccaucucauugggugccaaccucgaggaccacgugguccauacaugcaacucaugaauggaugacuacagaggauaugcucacuguuuggaauagggucuggauacaggaaaauccuuggauggaggacaaaacuccaguagagaguugggaagaaauuccuuacuuggggaaacgggaggaccaauggugugguuccuuaauugggcuaacuagcagagcaacuugggcuaaaaauauccaaacagccauaaaucaagugaggucuuugauuggaaaugaagaauacaccgauuauaugccuagcaugaagagguuucggcgagaagaagaagaagcaggcguacugugguaa

SEQ ID NO: 22888 - RNA, 9876 nt, Artificial Sequence
  derived and/or modified CDS sequence (opt6) from DENV-2__JN851115__SS-prME
acugcagguauaauuauuaugaugauaccuacuguuauggcauuccauuugacuacuagaaacggcgaaccacacaugauuguaaguagacaggaaaaagggaaauccuuauuauuuaaaacagagaaugguguuaauauguguacauugauggcuauggaccuuggggaauuaugcgaagauacgauaacauacaacugcccacuuuuaagacaaaaugagccagaagacauugacuguugguguaauucuacaaguaccuggguaacguacggaacaugcaccgcuacaggggaacauagacgagagaaaagaucgguagcucugguuccucaugucggaauggguuuagaaacaagaacugaaacuuggaugucuucugaaggggcuuggaaacaugcacagcguauagagacauggauauugagacauccaggauucacaauaauggcagcaauucuggcauauacuauugggaccacauauuuccaacguguauugauuuuuauucuccucacagcaguuacuccaagcauggcaaugagaugcauaggaaucucaaaucgagauuucguugaagggguaucgggcggaucauggguagacauugugcuugagcaugguucaugugucacgacuauggcuaaaaauaaaccuacucuggacuucgaacuaauuaaaacagaagcaaaacacccggccacacuccgcaaauacuguguggaagcaaaacuaacaaauacuacuaccgcaucaaggugccccacucaaggugaacccucauugaaugaagaacaggauaaaagguucguuugcaaacauucuaugguagaucgcggcuggggaaauggaugugggcuauuuggcaaagguggaauuguuacuugugcaauguuuaccuguaaaaagaacauggaagguaaagucguacaaccagaaaauuuggaguauacuaucguuaucacgccacacucaggcgaagaaaaugccguaggcaaugacacaggcaaacacgggaaagagauaaaaguaacgccacaaucaucuauaacagaagccgaacugacaggauaugggacagucacaauggaguguucuccaaggacuggccuggacuuuaaugagaugguucuguuacagauggaaaacaaagcguggcugguucauagacaauggcuguuagauuuaccccuuccguggcucccaggcgcugauacacaagggucaaacuggauacagaaagaaacuuugguuacuuuuaaaaacccccaugccaagaaacaagacguuguagucuuagguucccaagaaggagcgaugcacaccgcgcuaacaggagcuacugaaauacagaugucaucuggaaaucuccucuucaccggucauuugaaaugucgcuugagaauggacaaauuacaacuuaaagguaugucguauuccauguguaccggaaaauuuaaaguaguaaaagaaauugcggaaacacagcacggaaccauaguaauacgaguacaguacgaaggugacgguucaccaugcaaaauaccuuucgagauaauggacuuagaaaaacgucacguacuaggaagacugauaacaguaaacccaauaguaaccgagaaagauucaccagugaacauagaagcggagcccccuuuuggagauucauacauaauaauuggaguugaaccaggucaacuuaaauuaagcugguuuaaaaagggguccucgauaggacagauguuugagacgacaaugcguggggcuaaaagaauggcaauccuaggagauacagcaugggauuuuggcucccucggugguguauuuacaucaauaggcaaagcguugcaucaggucuucggagcgauuuauggugcugccuucaguggaguuucguggacaaugaaaauacucauaggaguagucauaacguggauaggaaugaacucgaggaguacaucucuauccguuucauuaguguuaguaggagucguuacgcuauaccuagguguuauggugcaagccgauaguggcugcgugguuucauggaaaaacaaagaacuuaaaugcgguucuggaauauuuaucacagacaauguccauacuuggaccgaacaauauaaauuucagccagaaucaccaaguaaauuagcaagugcaauucagaaggcccacgaggaaggcauaugugguauucgcaguguaacacgauuagaaaaccugauguggaaacaaauaacaccagaacuaaaucauauacuuaccgagaacgaggucaaacugacuauuaugacgggcgacaucaaaggcaucaugcaagcaggcaagagaagucuaagaccgcaaccaacagaauuaaaauauucguggaaagcauggggaaaagcaaagaugcuaucaacagaacuacauaaucauacuuuccuaauagaugggccagaaaccgcggaaugcccaaacacuaauagagccuggaacaguuuggaaguagaagauuacggguucggaguuuucacaaccaauauuuggcuaaaguuaaaagaacggcaagauguauuuugcgauucaaaguuaaugagcgccgccauuaaagauaaccgagcaguccaugcagacauggguuauuggauagaaucagcacuuaaugauacuuggaaaauugaaaaagcaucauucauagaagucaagagcugccauuggccaaaaagucauacgcuuuggucuaaugguguacucgaaagcgaaaugaucauaccuaaaaacuucgcagguccaguaagccaacacaauuaucgaccagguuaucauacacagacagccggaccguggcaccugggaagauuagagauggacuucgacuuuugugaagguacuacaguagugguuacugaggacugcggaaaucggggaccgaguuugagaacgaccacagcaagugggaaauugauuacagaauggugcugcaggucguguacguugccaccccucagauauagaggugaagacggcugcugguacgggauggaaaucaggccacucaaggaaaaagaggaaaaccugguaaauucauugguuacugcgggccauggacagauagacaauuuuaguuugggcgugcucgggauggcacuauuuuuagaagaaaugcuccguaccagagugggaacaaaacaugcuauacucuuaguagcggucucguucguuacuuuaauuacaggcaacauguccuuuagagauuuaggucgagugaugguaauggugggagcaacaaugacagaugacaucggaauggguguaaccuaucuagcacuacuugcugcauuuaaagugagacccacauuugcggcgggccucuuauuaagaaaacuaaccaguaaagaacuaaugaugacgacuauaggaauuguacuguuaagucaaaguacgauaccagagucaauauuggaauuaacagacgcauuagcacuugguaugaugguccugaaaauaguuagaaauauggaaaaauaccaacuagccgucacaauaauggcuauccuaugcguuccuaaugcaguaauauuacaaagugcuuggaaaguaucaugcacaacgcuagcaguuguaucuguaucaccccuacuucuuaccaguucacaacagaaagcugauuggauucccuuggcauuaacuauaaagggucuaaauccuacagcuauauucuuaaccacacuuucgcgcacuuccaagaaaagaucuuggccacuuaaugaggccaucauggcgguagggauggucucuauucucgcuucaucgcuccugaaaaacgauauaccaaugacaggcccucuaguagcagggggucuccuaacuguguguuauguacuuacagggcguagcgcagaccucgagcuagagagagcggcagauguuagaugggaagaacaagcagaaauaucagguagcucaccuauauuaagcaucacaauaagcgaagaugggaguaugucgaucaaaaaugaggaggaagaacaaacauuaaccauccucauaagaaccggucuauuaguaauaucaggguuguuuccaguuuccauaccuauaaccgcagcagcaugguaucuuugggaaguuaagaaacagagagcuggcguccuaugggacguaccaagucccccaccuguugguaaagcagaacuagaggacggagcuuauagaaucaaacaaaaaggaauacuuggauacucacaaaucggcgccgguguguacaaagaaggaacguuucauacaauguggcaugucacgagaggggcgguacuuaugcauaaaggaaaacgaauugagccaucuugggcagacgucaagaaagaccuaauauccuacgguggaggcuggaaauuagagggggaauggaaagagggcgaagaggugcaaguacuggcuuuggaacccgguaaaaauccgcgggcaguucaaacaaaacccggacuauuuaaaacuaauacaggaacgauaggagccguuagccuagacuuuucgccggguaccucggguucccccauuguagacaagaaaggaaagguagucggguuauauggaaauggaguggucacacguaguggcaccuacguuuccgcuauagcgcaaacugaaaaguccauagaggacaauccugaaauugaagacgauauauuuaggaagaaaagauugaccauuauggaccuucacccuggagcugggaaaaccaaaagguacuugcccgcaauuguucgagaggcaauuaaaagaggacugaggacccuuauauuggcaccaacacgaguaguagcugcagaaauggaggaggcgcuacgagggcuuccaauaagauaucaaacaccggcaaucagagcagaacacaccggccgugaaauaguagaccuaaugugucaugcgaccuuuacuaugaggcuucuuucuccaauacgaguaccaaauuacaauuuaauaaucauggaugaggcucauuuuaccgauccggcaucaauagcagcaagaggguauauaagcacacgcguagaaaugggcgaggcugcaggcauuuuuaugacugcaacgccucccgguucucgggacccauuuccucaguccaaugcaccuauuauggacgaagaaagagaaauuccagaaaggaguuggaacucaggacacgaaugggucacagacuuuaaaggaaagacugugugguuuguaccgucaauaaaagcugggaacgacauagcagcaugccuucgcaaaaacggcaagaaaguuauccaacuaagucgaaaaacauucgauuccgaauauauaaaaacaaggacaaaugauugggauuuugucgucacaaccgacauuucggagaugggagccaacuucaaggcagaaagagugauagaucccagaagauguaugaaaccuguaauucuuacagacggagaagaacgggugauacucgcaggacccaugccagucacacacucuucagcggcucaaagaagggguagagugggaagaaaccccaaaaaugaaaaugaccaguauauauacaugggagaaccgcuugagaaugacgaggacugcgcacacuggaaagaagcaaagaugcuacucgauaauauaaacacuccugagggaaucauuccgaguauguucgagccagaaagagaaaaaguugaugcaauugacggcgaauaccgauuaagaggcgaggcacgaaaaacuuuuguggaucuaaugaggcguggagaccucccaguuuggcuagccuacagaguggcugcagagggaauaaacuaugccgauaggcguugguguuuugacggcgucaaaaacaaccaaauucuugaagaaaacguagagguagaaauuuggacaaaggaaggggagaggaagaaacuaaaaccucguuggcuggacgccaggauuuauucagauccucuagcacugaaggaauuuaaagaauuugcagcaggcagaaaaucacuuacuuugaaucuaaucacagaaauggguagauuacccaccuucaugacccaaaaggcaaagaaugcuuuagauaacuuggcgguacuccauacagcugaagcaggcggccgcgcuuacaaccaugcucuuucggaacucccagagacauuagagacucuauuacuacuuacccucuuggcuaccguaacaggagguauuuuucuuuuccuaaugucagguaaagguauagguaaaaugacguuaggaaugugcugcauaauaacagcguccauauugcucugguacgcccagauacagccacauuggauagcagcuucaauaauauuagaguucuuuuuaauaguccuacucauaccggaaccagaaaagcaaagaacuccgcaggauaaucaacuuacguaugugguaauugccauccuaacugugguagcagcuacaauggccaacgaaauggguuuccuagaaaagaccaaaaaggacuuuggauuaggaagcauaaccacucaacaaccagaaucaaauauauuggauauugauuuaaggcccgcaagugcauggacacuauaugcaguugcuacaacguuuaucacaccaaugcugagacauagcauugaaaauagcucaguaaauguaucauugacagcgauagcaaaucaggccacaguuuuaauggguuugggcaagggauggccccucucuaaaauggacauuggcguaccacuuuuagcaaucggcuguuauagccaagucaacccgauaaccuuaacagcggcucuacuuuuauuagucgcacacuacgcuaucauagggccaggguuacaagcaaaagccacgagagaggcucaaaagcgugccgcggccggaauaaugaaaaauccaacgguggacgguaugacuguuaucgaucuagauccuauucccuacgacccgaaguuugaaaaacagcuuggucaaguuaugcuauuaguauuaugcguaacgcaaguccugaugaugagaacaaccugggcccuaugugaagcacugacucuagcaacugguccuaucucuacuuuaugggaagggaacccaggcagauucuggaauacaacuauagcaguuaguauggcgaauauuuuucgugguaguuaccucgcaggagccggccuccucuucucgauaaugaaaaacacggcaaacacuagacgugguacaggcaauacuggagaaacguugggugaaaaauggaaaaauagacugaaugcucuagguaagagcgaauuucaaauuuacaagaaauccggcauccaagaagucgaccgaaccuuagccaaagaaggaauuaagcgaggggaaacagaucaucacgcaguauccagagggucggcuaaauuacguugguucguagaacgaaaccuugucacuccugaaggaaaggucguagauuugggauguggaagagggggauggucuuacuauuguggcggccuuaaaaaugugaaagaaguaaaagggcuaacgaaaggagggccaggacaugaggagccuauaccaaugucuacguauggauggaaucuuguucgauuacaaucuggcguggacguguuuuucaccccaccugaaaaaugcgauacacuacucugugauauaggcgaaucaaguccaaaccccacggucgaagcaggucguacucuaagaguauuaaaccuuguggaaaacuggcuaaauaauaacacacaauuuuguauuaagguucuaaauccguacaugccgucaguuauugagaaaauggaggcauugcaaagaaaauaugguggugcacuuguacggaauccacugucuagaaauaguacgcacgagauguauuggguaucaaaugcaagcggaaauauagucucaucuguaaauaugauuagucggauguuaaucaaucgguucacaaugcggcauaaaaaggcuacguacgaacccgauguagaucuaggcucaggcacuagaaauauagguauagaaucagaaacaccaaaccuagacauaauagggaaaagaauagagaaaauaaagcaagaacacgaaacgucauggcauuacgaucaagaccauccauauaagacuugggcauaccauggcucguacgaaacuaaacaaaccgguagugcgucaucaaugguaaauggaguuguacgucuauuaacaaaacccugggauguaauaccaaugguaacucaaauggcuaugacggauaccacgcccuucggucagcagagaguauucaaagaaaagguugauacucgaacccaggaaccgaaagaagguaccaagaaauuaaugaaaauuacagcagaauggcucuggaaggaguuaggcaaaaagaagacaccacgaaugugcacaagagaagaauuuacuaggaagguacggaguaacgcggcacuaggagcuauauuuacagaugagaauaaguggaaaagcgcgcgagaggccgucgaagacucuggauuuugggaauuaguagauaaagagagaaaucuccauuuagagggaaaaugugaaacaugugucuauaauaugaugggaaaaagggagaagaaauuaggagaauuuggaaaggccaaaggcaguagggcaaucugguauauguggcuaggcgccagguucuuagaguucgaagcacuuggguuuuuaaaugaagaccauugguuuucucgggagaauaguuugaguggaguagaaggggaaggacuacauaaauuaggcuacauauuaagggauguuaguaagaaggaaggcggagcgauguaugcugaugacacugcagguugggacaccaggaucacguuagaagauuugaaaaaugaagaaauggugaccaaccacauggaaggagaacacaagaaacuagccgaggcaauauucaaacuaacuuaucaaaauaaggugguaagaguacagagaccaacuccacgggguacaguaauggauauaaucucgcgacgagaccaacgaggaucaggucaaguuguuacuuauggacucaacacauucacuaacauggaagcucaauuaauaaggcaaauggaaggagaagggguauucaagaguauacagcaacuaacagucaaagaggaaauagcagucaaaaauugguuaauucguguugguagggaacgauuaagccggauggcaauaucgggcgacgauugcguggucaaaccgcuagacgauagauuugcaucugcucucacagccuuaaacgauauggguaaaguuagaaaagauauucaacaaugggaaccaucuagaggguggaacgacuggacacaggugccauuuuguagccaucacuuucaugaacuaaucaugaaagacggaagaguacuggucguaccuugcagaaaccaagacgaacuaaucgguagagcuagaauaucucaaggggcaggauggagucugcgagaaacagcauguuuaggcaaaucguaugcccaaauguggucauuaauguacuuucaucgacgcgaccuacguuuagcagccaaugcgauuugcucagcgguuccaagccauugggucccaacaucccggaccaccuggucuauucaugcaacccaugaauggaugacaacggaagauauguugacgguuuggaauagaguauggauacaggaaaacccauggauggaagauaagaccccagucgagucaugggaggaaauaccuuauuuggguaaacgagaagaucaaugguguggcagcuugauaggacuuacaagccgagcaacaugggccaaaaauauccagacagcgauaaaccaagugaggagucuaauaggauacgaggaauauacggacuauaugccauccaugaaaagauuuagacgagaggaggaagaagccggcguacuuugguag

SEQ ID NO: 22889 - RNA, 9876 nt, Artificial Sequence
  derived and/or modified CDS sequence (opt6) from DENV-2__JN851127__SS-prME
accgcagguauuauuauuaugaugaucccaacaguuauggcauuccaccuaacaacacguaacggcgagccccauaugauaguaucacgacaggagaaagggaaaagccuuuuauucaaaacugaaaauggcgugaauauguguacucucauggcaauggaccugggagaacuuugugaagauacaauuacauauaauugcccauuauuaaagcaaaaugaaccugaggacauagacuguuggugcaacaguacaucaacguggguaacauacggaacguguacagcaacuggugagcaucgucgagaaaagagauccguugcacucguaccacacguugguaugggacuagaaacacgcacagaaacguggaugucaagugagggcgcauggaaacaugcucaacgaauugaaacauggguauuacgacaucccggguucacuaucauggcagcaauccuugccuauacaauaggaacuacuuauuuucagagaguacuaauauuuauucuucuaacggccgucgcucccagcaugacaaugcguugcauagggauuuccaauagagacuuuguagaaggaguaagcggcggaagcuggguugauauaguucuugaacaugguaguugugugacaaccauggcuaaaaacaaaccgacgcuugauuuugaauugauaaaaaccgaggcuaagcauccagcaacacuaagaaaguacuguauagaagcgaagcucaccaauacuaccaccgcgucgcgguguccgacucaaggagaaccuucacucagcgaagagcaggacaaaagauuuguuugcaaacauucaauggucgaccgaggcugggguaaugguuguggccucuuuggaaaaggaggcauaguuaccugcgcgauguucacauguaaaaaaaauauggaaggaaagauaguacaaccagaaaacuuagaauacacaauagucauaaccccucacaguggugaagagaaugcuguagguaaugauacaggcaaacaugguaaagagauaaaaguuacgccgcaaucaucaauuaccgaagcagaguugacuggcuaugggacaguuacuauggaauguucuccacggaccggguuagauuucaacgaaaugguucuacuucaaauggaaaauaaagcauggcuaguacacagacaaugguuucucgacuuaccccuacccuggcuuccuggagcggacacccaaggcucgaauuggauacaaaaagaaaccuuagucacauuuaaaaacccacaugcuaaaaagcaggacguaguuguacuaggaucacaagagggugcaaugcauacagcacuaacaggagcuacagaaauccaaaugucaucaggcaacuuacuauuuacgggucauuuaaagugccguuuaagaauggacaaauugcaacuaaagggaaugaguuacucaaugugcacugggaaauuuaaaguaguaaaggagauagcagaaacucaacacggaaccauuguaauacgcguacaauaugaaggagauggaucgccaugcaaaauaccauuugagauaauggaccuagaaaagcgucaugugcucgggagguuaauaacugugaacccaaucgugacagaaaaagacagucccguaaauauagaggcagagcccccguucggagauucauauauuauuauaggggucgagccaggacaacugaaauuaucaugguuuaagaaagguaguucuauaggucagauguucgagaccacuaugagaggcgcuaaacgaauggccauauuaggggauacagcuugggacuuugguucucugggcggcgucuuuacaaguauagguaaggcacuucaccaaguauuuggagcaauauacggcgcagcauuuagcgguguaucauggacuaugaaaauucuaaucgggguagucauaacuuggaucgguaugaauucaagaucaacgagccuuagugugucacuaguauuaguaggaguaguuacuuuauaucuagguguaaugguucaagcagacagcggcugcguuguaaguuggaaaaacaaagagcugaaaugugguagugguauauuuauuacugacaauguacauacuuggacugaacaguauaaauuucaaccugaaaguccuaguaaauuggccagugcaauacaaaaggcccacgaagaaggaauuugugguauaaggucgguaacacgucucgaaaaccuaauguggaaacagaucacaccagaacuaaaucauauccuaucugaaaaugaaauaaagcucacuaucaugacuggugauaucaaggguauaaugcaagcugggaaaagaagucuucgaccucaaccaauagaauuaaaauacucauggaaagcauggggaaaagcgaaaaugcuaagcacggaguuacacaaccauacauuccuuaucgacggaccugaaacagcagaauguccgaauacgaaucgagcuuggaauucacuugaaguagaggauuacggcuuuggcguuuucacuacuaauauaugguuaaaacuaaaagagaggcaggacguguuuugugacucuaaacuuauguccgcagucauaaaagauaaccgggccguccacgccgauauggguuacuggauugaauccgcgcuaaacgacacauggaaaauugaaaaagcaucauucauagaggugaaaucuugucauuggccgaaaagccacacauuauggucaaacggaguacuagagagugaaaugauaauaccuaaaaacuuugcggguccagugucucagcacaauuaccgacccggauaccauacacaaacagcuggcccauggcauuugggcagacuugaaauggauuucgauuucugcgagggaacaacaguagugguaacagaagauugcggaaauagagguccgagccuacgcacgacaacggccaguggaaaacuaaucacagaaugguguugucgaucuugcacucuacccccacugagauaccgcggggaagauggcugcugguacgguauggaaauaagaccucucaaggaaaaagaagagaaccuagucaacucacugguuaccgcaggucacggccaaauagauaauuucucccuuggaguuuuagggauggcguuauuucuagaagaaauguuacguacaagaguugggacgaaacacgccaucuuacucguagcgguauccuucgugacgcucaucacuggaaacaugucauucagagauuuagggagaguuaugguaaugguaggggcuacuaugacugaugauauagguaugggaguuacguaucuagcauuacuggcagcuuucaaaguaagaccgacauuugcggcuggguuauuacugagaaaacucacaaguaaagaacuuaugaugacuacaauaggaauuguccucuuaucucaaagcaccaucccagaaacaaucuuagaauuaacagacgcacucgcucuagguaugaugguucuaaaaauaguccguaauauggaaaaguaucaacucgccgucacuauuauggcaauucuauguguuccaaaugccgugauauuacaaaaugcuuggaaaguaagcugcacaacgcucgcugugguaucugugaguccuuuacucuuaaccucaucacgucaaaaagcagauuggauuccucuagcauugacaauaaaaggacuuaacccaacagcgauuuuccuaacuacauuaagcagaacauccaagaagaggaguuggccgcugaaugaagcuauaauggcaguuggcauggugaguauuuuagcguccagucuccugaaaaaugacauaccgaugacgggaccacuagucgcggggggucuccuaacaguuugcuacguauuaacaggccgaucagcagauuuggaauuagaacgagcagcagacguaaggugggaagaacaagcagaaauaagugggaguaguccgaucuugucuauuacaauaucagaagaugguagcaugagcauuaaaaaugaggaagaagaacaaacucugaccauacucauucguaccggucucuuaguuauaucaggguuauuccccguaagcaucccaauaacggccgcugcaugguaccucugggaagugaaaaaacaacgcgcaggaguccugugggaugucccuucccccccaccuguaggaaaagcagaauuagaagacggggccuaucggauaaagcagaaaggcauuuuaggauacucacaaauaggcgccggcgucuauaaagaaggaacuuuucauacgauguggcauguaaccagaggagccguauuaaugcauaaaggaaaacggaucgaacccucgugggcggauguaaagaaagacuugauauccuauggaggggguuggaaacucgaaggagaauggaaagaaggugaagaaguucaggucuuagcucucgaaccuggaaaaaacccaagggccguacaaacaaaaccgggcuuauuuaaaacuaauacggggacaaucggggcagugucacuagauuucucuccagggacaagcgggucuccaauuguagacaaaaaaggaaaaguagugggcuuauauggaaauggagucguaacgcgaagcggaacuuacguaagugcaauagcacaaacagaaaaaucgauugaagauaaccccgaaauagaggaugacaucuuucgaaagaaaagacugacgaucauggaccuucauccaggugccgguaaaacuaagcgauaucuuccugccauugucagggaagcgauaaaacgcggcuuaagaacauuaauccuagcuccgacaagaguuguagcagccgaaauggaagaagcacuuaggggucuaccgauacgauaucaaacuccugcaauacgagcggaacauaccgguagagaaauuguagauuugaugugucaugcuacauucacuaugagauuacugagcccaauuagagugccgaacuacaaucuaauaauuauggacgaagcacauuucaccgacccugcaagcauagcugcgagagguuauauuucgacacgaguugaaaugggcgaagcagcggguauuuucaugacggcuacuccgccugguaguagggauccguuuccacaaaguaaugccccuauaauggaugaggaacgcgagauuccggaacgcagcuggaacucaggccaugaauggguuacagauuucaaggguaagacaguaugguucgucccaaguauuaaggcaggaaacgauauagcugcaugccuuagaaaaaacggaaagaagguaauacaauugucuaggaaaacuuuugacucagaguauauuaagacucggacaaacgauugggacuuuguagugaccacagacauaucggaaaugggcgccaauuuuaaggcagaacggguaauagauccucgaagaugcaugaaaccaguuauucucacagauggggaagagcgugugauucuagcggguccgaugccaguuacacacuccagcgcagcacaacgaaggggaaggguuggaagaaacccuaaaaacgaaaacgaccaauauaucuacaugggagaaccauuagaaaacgacgaagauugugcgcauuggaaggaagccaaaaugcuacuagauaacauaaauacuccagaggguauaauaccaaguauguuugaaccagaaagggaaaaagucgacgcgauagauggggaauauagguuaaggggagaagcacggaaaaccuucguagaccuuaugaggagaggcgaucuuccaguuuggcuugcauauagaguagcugcagaagguaucaacuaugcugauagacgauggugcuuugauggaguaaagaauaaccagauccuugaagagaauguggaaguagaaauauggacgaaggaaggugagcgaaaaaaauuaaaaccaagguggcuagaugcgcggauuuacagcgauccucuugcuuugaaagaauuuaaagaguuugcagcuggacgaaagucacuaacauuaaaucugauaacagaaauggggagacuuccaaccuucaugacccaaaaagcucguaaugcacuggacaauuuagcagucuugcauaccgcugaagcuggugggagagcguacaaccacgcacuguccgagcuucccgagacuuuagaaaccuuauuauuauuaacauuauuagccacgguuaccggcggaauauuucuuuuucuaaugucuggaaaaggaauagguaagaugacuuuagguauguguuguauuaucacugcauccauauuacugugguaugcacaaauacaaccucauuggaucgcggcaucaauaauacucgaguucuuucucauuguauuauugaucccugaacccgagaaacaacgaacaccacaagauaaucaacuuacuuaugugguuaucgccauccuuacugucguagcggccacaauggcaaaugaaauggguuuuuuagaaaagacuaaaaaggacuucggucucggcuccauuacgacacaacaaccagaaucaaauauuuuggauauugauuuaagaccagccucugcguggaccuuauacgcagucgcgacuacauuuauaacaccuaugcuucgucauucuauugaaaauucaucaguaaaugucucguuaacugcaaucgcuaaccaggcgacuguuuuaaugggcuuggguaaaggauggcccuuaagcaaaauggacaucgguguuccgcuucuagcgauaggcuguuauagucaagugaauccaauuacacuaacagcggcacuacuuuuguuaguggcucauuacgcuaucauugggccaggacuucaagcaaaggcaacaagagaagcucaaaaacgagcugcugcuggaaucaugaaaaacccgacaguagauggaauaacggugauugauuuagauccgaucccuuaugaucccaaauucgaaaaacaauuaggucaaguaauguuacuaguacuaugcgugacacagguuuuaaugaugagaacaacgugggcauugugcgaagcucucacauuggcuacaggacccauaaguacguuaugggaaggaaacccuggucgauuuuggaauacuacuauagcuguuuccauggcuaacauauuuaggggaucauauuuagcaggagcgggacuauuauuuucaauaaugaagaauacagcgaacacgaggagagggaccggaaauacgggugaaacacugggggaaaaauggaaaaauagguuaaaugcguuagggaaaagugaauuccaaauuuacaaaaaaucugguauacaagaaguugauaggacacuagcaaaagaaggaauaaaacgcggagaaacagaccaccaugccguuuccaggggaucugcaaaauuaagaugguucauagaaagaaaccuugugacaccagagggaaaaguaguggauuuaggcugugggcggggcgguuggagcuacuauuguggcggacuaaaaaauguaaaagaggugaaagguuuaacuaagggagggccaggccacgaagaaccaauaccuaugucaacuuauggguggaauuuaguacguuuacagucaggugucgauguguuuuuuacaccuccugaaaaaugugauacgcuccuaugugacauaggggagaguucaccgaacccaacuguggaagcaggcagaacguugcgcgugcuuaaccuagucgaaaacuggcuaaacaacaauacacaguuuuguauuaaagucuugaacccuuauaugccaucaguuauugaaaaaauggaggcuuuacaaaggaaauaugggggggcucuaguaagaaauccucuaucccgaaacucuacacacgaaauguacuggguaucaaacgccucgggaaacauugugucgucagucaauaugaucaguagaaugcuuauaaaccgcuuuacaaugcgccauaaaaaagccaccuacgagccggauguagauuuaggcucuggaacgagaaauauuggcauugaaagcgagacuccaaaccucgauauaauuggcaaaagaaucgagaaaaucaaacaagaacaugaaacaagcuggcauuacgaucaggaucacccuuauaaaacuugggcuuaucaugguagcuaugagacuaaacaaacuggaucagccagcucaaugguaaacggcgucguccgucuccugacgaaaccuugggaugucauaccaaugguaacucaaauggcuaugacggauacuaccccauucggacagcaaagggucuucaaggaaaaaguagauacuaggacacaggagccaaaagaggguacaaagaaacuaaugaagaucacagcagaaugguuauggaaggaauuagguaaacgaaagacuccaagaaugugcacacgugaagaauucacaagaaagguacguuccaacgcagcguuaggcgcuauauucacagacgaaaauaaauggaaaucagcaagggaagcggucgaggauucugguuucugggaauuaguggauaaagaacguaacuugcacuuagaaggaaagugugagacguguguguauaauaugaugggaaagagagaaaaaaaacugggagaauuuggcaaggcaaaaggaagccgcgcaaucugguacaugugguugggagcccgauuucucgaauuugaagcuuugggauuucuaaacgaagaucacugguucagcagagaaaauucacuaucaggaguggagggagagggauuacauaaguuaggguacauucucagggauguaaguaagaaagaaggcggagcgauguaugcagaugauacugcgggaugggauacuagaauaacauuagaagauuuaaaaaaugaggaaaugguaacaaaucauauggaagggguucacaaaaaauuagcagaagcuauauucagauuaacauaccaaaauaaaguuguacgaguucaacguccgaccccacguggcacgguaauggauauaauuaguagacgagaucaaagaggaagcggacaaguugugacguacggacuaaauacuuuuacuaauauggaggcccaacuuauacgucaaauggaaggagaaggaguauuuaaauccauucaacauuuaacaguuacugaagaaaucgcggucaaaaauuggcucguuagggucggucgcgaaagauuaagucgaauggccauauccggcgaugauugugugguaaagccucuagaugaccgauucgccuccgcgcuuacggcgcugaaugacaugggaaaagugagaaaagacauacaacaaugggagccuaguagaggguggaaugauuggacacaagugccuuuuugcagccaccacuuucaugaacuuaucaugaaagacggacggguauuaguggucccuugcagaaaccaggaugaacucauaggcagagccagaaucucgcagggcgcuggauggucgcuaagagaaacugccuguuugggaaaaaguuacgcucagauguggaguuuaauguacuuucaucgccgugauuuacgcuuagcagcuaacgcuaucuguucagcaguucccagucauuggguuccuacaucucguacgacguggucgauucaugcaacucaugaguggaugacuacagaagauaugcuaacaguauggaauagaguguggauccaagaaaauccguggauggaagauaaaaccccgauagagucgugggaggaaauaccuuauuugggaaaacgagaagaccaauggugugguaguuuaaucggucugacuuccagagccacaugggcaaaaaacauccaaacugcuauaaaucaagugaggucccuuauagguaaugaagaguauacugacuacaugccgucaaugaagagauuucgccgagaggaagaagaagcaggaguacuaugguaa

SEQ ID NO: 22890 - RNA, 9876 nt, Artificial Sequence
  derived and/or modified CDS sequence (opt6) from DENV-2__JN851120__SS-prME
acagcuggaauaauuauuaugaugauaccuacaguuauggccuuccaucuuacaacgcgaaacggagaaccacauaugauuguuucaaggcaggaaaaaggaaaaucucuccuuuucaaaacggaaaacgguguaaauaugugcacgcuaauggcgauggaucuuggagaacuuugugaagacacuauaacuuauaauuguccauuauuacgucagaacgaaccugaagacauagauuguugguguaauucaacaaguacuuggguuaccuauggaacuugcacggccacaggagaacaucgacgugagaaaagaagcguagcguuaguaccacacguggguauggguuuagaaacccguacagaaacuuggaugaguucagaaggugcauggaaacaugcacaaagaauugaaacauggauacugagacacccugguuuuacuaucauggcugcgauucuggcuuauacuguuggcacuacauauuuccaaagaguuuuaaucuuuauacugcugacggcuguaacaccaaguauggcuaugcgaugcaucgggauaucgaauagggauuucguggaaggaguuucugggggcagcuggguggauaucguucucgaacauggcaguugugucacuacaauggccaaaaauaaaccaacuuuggauuuugaacuaauaaaaacggaagcuaaacauccugcaacgcuuaggaaauacugcguggaagcgaaauuaacuaauacaacgacagcaagccgcuguccgacacaaggagagccuaguuuaaaugaagaacaagauaaaagguuuguuuguaaacacuccauggucgaccgaggaugggguaauggguguggauuauucgguaaagguggaauuguaacaugcgcaauguuuacguguaaaaagaacauggaagguaaaguuguucaaccagaaaauuuagaguauacuauaguuauuacaccacauagcggugaagaaaaugcaguuggaaacgauacgggcaaacaugggaaggagauuaaaguaacuccucagucaaguauuacggaagcagaguuaacuggauacgggacaguaacaauggaauguucgccccgaaccggccuugauuucaaugaaauggucuuguuacaaauggaaaauaaagccugguuaguucaccgucagugguuucuagauuugcccuuacccugguuaccaggagcagauacacaggguaguaauuggauacagaaagagacucuugucacuuucaagaauccucaugcaaagaagcaggacgucguaguacuggguagccaagagggugcuaugcacacagcgcuaacaggggcaacugaaauacaaauguccucugggaacuuauuauucacgggacaucuaaaauguagauuacguauggacaaauuacaacuuaagggaaugaguuacaguauguguacugguaaauucaaaguagucaaagagauagcagaaacgcaacauggaacaauaguaauuagaguacaauaugaaggcgacggcucccccugcaagauaccguuugagaucauggaccuugagaaaagacacguucuagguagacuaaucacuguuaauccaaucguaacugaaaaagauucgcccgucaauaucgaagcugaaccaccuuuuggagauucuuacauaauuauagggguugaaccaggacaacuuaaauuaaguugguuuaaaaagggauccucuauuggacaaauguuugagacuacaaugcguggugccaaacgaauggcuauauuaggggauacugcaugggauuucgguagccuuggaggcguguucacaaguauaggaaaagccuugcaccaaguauuuggagcaauuuacggagcagccuuuaguggcguaaguuggacaaugaagaucuuaauuggaguaguuauaacguggauugggaugaacucucgaaguaccagccucucagugucguuaguacuuguaggaguagugacauuguaucuuggugucaugguccaagcagauucaggauguguaguaucauggaaaaacaaagaacuuaaauguggaucgggcauauucauuacugauaauguccauacauggaccgaacaauauaaguuccaaccggagaguccuucgaaauuagcgucugcuauacagaaagcacaugaagaaggcauauguggcauuagaaguguaacgagauuggaaaaccuuauguggaaacaaaucacaccagaacuaaaucauauucugacagaaaacgaaguaaaguugacuauaaugacgggcgacauuaaaggcauuaugcaagcugguaagcguagucuucgaccgcagcccacagaauugaaauacucauggaaagcauggggcaaagcaaaaauguugucaacagaauuacauaaccauacuuucuuaauagaugguccugaaacggccgagugcccuaauacgaacagggcauggaacaguuuagaaguagaggacuacggguuugguguuuuuacaacaaauauauggcuaaaguuaaaggaacggcaagauguuuucugugauucuaaacuuaugucggccgcgauuaaagacaaucgugcuguucaugcagauauggguuacuggauugaaucugcucuuaaugauacauggaagauagagaaagcguccuucauagaagugaaaucaugucauuggcccaaaucacauacucucuggaguaauggagugcuugaauccgaaaugauuauuccuaaaaacuucgccgggccaguaucacaacauaauuaccgucccggcuaucauacucagaccgcugggccauggcaucuaggaagguuagaaauggauuucgauuuuugugaaggcacuaccgugguagucacugaagauugcgguaaucgaggucccagccuaaggacuacuaccgcuucgggaaagcugaucacagaaugguguugucgaaguugcaccuuaccaccguuacgcuacagaggcgaagauggauguugguacgggauggaaauaaggccccuaaaggaaaaagaagagaaucuaguuaacagcuuaguaacagccggacacggccagaucgauaauuuuaguuuagguguauuagggauggcccuauucuuggaggaaauguuaagaacuaggguaggaacgaaacaugcaauacuauuaguagcuguuucuuucguaacacuuaucacagggaacauguccuuuagagaccuaggacgcguaauggucauggucggugcuacaaugacggacgauauagguaugggaguaacauaccucgcauuacuggcagcauuuaaaguaagacccacguuugcagccggauuacugcuaaggaaauugacuucaaaagaauuaaugaugacaaccauagggauagucuuacuaucacagucaacuauacccgaaaguauucuagaauuaacagaugcauuggcauuaggaaugaugguccugaaaauaguccgcaacauggaaaaguaucagcuagccgucacuauaauggcaauacugugcguuccaaaugcagugauauuacagaacgcguggaagguaucuuguacaacauuggcugugguguccguuuccccauuacuacugaccucaucucaacagaaagcugauuggaucccauuagccuugacgauuaaagggcuuaauccgacggccauauuuuuaacaacacuaucgcgcacaucaaagaagcgaucuuggccuuuaaaugaagcgauaauggcagucggaauggucucuauauuggcaaguucacuccugaagaaugacauaccaaugacaggcccccuaguagcggguggacuuuugacaguauguuauguacucacaggacggucagccgaucuugaacuugaaagagcagcugauguaagaugggaagaacaggcagaaaucucgggaaguucacccauacuaucgauaacaauaucugaagauggaucaaugagcaucaaaaaugaggaggaagaacaaacguugacgauacuuaucaggaccggacugcuagucauaagugggcuauuucccguuagcauucccauaacagcggcggcuugguauuuaugggaaguaaagaaacaaagagcaggcguccucugggacguuccuucgccaccuccugugggaaaagcagaguuagaagauggcgcuuauagaauuaaacaaaaagggauccuagguuauucacaaauaggugcaggaguguacaaagaagggacauuucacaccauguggcaugucacacguggggcagucuuaaugcacaaaggcaaacgaauagaaccgaguugggcugaugucaagaaagacuugauuucguacgguggagguuggaaauuggagggugaauggaaggaaggggaagaaguccagguuuuggcauuagaaccaggcaaaaauccacgcgcuguccagacuaaaccaggauuauuuaaaacgaauacaggaacuauaggugccgucagucuagauuuuucgccugguacgucaggcucucccauaguugauaaaaagggaaaagucgucggucuguauggcaauggggucguaacacgcucugguacuuauguaagcgcaauugcccagaccgagaaaucaauagaagacaaucccgaaaucgaagacgauauuuuuagaaagaaaagacugaccauuauggaccuacauccaggugcagggaaaacuaaaagauauuuaccagcaauuguacgugaagcgauuaaacgaggauuaaggacauuaauacuggcacccacucguguaguagcggcugaaauggaagaagcacucagaggucuaccgauucgauaucaaaccccagccauaagagccgaacauacagguagagaaauaguagauuuaaugugccacgcuacauucacaaugaggcuauuaucuccgauucgagugcccaauuauaaccuuauaauaauggaugaagcacauuuuaccgauccggcaucaauugcagcuagaggauauauaucuacaagaguagaaaugggggaagcggcaggaaucuuuaugacugcaacgccaccuggcagucgggacccauuuccccaaaguaacgcgccaauaauggacgaggaacgagaaauaccagaaaggaguuggaacagcgggcaugaguggguuacagauuuuaaagggaaaacaguaugguucgucccgaguauaaaagcaggaaacgauaucgcggccugucuacggaagaauggcaagaaaguaauccaacuaagccgaaaaacauuugauucagaauauauaaaaaccagaacuaacgacugggauuucguagugacaacggauauauccgaaaugggugccaauuuuaaagcugagcgcgugauugacccccgccgaugcaugaaaccuguaauucuuacagacggagaggagagaguaauucucgcuggacccaugccaguaacucauucuagugcugcucagagacgaggucgagugggaagaaaucccaaaaaugaaaaugaucaauacauauacaugggugaaccucuagagaacgaugaagacugugcccacuggaaagaagcuaagaugcuucuagacaacaucaacaccccggaagguauuauaccaucgauguucgaaccagaaagagaaaaaguggaugcgauagacggcgaauaccgacuaagaggugaggcccgcaaaacuuuuguagaucugaugcgaagaggcgauuuaccaguuuggcucgcauaucgaguugcagcagagggcauaaacuacgccgauagacgauggugcuucgauggagugaaaaauaaccaaauccuugaagaaaauguagagguagagauauggacgaaggaaggggaacguaagaaacuaaaaccacgaugguuagaugcgcgaauauauagugauccauuagcacuaaaagaguucaaggaguucgcagcaggcagaaaauccuugacccuaaauuuaauuacagagauggguagacugccgaccuucaugacacaaaaagcuaaaaaugcucuagacaacuuagcaguacuccauacagcugaagcaggaggacgagcguacaaccacgcucucucugaguugccugaaacguuggagacacuccuauuauugacuuugcuagcuacggugacgggagguauuuuucuauuccuaaugucagguaagggaauaggaaaaaugaccuuaggcaugugcuguauaauaacugccucaauacuucuuugguacgcgcaaauacagccucauuggauugcagcaaguauuauucuagaguucuuuuuaauaguccucuugauaccggaaccagaaaagcagcggacaccucaggacaaucagcuuacguacguagucauugcaauacuaaccguaguggccgcgacaauggcaaacgaaauggguuucuuggagaaaacuaagaaagauuuuggucuagguagcauaaccacacaacaaccugaaagcaacauuuuggacaucgauuugcgcccugcuucugcguggacucucuaugcuguggcaaccacuuuuauuacucccauguuacgucauucaauagagaacaguagcguuaaugucucuuuaacagcuaucgcuaaucaagcaacaguauuaaugggacucgguaaaggauggccccucucaaaaauggauauuggagugccuuuauuagccauaggcuguuauucacaaguaaacccuauaaccuugacagccgcuuuacuauuauuaguugcgcacuaugcgauaauugguccaggucuacaagcaaaagcaacccgcgaagcccagaagagggcagcagcggguauuaugaaaaauccgacgguugaugggaugacaguaauagaucuagaucccauaccuuaugauccgaaauucgaaaaacaguuaggacagguaauguuauuaguucucuguguaacacagguucugaugaugcguacaacgugggcacuaugcgaagccuuaacauuggcaacaggccccauuucaacccuuugggaaggcaauccugggagauuuuggaauacaacuauagcggugaguauggcuaacauauuuagaggcucuuaucuagcaggcgcaggauuacuuuuuagcauaaugaaaaauacugcaaauacuaggagagggacgggaaauacaggugaaacuuuaggcgaaaaauggaaaaauagacuuaaugcacuuggcaaaucggaauuucaaaucuauaaaaagagugggauacaagagguggacagaacgcucgcuaaagaaggcauuaagaggggagaaaccgaucaccaugcugugucucguggcucugcgaaacuuagaugguuuguagaacgaaaccuggugaccccagaaggcaagguaguggaucucggaugcggucgaggaggauggaguuauuauugugguggccuaaagaauguaaaagagguaaaaggauuaacaaaaggcgguccaggacacgaggaaccuauuccaaugaguacuuauggauggaaucuaguacguuuacaaucagguguugaugucuucuucacaccaccggagaaaugcgauacccuucugugugauaucggugaaaguucuccuaacccuacuguggaagcaggaagaacgcugcgaguauuaaaucucgucgaaaacuggcuaaauaacaacacccaauucuguauaaaagugcuaaaccccuacaugccaucgguuauagagaaaauggaagcauuacaaagaaaauacggaggagcacucguaagaaacccgcuaucaagaaacucgacacacgaaauguacuggguaaguaaugcaucagguaauauaguaucgucaguaaauaugaucaguaggaugcucauaaaucguuuuaccaugcgacauaagaaagccacauaugagccggacguagaccuugggaguggcacaagaaauaucgggauugaaagcgagacuccaaaccuggacauaauaggcaaaagaauugaaaagauaaaacaggaacaugaaacaaguuggcacuacgaucaggaccacccauacaaaacaugggcuuaccacgggucauaugagaccaagcaaacagguagugcuucuucaaugguaaauggcgugguaagguuauuaacaaagccuugggauguuauaccgaugguaacccagauggccaugacugauacuacaccauuuggucagcaaagaguauuuaaggaaaaaguggauacaagaacacaagaaccaaaagaaggaaccaagaaauuaaugaagauaacggcagaauggcucuggaaagaauuaggcaagaagaaaacaccaaggaugugcacccgugaggaauuuacaagaaagguacguagcaacgcagcacucggggccaucuucacagaugaaaauaaguggaaaagugcaagggaagcaguugaagauucagguuucugggaauuagucgacaaagaacgcaauuuacacuuagaaggaaaaugugagacguguguuuacaauaugauggguaaaagagaaaagaaacuaggugaauuugggaaagcaaaggggagcagagcaaucugguacaugugguuaggagcacgauuucuagaguuugaagcauuaggguuucuaaacgaagaucacugguucucgagagagaacucacuuaguggcguagaaggugaaggacuacauaaacucggcuauauucugcgagauguuucaaagaaggaaggcggagcaauguaugcagaugauacagcgggcugggauacaaggauaacacucgaagacuugaaaaacgaggaaaugguaacaaaucacauggaaggagaacauaaaaaguuagccgaggcaauauucaaacugacauaucaaaauaagguuguucgcguucaaagaccaacucccagaggaacaguaauggacauaauaucacgacgggaccaaagaggaucuggucagguuguaacuuauggauuaaauacuuuuacaaauauggaggcccaauuaauacgccagauggaaggugaaggagucuucaaaucuauucagcaauuaacagucaaggaagaaauagcagucaaaaauuggcuuauaagaguuggccgagaaagauuaucuaggauggcgauuagcggagacgauuguguagugaaaccacuagacgaucgauuugcaagugcauuaacagcguuaaaugauauggguaaaguacgcaaggacauccaacagugggaaccgagccgaggguggaacgauuggacgcaaguaccauucuguucucaccacuuucacgaacuuauuaugaaagacggacgaguacuuguagucccaugcaggaaucaggaugaauugauaggucgagcacggauuucgcaaggagcgggauggucucuaagagaaaccgcaugccuagguaagagcuaugcgcaaauguggucguuaauguauuuucauagaagagaucuccgacuagcggcaaaugcaauaugcagcgcaguuccgagucacugggugccaacaaguagaacuacauggucuauccacgccacacacgaauggaugacaaccgaagacaugcuaacaguauggaacagggucuggauucaagaaaauccguggauggaagacaaaaccccagucgaauccugggaagaaauaccguaucugggcaaaagagaggaucaauggugcgggaguuugauaggauuaaccagccgagccacaugggcgaagaauauccagaccgcaauaaaccaaguuagaucauuaauugguaacgaagaguauacagauuauaugccuucaaugaagcguuuccgaauugaagaggaagaagcaggaguccuaugguga

SEQ ID NO: 22891 - RNA, 9876 nt, Artificial Sequence
  derived and/or modified CDS sequence (opt6) from DENV-2__JN851131__SS-prME
acugcggguguuauaauaaugaugauaccaacgguuauggcuuuucaucugacaacucgcaauggagaaccacacaugauuguaucaagacaagaaaaagggaaaucauuacuguuuaaaaccgaaaaugguguuaacauguguacacuaauggcuauagacuuaggugaauugugcgaagauaccauaaccuacaacugcccccuacuaaggcagaaugaaccugaagacaucgauuguuggugcaacaguacaucgacuuggguaacguaugguacauguacggcaacaggagaacauagacgagagaaaagaagcguugcuuuaguaccccacguggguauggguuuagaaacuaggacagaaacuuggaugagcagugaaggcgcuuggaaacacgcacaaaggaucgaaacguggguccuaaggcauccaggauucacaaucauggcugcaauauuagcauacacuaucggcacgacauacuuucaaagaguacuuauauuuauuuuacuuacagcaguagcaccgucaaugacuaugcgcuguauaggaauuucaaacagagauuucguagaaggaguuagugguggaaguugggucgacauaguauuagaacacggaucuuguguuacgacaauggccaaaaauaaacccacauuggacuuugaauuaauaaaaacggaagcgaaacaucccgcaacacuacgaaaauacugcauugaagcaaaacuaacaaauacuacaaccgcuagcagauguccaacgcaaggugaaccaagccuaaaagaagaacaagauaaaagauucguauguaaacacuccaugguagaucggggaugggggaacggauguggucuuuucggaaaagguggaauuguuacuugcgcuauguuuacauguaagaaaaauauggaagguaaagucguucaacccgaaaacuuggaauauacaaucgugaucacuccacauucuggagaagaaaacgcuguaggaaacgauaccggaaaacauggaaaagaaauaaaaguaaccccgcagucaucaauaacagaagcagaacuuaccggguaugggacgguuaccauggaaugcucucccagaaccggguuagauuucaaugaaaugguucuauuacagauggaagauaaagcgugguuaguacauaggcaaugguuccuugaccucccucucccaugguuaccaggagcagauacucaaggaucuaauuggauccaaaaagaaacccuugugacuuuuaaaaauccccaugccaagaaacaggacgucgugguacucgguagccaagaaggagcaaugcacacagcacuuacgggugcgacugaaauccagaugaguucagguaacuuacuguucacgggacacuuaaaauguagacucagaauggacaaacuccaacugaaaggcauguccuauucuaugugcacgggcaaauuuaaaguaguuaaagaaaucgcagaaacacaacauggcacgauugucauaaggguacaauacgagggagaugguucuccauguaaaauaccguucgagauaauggauuuagagaaacgacauguacucggacguuuaauuacaguuaacccuaucgucacagaaaaagauucgccagugaauauugaggcugaaccaccuuuuggagauucuuacauaauuauaggcguggaacccggucagcuaaaacuuucaugguuuaagaaaggcucgucgauuggucaaauguuugagacaacuaugagaggagcaaaaagaauggcuauauugggagacaccgcuugggacuuugggucgcucgggggcguauuuacgucaauuggcaaagcauuacaucaaguuuucggcgcaauauacggugcagcguuuucagggguuucuuggacaaugaaaaucuugauuggcguagugaucacguggaucggaaugaauagucgaucuacgagucuuagcguaagccuaguucuuguaggaguuguuacauuauaucuaggaguaaugguucaggcugacagugggugcguagugagcuggaaaaauaaagaacugaaauguggcagcggaaucuucaucacggacaacguacacacguggacagaacaguacaaauuccaaccugaaaguccauccaagcucgcaucagcgauucagaaggcacaugaggaaggcauauguggaaucagaucagugacaaggcuagaaaaucuaauguggaaacaaauuaccccugaacuuaaucauauauuaagugaaaaugaagucaaacucacgauaaugaccggcgauaucaaaggaauaaugcaagcagguaagcgauccuuacguccacagcccacggaauuaaaauauuccuggaaaacaugggggaaagcaaaaauguuaucgacagaacuucacaaucauacauuuuuaauagauggaccagaaacagcagaauguccgaauacuaauagagcguggaacagucuugaaguggaagacuaugguuuugguguauuuacaaccaauauauggcuuaaacuaaaggagcgacaagagguguuuugugauaguaaauugaugagcgcggccaucaaagacaauagagcaguccacgcagauauggguuacuggauugaaagugcauugaacgacacauggaaaauagaaaaggcaucauucaucgaaguaaagaguugucacuggcccaaaagucacacauuauggagcaacggagugcuggaauccgagaugauuauaccuaaaaauuucgcgggccccgugucgcaacauaacuacagaccuggcuaucauacacaaaccgcuggaccuuggcauuuggggaagcuagagauggacuucgauuucugugagggcacaaccguagucgucacagaagauugcggaaacagaggacccagcuugcguacuacuacggcaaguggaaagcucauuacugaguggugcuguagaucuugcacucuaccuccauugagauaucgaggcgaagauggaugcugguauggaauggaaauuaggccgaguaaagaaaaggaggagaauuugguaaauucauuggucacggcuggccacggccaaauugauaacuuuagucuuggaguauuaggaauggcuuuguuucuagaggaaauguuaaggacaaggguuggcacuaaacacgcaauacuauuaguagcgguaaguuuuguuacacucauuacaggaaauaugaguuuccgugaucuugguagaguuaugguaaugguaggggccacgaugacagacgacauaggaauggguguaaccuacuuagcgcucuuagcugccuucaaaguaagaccaaccuuugcagcuggauuauugcuccggaaauuaacuagcaaggaacuuaugaugaccacuauagguauugucuuguuaucgcaaucaacaauaccugaaaccauuuuggagcuaacagaugcacuggcuuuagggaugaugguauuaaaaauugugcguaauauggagaaauaccaacuagcuguaacuauaauggcaauucugugcguuccuaacgcgguaauucuacaaaaugcauggaagguuagcuguaccacucuugcggucgucaguguaucaccucuacuguuaacauccucacaacaaaaagcagauuggauaccacuagcacuuacaauaaagggucuaaauccuacggcuauauuucugacgacauuaagucguacaaguaaaaagagaagcuggcccuuaaaugaggcaauuauggccguuggcaugguaucaauacuugcaaguagccuucugaaaaaugauauaccaaugacuggaccgcuaguagcaggaggccugcucaccguguguuauguucuaacuggaagaagcgcugacuuagaacucgagagagccgccgacguucgcugggaagaacaagcugaaauaucgggcucgucaccgauccuaaguauaacaauaucagaggauggcucaaugucaauuaaaaacgaggaagaagaacaaacucuuacuauucugaucagaacuggacuccuagugauuaguggucuauucccaguuucuauuccaauuacggcagcugcgugguauuugugggaagugaaaaagcagagagcagggguguugugggacgugccaucgcccccaccuguuggcaaagcagaacuugaagauggggcauauagaauaaaacaaaaagguauccugggcuacucccaaauuggcgcgggcguuuauaaagaaggaaccuuucacacaauguggcacgucaccagaggggcuguucucaugcauaagggaaaaagaauagaaccuucgugggcugacgucaagaaagaucucauaagcuacgguggaggauggaaauuagaaggagaauggaaggaaggagaagaaguacaaguauuagcauuagagcccggcaaaaauccacgagcgguccaaacgaaaccaggccuauuuaaaacaaacacuggaacaauaggugcaguuagucuagauuuuucacccggaaccagcgggagcccaaucgucgauaagaaaggcaaaguggucgggcuuuauggcaacgguguugugacucgcagugguacauacguaagugcaauugcacaaacagaaaaaucaauugaagauaauccagaaaucgaggaugacauuuuucguaagaaaagacuaacaauuauggauuuacaccccggagcaggcaaaacaaaaagauauuuaccugcaauagugagagaagcgaucaaacgcggucuaagaacacuaauauuagcgccuacgcgaguuguggcugccgaaauggaagaggcauuacgaggccuacccauucguuaccagacacccgcaauacgugucgaacauacaggacgagagauaguagaccuuaugugucacgcuacuuucaccaugcgucuacuuagcccuaucaggguaccgaauuacaaucuuauaauuauggaugaagcacauuucacagaucccgcaaguauugcggcuagaggauacauaaguacgaggguagagaugggggaagcagcggggauuuuuaugaccgcaacaccaccuggcucaagagacccauucccucaaucuaaugccccaauuauggaugaagaacgagaaauaccagaacgcucauggaacuccggacacgaguggauuacggauuuuaagggcaagacuguuugguuuguuccuaguauaaaggccggaaaugacauugcggccugccuucggaaaaaugguaagaaagucauccaacucaguagaaagacuuucgauucagaauauaucaaaacaagaacaaacgauugggauuucguagucaccacagauauaucagaaaugggugcaaauuucaaagcugaaagaguaauagaucccaggcgaugcaugaagcccguaauauuaacugauggagaggaaaggguuauauuagccggucccaugcccgucacacacaguucugcagcucagagaaggggccgaguggguagaaacccgaagaacgaaaacgaccaauacauauacaugggcgaaccacuagagaacgacgaagauugugcacauuggaaagaagcaaaaaugcuauuagacaacauuaauacaccggaaggaaucauacccucuauguucgagccggaaagagaaaaaguggaugccauugauggagaauacaggcucagaggggaagcuagaaaaaccuucguagaucuaaugagacgaggcgaccuacccguguggcuggcuuauaggguugcagcugagggaauaaauuacgcagacagacguugguguuucgauggcgugaaaaauaaucaaauauuggaggaaaacguugagguugaaauauggacaaaggaaggugaaaggaagaaacuuaaaccgagauggcuggaugccagaauauauucggauccgcuggcuuuaaaagaguuuaaagaguucgcugcgggacgaaaaucucuuacgcuaaauuugauaacggaaaugggaagacuaccaacguuuaugacucaaaaagccagaaacgcucucgauaaucucgcaguguuacacacagcagaagcaggagggcgagcguauaaucacgcucuauccgaacuaccagagacuuuggaaacacuucuucuucuuacccuacuugcgacaguaacaggaggcauauuucucuuucucaugucgggcaagggaaucggaaaaaugaccuuagguaugugcuguaucauuacagcgucagucuuauuaugguacgcacaaauucagccacauuggauugccgcauccaucauacuagaguucuuucuaauaguacuacuuauuccugaaccagaaaaacaaagaacaccacaggacaaccagcuaaccuauguaguaauagcaauuuuaacuguaguugcugcgacaauggcgaacgagaugggcuuccuagagaagacaaagaaggauuuuggauuagguucaauagccauacaacaaccagagucgaacauauuggauauugaucuucgaccugccucagccuggacuuuauacgcgguugccacaaccuucaucacuccuaugcugagacauucgauugagaauagcagugucaauguguccuuaacggcaauagcuaaucaagcaacuguacuaaugggucuaggcaaagguuggccuuuauccaaaauggauauuggaguaccauugcuagcaauaggaugcuacagucaagugaacccaauaacauuaacagcggcucuacuccuuuugguugcgcacuaugcaauaaucgguccaggccuucaagccaaagccacgagggaagcucagaaacgugcugcggcgggaauaaugaagaauccaacuguugacgguauaacaguaauagaucuagacccaauaccguacgauccaaaguuugaaaaacaauugggccagguuaugcuguuaguccuuugcguaacacaaguauuaaugaugaggacaacgugggcauuaugcgaggcacuaacauuagccacaggaccuauaucaacacuaugggagggcaauccagggagauucuggaauacaacaauagcggugucaauggcuaauauuuuuaggggaucuuaucuagccggugcgggccuauuauucucaauaaugaaaaauacggcaaauacccgucguggaacgggaaacacgggugaaacuuugggagagaaauggaagaaucgauuaaacgcauuggguaaaagcgaguuucaaaucuauaaaaaguccgguauacaagaaguggacaggacucuggcaaaagaggggauuaagagaggagaaacagaucaucaugcaguaucuagagguagcgcaaaguuacgaugguuuguugaaagaaaucucguuacaccagaaggaaaggugguagaucuagguugcgggagggguggcuggucguauuauuguggcggacucaaaaauguaaaagaaguaaaaggucugacuaaagggggaccaggccaugaagaaccgauaccuaugagcacguauggauggaacuuaguaaggcuucaauccggaguagauguauucuucacaccaccagagaagugugauacacuuuuaugugacauaggcgaauccucgcccaauccaaccguagaggcggguagaacacuccguguauuaaacuugguugagaauuggcuaaacaauaauacucaauuuugcauuaaggugcuaaacccuuacaugccaagcgucaucgagaaaauggaagcacuacaacguaaauauggaggugcccuaguaagaaauccauuaucgagaaauucuacacacgaaauguauugggucucuaaugcaagcggaaauauaguaucgagcguaaacaugauuucacgcauguuaauuaauagauucacuaugagacauaagaaagcuacauaugaaccagacguugacuuaggaucggguacaaggaacaucggcauagaaucugaaaaaccaaaccucgauauaauagguaagcgaaucgagaaaauuaaacaggaacacgagacgaguuggcauuacgaccaagaccauccguacaagacuugggcuuaccacggaucauaugaaacuaagcaaacaggaagugcuagcagcaugguaaauggaguagugcgacuucucacuaaaccuugggacguuauuccaaugguuacccagauggcgaugacugacacaacaccuuuugggcaacaaagaguauuuaaggaaaagguugacacucgaacacaagaaccgaaagaggguacgaagaaacuuaugaagauaacagcggaaugguuauggaaggaauuaggcaagaagaaaaccccaagaauguguacacgggaggaauuuaccagaaaaguaagaagcaacgccgcccucggagcuaucuuuaccgaugaaaauaaauggaaaagugcacgcgaagcuguggaagauaguggauucugggaauuaguuaauaaagagaggaaucuccaccuagaagggaagugugagacaugcguauauaacaugauggggaaacgugagaagaaauuaggagaguucggaaaagcaaaagggucaagggcuauaugguauaugugguuaggcgcaagauuuuuagaguucgaggcuuuaggauuuuuaaaugaagaccacugguuuucaagagaaaauucgcuaucugguguugagggagaaggcuuacauaaacuuggguauauccugcgagacguaucuaaaaaggaaggaggugccauguaugcggaugauacagcggggugggauacaagaauaacucuagaagaccucaaaaaugaagaaaugguuacgaaccacauggaaggugaacauaagaaacucgcagaggccauauuuaaauuaacguaccaaaauaaaguaguaaggguacaaagaccaacaccccgaggaaccguuauggauauaaucagucgaagggaucaaagaggcagcggccaaguggugacuuauggacuaaacaccuucacaaauauggaagcacaacuuauucggcaaauggaaggagaagguguuuucaaaucuauccaacauuuaacuguuacagaagaaauagcuguuaaaaacugguuggucagaguggggcgggaaaggcuaaguagaauggcuauuaguggggacgacuguguugucaaaccuuuagaugaucgauucgcauccgcuuuaacagcacuaaaugauaugggcaaggucagaaaagauauccaacagugggagccauccaggggguggaaugauuggacccaaguaccauuuuguucgcaccauuuucaugaguugauaaugaaagauggaagaguucuggugguuccauguagaaaccaagacgaacucauugggagagcuagaauaagucaaggugcuggauggucacuacgagaaacagcauguuugggaaagagcuacgcacaaaugugguccuuaauguauuuucacagaagggauuuaagacuagcagcaaaugcgauauguagugcuguaccaucucacuggguaccgaccucgcggacaacauggucaauccacgcaacgcaugaauggaugacaacggaagacaugcucacaguauggaacagagucuggauccaagaaaacccguggauggaagauaaaacaccugucgagucgugggaagagaucccguaccuggguaaaagagaggaccaguggugcggaucuuugauuggguugacgucucgagcuacaugggcuaagaauauacaaacagcaauaaaucaaguuagaagccuaauuggaaacgaagaauauacugauuauaugccuaguaugaaaagauuccgaagagaagaagaggaagcaggggugcuaugguga

SEQ ID NO: 22892 - RNA, 9876 nt, Artificial Sequence
  derived and/or modified CDS sequence (opt6) from DENV-2__JN851122__SS-prME
accgcagguauaauaauaaugaugauaccuacaguuauggcuuuccaccuaacaacuagaaauggagaaccccacaugauuguguccagacaagaaaaagggaaaagucugcuauuuaaaacugaaaauggugugaauauguguacacuuauggccauggauuugggcgaacuaugugaagauacuauuacuuauaacugcccacuacuacgacaaaaugagcccgaagauaucgauugcugguguaacucuaccaguacgugggucacguacggaacgugcacugcuacgggggaacauagacgagagaaacgaucuguugccuuaguuccucaugucgguaugggcuuggagacaagaaccgaaacauggaugucaucugaaggugcuuggaaacacgcccaacguauagaaacuuggauuuugagacacccaggcuuuacgauaauggccgcaauucuagcuuacacuauaggaacaacauauuuucagaggguauuaaucuucauacuuuuaacggcugugacuccuucgauggcgaugcguuguauugggauuuccaauagagacuucguagaaggcguaaguggagggucauggguugacaucguauuggaacacggaucuugcgugacuacaauggccaaaaauaaaccgacgcuagauuucgaacuaauaaagacagaagccaaacauccagccacacuacgaaaauauugcguagaagcaaaacuaacaaauaccacuacggcaucaagaugcccgacacaaggagaaccgucauuaaacgaggaacaggacaaaagguucgucugcaagcacagcauggucgacagaggcuggggaaauggcuguggauuguucgguaaaggaggaauagugacgugugcuauguuuacauguaaaaaaaauauggaggguaaaguuguccaaccagagaacuuagaguacacaaucgugauuacaccucauucgggggaggagaaugcaguagggaaugacacagggaaacaugguaaagaaauaaaagugacgccucaaucaucgaucacagaggcagaacugacaggcuacggaacuguuacaauggaauguaguccaagaacaggauuagauuucaaugagauggucuuacuacaaauggagaacaaagccuggcuagugcaucgucagugguuucuagaucuuccucuaccgugguuaccgggugcagacacacaaggcucaaauuggauucaaaaagagacacuggucacauucaagaacccgcaugcaaaaaagcaagauguuguaguacuaggaucacaagagggugccaugcacacagcauuaacaggagcaacugaaauccaaaugucgaguggcaaucuauuauucacuggccaucuaaaaugcagacuucgaauggacaaacuucaacuuaaagguaugagcuacagcauguguacuggaaaguuuaaagugguaaaagaaaucgcagaaacacaacaugguacgauugucauuagggugcaguaugagggugauggauccccguguaagauuccuuuugaaauaauggauuuagaaaaacgacacguucuagggagacuaauaacagucaauccaauagucacggaaaaagauagcccaguaaacauagaagcugaaccaccuuucggagauucguacaucaucauugguguugaaccugggcaauugaaacuaucuugguucaaaaaaggcucaaguauagggcaaauguucgaaaccacaaugagaggagcgaaaagaauggcaauauuaggagauacggccugggacuuugggagccuaggcggaguuuuuacaaguauugguaaagcccuccaccaaguuuucggugccaucuauggagcagcauuuaguggaguaucguggaccaugaaaaucuuaauagguguuguaauaaccuggauuggaaugaauagucgauccacaagucucagcguaagccuuguacuggucgggguugucacauuguaucuuggaguaaugguacaagcugacagugguuguguaguaaguuggaagaauaaagaacuaaagugcgguucugguauuuucaucacggacaauguacauaccuggacagagcaauauaaauuucaaccugaaucaccaagcaaacuugcaagugcaauccagaaagcacaugaagaggggauuugcggcauaaggucaguuacgaggcuagaaaauuugauguggaaacaaauuacaccagaguugaaucauauuuugacagaaaaugaagucaaauugacuauuaugacaggugacauaaaggguauuaugcaagcaggaaagagaagucuuagaccgcaaccaacagaacucaaauauucguggaaagcuugggguaaagcaaagauguuaucgacagaacuacacaaucauacauuuuuaauagauggcccagagacagcagaaugcccuaauaccaauagagcuuggaauagucucgagguggaagacuauggauucgggguguucacaacuaauauaugguuaaaacuuaaagaaaggcaagauguauuuugcgauaguaaauuaaugucugcggcaauaaaagauaacagggcaguccaugcugauauggguuacuggauagaaagugcauugaacgacacauggaagauagaaaaggcaucauucauugaagugaaaagcugucauuggccuaaaucgcacacacucuggucgaacggcguccucgaaucagagaugaucauaccaaaaaauuuugcaggaccugucucucaacacaacuaucgaccuggauaucauacucagaccgcuggaccguggcauuuagguaggcuugaaauggacuucgacuucugugaggguaccacgguaguaguuacagaggauugugguaacagagguccuucccugaggacuacaacugcaagugguaaguuaauaacugaauggugcugcagaucguguacauuaccaccuuugagauaucggggugaggaugguugcugguauggaauggaaauacgaccuuuaaaagagaaagaggagaauuuagucaacagccuaguaacagcaggucacgggcaaauugauaauuuuucuuuagguguuuuaggaauggcccuguucuuagaggagauguuaagaacucgcguaggcacaaaacacgcuauucuucugguagcuguaagcuucguaacuuugaucacgggaaauaugucauuucgugaucugggcagagucauggucauggucggagcaacaaugacagaugauauugggaugggaguaacuuaccuagcucuccuagcagcguuuaagguucgcccgacguuugccgcgggucuuuuacuaaggaaacuaacaaguaaagagcuuaugaugacuacuauagggauaguacugcugucacaaaguacaauacccgaauccauccuugaacuuacagaugcuuuagccuuagggaugaugguacugaaaauuguacgaaauauggagaaauaucaacuagcagucacgauaauggcaauacugugcguaccaaacgccguaauacuacagaaugcauggaaaguaagcugcacaacacuagcaguuguuaguguaucaccguuguuacuaacaucaucucaacaaaaagccgacuggauucccuuggcauuaacaauaaaaggacuaaacccaacugcaauauuucuaaccacauuaucacgaacaaguaaaaaaagaaguuggccauugaacgaagcuauaauggcaguaggcaugguaucuauucucgccucgucuuuacuaaaaaaugacauuccuaugacaggaccguuaguugcaggaggacuauugacaguaugcuacguacuaacugguagaucggcagacuuagaacuugagcgagcagccgauguacgaugggaggaacaagcagagauauccggaucaucccccaucuuauccauaacaauaucugaggacggcaguaugagcauuaaaaaugaagaagaagagcaaacacugaccauacuaauaaggacugguuuacuagugauuucaggguuauucccuguaaguauuccgauaaccgcugcugcuugguaucucugggaagugaagaagcaacgugcaggcguauuaugggauguaccaaguccuccaccgguaggaaaagccgaacuagaagacggugcauauaggaucaaacaaaaaggcauucuagguuauagccaaauaggugccggaguauacaaggaaggaaccuuccacacaauguggcauguaacuagaggagcuguacuaaugcauaaagguaagcgaaucgaacccucaugggcugaugucaaaaaagaucugaucucauauggaggugguuggaaacuagaaggcgaauggaaagaaggggaggaagugcagguacuggcccuagagccagggaaaaauccaagagcaguccaaacaaaacccggucuauucaagacgaacacugguacaauuggcgcagucuccuuagacuucucacccggaaccucuggaucaccaaucguggauaaaaaaggcaaaguuguuggauuauaugguaaugguguaguaacccgaaguggcacuuauguuucggcuauagcacaaacagaaaaauccauagaagacaauccugaaauagaggaugauaucuuuagaaaaaaaagacuuacgaucauggaccuacaucccggcgcaggaaaaacuaaacgauaucuucccgcgaucguucgagaggcgauaaagagagguuugagaacacugaucuuggcuccaacacguguagucgccgcggagauggaagaggcacuacgagggcucccuauaagauaucaaacuccagcaauacgggccgaacauacugggagggaaauuguugaccucaugugccaugcaacauucaccaugaggcuauuauccccaauaagaguaccuaacuauaaccugauaauaauggacgaagcccauuuuaccgauccagcgagcaucgcugccagaggguauauuuccacuagagucgaaaugggcgaagcagccggaauauucaugacugcaaccccaccaggguccagggaucccuuuccgcagucaaaugcuccuauuauggacgaagaacgagaaaucccggaaagauccuggaauucuggccaugaauggguaacugacuucaaagguaaaaccgucugguuuguaccaucaauaaaaacagguaaugauaucgcggcaugucuacggaagaauggaaagaaaguaauacaacuuucgagaaagacauucgauagugaguacauaaaaacucggaccaacgauugggauuucguugucacaacggacauuucagaaaugggagcuaauuucaaagcugaacgagucauugauccaaggagguguaugaagccggugauauugacagauggagaggaacgaguuauacuagccggaccaaugccgguaacccauaguagugcugcccagcguagagggcggguuggaagaaaucccaaaaaugagaaugaccaauacauauauaugggugaaccucuagaaaacgaugaggauugcgcacauuggaaggaggcgaaaaugcuacuagauaauauaaauacaccugaagguaucauuccuagcauguuugaacccgaacgggaaaaaguggacgcaaucgacggagaauauagguuacgaggcgaggcaagaaaaacauuuguugauuuaaugcgacguggagaccuuccugucugguuagcuuacagagucgccgcggaggggaucaauuacgcugaccgacgauggugcuuugauggcguuaagaauaaccaaaucuuggaagaaaauguagagguggagauauggacaaaagagggagaaagaaagaaguuaaaaccccguuggcuggaugcucgaauuuauagugauccauuagcacuaaaagaauucaaggaauuugcagcaggcaggaaaagccuaaccuuaaauuugaucacagagauggguaggcuuccgacguucaugacucagaaagcgaaaaacgcacuagauaauuuggcaguucuacacacggcagaagccggaggucgagcauacaaccacgcacuaucugaacuaccggaaacgcuagagacacuacuuuuacuuacccuacucgcaaccgugacaggcggaaucuuuuuauuuuuaaugucgggcaaagguauagguaaaaugacacuaggcauguguuguauaauuacggcuaguauauuacucugguaugcgcaaauccagccgcauuggauugccgcuucgauuauccuagaauuuuucuuaauaguacuuuugauaccugaaccggagaaacaacgaacuccccaggauaaucaguuaacuuaugugguuauugcgauccuuacgguuguggcagcaacuauggcaaacgaaauggguuucuuggaaaaaacaaaaaaagauuucggauuaggcuccauuacaacgcagcaaccugaaucuaacauacuagacauugaccuuagaccagccucagcuuggacucucuaugcaguagcaacaacguucauaacaccaauguuacgacauucuaucgaaaauucgaguguuaauguuucacuaaccgcaauagccaaccaggcuacuguucucaugggguuggguaaagguuggccacugaguaaaauggauauagguguucccuuacucgcaauaggauguuauucgcaaguaaauccaauuaccuuaacugccgcauuguuacuauuagucacacauuaugcgauuauuggacccggucuacaggcuaaagcaacacgcgaagcacagaaacgagcagcagcagggauuaugaagaacccaacagucgaugguaugacaguuauugaccuugaccccauacccuacgauccaaaauucgagaaacaacuuggacaaguuaugcugcuuguuuuaugugugacacagguacuaaugaugcgcacgaccugggccuuaugugaggcauuaaccuuagccacaggucccauaucuacacuaugggaggggaaccccggaagauuuuggaauacgacgauagcaguaucaauggcgaacauauuuagaggauccuauuuagcuggagcuggacuucuuuuuaguauaaugaaaaauacagcuaauacgagaagaggaacgggaaacauuggcgaaacacuuggagaaaaguggaaaaaccgcuuaaaugcgcucggaaagagugaguuucagauauauaaaaaauccgggauacaagaaguugauaggacacuagcaaaggaagggauaaaacguggagaaaccgaccaucaugccguuaguagaggaagcgcaaaacuuaggugguuugucgaaaggaaucuuguaaccccugaaggcaaagucguugauuuaggcugcggaaggggaggcuggaguuauuauugcggcgggcugaaaaacguuaaagaaguuaaagggcugacuaaagggggacccggacacgaagaaccuauaccaaugagcacauacggauggaauuuagugagauuacaguccggaguggauguauucuuuacgccuccugaaaagugugauacacuacugugugauauaggcgaaucgucaccuaacccuacuguagaggccgggaggacauuaagaguucucaacuuaguagaaaauuggcuaaauaacaauacucaauucugcauaaaagugcucaacccauauaugccaagcgucauugaaaagauggaagcauuacaaagaaaauacggcggggcuuuaguuagaaauccuuugucacgaaacaguacccaugaaauguacugggucucaaacgccagcggaaacaucguuuccagcguaaauaugauaucacguauguuaauuaauagauucacaaugcgacauaaaaaagcaacauacgaaccagacguagauuugggauccggaacacgcaacauagggauugaaucagagacaccgaaucuagacaucauaggcaaacgcauugaaaagauaaagcaagagcaugaaaccucuuggcacuacgaucaagaucauccauacaaaacaugggcguaucaugggucauaugaaacaaagcaaacuggaucggccucgucaauggucaauggagucgugcgacuuuugaccaaaccgugggaugugauaccuaugguuacucaaauggcuaugacggacacaacuccauucggccaacagagaguuuucaaggaaaaaguugacacccguacucaagaaccuaaagaagguaccaagaaguuaaugaagauaacugcugaauggcuauggaaagaacuugguaaaaaaaaaacgccuagaaugugcacuagagaggaauucacgaggaaaguacgcaguaaugcugcauugggagcuauauuuacagaugaaaauaaguggaaaucugcgagagaagcuguagaagacagugguuuuugggagcugguagauaaagaacguaacuuacauuuggaaggaaaaugcgaaacguguguauacaauaugauggggaagcgcgaaaagaaauugggagaauuugggaaagccaaggguucccgagcgauuugguacauguggcucggugccagauuccucgaauuugaagcauuaggauuuuuaaaugaggaccauugguucagcagggaaaauucacuuuccggaguagaaggagaaggucuacauaagcuuggcuauauuuugagagauguaaguaaaaaagagggcggggcgauguaugcggacgauacggcuggaugggacaccagaauaacucuugaagauuuaaaaaaugaagaaauggugacaaaucacauggaaggugaacauaaaaaauuagcugaagcaauauucaaacugacauaucaaaauaaaguaguuagaguucaacgaccgacuccacguggaacuguaauggacaucauaucuagaagagaccaacgggguaguggacaaguaguaaccuauggcuuaaacacauucacaaauauggaagcacaguugauaagacaaauggaaggcgaaggcguauuuaagaguauacaacaacucacgguaaaggaagagaucgcaguaaaaaacuggcuuauacgagucggaagagaaaggcucucaaggauggcuauuucuggagaugauugugucguaaagccgcuagaugauagguuugccucagcgcuuacagcgcuaaaugauauggggaaaguccgaaaagacauacaacaaugggaaccuaguaggggguggaaugauuggacucaagucccauuuugcagucaucacuuccacgaguuaauaaugaaagacggaagaguauugguugugccgugcagaaaccaggaugaacuaauagggagagcacggauaagucaaggcgccgguuggucucugagagaaacagcuuguuuagguaaaagcuacgcucagaugugguccuuaauguauuuccaucgacgugaucuuagauuagcggccaaugcuaucugcucagcuguuccgucacacuggguaccaacgagucguaccacauggaguauccaugcaacacaugaauggaugaccacagaagauaugcuaacuguguggaacaggguuuggauacaggaaaauccguggauggaagacaagacgccaguugaaucaugggaagaaauaccguacuuaggcaagagagaagaucaaugguguggaucacuuaucggauugaccucacgagcgacaugggcuaaaaacauacaaacagcaauuaaucaaguucggucauuaauaggaaaugaagaguauacugauuauaugccaagcaugaaacgcuucagaagagaagaagaggaggcaggaguauuaugguaa

SEQ ID NO: 22893 - RNA, 9876 nt, Artificial Sequence
  derived and/or modified CDS sequence (opt6) from DENV-2__JN851116__SS-prME
acugcugggauaauuaucaugaugauuccgacgguaauggcuuuucauuuaacuacccguaacggagaaccgcacaugaucgucaguagacaagaaaaaggaaaaaguuugcuauuuaaaacggaaaauggaguaaacaugugcacccuaauggcuauggauuugggagaacugugcgaagauacgauaacuuauaacugucccuuauuaagacaaaaugaacccgaagacauagacugcuggugcaauagcacuucuacauggguaacauauggaacaugcacagcuaccggggaacauagaagggaaaaacgaagugucgcauugguaccucacguaggaaugggauuggaaacuagaacugaaacauggaugagcuccgaaggugcauggaaacacgcccaacguauagaaacauggauuuuaagacauccaggauucacaauaauggcagcaauuuuggccuauacaauaggcacgaccuacuuccaaagaguucuaauuuuuauucuucucacugcaguaacgccaaguauggcaaugagauguaucggaauaucgaauagagacuucguggaaggugucagcgguggcaguuggguugacauuguccuggaacaugguucauguguaacaacaauggccaaaaauaaaccaacgcuagauuucgaguuaauaaaaacggaggcaaaacauccggcaacacuccguaaauauugcguggaagcaaaacucacgaauacgacuacagccuccagaugcccuacacaaggagagccuucauugaacgaagaacaagauaaaagauucguuugcaaacacucaaugguagacaggggauggggcaauggcugcggauuauuugggaagggcggcauuguaacaugcgcaauguuuacaugcaaaaagaauauggaagguaagguaguacaacccgaaaaucuagaauauacaauugucauaacaccacauagcggagaagagaacgccgucgguaaugauacaggaaagcacggcaaagagauuaaggugaccccgcaaucgagcauaaccgaagcggaauuaacgggcuauggaacaguaacgauggaaugcagcccacguacagguuuagauuuuaaugaaaugguacuauuacagauggaaaacaaggcuuggcuggugcaucgccagugguuccuagaucucccccuuccgugguuacccggagcagauacacaagggaguaauuggauacaaaaagaaacauugguaacguucaaaaacccgcaugcaaagaaacaggacgugguuguauuaggcagccaagaaggugcgaugcauaccgcccuuacaggagcuacugaaauucagaugagcucugguaaucuauuguucacaggacauuuaaaaugcagacucagaauggacaaauuacagcucaaaggcaugagcuacucgaugugcacagguaaguuuaaaguugugaaagagauugcagagacacaacacgguacaauagucauuagaguucaguaugagggugacgguuccccauguaaaauaccauuugaaaucauggaccuugaaaaacgucacguacuugggcggcuaauuacaguaaacccgauuguaacggagaaggauagcccugucaauauagaagccgagccacccuuuggcgauucuuacauuauuauugguguggagcccggacaauuaaagcuaucuugguuuaagaaggggucauccaucgggcaaauguucgaaacaacaaugcguggagccaagagaauggccauucuaggugacacggcgugggacuuuggaucgcucggagggguguuuacaucgauagguaaggcucuccaccaaguauucggugcgauauauggagcagcauuuuccgguguaucauggacuaugaagauucuuauaggugucgucauaaccuggauaggcaugaacucacgcaguacgagcuuaucggugagucugguucuaguuggcguuguuaccuuauaccuaggaguaaugguccaagcagauucaggcuguguaguaucuuggaaaaauaaagaacugaaauguggaagcggaaucuucaucacagacaaugugcauacuuggacugagcaauauaaauuccaaccugaaucgccaucaaaauuagccucagcuauccaaaaagcucaugaagaagguaucugcgguauaaggagcguaacgagacuagaaaauuuaauguggaaacaaaucacacccgaacuaaaucacauucuuacggaaaaugaggugaaacuaacaauaaugacuggcgauauuaagggaauaaugcaggcaggaaaaagaucgcuacguccgcaaccgaccgaguuaaaauauagcuggaaagcaugggguaaagcaaaaauguuguccacagaauuacacaaucacacguuuuuaauugacggacccgagacagcugaaugcccuaauacgaacagagccuggaacucacuagaaguagaagacuauggauuuggaguuuucacuacaaacauuugguuaaaacuaaaggagcgucaagacguguucugugacucaaaacuuaugucugcagcuauaaaagauaaccgggccguacaugcagauaugggcuauuggauagaaagugccuuaaaugauacuuggaaaauagaaaaagcaucauuuauugaaguaaaaucuugucauuggccuaaaucucauacucuauggucaaacgguguacucgaaagcgaaaugauaauacccaagaacuucgccggaccagugucacaacauaauuacagaccgggauaucauacacaaacagcaggaccuuggcaucugggcaggcuagaaauggacuuugacuuuugugaaggcacgacaguuguaguaacugaagacuguggcaaccgaggcccaucauuaaggacuacuacugcauccgguaagcuaauaaccgaauggugcugucgcucauguacucuaccaccgcuuagguauaggggagaagauggauguugguaugguauggagauacggccacugaaagaaaaagaggaaaaccuaguaaauagcuuagugacugccggucauggucaaauagacaauuucucuuuagggguucuagggauggcucuauuucuggaggagaugcuaagaacaagagugggaacuaaacaugcuauauuacucguugccgucucuuuugucacucuaauaacuggaaacaugaguuucagagacuugggcagaguuaugguaaugguaggggcaacaaugacagacgacauagguaugggcgucaccuaucuggcacuauuagcugcauuuaaaguaaggccuacuuucgcagccggucuguuauugcguaaauuaaccuccaaagaacuaaugaugacuacaauaggcauuguauuauugucacaaucaacaauaccagaaucuauuuuagaauuaacugaugcacuagccuuaggaaugaugguuuugaaaauuguacguaacauggaaaaauaucaauuagcuguuaccauaauggcuauucugugugugccuaacgcagugauucuacaaaacgcauggaaagugaguuguaccauauuagcagugguuaguguuucuccucuucucuugacuucuucacaacaaaaggcagauuggauuccuuuggcccuuacuaucaaaggauuaaacccgacugcgauuuucuuaacgacgcuuagcagaacaagcaagaaaagaucguggccauugaacgaagcaauaauggcgguagggaugguuucgaucuuagccucaucauuacucaaaaacgauauuccaaugacuggaccguuaguagcgggaggucuccugacaguuuguuauguccugaccgguagaagugcagauuuagaauuagaaagggcagcagacguucguugggaagaacaagcggagauauccggaucaucucccauuuugaguaucaccauaucagaagacggcucaaugucaaucaaaaaugaagaggaggaacaaacucuuacuauacuaauacggacagguuuauuagugauuaguggguuguuuccgguaucuaucccgauaacggcagcagcaugguauuuaugggaagucaagaaacaaagggccggcguacuaugggauguaccuucaccaccgcccguaggaaaagcugaacucgaggacggcgcauaucgcauuaaacaaaaaggaauuuuagguuauucacagauuggugcuggcguuuacaaggagggaacauuccacacgauguggcauguaacccguggagccgugcuaaugcacaaaggaaaaaggauugaaccgucgugggcagaugugaagaaggaucuaauaagcuauggcgguggcuggaagcucgaaggagaauggaaagaaggugaagaaguucaagucuuagcauuggaaccaggcaaaaacccgcgagcgguacagacaaaaccuggccuauuuaagaccaauacaggaacaauaggagcaguaucuuuggauuucagucccgggacuucugguagccccauuguagauaaaaagggaaaagucgugggguuauacgguaauggaguggugacacggucaggaaccuacgugucagcaaucgcucaaacagagaaaagcauagaagauaaccccgagauugaagacgacauauuucguaagaaaagauugaccauaauggauuuacacccaggagcgggcaaaacgaaacguuauuugccggcaaucguucgggaagccauaaaaagaggacucaggacauugauauuagcuccaacucggguaguggcugcagaaauggaagaagcccucaggggauuaccuauaagauaucagaccccugcgauuagagcugaacauacaggaagagagaucguugacuugaugugucaugcuacuuuuacaaugcguuugcuaucgccuauaagaguuccuaauuacaaucucauuauaauggaugaagcucacuuuacggaccccgcaaguaucgcagcuaggggauauaucucaacuagaguugaaaugggcgaagcagccggaaucuuuaugaccgccacuccaccaggcucgagggauccuuuuccucagagcaaugcuccgauaauggaugaggaacgcgagauuccugaacgcaguuggaacucuggccaugaguggguuacggauuuuaaaggaaaaacaguaugguuuguaccuaguauuaaagcagggaaugauaucgcugcuugucuaagaaagaaugggaagaaagucauacaauuaucgagaaaaacauucgacagugaguauauaaaaacacgaacaaacgacugggacuuuguuguaacaacagacauaagugagaugggagcuaauuuuaaagcagaaagaguuauugauccgagacgguguaugaaaccagucauauuaacagauggagaggaacggguaauacucgcagguccaaugccuguaacucauagcagugcagcacagagacgaggaagagucgggaggaacccuaaaaaugagaacgaucaauauauuuauaugggugagccucuggaaaaugaugaggauugcgcacacuggaaagaagccaagaugcucuuagauaacaucaauacaccagagggaauuauaccgucaauguuugaacccgagagggaaaaaguggaugcgauugauggagaguaucggcuucggggugaggccagaaagacauuuguggaucugaugagaagaggagaucuuccagucugguuagccuacaggguugcagcugaaggaauaaacuaugcugauagaagauggugcuuugauggcgucaaaaauaaccaaauucuagaagaaaauguagagguagaaaucuggaccaaagaaggugaacgcaagaaauuaaaaccacgauggcuggaugcgcgaauauacucagauccguuagcacuaaaagaguuuaaagaauuugcagccggccgcaagucgcugacauugaaucuaauaacagaaaugggaagguuaccuaccuucaugacacaaaaagcgaaaaacgcacucgauaacuuggcaguauugcauacagcggaagccgggggcagagcauauaaccacgcacuuucagaacuaccggaaacauuagaaacguuacuacuacuaacucuccuagcaaccguaaccggagggaucuuucuguuuuuaaugaguggcaaaggcauuggcaaaaugacauuaggaaugugcugcauuauaacugccuccauccuucuaugguacgcacaaauucaaccucauuggauagcagccagcauaauacuagaauuuuuccuuaucguguuacuuauuccagaaccugaaaagcagcgcacaccccaagacaaucaguuaacauaugucguaauagcaauacuuacaguuguggccgcaacaauggcgaacgagaugggguuccuagagaaaaccaagaaagacuuugguuugggaucgauaacaacacaacaaccagaauccaauaucuuggacaucgaccuaagaccagcgucagcuuggacuuuguaugcaguugcaacaacauuuauuacuccuaugcucaggcacucaauugaaaacucgagcguuaacgugucucuuacggcaauugccaaccaagcuacagucuugaugggucuagggaaaggguggccuuuaucaaaaauggauauaggagucccauugcuagcaauagguuguuacucacaaguaaauccuauaacuuuaacugccgcauuacucuuacuuguagcgcauuacgcuauuauagguccaggguuacaagccaaagcaacuagagaagcacagaaaagggcagcagccggaauaaugaaaaacccgacagucgauggaaugacgguaauagaucuugaccccauaccguacgauccaaaguuugagaagcagcuugggcagguaaugcucuuaguucucugugugacacaaguucuuaugaugcguacgacuugggcacugugugaggcuuuaacauuggcuaccgguccaauaucgaccuugugggaaggcaacccuggccgcuuuuggaacacgaccauagccguaaguauggcuaacaucuucagggguagcuaucucgcuggagcuggacuauuauuuucaauaaugaaaaauacugcaaacacucgaagaggaacaggaaauacgggugaaacguugggcgaaaaauggaagaaucgcuuaaaugcauugggaaaaagugaguuucaaauuuacaagaaaagcgggauacaagaaguagaccgaacucuagcaaaagaagguauuaaaagaggugagacagaucaucaugcaguuagcagagguuccgcaaaauuaaggugguuuguagaaagaaaucuggucacgccggaagggaaaguaguggauuuaggcugcgguagaggagguuggaguuacuauuguggaggccugaaaaacguuaaggaaguaaagggcuuaacaaaggguggaccuggccaugaggaaccaauuccaaugucuaccuaugguuggaacuuaguucgucugcagucuggaguggauguauucuuuacuccaccagaaaaaugcgacacguuacuaugcgauauuggcgagagcucgccaaacccuacgguugaagcaggaagaacacuacggguuuugaaucuaguugaaaauugguuaaacaauaacacucaauuuugcauaaaagucuuaaauccauauaugccuagcguuaucgagaaaauggaagcacuccaacgaaaauacggcggagcauuaguuagaaauccauuaucuagaaauaguacucaugagauguauuggguaucaaaugccagcggaaacauaguaaguaguguaaauaugaucucucgaaugcuaauuaauagguucacaaugaggcacaagaaagccacuuacgaacccgaugucgaucuuggaucugguaccagaaacauagggauagaaucagaaacaccaaauuuagacauaauugguaaacgaaucgagaaaaucaaacaagaacaugagacuagcuggcauuacgaucaggaccauccauauaaaacaugggcauaucauggaucguaugagacaaaacaaacaggauccgcaagcucaauggugaauggcgucgugcgcuuacuuacaaagcccugggacguuauaccaauggugacacaaauggcuaugacagauacaacaccauuuggucaacaacguguauucaaagaaaaagucgauacuagaacucaagaaccuaaagaaggaacuaaaaagcuaaugaaaauaacugcagaauggcuuuggaaagaacugggaaagaagaaaacaccucggaugugcacacgggaagaauuuacccgcaaaguccguaguaaugccgccuuaggagccauuuuuacagacgaaaauaaauggaaaucugcccgagaagccguagaagauagcgguuuuugggaacuggucgacaaggaaaggaaucugcaucuagaggggaagugugagacaugugucuacaauaugaugggaaaaagggagaagaaacuaggggaauuuggaaaagcuaaagguagccgugcaauuugguauaugugguugggugcaagauucuuagaguuugaggcucucgguuuccucaaugaggaccauugguuuuccagagagaacucacuauccgggguugaaggggaaggauuacacaaacuuggauauauccuccgagauguaucuaagaaagagggaggagcaauguaugcugaugacacugcaggaugggacacacguaucacgcuugaagaucugaaaaaugaggaaauggugaccaaccacauggaaggagagcacaaaaagcuagccgaagcaaucuucaaauuaaccuaccaaaauaaggucguaagaguacagaggccaacaccccgaggcacaguuauggacaucauaucacggcgugaccaacgcggaaguggacaaguagucacauauggauugaacacauuuacaaauauggaagcgcaacuaauaagacagauggagggagaaggaguuuucaaaaguauucaacaauuaacggugaaagaagaaaucgcugucaaaaacuggcuaaucaggguagggcgggagagauuaagcaggauggcaauauccggugacgacugcguagucaaaccguuagacgaccgcuucgcuucagcgcuaacagcauuaaaugauaugggaaaaguucgaaaggauauacaacagugggaacccucccgugguuggaacgauuggacacaaguucccuuuugcucucaucauuuccaugaauugauuaugaaagaugggaggguauugguaguaccaugcagaaaccaagaugaacugauaggcagagcacggauuucacaaggagcaggauggucccuucgugaaacugcuugcuuaggaaaaucguaugcccaaauguggucucugauguauuuccaucggcgcgauuugagacuggcagcaaaugccauuugcagugcuguaccaagccacuggguacccacaucacgaacaacauggagcauucaugcuacacacgaauggaugacaacagaagacauguuaaccgucuggaacaggguauggauacaagaaaaucccuggauggaagauaagaccccaguagaaaguugggaggaaauaccauaucuaggaaaaagagaagaccaauggugcggaucuuuaauuggauuaacgucuagagcgacaugggcgaaaaacauacagaccgcaauaaaucaagugagaaguuugauuggaaaugaagaauauacagauuacaugccaaguaugaaacguuucaggcgagaagaagaagaagcgggaguauuaugguga

SEQ ID NO: 22894 - RNA, 9876 nt, Artificial Sequence
  derived and/or modified CDS sequence (opt6) from DENV-2__GU370051__SS-prME
accgcagguauuauaauaaugaugauaccuacggucauggcuuuccaccucacgacacgaaacggugaaccgcacaugauuguuagucgucaggaaaaagguaaaucccuacuauucaaaacugaaaaugguguaaauauguguacacuaauggcuauggaucuaggagaacucugcgaagauacaauaaccuacaauuguccuuuacuucgucaaaaugaaccugaagacauugauuguuggugcaacuccacuucaaccuggguuacuuacgggacgugcacagcgaccggggaacaucgucgggaaaaacgcucaguagcguuagugccucauguaggaaugggauuagaaacaagaacggaaacuuggaugucaagcgaaggugcuuggaaacaugcacagagaauugaaacauggauuuuaagacaucccggauuuacuauaauggcggcaauacucgcguacacaauuggaaccacauacuuccaaaggguauuaauauuuauacuauuaacggcgguaacaccaucaauggcaaugcgaugcauugguauaagcaacagagacuuugucgaaggagucagcggaggaucauggguggauauaguauuagagcaugguucauguguaacaaccauggccaaaaauaaaccaacucuugacuuugaguuaauuaaaaccgaggcaaaacaccccgcaacauugagaaaauacugcgucgaagcaaaauuaaccaauaccacaacagcaagccguugcccuacgcaaggugaacccaguuuaaacgaagaacaagauaaaagauuugucugcaaacauucaaugguggaccgagguugggggaauggaugcggguuguucggaaaaggagggauagugaccugugcaauguuuacgugcaagaaaaacauggaagguaaaguaguacaaccugagaauuuagaauauacaauuguaauuacaccccauagcggugaggagaacgcugucggcaaugacacugggaaacauggaaaggaaauuaagguuacaccucagaguucgauaacagaagcagaacucacuggauauggaacuguuacuauggaauguagcccccguacaggccuagauuuuaaugaaaugguuuuauuacaaauggaaaauaaggccuggcugguacauagacaaugguuuuuggaucucccgcuuccguggcuaccuggagcugauacccaaggaagcaauuggauucaaaaagagacacucguuacguuuaaaaauccacacgcuaaaaagcaagauguugucguguuagguucacaagagggcgcaaugcacaccgcguuaacuggggcaacggagauacagaugucaagcggcaaccuauuauucaccggccauuuaaaauguagguuacgcauggauaagcuacaacugaaggggaugucauauucaaugugcacuggcaaauuuaagguaguaaaggaaauagcagaaacacaacacgguacaauuguaauaagaguucaauaugagggagauggcucucccuguaaaaucccuuucgaaauaauggaucucgagaaacgacacguuuuaggaagguuaauuacuguaaaccccauuguuacagaaaaagacucgccaguaaauauagaagccgaaccaccuuucggugacucauauauuauuauuggcguagagccaggucaauuaaaauuaucaugguucaagaaaggaagcagcauaggacagauguuugaaacuacaaugcguggugcaaagcgaauggccauccucggagacacagccugggauuuugguucucuaggaggaguauuuacuucuauuggaaaagcauuacaccaaguauucggugcaauuuauggcgcggccuuuuccggaguuucauggacuaugaaaauacuaauaggaguugugaucacauggauagguaugaacuccaggucaacuucuuuaucuguaucguuagucuuaguagguguaguuacuuuauaccuuggagugauggugcaagcugauagcgguuguguaguaaguuggaaaaacaaggaacugaaauguggcuccgggauauucauuaccgauaacgugcauacguggacggaacaauauaaauuucagccugaaucuccuaguaaauuagccagugccauccaaaaagcccacgaagaaggcauuuguggaaucaggucuguaacccgucuugaaaaucuaauguggaaacaaaucacuccagaauuaaaucacauuuuaacugaaaaugaaguaaaacuuacuauuaugacaggcgauauaaaagggauuaugcaagccgguaagagaucucugcgcccccaaccgacggaguuaaaauauucguggaaggccugggggaaggccaagaugcuaagcacggaacuacauaaccauacguuucuaauagauggcccagaaaccgccgagugccccaacacaaauagagcuuggaacucucucgagguagaggauuacgguuuuggcgucuucacgacuaacauaugguuaaaauuaaaagaaagacaggauguauuuugcgauucaaagcucaugucugcagcaaucaaggauaaucgagcagugcacgcagacaugggguauuggaucgaaagugcauugaacgauacauggaaaaucgaaaaagcgucauucaucgaaguaaaaucaugccauuggccaaagagucauaccuuauggucgaacgggguacuagaaucugagaugauaauaccuaaaaauuuugccgggccuguuucgcaacauaauuacagaccaggcuaucacacacaaacugcaggucccuggcauuugggucggcuggaaauggacuuugacuucugugaaggcaccacugucguaguuacagaagacugugguaaucgugggcccagccuucgcacuacuacggcuucggguaaacuaauaaccgaaugguguugucgcaguugcacauuaccacccuuaagguacagaggagaggacggguguugguacgguauggaaauuagaccuuuaaaagaaaaagaggaaaauuuaguaaacagcuugguaacagcugggcauggccaaauagauaauuuuagucuaggaguuuuaggcauggcucuauuucuagaagaaauguugagaacacgcgucggcacaaaacacgcuaucuuacuuguagcgguaucuuuuguuacgcuuaucacagguaacaugucauuucgcgacuuagggcguguaauggugaugguaggagcuaccaugacagaugauauugguauggguguuacuuacuuagcauuauuagccgcauuuaaagucagaccuacauuugcagcuggacugcuauugagaaaacuaacaaguaaagaacuaaugaugacaacaauugguauuguauuacuaagucaguccacaaucccagaaagcauacuggaacucacagaugcucucgcguuaggcaugaugguguugaaaauaguaagaaauauggaaaaauaucaauuggcgguuacaauaauggcuaucuuauguguaccuaacgcuguaaucuuagaaaaugcguggaaaguaucuuguaccacacuugcuguaguaaguguaagucccuuguuauuaacaaguucacaacaaaaggcagacuggauuccauuagcucugacaauaaaaggucuuaauccuacagcgauauucuuaacaacccuaagucggacaucaaagaaaagaaguuggccauugaacgaagcaaucauggcaguuggaauggugagcauacuggcaagcucuuuauugaaaaaugauauaccaaugacuggaccacugguagcuggcggauugcucacagucugcuauguacugacugguagauccgcagauuuggaauuggaaagggcggcagauguacgcugggaagaacaggcugaaauaagugggaguagcccaauucucaguauaacaauaucagaagacgguuccaugagcaucaaaaaugaagaggaagaacaaacuuuaacaaucuuaauaagaacuggcuuguuaguuauuagcgggcuguuuccggugaguauaccuauuacagcagcugcgugguaccucugggaggucaagaaacagcgugccggcguucuaugggaugugcccaguccgccaccgguuggaaaagcagaacuagaagauggugcuuacagaauaaaacaaaaagguauccuuggauauagucaaauaggagccggaguauauaaggaaggaaccuuccauacaauguggcacguuacaagaggcgcuguucuaaugcauaaaggaaagagaauugagccgucaugggcggaugucaagaaagaccucaucucauacggaggagguuggaaguuagaaggagaauggaaagaaggggaagagguucaagugcuugcauuagaaccuggcaaaaauccaagagcgguucaaacuaaacccggcuuguuuaaaacaaauacaggcacaauaggagcagucagucuugauuuuucacccgggacgucuggaagcccaauaguugauaagaaaggaaaaguaguaggucuuuacgguaacgggguuguuaccaggucagggacguaugugucagcgauugcucaaacugaaaaaucuauugaggacaauccggauauagaagaugacauuuucagaaagaaaagauugacaauuauggaucuacauccgggcgcuggcaaaacgaagagauaccucccugcaaucguacgagaggcaauuaaaagagggcuacggacacuaauacuagccccgaccagagucguagcagcggaaauggaagaagccuuacgaggacugccuauucgauaucagacaccagcgauaagagcugaacacacaggaagggaaauugucgaccuuaugugucacgcaacauucacaaugagacuauuaagcccaaucagggucccuaacuacaaucuaauaaucauggacgaagcccauuuuacagauccggcauccaucgccgccagaggauacauaucuacaagaguggaaaugggggaagcugcugggauauucaugacagcuacaccacccggaagucgugacccauuuccucagagcaaugcgccaauuauggaugaagaacgagaaauaccugagagaucauggaacaguggacaugaauggguaacugauuuuaaagggaaaacuguaugguucguacccucaauuaaagcagggaacgauauagcggcaugcuugcguaaaaauggaaagaaaguaauacaacuaucacguaagaccuucgauuccgaguauauuaaaacucguacuaacgauugggauuuuguaguaacuacugacauuucagaaaugggugccaacuucaaagcagaaagagugauagacccacgaagauguaugaaaccggugauuuuaacggacggugaagagagaguuauuuuagcaggcccuaugccgguuacacacucauccgcggcucagcgcaggggcagaguuggcagaaauccuaaaaacgacaaugaucaguauaucuauaugggcgaaccauuggagaaugaugaggacugcgcgcacuggaaagaagcaaaaauguuacuugacaauauuaacacaccagaaggcaucauucccaguauguuugagcccgaacgagaaaaaguagaugcgauagauggcgaauauagacuaaggggugaagcgcguaaaacauucgucgacuuaaugaggcgcggagaccucccgguauggcuggccuauagaguggccgccgaggguauaaauuaugcggaucggcggugguguuucgauggggucaaaaauaaucaaauuuuggaagaaaauguagaagucgaaauauggacuaaagaaggagagaggaagaaacucaaaccgcgcugguuagacgcaaggauauauucugauccacuugcacugaaggaguucaaagaauuugcugcagggcgaaaaucauugaccuuaaaucuuauuacugaaaugggaagacucccuacauuuaugacccaaaaagcaaagaaugcauuagacaacuuagcuguuuugcauacagcagaagcaggggguagagcuuauaaccaugcucuaucugaauuacccgaaacauuagaaacauuacuucuucugacgcuucuugcuacaguaaccgguggcauauuuuuguuucuaaugagugguaaaggaaucggcaaaaugacguuaggaaugugcugcaucauaacugcuaguauucuccuaugguacgcacagauacaaccacacuggaucgcagcaucgaucaucuuagaauuuuucuugauuguucuacuaaucccagaaccagaaaaacaacgaacuccgcaagacaaucaguuaacauacguugugauagcaauuuugacaguuguagcagcaacaauggcgaaugaaaugggcuuccucgagaaaacuaagaaagauuucgguuuagggaguauaacaacgcaacaaccagaaucgaauauuuuagacauagaccuaagacccgcuucugcuuggacauuauacgcgguugccacuacauuuauaacgccgaugcuacgccacaguauagagaauagcucagugaaugucaguuuaacagcaauugcgaaccaagccacaguucucaugggacuagggaaaggguggccucucaguaaaauggacauaggugugccucuacuggcuauagguuguuacucacagguuaaucccauuacacuaacagccgcacuucuauugcuagucgcgcacuaugcgauuaucgguccaggccuacaagccaaggccacacgugaagcacaaaagagggccgcugcaggcaucaugaagaauccgacuguagaugguaucaccguaauugaucuagauccgauuccauaugauccaaaauuugaaaaacaacuaggccaaguaaugcuacuuguacucuguguaacgcaaguauuaaugaugaggacaaccugggcucuaugugaggcacuaacacuagcaacugguccaauaucuacacuaugggaagggaauccuggaagguuuuggaacacaacaaucgcggugagcauggcuaauauuuuuagagguucuuacuuggcaggagcagguuuacuguuuagcauaaugaaaaauaccgcaaacaccaggcgugguacgggaaacaccggagaaaccuugggugaaaaauggaaaaauagacucaacgcuuuaggaaaaagugaguuccaaaucuacaagaaaagcgguauucaagagguggauaggacacuagccaaagagggaauuaaacgaggugaaacagaccaucaugcaguuucaagagggucagcgaaacuucguugguuugucgaaagaaauuuggucacucccgagggaaagguuguagauuuaggcugcgguaggggaggcuggucauacuauugcggaggauuaaagaauguaaaagaaguuaaaggacuaacaaaaggagggcccggacacgaagaacccauuccaaugucuacauacggauggaauuugguaagacuacaaagugguguggacguauucuuuacuccuccagaaaagugugauacacuucucugcgacauuggagagagcagcccuaaccccacgguagaagcaggaagaacucucaggguauuaaaucuugucgaaaauuggcuuaacaauaauacacaauucugcauuaaaguacucacaccguauaugccaucagugauagaaaagauggaagcguuacaaagaaaguauggaggagcacuuguacgaaauccccuaaguaggaacaguacgcaugaaauguauugggucucgaacgcaucaggaaauaucgucucaucuguaaauaugaucaguagaauguuaauaaaccguuuuacgaugaggcacaaaaaggcgacuuaugaaccagauguagaccuagggaguggaacgcggaauauagguauagaaucagagacaccaaauuuagacauuauagguaaaaggauagguaaaauaaaacaagagcaugagacaaguuggcauuaugaccaagaucauccuuacaaaacuugggcguaucauggcucauaugaaacuaaacaaacuggaucagccucaucuaugguuaauggagucguaagauuacugacgaagccaugggaugucaucccuaugguuacacaaauggcaaugacugauaccacucccuucggacaacagcgcguguuuaaagaaaagguugauacucgaacgcaagagccaaaagaagguacuaagaaauuaaugaaaaucacggccgaauggcuauggaaagaauuaggcaagaagaaaaccccacguaugugcacgagggaggaguucacacgaaaaguacgaucuaaugcugcgcucggagcuaucuuuacggaugaaaacaaauggaaaucagcuagagaagccguagaagauaguggauuuugggaauugguagauaaagaacgaaaucugcaucuggaagguaagugugagacauguguauacaauaugaugggaaaacgagagaagaaauugggugaguucggaaaagcuaaaggaagcagggcgauaugguacaugugguugggagcaagauuuuuagaguucgaagcucuuggauucuuaaacgaagaucacugguuuagcagggaaaauucuuuaaguggcguugaaggggaaggauuacauaaguuaggguauauacuacgagauguuucaaagaaggaaggaggggcaauguaugccgaugacacggcagggugggacacgcgcaucacacuggaagaucuaaagaaugaagaaaugguaacgaaccauauggaaggagagcauaagaaacuagcagaagcgauauucaaacucacauaccagaacaaaguggugcgaguucaaaggccaacgccaagaggaacaguuauggauauaauaucuaggagggaucaacgcgguagcggucaagucguaacauacggcuuaaauaccuuuacuaacauggaagcccaauuaauacgacagauggaaggggaaggaguauuuaaaucgauucagcaguuaacuguaaaggaagaaauagccguugaaaacugguugaugcgcguuggaagggaacguuuaaguaggauggcuauaucaggagaugacugcguuguaaaaccucuagaugacagguucgcuucugcacuuacagcccuuaaugacauggguaaaguuaggaaagauauucagcagugggaaccuaguaggggauggaaugauuggacgcagguuccauuuugcucccaccauuuccaugaacuaauaaugaaggauggucgaguccugguuguacccugucguaaucaggacgagcuaauaggacgagcacgcaucucccaaggagcagguugguccuugagagaaacagcaugccucgggaagucuuaugcacagauguggagccuaauguauuuucauaggagagaccuacgucuagcggccaacgcaauuugcucugcagugcccagccauugggucccaacuucuagaacuaccuggucaauacacgcuacacacgaauggaugacgacugaggauauguuaaccguguggaauagaguauggauucaagaaaacccauggauggaagauaaaaccccuguagagaguugggaagaaauuccauauuuaggaaaaagggaagaucaauggugcggaucacuaaucggauugacaagccgagcgacaugggccaaaaauauucaaacugcaauaaaucaagucagaucucuuaucggaaaugaagaguacacugauuauaugccaucaaugaaaagguuuagaagagaggaagaggaagccgguguauuaugguag

SEQ ID NO: 22895 - RNA, 9876 nt, Artificial Sequence
  derived and/or modified CDS sequence (opt6) from DENV-2__EU359009__SS-prME
acagcugguauuauaauaaugaugauaccuacuguaauggcguuucaccuaacaacuagaaauggagaaccgcacaugauuguaucuagacaggaaaaagguaaaucacuuuuguucaaaaccgaaaauggaguaaauauguguacgcuaauggcgauggauuuaggagaauugugcgaagauacuaucacauacaacugcccuuuauuacgacaaaacgaaccagaagacauagacuguuggugcaauucaacgaguacaugggucacuuacgguaccuguacagcaacgggggaacaucgaagagagaaaagaaguguggcauuaguaccucauguagguaugggauuagaaacaagaacagaaacuuggaugucgagugaaggagcauggaaacaugcucaaaggauagaaacuuggguguugcggcauccgggauuuaccauaauggcagcaauuuuagcauauacuaucgguacuacuuacuuucaacgcguucuaauauuuauccuauuaacugcuauagccccaucgaugacuaugagauguauagguauaucaaacagagacuucguugaaggggucucgggaggaucauggguggacauuguccuugaacauggguccugugugacgacgauggcgaaaaacaaaccaacgcucgauuuugaacuuauuaaaacagaagcaaaacacccugcaacgcugaggaaauacuguauagaagcaaaauuaacgaauacuacaacagcaucacguuguccaacucaaggagaaccaucauuaaaugaagaacaagauaaacgauuuguauguaaacacaguauggucgacagaggauggggaaaugguugcggucuauucggcaaaggaggaaucguaacaugcgcuauguuuacauguaagaaaaauauggaagggaaaauaguacaaccggaaaauuuagaauacaccauaguuauuacgccucauucaggggaagaaaaugccguagggaaugacacagguaaacaugguaaagaaauaaaaguaacuccacaauccuccauaacugaagcggaacucacgggauauggcacaguaacaauggaauguucaccacgaacaggguuagauuucaacgaaaugguacuuuuacaaauggaaaauaaggcuugguuaguucaucgacagugguucuuagauuuaccauuuccauggcuaccaggagcagacacacaaggaagcaauuggauacagaaggaaacccucgugacauuuaaaaauccacaugccaagaaacaggaugucgucgucuuggggagucaagaaggcgcaaugcauacagcacuaaccggcgcuacagaaauccaaaugaguucaggaaaucuuuuauuuacaggucaucugaaaugccguuuaagaauggauaaauugcaguuaaaaggaaugucuuauaguaugugcacgggaaaguuuaaaguggucaaggaaauagcagagacccaacauggcacuauaguaauucguguacaauaugagggugaugggucccccugcaagaucccauuugaaauaauggauuuagagaaaagacauguucuggguagacuuauaaccguaaaucccaucgugacagagaaggauaguccugugaauauagaagcagaaccacccuucggugauucuuacauuauaaucgggguagagccaggacaauuaaaauugucaugguuuaagaaggguucaucuauugggcagauguuugaaaccacaaugcguggagcuaaaagaauggcaauacucggagacacagcuugggauuuuggaucauuagguggagucuucacgucaaucggaaaggcucuacaucaagucuuuggagcaauauacggggcagccuucaguggcgugucuuggacaaugaaaauacugaucggaguaguuauaacguggauugguaugaacucaagaagcacaucuuuaagcgucucccucgugcuaguagguguaguaacccuuuaccuggguguaaugguacaggcugauucagguuguguaguaaguuggaaaaacaaagaacugaaaugcggaagcgggauauuuauaacagauaauguccacacauggaccgaacaauauaaauuccagccagaaucccccuccaaacuugcaucagcgauacaaaaggcucacgaggaaggaaucugugggauccgaucaguaaccagacuggaaaaucugauguggaaacaaauaacaccggaauuaaaucacauacuaagcgagaaugaaguuaaacucacuauaaugacaggagauauuaaaggcauaaugcaagcuggaaaacguucgcucaggccacagccuacagaguuaaaauacaguuggaaagcgugggggaaggcgaagaugcuaucaacagagcuacauaaucauacauuucuaauagacgggccugaaacagcagagugcccaaauacuaaccgagcauggaacucuuuagagguggaagacuacggcuuuggaguauucacuacgaauauuugguugaaacuuaaagagaggcaagauguauucugugacuccaaacuuaugucagcugcaauaaaagacaauagagcaguacaugcugacauggguuauuggauagaaagcgcuuugaacgauacuuggaaaaucgaaaaagcaucuuucauugaaguuaaauccugccacuggccaaagucucauacacuauggucaaaugggguauuggaaagugagaugaucauucccaaaaauuuugcaggaccaguaucgcaacacaauuaucguccuggauaccauacucagacagcugggccguggcauuugggacgccuugagauggacuucgauuucugcgaggggacaacggucguaguaacugaagacugugguaacagaggaccuagccuaagaacaacgaccgcuaguggaaaacuuauaacagaaugguguuguaggagcuguacauuacccccgcugcgauaucgcggagaggacggauguugguacggcauggaaauuaggccgcuaaaagaaaaggaagaaaauuuagucaauucauuaguaacugcuggccauggucaaaucgacaauuuuucucugggcguuuuaggaauggcuuuauuuuuagaagagaugcuuaggacacgaguugggacuaaacaugcaauuuuacuugucgcggucagcuucgucacauuaaucacagggaauaugagcuuuagggaccuuggaagaguuaugguaaugguuggugcuacaaugacugaugauaucgguaugggcguuacuuaucuugcguuauuggccgcauuuaaaguacgcccaacauuugcggccggacuccuauuaagaaaacuaacaucaaaggaacucaugaugaccacuauuggaauaguucucuuaagucaaaguacuauaccagaaaccauacuggaguuaacggaugcauuagccuuagggaugauggugcuaaaaauuguuagaaauauggaaaaauaccaauuagcaguaacaauaauggcuauucuaugcguaccaaacgccgucauauuacaaaacgcuuggaaaguuaguugcaccacauuagcuguuguaucaguaucgccauuacuauuaacaagcucacaacaaaaagcggauuggauacccuuagcucuuacuauuaaaggacucaauccaacagcuauauuuuugacaacacuuucacgaacaagcaagaaacgaucauggccccugaacgaagccaucauggcuguaggaaugguuucgauacuagccaguucuuuacuuaaaaacgacauccccaugacugggccucuaguagcaggaggacuacugacggucuguuacguauuaaccggaaggagcgcagauuuggaguuagagagagccgcagacguucgaugggaggaacaagcggaaaucagugguagcagcccaaucuugucaauuacgaucuccgaagauggaucaaugaguauuaaaaacgaagaggaagaacaaacauuaacuaucuugaucagaacagggcuauuaguaauaucaggacucuucccaguaucaauaccaauaaccgcggcugcaugguaucuaugggagguuaagaaacaacgugcaggcguccuuugggaugugccgagucccccacccguagguaaagcagaauuagaggauggagccuaccggauaaaacaaaaggguauacuuggauacucucaaauaggagccggaguuuauaaagaaggcaccuuccauacaauguggcauguuacaaggggcgcaguuuugaugcauaagggcaaaagaauagaaccaucaugggccgaugucaagaaagaucuuauuucauauggugggggcuggaagcuggaaggggaguggaaagagggggaagaaguacaagucuuagcauuagagccaggaaagaauccgcgagcaguacagacaaaaccggggcuauucaaaacaaauacaggaacaaucggcgcaguuaguuuagacuuuucuccuggaacaagcggaucacccauaguugauaagaaaggaaaaguuguuggcuuauauggcaaugggguuguuaccaggucagguacuuacguaucggccauagcucaaacugaaaaaucaaucgaggauaauccggagauugaagaugauaucuuccguaagaaaagacuaacuauaauggaucuucacccuggagcaggaaaaacaaaaagauaucuaccagcaauaguacgagaggcaauuaaacgcggguuacguacccucauacuugcuccuacccgaguaguagcugcagaaauggaagaagcucuaaggggacuuccuauuagauaucagacucccgccauuagagcagaacauacggggagagaaauuguugaccucaugugucacgcaacauuuaccaugagacucuuaucuccaauacgaguaccaaauuauaacuuaauaauuauggaugaagcacacuuuacagacccugcuucaauugccgccaggggauauauaucaacccgggucgaaaugggugaagccgccggcauauuuaugacugcaacgcccccgggaucaagagauccuuucccacaaucuaaugcacccaucauggaugaggagcgagagauuccagaaagaaguuggaacucaggacaugaguggguaacagauuuuaaagggaaaacagugugguuugugccuucgauuaaggccggaaaugacauagcagcaugccuuaggaaaaaugguaagaaagugauacaacuauccaggaaaacauucgacaccgaguauaucaaaacgagaacaaacgacugggauuucguaguuacaacggauaucuccgaaaugggagccaauuuuaaagcagaacggguuauagacccacguagguguaugaaaccaguuauauuaacagacggagaagaacgagugauccuagcaggaccaaugccaguuacacauucaucagcugcgcagcgaagggggcgaguaggaagaaauccgaagaacgaaaaugaccaauauaucuauaugggagaaccauuagaaaacgaugaggacugcgcacauuggaaggaggcaaagauguugcuagauaauauaaacaccccagaaggcauaauuccuuccauguuugaaccugagagggaaaaaguagacgcuauagauggggaauaucgauuacgaggugaagcacgaaagacguucguugacuugaugagacgcggagauuuaccggucuggcucgcauauagaguugcggcagaagggaucaauuacgccgaucgaagauggugcuuugacggagucaaaaauaaccaaauauuagaagaaaacguggaggucgaaaucuggaccaaagaaggagaacgaaagaaacuuaaacccagauggcuugaugcgaggauuuacagugacccguuagcacuaaaagaguucaaagaguucgcggcaggccguaaaaguuugacccugaacuuaauuaccgaaaugggccgguuacccacauucaugacgcaaaaagcccgaaaugcauuagacaaccucgccguuuuacauacugcagaagccgguggcagagcauauaaucaugcucucagcgaauuacccgagacucuagaaacccucuuauuauuaacucuauuagcuacaguaacuggaggaauuuuucuauuucugaugagcggaaagggaauagggaaaaugacgcuggguaugugcuguauaauuacugcgucaauacuauuaugguaugcacagauacagccacacuggauagccgcgaguauaauacuagaguucuuucugaucguauuacucaucccagaaccagaaaaacaaagaaccccucaagauaaucaacuuacauacgucguaauugcgauacuuacggucguagcugcaacuauggcaaaugaaauggguuucuuagaaaagacaaagaaggauuucggccucggauccauaacgacccaacaaccagagaguaacauauuagauauagacuuacggccggcuucugcauggacucuauaugcgguggcaacgacguuuauaaccccaaugcuaagacauaguauugaaaacaguagcguuaauguaucucuuaccgccaucgccaaucaagcuacagugcuuaugggcuuaggaaagggauggccccuaagcaaaauggacauaggaguaccauuacuugcuauagguugcuauucacaaguaaaccccauaaccuuaacagcugcguuguuacuauuaguagcacauuacgcaaucaucgguccuggauugcaagcaaaagcaaccagagaagcccaaaaacgugcugccgcgggcauaaugaaaaauccaacggucgacgggauaacuguaauagaccuagaucccauaccuuacgacccaaaauucgaaaaacagcuugggcaaguaaugcuccuuguauuauguguuacucaagugcugaugaugcgcacuacaugggcguuaugugaagcucuaacacuagcaacagguccgauaucaacacuaugggaaggaaauccugggcguuuuuggaacacaaccauagcggucucaauggcaaacaucuucaggggaagcuaccucgcgggagccgguuuacuauuuucaaucaugaaaaacacugcuaauaccagaagaggaacugguaauacuggcgaaacucuaggugaaaaauggaaaaacaggcuaaaugcuuugggaaaaagcgaguuucagauuuacaagaaaaguggaauacaagaaguagauagaacguuagcaaaagaaggcauaaagagaggggaaacagaccaccaugcgguuagcagagguuccgcuaaacugcgcugguucguggaacgcaacuugguaacaccagaaggcaaaguugucgaccucggaugcggcagggguggauggucauacuacuguggaggauuaaagaacguuaaggaaguuaaaggacuaacaaaaggagguccaggacaugaggaaccuauacccauguccacguauggauggaacuuagugagacugcaaucagguguugauguauuuuucacaccucccgagaaaugugacacguugcucugugacauaggcgagaguucgccaaaucccacuguagaagcagggagaacacuuagagucuugaaucuaguugaaaacuggcuaaacaacaauacucaauuuugcauaaaaguucucaaucccuacaugccaucgguuaucgagaaaauggaggcccuacaaagaaaauacggaggagcacuuguuagaaauccuuuaaguaggaacucaacacacgagauguacuggguaagcaacgcuuccgggaacaucgucaguucagucaacaugauaucacgaaugcucauaaauagauuuacuaugagacauaagaaggcuacauacgaaccugaugucgauuuaggaucuggcacuagaaauauagguauugagagugaaacaccaaacuuagacauaauuggaaaacgaaucgagaaaauuaaacaagaacacgaaacgaguuggcauuacgaccaagaccacccauacaagacuugggcauaucacgguucuuacgaaacaaagcaaacaggaagugcaaguuccaugguaaacggaguggugcgauuguuaacaaagccaugggauguaauacccaugguuacgcaaauggcuaugaccgacacaacaccauuugggcaacaacgugucuucaaagaaaaaguugacacuagaacccaagaacccaaagaagggaccaaaaagcuaaugaagauaacagcugaaugguuauggaaagaguuggguaagaagaaaacgccaagaauguguaccagagaagaguucacaagaaaaguucgaucuaacgcggcucucggagcaaucuuuacagaugaaaacaaauggaaaucugcgcgcgaagcuguggaggacucggguuuuugggaauuaguagauaaagagaggaauuugcaccuggagggaaaaugugaaaccuguguuuacaauaugaugggaaagagggagaagaaacucggggaauuugguaaagcgaaagggaguagggccauaugguauaugugguuaggagcaagauuccuugaguuugaggcucuuggguucuugaaugaggaccauugguuuagcagggaaaauagccucucaggugucgagggggagggucuacacaaacucggauauauacuacgugacguaagcaagaaagaaggaggggcaauguacgcagaugauaccgcaggaugggacacccguauuacauuagaagaucuuaaaaacgaagaaauggucaccaaucauauggagggagaacacaagaaauuagcagaagcuauuuucagauugacauaucagaauaaagugguacguguucaaagaccuacgccaagaggcacuguuauggauaucaucagcagaagggaccagcgaggaagcggacaagugguuacauacggccuaaacacauuuacaaauauggaagcacaauuaauaagacaaauggaaggcgaaggagucuucaaauccauucaacaucuaaccguuacagaagaaauagccgucaaaaauugguuaguaagggugggaagagaacgauuaaguagaauggcgauuucaggagaugauuguguaguuaaaccgcuggaugaucgguucgcaagugcgcuaacugcacuuaaugacaugggaaaaguccggaaagacauucaacaaugggagccauccaggggauggaacgacuggacacagguaccuuucuguucucaccacuuccaugagcuaauaaugaaagauggacguguucuggucgugccguguaggaaccaagaugaguuaauuggacgagcccgcauaagucaaggagcugguuggagccuccgugaaacagccugucuggggaaaucauaugcucagauguggucauuaauguacuuucaucgacgagaccugcgauuagcagcaaacgcuaucugcucugcagugccgagccacugggugccuacuucacgaaccacuuggaguauacaugcuacacaugaauggaugacaacagaagacaugcucacuguauggaacaggguauggauacaagaaaacccuuggauggaagauaaaacaccggucgaaucaugggaagagauucccuauuuaggaaaacgugaagaucaauggugcggcagucuuauuggguuaaccagccgagcuacgugggccaaaaauauucaaacagcaauuaaccaaguucgaaguuuaaucggaaaugaagaauauacggauuacaugccaaguaugaagagauuucgcagagaagaagaagaagccgguguauuaugguag

SEQ ID NO: 22896 - RNA, 9876 nt, Artificial Sequence
  derived and/or modified CDS sequence (opt6) from DENV-2__KC131142__SS-prME
acugcagggauaauuaucaugguaauuccgacaguaauggcauuucacuuaacaacgcgaaauggagaaccucauaugauuguaucacgccaggaaaaaggaaaaaguuuauuguuuaaaacagaaaauggacuaaacauguguacucuaauggcuauggaccuuggagaauuaugcgaagacacaaucacuuauaacuguccauuacuaagacaaaaugaaccagaagauauagauuguuggugcaauuccacaaguacuuggguuaccuacggaacuugcacagcgacuggcgaacacagaagagagaaaagaucuguugcauuaguaccucauguuggaaugggauuagaaacccguacagaaaccuggaugucaucugaaggugcuuggaaacaugcacaacgaauugaaacauggguucuuagacacccuggcuucaccauaauggcagcgauacuugcguacacaaucggaacaacauacuuucagagggugcuuauauucaucuuguuaacugcaauagcaccuagcaugaccaugcgaugcauaggaauuucuaaucgagacuuuguugaaggcguuaguggaggaaguuggguagauauuguguuagaacauggcucguguguaacaacgauggcgaaaaacaaaccaaccuuagauuuugaacucauuaaaacagaagcaaaacauccagcgacguugcgaaaauauuguauagaagcaaaauuaacaaauacgacuacggcgucccguugcccaacucaaggagaaccuagucuuaaugaagaacaagauaaaagguuuguauguaaacacucaaugguggauagagguuggggcaauggaugcggacuauucggaaaagggggaaucguaaccugugcgauguuuacaugcaagaaaaauauggaggguaaaauaguucaaccagagaacuuagaauacacaauaguaaucacuccacacagcggcgaagagaaugcuguagggaacgacacgggaaaacacggaaaggagauaaaagucacuccacagaguucaauaacugaggcagaacuuacugguuacgguacugucacuauggaaugcucuccuagaaccggauuagauuuuaacgaaaugguuuuauuacagauggaaaauaaggcuuggcuaguucauaggcaaugguucuuagacuuaccauugcccuggcuuccuggagccgauacacaaggauccaacuggauucaaaaggaaacacugguuacauuuaaaaauccccaugccaagaaacaagaugucguaguacugggaucccaagagggcgcgaugcauacugcauuaacaggcgcaaccgaaauucaaauguccagcgguaauuuacuuuuuacaggucaccuuaaguguagauugcgaauggacaaacuucagcuaaagggaaugucauauagcaugugcacaggaaaauucaagguaguaaaagaaauagccgagacucaacaugguacaaucgugauaagaguacaauacgagggagacggcagcccauguaagauucccuuugaaauaauggauuuggagaaaagacacguucuugggagacuaauaacaguuaacccaauugucaccgaaaaggauuccccagugaauauugaagcagaaccuccguucggugauaguuacaucauaauaggaguugaaccuggucaauuaaaacuaaguugguucaagaaaggcucaucaauagggcagauguuugaaacaacaaugagaggugcgaaacgaauggcgauucuaggagauacugcuugggauuuugggagccugggaggaguguucacaaguauagggaaagcccuacaucaaguguucggagcaauuuacggcgcggccuucucaggggucagcuggacaaugaagauuuuaauaggagugguaaucacauggauagggaugaacucgagaucuacaagccucucaguaagucucguauuagucggaguuguuacacuuuaucuaggaguuauggugcaggccgauucuggcuguguaguaucauggaaaaauaaagaacuaaaaugugguucaggaauuuuuaucacggauaacguccauaccuggacugaacaguacaaauuucagccggagucacccaguaaacuugcaagugcuauacaaaaggcgcaugaagaaggaaucuguggaauuaggaguguaacucggcuagaaaauuuaauguggaagcaaaucaccccagagcucaaccauauacucucggaaaacgaaguuaaacuaacuauuaugacgggcgauaucaaggggauaaugcaagcagguaaacgcucacuaagaccccaaccaacagaguuaaaauacaguuggaaggcuuggggcaaggcaaaaauguuaagcacagaacuucauaaucacacauuccucauagacggaccggaaacugcagaaugucccaacacaaaucgugcauggaacucacuggagguagaagauuacgguuucggcguauuuaccacuaacauauggcuuaaguugaaagaaagacaagauguauuuugugauagcaaacuaaugucagccgccauaaaagacaauagagccguucaugcagacauggguuacuggauugaaucagccuugaaugauaccuggaaaauagaaaaagcgagcuucaucgaggucaaaucgugucacuggccaaaaucucacacacuuuggaguaacgguguacuggaaucggagaugauaauacccaaaaauuuugcaggaccuguaucacaacauaauuacagaccgggguaccauacucaaaccgccgggccuuggcauuuaggucguuuagagauggacuuugauuucugcgaagggacuacuguaguagugacggaagauugcgggaaccggggaccuucacucagaacaacaacggcuucaggaaaguuaauaacggaauggugcuguagaucauguacacuacccccacugcguuauagaggggaagauggcuguugguacgggauggaaauuagaccacuaaaagagaaagaagaaaaccugguuaacaguuuagucacugccggacauggccaaauagacaauuuuagucuaggggugcuaggaauggcauuguuucuggaggaaauguuaagaacgcgaguaggaacgaagcaugcgauuuuauugguagcaguaaguuucguaacucuaauuacgggaaacaugagcuuccgugaccuagguagaguaaugguuauggucggugcaacuaugaccgaugauauagguaugggcguaaccuaccuagccuuacuagcugcauuuaagguccgcccuaccuuugccgcugguuugcuauugagaaaauuaacuuccaaggaacugaugaugacaacgauagguauuguauuauuaagucagucaacaauuccagaaacaaucuuagaacuaacggacgcucuugccuugggaaugaugguauuaaaaauagucaggaacauggagaaauaucaacucgcgguaacgauaauggccauauuaugcgugccgaaugcggucauucuacaaaaugcguggaaaguuaguuguaccacgcucgccgugguaucagugagccccuuauuauugacaucgucgcagcaaaaagccgauuggauaccucuagcacuuacuauaaaaggucuaaauccaaccgcuauauuccuaacgacauuaagucgcacgagcaaaaagcgaaguuggccauuaaaugaagccaucauggcaguaggaaugguaagcauauuagcaucuagcuuacuaaagaaugauaucccaaugacaggucccuugguggcgggcggccuccuaacaguaugcuacguacuaaccggaagaucggcagaccuagaguuagaaagagcagcagauguuagaugggaagaacaggcagagauuucaggaucaagcccaauacugaguauaacaaucagcgaagauggaaguaugaguauuaagaacgaagaggaagaacagaccuugacuauacuuauaagaacaggccuauuagugauuaguggcuuauuuccgguaucuauaccaauaaccgcggccgccugguacuuaugggaagucaagaaacaaagggccgggguuuuaugggauguuccuucacccccuccugucggaaaagcugaauuggaggauggugcauaucgaauuaaacaaaaaggaauacuaggauauucacaaauaggugcaggaguguacaaggaaggaaccuuucacacaauguggcacguaacuagaggggcaguucucaugcacaagggcaaacguauagaaccaucuugggcagaugugaagaaagaucucauauccuacggaggagguuggaaauuagaaggugaauggaaggaaggagaagaaguacaaguacuagcgcuugagccgggaaagaacccaagagcaguucaaaccaagccaggacuauuuaaaaccaauacaggcacaauaggugcagugucguuagauuuuaguccaggcacauccggaaguccuaucguugauaaaaaggguaaaguuguaggauuguaugggaacgguguugucacgaggaguggaacauacguuagugcgauagcccaaacugaaaaaucaaucgaagacaaccuagaaauagaagacgacauauuuaggaagaaacgucucacuguaauggaccuacacccaggugcagguaaaacaaaacguuacuuacccgcaauagugagagaggcuauaaaacggggacugagaacacuaauuuuggcaccgacucgagugguugcugcugaaauggaggaagcucuuagggguuugcccauaagguaccaaacgccggcaauccgagcagagcauacgggcagagagauaguugaccuaaugugccaugcaacuuuuacaaugaggcuuuuaucccccauuagaguaccuaauuauaaucugauuauaauggacgaagcucacuucacugauccagccaguauagcagcuagaggauacauaucuacaaggguagaaaugggggaggcagccggcaucuucaugacggcaacgccaccuggaucacgagacccuuuuccacaaucuaaugcucccaucauggaugaagaaagagagauccccgaacgaaguuggaacucaggucacgaaugggugacagauuuuaaaggcaagaccgucugguucgugccuaguauaaaagcuggaaacgacauagcagcaugcuuacgcaaaaauggcaagaaagugauacaguuaucgcgcaaaacuuuugauacagaguacauuaaaacccgaacgaaugauugggauuuugugguaaccaccgauauaucagaaaugggcgcgaauuucaaggcagaaagaguaauugauccaagacgauguaugaaaccuguuauauugacagacggugaggaaagaguaauauuagcaggaccgaugccuguuacccacagcucugcagcucagaggaggggacgaguugggagaaaucccaaaaaugaaaaugaccaguauauauauaugggugaaccucuugaaaacgacgaagauugcgcucacuggaaggaagccaaaauguuguuagacaauaucaacacgccagaaggcaucauccccagcauguuugagcccgaacgagaaaaaguagacgccauagacggagaauaccggcuacggggagaagcuagaaaaacauuuguggaucuuaugcgcagaggagacuuaccuguaugguuggcauaccgaguagcugcggaagggauuaauuaugcagaccggcguuggugcuuugacggggugaaaaauaaccaaauacuagaggaaaauguugaaguugagauuuggacuaaagaaggagaacgaaagaaacucaaaccccggugguuagacgcgcgcaucuauagcgacccauuagcuuuaaaagaguucaaagaguucgcagccgggagaaagagcuuaaccuugaaucugauaaccgaaaugggacgacuacccacguuuaugacacaaaaagcacgaaaugcuuuagacaacuuagcuguuuuacauacggcagaagcuggaggacgugcuuauaaucaugcauuaucugagcuucccgaaacgcucgagacacuccuccucuugacccuacuagcgacaguaacaggaggaaucuuuuuguucuugaugagcgguaaagggauuggaaaaaugacgcuaggaaugugcugcauaauaacagcuucaauacucuuaugguacgcacagauacaaccucacuggaucgcugcaucaaucauauuggaauuuuucuuaauuguuuuguuaaucccagagccggaaaaacagaggacuccgcaagauaaucaauuaaccuaugucgucauagccauacuaacggucgucgcggcaacaauggccaaugaaaugggauuccuagagaaaacuaagaaagauuuuggauuaggaaguaucaccacccaacagccugaaagcaauauuuuagacaucgacuuaaggccagcauccgccuggacacuguaugcaguagccaccacuuuuaucacgccgaugcugagacauucuauugaaaauucgaguguaaaugucaguuuaacagcaauugccaaucaagcaacuguucugaugggauuaggaaaaggguggccacuuuccaaaauggauauuggaguaccgcugcuagccauagguuguuacucacaagucaacccaauuaccuuaacagcagcacucuuauuauuaguagcucauuaugccauaauaggaccaggcuugcaagcaaaagcgacuagagaagcacagaaacgagcugcagcagguauaaugaaaaacccuacggucgacgguauuaccgucauagaucuagauccaaucccauaugauccuaaauuugaaaagcaauuagggcagguaauguuauuagugcuuugcguaacucaaguacuaaugaugagaacuacaugggcacugugcgaagcauuaacacuggcuacagguccuaucaguacucuaugggagggcaauccaggaagauuuuggaauacaaccauagccguuucaauggcuaacauauucagggguucauaucuagcuggagcuggucuucuauucagcauuaugaaaaacacagcaaauaccagaagagguacugguaacacgggagagacacuuggggaaaaauggaagaaccgcuugaaugcacucggcaagagcgaauuucagauuuacaagaaaucgggcauucaagaaguagacagaacucuagcuaaggaagggauuaaaagaggggagacagaucaucacgccgugaguagagggucggcaaaauuacgaugguucguugaaagaaaucuuguuacaccagaaggcaaaguaguggaccuagguugcgggcgaggcggauggagcuacuauuguggaggacucaaaaacgucaaagaaguaaaaggcuuaacuaaaggaggcccaggucaugaggaaccaauaccaaugucuacguauggauggaaucuuguaagauuacaaaguggaguagacguauucuucacaccgccugaaaagugcgauacucuucuaugcgacauaggugaaucaucacccaauccuacagucgaagcaggacgaaccuuaagaguauuaaacuuagucgaaaauuggcucaacaacaacacacaauuuugcauaaaaguccuaaauccuuauaugccaucagugauagagaaaauggaagccuuacaaagaaaauacggaggcgcauuaguaagaaauccauuaucgagaaauucaacccacgaaauguauugggugucaaacgcguccggaaacauaguuucuucgguaaacaugaucucacguauguugauaaauagauucacaaugcgacauaaaaaggcaaccuacgaaccagacguugaucuaggaagugggacaagaaauauuggaauagaaagugaaacuccaaauuuagacauaaucggaaagcgaauagagaaaauaaaacaagagcaugaaacaagcuggcauuaugaccaggaucacccauacaaaacaugggcauaccauggaucauacgaaacaaaacagacgggaucagcgucaaguaugguaaaugguguaguaaaacuguugaccaaaccuugggacguuauccccaugguuacacaaauggcgaugacagacacaacaccauuuggacagcaaagaguuuuuaaggaaaaggucgauacuagaacucaagaaccuaaagaaggaaccaaaaaguuaaugaaaauaacggcugaaugguuauggaaagaauuaggcaagaagaaaacuccacguauguguacuagagaagaauuuacccguaaaguaagaucgaaugcagcacugggagcaauauuuacggaugagaacaaauggaaaucagcccgaggugccguggaggacuccgguuuuugggaauuaguggauaaagaacguaaccuacacuuggaagguaaaugcgaaacaugcguauacaacaugaugggaaaacgagaaaagaaacucggagaauuuggaaaggcuaaagggucaagagcaauuugguacauguggcugggcgcccgauuuuuagaguucgaggcuuugggauuucuuaacgaggaucacugguucuccagagaaaacagucuuucaggggucgaaggcgaaggauugcacaaauuagguuauauccuacgagauguaucgaagaaagaaggaggugcaauguaugcagaugacacggcaggaugggauacgcgaauuacauuggaagauuugaagaacgaagaaaugguaaccaaucacauggaaggaguacacaagaaacuagcagaagccauauuucgacucacauaccagaauaaaguaguuagaguacaacggccaacgccccgagguacggucauggauaucauaucacgcagagaucaaagaggaaguggucagguaguaaccuacgguuuaaauaccuucaccaauauggaagcacaacuuauacgucaaauggaaggcgaaggaguuuucaagucuauacagcaucuaacaguaacggaagagauagcugucaaaaacugguuagucagagucggaagagagcgucuuaguagaauggcgauaagcggagaugacugcguggugaaaccacucgacgaccgauuugcaagugcucucaccgcauuaaaugauauggggaaaguccgaaaagacauacaacaaugggagcccucccgugguuggaaugauuggacucaagucccuuuuugcucucaccauuuucacgagcucauuaugaaagaugggaggguccucguaguuccuugucgaaaccaagaugaacuaauagggagagcccgaauaagucaaggugccggcuggaguuugcgagaaacugcuugucuaggcaaguccuaugcucaaauguggucauuaauguauuuucauagacgcgaccuaaggcucgcggcaaacgcgauaugcucagcuguaccuucucauugggugccuacaucacguacgacauggagcauacaugcuacccacgaguggaugacuacggaagauauguuaacagucuggaacagaguguggauacaagaaaacccuuggauggaagauaaaacuccuguagaaucgugggaggaaauacccuauuuaggcaaaagagaagaccaauggugcggcucguuaauaggguugaccagucgagcaaccugggccaaaaauauacaaacugcgaucaaucagguaagaaguuuaauaggaaacgaagaauauacagauuauaugccgucaaugaaaagauuccggagagaggaggaagaagcaggaguauuaugguaa

SEQ ID NO: 22897 - RNA, 9876 nt, Artificial Sequence
  derived and/or modified CDS sequence (opt6) from DENV-2__AY858035__SS-prME
acagcugggauuaucauaaugaugaucccgacagugauggcauuucauuuaacgacacgaaacggugaaccucacaugauaguaucgcgucaagaaaagggaaaaagccuucuuuuuaagacagagaacggcguaaacauguguacgcuaauggcuauggaucucggggagcuaugcgaagacacuaucacguauaacuguccucuucuuaggcaaaaugaaccugaagauauagauuguugguguaauaguaccagcacauggguaacauauggaacguguacugcuacaggggaacauagaagagaaaaacgcucaguugcauuagucccgcaugucggaaugggucuggaaacacguacagaaacguggaugucgagugagggcgcuuggaaacaugcgcaaagaaucgagacuuggguacuacggcacccugguuucacgauaauggcagccauuuuggcguacacaauaggaacgacauauuuucagagaguauuaauuuucauccuuuugacugcaguagcaccaucuaugacaaugagaugcauaggcauaucaaauagagauuuuguagaagguguuuccggcgguucauggguugacaucguauuagaacaugguagcuguguaacuacuauggcuaaaaacaaaccaacauuagacuucgaguugauaaaaacagaagcaaagcaucccgccacccucagaaaauacuguaucgaagcuaaacucaccaacacaacaacagcaagucguugcccgacucagggcgaacccucacuaaacgaagaacaagauaaaagauucguguguaaacauaguaugguagauagggggugggggaacggauguggauuguuuggcaaagguggaaucguuacaugugcaauguuuaccugcaaaaagaacauggaagguaaaauaguucaacccgaaaaccuugaauauacaauaguuauaacgccacacaguggggaagaaaaugcaguugggaacgauacaggcaaacauggaaaggaaauaaaggucacaccacaauccucgauuacggaagcagaacuaacaggauauggaacuguaacaauggaaugcucaccaagaacaggucuugauuuuaacgaaauggugcuauuacagauggaaaacaaagcuugguuaguacaccgacaaugguuucuagaucugccucuccccugguuaccaggagcugauacucaaggauccaauuggauccaaaaggagacacuagugacauuuaagaacccucacgcgaagaagcaagacguaguaguuuugggcagccaagaaggagcaaugcauacagcccugaccggagcaacggagauacaaaugaguucuggaaaucuacucuucaccggucacuugaaaugucgguuaagaauggauaaacuacaacugaagggcaugaguuauucaauguguacuggaaaauucaaaguuguuaaggaaaucgccgaaacucaacacggcacaauagucauacgcgugcaguacgagggggauggcagcccgugcaaaauaccauuugagaucauggaccuggaaaaacgacacguacucggaagacuuauuacaguuaauccaauuguuacggaaaaagacagcccagucaauauugaagcugaaccuccguuuggcgacucauacauaauuauaggggucgaaccaggacagcuuaaauugucuugguuuaaaaaaggaucaaguauagggcaaauguucgaaacgacuaugagaggggccaaacgaauggcgauuuuaggagauacugcaugggacuucggaucacucggcgggguauuuacgucuaucggaaaagccuugcaucaagucuucggagcaauauauggugcggcuuuuucaggugucuccuggacaaugaagauccuuauaggaguaguuauaacauggauagguaugaauucucgcucaacuucucuaucaguauccuugguacuaguaggaguggucacuuuguaccuuggagucaugguucaagcagauagcggaugcguggucagcuggaaaaauaaggaacucaaauguggauccgguaucuucauaacagauaauguccacacguggacagaacaauauaaauuucaaccagaaucacccucaaaacuagcauccgcgauacaaaaagcucacgaagaaggaauuugugguauaagaagcguaacuagacuagaaaacuugauguggaagcaaaucacaccagaauugaaccacauuuuaucagaaaaugagguaaaacuaacgauaaugacaggggauaucaaagguaucaugcaagcaggcaagcggucucuacgaccacaaccaaccgaacuaaaauacucauggaaaaccuggggaaaggcaaaaauguuaucaacugaauuacacaaucacacuuuccucauagaugguccggagaccgcagaauguccaaauacuaaucgugcauggaauucauuggaagucgaagauuacgguuucggggucuuuacuacaaauauauggcuuaaacucaaagaaagacaagacguauucugugacucaaagcucaugucggcugccauaaaagauaacagagcaguccaugcagacauggguuauuggauagagucagcacucaaugacacauggaaaauagaaaaagcaucauuuaucgaagugaaauccugccauuggccuaagucacacacacucuggucaaacggcguacucgaaucagaaaugauuauaccuaaaaacuuugcaggucccgucucgcagcauaacuaucgucccgguuaccauacccagacagcaggaccauggcauuugggacgacuggagauggacuucgacuuuugugaaggaacgaccgugguuguuaccgaagauugugggaaccgaggacccagcuugagaacaacuacggcuaguggaaaacucauaacugaauggugcugcagguccugcacgcucccaccauuaagauaucguggggaggauggcuguugguacggcauggagauucggccucuaaaagaaaaggaagaaaaccuaguuaacucauuaguuacggccggacacggucaaauugacaacuuuucacucggugugcuagguauggcguuauuccuagaagaaaugcuccguacccguguggggacaaaacaugcgauacuguugguagccguaucauuugucacacugauaacugguaauaugucuuuuagagaucucggaagaguuaugguaaugguuggagcaacgaugaccgaugacauagguaugggagucacauauuuggccuuacuagccgcuuuuaagguacggccaacauuugcagcuggccuuuuauuacgaaaacucacuucgaaagaacuaaugaugacaacaauagggauaguccuacuaucacaauccaccauuccagaaacgauccuagaacugacagacgcacucgccuuaggaaugaugguauuaaagauaguuagaaauauggaaaaauaucaacuagcagucacuauuauggcaauuuuauguguaccuaaugcuguuauauuacaaaaugccuggaaaguuagcugcaccacacuugcagucgugucugucucaccccuguuauugaccaguucccagcaaaaagcagauuggauuccgcuagcucuuaccauaaaaggacuaaacccgacagccauauuuuuaacuacauuaucaagaacgucuaaaaaacgaaguuggccucuaaaugaagcuauuauggcuguuggaauggucucuauacuugccucgucuuugcuaaagaaugauauaccaaugacagguccguuaguggcggguggucuauugacagucuguuauguguuaacuggaagaucugcugaucuggaguuggaacgugcagcggauguuaggugggaagaacaagcagaaauuaguggauccuccccgaucuuguccauaaccauaucugaagauggaagcaugucaauaaaaaaugaggaagaagaacagacgcuaaccauucuuauacgaacagguuuauugguaguuagugggcuauucccaguaagcauaccaaucacugcugcagcaugguauuuaugggaagucaagaaacaaagagcaggaguccuaugggacguccccucuccaccgccggucggcaaagcagaauuagaagacggugcguaccgaauuaaacaaaaagguauacuugguuacagucagauuggagcuggaguuuauaaagaaggaacuuuucauaccauguggcaugugacaaggggugcagucuuaaugcacaaagguaagcgcauagagccgucuugggcugauguuaaaaaggacuuaauaucauauggaggagguuggaagcucgaaggcgaguggaaagagggagaagaaguccaggucuuagcucuagaaccaggaaaaaauccacgggcaguacaaacaaagccgggacucuucaaaacgaacacugggacgauaggagcuguaaguuuagauuuuagcccugggaccucuggcagucccaucguugauaaaaaagguaaaguuguagguuuauaugguaacgguguuguuacacgaaguggcacuuauguaagcgcaauagcucaaacagaaaagucaaucgaggauaacccggagauugaagacgauauauucaggaagaaacgcuuaacaaucauggaccuucauccgggagcuggaaagacgaaacguuauuuaccagcaauaguuagggaagcaauuaaaagaggucuaagaacgcuuauacucgcaccaacucgagugguugcugcagaaauggaggaagcacucaggggacuaccgauaagguaccaaaccccagcuauuagagcagaacacaccggacgcgaaauaguagauuuaaugugccaugcgacauucacuaugagacuauugagucccauaagaguaccaaauuauaaucuaaucaucauggaugaagcacacuuuacagaucccgcuaguaucgcagcgcggggauacauaucaacaagaguugaaaugggggaagcggcugguauuuucaugacagcaacuccgccuggcagucgcgacccauuuccucaaucaaaugcgccuauuauggacgaagaaagagaaauccccgaacgcucauggaauagcggccaugaaugggucacugauuuuaaagguaaaacgguuugguucguaccaaguauaaaagcagggaacgacaucgcagcuuguuuaagaaaaaauggcaaaaaggucauacagcugagcagaaagacuuucgacucggaauauauaaagacuagaacaaaugauugggauuuuguaguaacgacggacauauccgagaugggugcgaauuuuaaagcagaacgcguaaucgauccucgacguugcaugaaaccaguaauacuaaccgacggagaagaaagagucauccuagcagguccgaugcccgucacgcauaguuccgcugcacaacgucguggcaggguaggaagaaauccaaagaaugaaaaugaucaauauauuuauaugggugaaccccuggagaaugaugaagauugugcacauuggaaagaagcuaaaauguugcucgauaauauuaauacaccagaagguauaauacccuccauguucgaaccagagcgagagaaaguugaugcgauugauggggaguaccgccuucggggugaggcuagaaaaacguuugucgaucuuaugagaaggggcgaccuuccuguaugguuagccuacaagguggcagcugaaggaauaaacuacgccgacagacguuggugcuuugacggaguaaaaaauaaucaaauccuagaagaaaacguugaaguagaaauauggacuaaagaaggggaaagaaagaaauuaaaaccuagauggcuggacgcacggauauauucugaucccuuagcacuaaaagaguuuaaagaauucgcagcuggcagaaaaagucuaacccuuaaucuaauuaccgaaaugggacgacuaccaacauuuaugacucaaaaggcaagaaacgccuuggauaacuuagcagucuuacauacugcugaagcggggggaagggcauacaaucaugcauugagugagcuuccagagacgcuugaaacacuauugcuacugacacugcuggcuacugugacaggcggcaucuuucuauuuuugaugagugggaaagggaucgguaagaugacccuagguaugugcuguaucauuacagcaucaauccuacuaugguacgcgcagauucaaccccacuggauagcugcuaguaucauuuuggaauucuuccuuauuguucuccuuauaccugagccugaaaaacagcgaacaccgcaagauaaccaauuaacuuauguugugauugcuauuuugacaguaguugcagccacgauggcuaacgaaauggguuuucuugagaaaacuaaaaaagacuuuggccuugguucgauaaccacacaacaaccagaaucaaauauacuggauauagaccucaggccagccucagcauggacccuauaugcaguugcaacaacauucauuacuccaauguuaagacauucaauagaaaauucuucugugaacguguccuuaaccgcaauugcaaaucaagcaacagucuuaaugggacucggaaaaggguggccacugucaaagauggauauaggaguaccuuuauuagcaauuggauguuacucacaggucaauccaauaacucuuacugccgcacugcuucuuuuaguagcacauuaugcuaucaucgggccaggacuacaagcaaaagcuacacgugaagcacagaaacgagcagcugccgggauaaugaagaacccuacaguugauggcauaaccguuauugacuuagacccuauaccauaugauccgaaauucgaaaaacaauuaggccagguaauguugcucguauuguguguuacccaaguccugaugaugaggacgacuugggcucuuugcgaagcauuaacguuagcaacaggaccaauuucuacccucugggaaggaaaccccggaagauucuggaauacaaccauagcagugucuauggcaaauauauuucgagguucauaucuagccggggcgggacuacuguuuucuauuaugaagaacacagcuaauacaaggagggggacugggaauacuggugaaacacuuggcgagaaauggaaaaacagacucaacacccuagggaaaucagaguuccaaauauauaaaaaaagcgguauccaggaaguagauagaacauuggcuaaagaaggcaucaaaagaggugagacugaucaccaugcaguaaguagaggcucugcaaaacuacgcugguuuguugaaagaaaucuaguaacaccugaagguaaaguugucgaucuaggaugcggaagagggggauggaguuauuauugugguggacugaaaaaugugaaagagguaaaaggacugacgaaaggcggaccuggacaugaagaaccuauaccgaugagcacauauggcuggaacuugguucgacuacagagcggaguagauguauucuucaccccacccgaaaaaugcgauacauuacuuugcgauauaggagaaagcagccccaacccaacaguagaagcuggccgcacacuuagagugcuuaaucucguagagaacuggcuaaacaacaacacucaguuuugcauaaaaguguuaaauccauacaugcccucaguuauagaaaaaauggaagcguuacaaagaaaauaugguggagcacucguacggaacccguugagccguaauucuacacacgaaauguauuggguauccaaugccucuggaaauaucguaucuagugucaauaugaucaguaggaugcuuauuaacagauuuaccaugagacacaaaaaagcaacauaugaaccugacguggaucuugggucugguacccgcaacaucgguauugaaucagaaauuccaaauuuagauauuauagguaaaaggaucgagaagauaaagcaagaacaugaaaccucauggcacuacgaucaagaccauccauauaagacuugggcuuaucacggcucauacgaaaccaaacaaacagguuccgccaguaguauggugaauggaguagucagauuauuaacaaaacccugggauguaauucccaugguuacacaaauggcaaugacagauacaacucccuuuggacaacaaagaguuuucaaagaaaaagucgauacacggacgcaagagccaaaggagggaacuaagaaauuaaugaaaauaacggcggaguggcuuuggaaggaacuggggaagaaaaagacuagaagaauguguacaagagaagaauuuacaagaaaaguacgcaguaacgcugcccuaggcgcgauuuucacagacgaaaacaaauggaagucugcgcgagaagccguagaagacucuggcuuuugggaauugguggacaaagagcggaauuuacaucuugagggaaaaugcgagacauguguguauaacaugaugggcaaaagagaaaagaaacuuggagaguuugggaaagcaaagggaucacgagcuaucugguauauguggcuuggagcacgauuccuugaauucgaggcuuuaggcuuuuuaaaugaagaucauugguuuaguagagaaaacaguuuaaguggagucgagggugaaggucugcauaaacuaggauauauacuccgagacguuagcaaaaaggagggaggugcaauguaugcagacgauacugcaggaugggacacaaggauaacauuagaagaccuuaaaaacgaggaaauggugacaaaccauauggagggagaacauaaaaaauuggcagaggcuauuuucaaauuaaccuaccaaaacaaagucguaagaguccaaaggccuacuccaagaggaacaguuauggacauuauauccaggagagaucaacgaggaagcggacaaguagucacuuaugggcuuaacacauuuacaaacauggaggcccaauuaauacgccaaauggaaggcgaaggaguguuuaaaucaauccaacaacucacaguuacggaagaaauagcggucaaaaacuggcucgaacguguuggucgcgaacgauugucuagaauggcaaucaguggggaugauugcgugguaaaaccacuagaugacagauucgccucagccuuaacugcuuuaaacgauaugggaaaagucagaaaagacauacaacagugggaaccgagucgaggauggaaugauuggacacaaguuccauucuguucgcaucauuuucaugaacuuaucaugaaagauggccgugucuuaguaguaccaugcagaaaccaagacgaacuuauugguagggcaagaaucagccaaggagcuggguggucacuucgcgaaacagcuugccucggaaaaaguuacgcucaaauguggagccuaauguacuuucaucgaagggaucuacgauuagccgccaaugcaauuugcucugcaguuccaucacacuggguaccaacguccagaacuaccuggucgauacaugcaacccacgaauggaugacaaccgaggauaugcuuaccguauggaauagaguauggauucaggaaaaucccuggauggaagauaaaaccccuguagaaucuugggaggagauaccauauuugggaaaacgagaggaccagugguguggaucccuuauuggacuuacaucccgagcuacuugggcaaaaaauauccaaacagcaauuaaucaaguaagaucgcuaaucggaaaugaagaauacacagacuauaugccuucaaugaaacgauuuagaagggaagaagaagaagcaggcguccucugguaa

SEQ ID NO: 22898 - RNA, 9873 nt, Artificial Sequence
  derived and/or modified CDS sequence (opt6) from DENV-2__JX567951__SS-prME
acugcaggaguuauaguuauguugauaccaacagcaauggcuuuccaucuuacuacucgaaauggagaaccacauaugauaguaggacgacaagaaaaaggaaaaaguuuacuauuuaaaacggaagauggaguaaauaugugcacucugauggccauagaucuaggagaacuuugcgaagacacuaucacguauaaauguccucuacuacgacagaacgaaccugaagauauagacugcugguguaauucaacgucaacuuggguaacauacgguacauguacaacaacaggcgaacacagacgagaaaaacgaaguguggcccuaguuccgcacguaggcaugggccucgaaacgcgaacugaaacguggaugaguagugaaggagcuuggaaacacguccaaagaaucgaaacuuggauacuuagacauccagguuuuacuaucauggcugcgauacucgcauacacaauagguacaacgcauuuccaacgcgcuuuaaucuuuauacuuuuaacggcgguagcgccguccaugacgaugcgauguauaggaaucucaaaccgagacuuuguagaaggugucaguggaggcucuuggguugacaucguauuggaacaugguuccugugugacgacaauggccaaaaauaaaccuacacucgauuucgaacuaauaaaaacugaagcuaaacagccagcgacgcuacgaaaauacuguauagaagcgaaacuaacuaauaccacaaccgaaaguagaugcccaacucaaggagaaccaucauuaaacgaagaacaagacaaacgguucauauguaaacauaguaugguagaucgcggauggggaaaugggugcggucucuucgguaaaggugggauagugacaugcgcuauguucacuuguaagaaaaauauggaaggaaaaaucguucaaccagaaaaucuggaauacacaauaguuauuacgccacauucaggagaggaacacgcagucggcaacgacacugggaaacauggaaaagaaauuaaaauuacaccucagucgagcacuacggaagcagaacucaccggauacgggacuguaacaauggaauguagcccgcgcacaggauuagacuucaacgaaaugguauugcuccaaauggaagacaaagcauggcuaguacauagacagugguuucuugauuuaccgcuaccauggcuuccaggagcugauacucaaggcucuaauuggauacagaaagaaaccuuagucacauuuaaaaauccgcacgccaagaaacaagauguaguaguuuuaggcucacaagaaggcgccaugcacacggccuuaacuggugccacagaaauccagaugucgucaggaaaucugcuauuuacgggacaucuaaaaugcagauuaagaauggauaaauuacaacuuaaagguaugagcuauaguauguguacagggaaauuuaaaauaguuaaagaaauagcggaaacccaacaugggaccauugugauucgaguacaauaugaaggagacggcucaccauguaagauaccauucgaaauaacugacuuggagaaacgacauguacuaggcagauuaaucacuguuaacccaauuguuacagaaaaagauaguccaguaaauauagaagcugagcccccuuucggcgauucauauauuauuguaggaguagaaccagggcaacuaaagcuaaauugguuuaaaaagggauccucaauaggucaaauguuugaaaccacuaugcgcggcgcaaaaagaauggcaauuuuaggagacaccgcaugggacuuugguucauuaggcggugucuuuacgagcauugguaaagcacuccaccaaguauuuggugcaaucuacggugcugcguucaguggaguauccuggacaaugaaaauacucauaggugucauaauaacguggaucgggaugaauaguagguccacgucacuaucaguuucguuaguauuaguaggaguuguaacauuguaccuuggcgcaaugguucaggcugauucggggugcauaguaucguggaagaacaaagaauuaaaaugugguaguggaauuuuuauuaccgacaacguacacacauggacugaacaauauaaguuccaaccagagaguccaucuaaacuagcaucagcaauccaaaaggcucaugaagaaggaauaugcgggaucaggucgguaacacgccucgagaaucucauguggaaacagaucacuccagaauuaaaccacauauugucagaaaaugaaguaaaauuaacuauaaugacuggugauaucaaaggaauaaugcaagcuggaaaaaggagucugcgaccacagccaacagaacuaaaguacucuuggaaaaccuggggcaaagcaaaaaugcuaucuacggaaucccauaaucaaacuuuucuaauagaugggccugaaacagcagaaugccccaacacaaacagggccuggaauagucuagaagucgaagauuacgguuucggaguguuuacuacgaauauuugguuaaaacuacgagaaaaacaagauguauuuugcgauaguaaauugaugagugcggccauuaaagauaaucgugcaguacaugcagauaugggauauuggauugagagugcguuaaacgauacuuggaagauggagaaggcuaguuuuaucgaagucaaauccugucacuggccuaagucgcauacucuauggucaaauggaguacuagaaucagaaaugauuauccccaaaaauuucgcaggcccaguuucacagcacaauuaccgacccgguuaucauacucagacggcggggccauggcaucuagguaaauuggaaauggacuuugauuucugcgaaggcaccacagucguugucacggaagauugugguaaucgaggacccuccuuaaggacaacaacggcuucaggcaaguuaaucacugaaugguguugucgcucaugcacgcuuccgccucugcgguaccguggugaagauggaugcugguaugguauggagauaagaccacuuaaggaaaaagaagagaaucucguaaauucccucgucacagccggacauggucaaauagacaauuuuagcuuaggcgugcucgguauggcucucuuucuagaggagaugcuacguacuagaguuggaacaaaacaugccauuuuguugguagcccuaaguuucguaacauugauuacaggaaauaugucauucagagaucuuggucgcguaaugguaaugguuggugccacuaugacugacgauauagggauggggguaaccuaucuagcacuauuggcugccuucaagguuaggcccacguuugcagcaggacuacugcuuagaaaguuaacaucgaaagaacugaugauggcaacaaucgguauagcuuuacuaagucaaucaacgcuaccugaaacgauccucgaauuaacagaugcguuagcacuaggcaugauggcacuaaagaucguaaggaacauggagaaguaccaacuagcaguaaccauaauggcaauaaguugugugccaaaugcuguaauauuacagaaugcuuggaaaguaagcuguacgauauuagcugcagucucaguaaguccuuugcuacuaaccagcucucagcaaaaggccgacuggauuccgcuagcgcuaaccauaaaagguuuaaauccuacagcuaucuuucuuacaacgcuauccaggacuagcaagaaacguuccuggccguugaacgaagcgauaauggcaguagggaugguaaguauacuagccucuuccuuauuaaagaacgacauaccaaugacaggcccauuaguagccgguggucuccucacuguauguuauguacucacuggcagaagcgcagacuuagaacuagagagagcagcggacgucaaaugggaggaccaagcugaaauaucaggaucgaguccgauauuaucuauaacuaucucggaagauggcucuaugaguauuaaaaacgaggaagaagaacaaacguuaacaauucuaauaagaaccggacuccuagucauaucugguguauuuccuguuuccauaccuaucaccgcugcugcuugguacuuaugggaggucaaaaagcagagggcaggaguucuaugggauguucccuccccuccuccugugggaaaagcugaauuagaagacggcgcuuacagaaucaagcaaagagguauacuagguuauucccagauuggugcaggaguuuauaaagaaggaacauuucauacuauguggcauguuacaaggggagcgguauuaaugcaucgugggaaaagaauagagcccucgugggcagauguuaagaaagaccugaucaguuacgguggaggauggaaacuugaaggggaauggaaggaaggagaagagguccaaguucuugcucucgaaccuggcaaaaauccccgagcaguacagacuaaaccagguauauucaaaacaaauacagguacgaucggagcgguuagucuugacuucagccccggaaccucagguucccccauuguagaucguaagggaaaaguaguuggauuauacggaaacggcguuguaacucgaucgggggcuuauguuucagcuauugcgcagacagagaaaaguauagaagauaacccggaaauagaagacgauauauuuaggaaaaagcgacugacuauaauggauuugcauccaggagccgguaaaaccaaaagauauuuacccgcaauaguuagagaagccaucaaaagaggauugaggacucucaucuuagcaccgacgcguguaguugcggcugaaauggaggaagcacuucggggcuugccaauuagauaccaaaccccugcuauuagggcagaacacacuggacgagaaaucguggaucuaaugugucaugccacuuucacuaugcgacuuuugucacccguaagaguuccgaacuauaaucuuaucauaauggaugaagcacacuuuacggaccccgcaaguauagccgcacgaggauacauaucuacgagaguggaaaugggggaggccgcgggaauauuuaugacugcaacaccaccaggaucucgagacccuuuuccccaaucaaaugcgccgauuauggaugaagaaagggaaauuccagagcggucuuggaacucaggacaugaauggguuacugacuuuaaaggaaaaacuguaugguuuguucccaguauaaaagcgggaaaugauauagcugccugccuaaggaaaaauggcaagaaaguaauacaacuuucaagaaaaaccuuugauuccgaguauguaaagaccagggcgaaugauugggauuucguugugaccacugacauaagugagaugggugcuaauuuuaaagcggaacguguuauugacccccgaagauguaugaagccgguaauacugaccgauggggaagaacgcguaauucuagcggguccgaugccaguaacacauuccucagcagcccagcgacggggacgaauuggcagaaaccccaaaaaugagaacgaccaguauauuuauaugggagaaccgcuagaaaaugacgaggauugugcacauuggaaggaagcgaaaauguugcucgauaacaucaauacuccagaaggaaucauuccuaguauguuugaacccgaacgcgaaaagguagaugcgauagauggagaauauaggcuucgaggagaagcacgaaagacguucgucgaucuaaugaggagaggagauuuaccggucugguuagcauauaaaguugcggcagaaggaauuaauuaugcagacagaaagugguguuucgacgguaucaaaaacaaccaaauacuugaggaaaauguggaaguggaaauauggacuaaagaaggugaaagaaagaaauuaaaaccacgaugguuggaugcuagaauauauagugauccauuagcucuaaaggaauuuaaagaauuugccgcuggaaggaaaaguuuaacauuaaaccucauaacagagauggggcgacuucccacauucaugacccaaaaagcacguaacgcucucgauaaccuggccguguuacauacagcugaaguugggggcaaagcauacacccacgcucuuucggaauugccggaaacccuugaaacacuauuauuguuaacccugcucgcugcaguuacuggaggaaucuucuuauuccuaaugucuggcaaagguauugggaaaaugacacuugggauguguuguauaauuacagcaaguauucuccuaugguaugcacagauacaaccucacuggauagcagcaucaaucauuuuggaauuuuuccucaucguauuacuaauacccgaaccagaaaaacaacgcacaccccaagacaaccaacugacauauguagugaucgccauauuaacgguuguagccgcuacaauggcuaaugaaaugggauuucuggagaaaaccaagaaagaucugggguuugguagcauaaccacacaggaaucugaaucaaacauauuagacauagaucuuagaccagcuucagcuuggacacuuuaugccguagccacaacauuuguaacaccaauguugagacauaguauugaaaauuccucuguaaacguaucacuaacugccauagcuaaccaagcgacuguuuuaaugggucuuggaaaggguuggccacuaucuaaaauggauaucgggguaccucuucuagccauagguuguuacucccaagugaauccaauuacucuaaccgcagcucuacuguugcuuguugcacauuaugcaauaauagggccuggucuacaggcgaaagcaaccagagaagcacaaaaacgcgcagcugcaggaauaaugaaaaauccuacaguggauggaauuacuguaauugaccuagagccuauaccuuaugacccgaaauuugaaaaacaauuaggucaaguaaugcuauuaaucuuguguguaacccagguuuuaaugaugcguacgacuugggcccugugugaagcacugacacuugccacggggccaauuucuacauuaugggaagggaacccgggaagauucuggaauacaacaauagcagucucaauggcuaauaucuuuaggggcucauauuuagccggugccggguugcucuuuaguauaaugaaaaauacgacaaauacaaggcgaggaacaggaaauguuggagagacacugggugaaaaauggaaaagucggcugaacgccuugggaaaaucugaauuucaaaucuauaaaaaguccggaauacaagaaguagauagaacauuagcuaaagaaggcauaaaacgcggagaaacagaccaccaugcggugucgagaggaagugcaaaguuacgcugguucguggaacgaaacaugguuacaccagaagguaaagugguugaccuugggugcggcagaggcggcuggucguauuauugcggaggacucaaaaauguucgcgagguaaaggguuuaacgaaaggaggaccaggacacgaagaaccgaucccaauguccacauauggcuggaaccugguuagacugcaaagcggaguagaugucuucuucaccccuccugagaagugugauacuuuacuuugugauauuggagaaaguucaccaaauccgacaaucgaggccggaagaacacuucgaguguugaacuugguugaaaacuggcuaaauaauaauacucaauuuuguauaaagguacuaaaucccuacaugccaucgguaauagagaaaauggaaacauuacagcgaaaauauggcggagcacucguucgaaacccguuaaguagaaacaguacacaugaaauguauuggguauccaacgccacagguaacauuguauccagugucaauaugauaucucgaaugcucauuaauagauucacaaugaagcacaaaaaggccaccuaugaaccagaugucgauuuggggagugguacccgaaacauaggaauugagagcgagauaccaaauuuagauaucauugguaaaagaauagaaaagauuaagcaagaacaugaaacuucuuggcacuacgaucaagaccauccuuacaaaaccugggcauaucacgggaguuacgaaacuaagcaaacaggcucugcaucuagcaugguaaauggugucgugaggcuacucacuaagccaugggacgucguuccgaugguaacgcagauggcuaugacagacacaacacccuuuggucaacaacgaguuuuuaaagagaaggucgacaccagaacacaagaaccuaaagaagguacaaagaaauuaaugaaaauaacagcggaaugguuauggaaagaauuagggaaagagaaaacuccaaggaugugcacaagagaagaauuuacuagaaaagugagaaguaacgccgcccuaggcgcuguuuucacugacgaaaauaaauggaaaucugcacgggaggcaguggaagaugguagguucugggaauugguagaccgcgagagaaaucuccaucuagaaggaaaaugcgagacuugcguauacaauaugaugggaaagcgagagaagaaauugggagaguucggaaaggcaaagggaagucgugcaauaugguauauguggcugggggcgcgauuucucgaguuugaagcacuagguuuccuuaaugaagaucacugguucucccgaggaaauucgcuuucugguguugagggggaaggcuuacauagacuagguuauaucuuacgggagguugguaaaaaggaaggcggggcuauguaugccgaugauacugcgggaugggacaccaggauuacccuagaagaccugaaaaacgaagaaaugguaacgaaccauaugaaaggagagcauaagaaacuagcugaagcaauauuuaaguuaaccuaucaaaacaagguaguaagaguacaacgccccacaccaagagguaccguaauggauauaaucagcaggaaagaucaaagagguagcggucaaguaggcaccuauggacuuaauaccuuuacaaacauggaagcccaauuaauaagacaaauggaaggugaggguauauucaaaucaauacaacaccucacugcgacagaagagaucgcgguucagaauuggcucgcacgcguaggccgugagcgacuuucaagaauggcgauaaguggugaugacugcguaguuaaaccaaucgaugauagguuugcuucagcccucacagcacuuaaugacaugggaaaaguacguaaggauauacaacaaugggaaccaucccgaggcuggaaugauuggacgcaaguaccauucuguucacaucauuuccacgagcugguaaugaaggaugguagagugcuaguagucccaugcaggaaucaggaugaauuaauuggacgagcucggauaagucagggugcuggguggucacugaaagaaacugccugccuugggaaaagcuacgcccagauguggaccuugauguacuuucauagaagagauuugagauuagcagcuaacgcaauauguagugcagucccaagucauuggguuccaacgaguaggacgacguggaguauacaugcaaaacaugaauggaugacaacugaagauaugcuagcaguguggaaccgcguauggauacaagagaacccauggauggaggacaaaacacccguggaaagcugggaggaaguuccauaucuuggaaaacgagaagaccaauggugugguucccuuauaggucuuacaucgagagcaacaugggcuaaaaacauacaaacggccaucaaucaaguacggucacuuauaggaaacgaaggguacaccgacuauaugcccagcaugaaaagauucagacgagaagaagaggaagcuggaguccuaugg

SEQ ID NO: 22899 - RNA, 9873 nt, Artificial Sequence
  derived and/or modified CDS sequence (opt6) from DENV-2__JX567950__SS-prME
accgcagggguaauaguaauguuaauaccaacagcgauggcauuucacuugacaacccguaauggagaaccgcacaugaucguagggagacaagaaaaaggaaaaagccuacuauucaaaaccgaagacgguguaaauauguguacuuuaauggcaauagauuugggagaacugugcgaagacacuauaacauauaaaugcccauuauuacgucaaaaugaacccgaagacauugauuguugguguaauucgacaucgacauggguaaccuauggaacgugcacgaccacgggggaacacagacgugaaaaacgguccgucgccuuaguaccacacguaggaaugggcuuggaaacaagaacagaaacguggaugucguccgaaggcgcauggaaacauguucagagaauagaaaccuggauauuacgacaccccggauucacuauaauggcugcaaucuuagcauacacaauaggaacaacucacuuucagcgugcauugauauuuaucuuacuuacggcuguggcgccgucgaugacuaugagguguauaggcauaaguaacagggacuucguagaaggcgugucaggcggcuccuggguggauauugugcuggaacaugguucaugugugacuacuauggccaaaaauaaaccaacauuagacuucgaacugauaaaaacugaagcgaaacaaccggccacacuucggaaauacugcauagaagcaaaacuaacgaacacaacaacugaaucacgcuguccaacgcaaggagaaccuucccuaaaugaagaacaagacaaacguuucauuuguaaacauagcaugguggaucgugguuggggaaacggguguggacuuuucggaaaaggcggaauaguuacaugugcuauguucacuugcaagaaaaacauggaaggaaaaguuguguuaccagaaaaccuggaauacacaauuguaauuacgccgcacaguggugaggaacaugcggucggcaaugacacagggaaacacggugaagaaauaaaaauaacaccccagaguucaauuaccgaagcggaauuaacagguuauggaacuguuacaauggaauguaguccgcgaacuggacuagacuucaaugaaaugguccugcuucaaauggaagauaaagcguggcucguacacagacagugguuccuagauuuaccccuacccugguuaccuggcgcugacacacagggcucaaauuggauacagaaagaaacccugguaacauuuaaaaauccgcacgcgaagaaacaagauguuguuguacuaggaucacaagaaggggcuaugcacacagcauuaacuggggcaaccgaaauacaaaugucgagugggaauuuguuauucacaggacaucuuaaaugccgccugcgaauggacaaacuccaacucaaaggaaugaguuauuccauguguacgggcaaauucaaaauaguaaaagaaauugcggaaacgcaacacggaaccauuguaauacggguacaauacgaaggugauggaucuccaugcaaaauuccauucgaaauaaccgauuuagagaaacgacaugugcuaggaagauuaauuacagucaacccuauuguaacagagaaagacuccccgguaaacaucgaagcugaaccaccguucggcgacagcuacauaaucgugggaguugaaccaggacaguuaaaacugaauugguuuaagaaaggcuccucgauuggucaaauguucgaaacuacaaugagaggggcuaaaaggauggcuauuuuaggugacacagcaugggauuuugggucuuuagggggaguguuuacauccauaggaaaagcgcugcaucaagucuucggagcaauauacggugcugcauuuuccggugugagcuggacuaugaaaauacuuauugggguaauaaucacauggaucggaaugaacagcaggucaaccaguuuaucuguuucauuaguuuugguuggaguugucacauuauaccuuggagcuaugguacaggcggauagcggaugcauaguaaguuggaagaauaaagaacuaaaauguggauccggaauuuuuauaacugacaacguacacacauggacggaacaguauaaauuccagccggaaagcccgucgaaauuagcuucggcaauucagaaggcucacgaagaagggauaugugguauaagaucagucacuagguuggaaaacuuaauguggaaacagauaacacccgagcuaaaucacauucuaucugaaaacgaagucaaacucacaauuaugaccggugacauuaaggggauaaugcaagcgggaaaaagaucacuucgaccacaaccgacagaauuaaaguauaguuggaaaacuuggggaaaagcaaagauguuaucaacagaaagccauaaccaaacauuuuuaaucgauggcccggaaacagcggagugcccuaauacuaauagagcauggaacucacuggaagucgaagauuauggcuuuggaguauucacuacaaauauuugguugaaacuuagagaaaagcaggacguauucugugacuccaaacucaugagcgcagcaauaaaggauaauagagcaguucacgcagauaugggauacuggauugaaagcgcuuuaaacgacaccuggaaaauggaaaaagccucauucaucgaaguuaaaaguugccauuggccgaagucgcauacauuauggucaaauggcguacucgaauccgaaaugauuauacccaaaaacuucgcaggaccuguaucacagcacaacuacagacccgguuaccacacucagacagcggguccauggcaccuggguaagcuggaaauggauuucgauuuuugcgaaggaacaacagucgugguaacagaagauugugguaauaggggcccuucauugagaaccaccacugcaucaggaaaacuuauaacggaaugguguugccgaucuuguacacucccaccgcuccgauauagaggagaggacggauguugguauggaauggaaauacgcccccuaaaggaaaaagaagaaaaccuaguaaacucgcuaguaacagcaggucacggacaaauugauaacuuuucucuugguguacuaggaauggcccuguucuuggaagaaaugcuaagaacacgaguugguacgaaacaugcuauucuacugguagcacugucuuucguuacccuaauuacugguaacaugaguuuccgggaucuuggcaggguaaugguuauggucggugcuacuaugaccgacgauauugguaugggcgucacauaucuggcccuccuagccgcauuuaagguacgacccacauuugccgccgggcuacuucuacgcaaguuaacaaguaaggaauugaugauggcgacuauagguauugcccuacugucccaguccacgcugccagagacuaucuuagaauuaacugaugcacuagccuuaggcaugauggcacuaaagauugugagaaauauggaaaaguaucaacuugcgguuacaaucauggcaaucucauguguaccaaacgcaguuauacuacaaaacgcuuggaaaguuucauguacgauacuagcagccgugucaguuucaccacuucuacuaacaagcucgcagcaaaaggcugacuggauuccgcuagccuugacaauaaaaggacucaauccaacagcuauauuccuaaccacgcuuucaagaacaaguaagaaacgaaguuggccguuaaacgaggcuauuauggccguaggaaugguauccauacuagcuagcagucugcucaaaaaugauauuccuaugacagggccauuaguugcaggaggauuguuaacuguauguuacguacuaacaggacgaucagcugacuuagagcuagaaagagcugcugauguaaaaugggaagaucaagccgaaauuagcgggucgucaccgauacuuuccguaacgaucucugaagauggaagcaugucaauuaaaaaugaagaagaagaacaaacauuaacaauauuaauuaggaccggucuauuaguaauaaguggcgucuuucccguaaguaucccaauaacggcagcggcaugguaucucugggaaguuaagaaacaaagagcaggaguuuuaugggacguuccgaguccuccaccaguugguaaagcagaauuggaagacggcgcguauagaaucaagcaaagagguauacuaggcuauucucaaauaggggcgggaguauacaaagaagguacauuucauacuauguggcacguuacaaggggugcaguguuaaugcauaggggcaaaagaauagagccgucgugggcagacguaaagaaagauuuaauuagcuacggagggggauggaaacuagaaggagaauggaaagagggcgaagagguacaagucuuagcguuagagccaggcaaaaacccaagagcgguacaaacaaaaccaggaaucuucaaaacgaauaccggcacgauaggugcaguaucacuggauuuuucacccgguacgucaggaucaccgauuguugauaggaaaggaaaaguagucgguuuguauggaaacggaguaguuacacgaucuggggcauaugucucagcaauugcucaaacugagaaaucaauugaagauaauccggaaauagaagacgacauauuucguaagaaaagguuaacgaucauggaucuucacccuggcgcaggcaaaacaaaaagguauuuaccugccauuguucgugaagcuauaaaacgugggcucagaacacuaauccuagcuccaacucgggugguagccgcugaaauggaagaagcacuaaggggacugccgauacgauaccagacuccggcuauacgcgcugaacauacuggaagagagauugucgauuuaaugugucacgccacauuuacaaugagguuacugucccccguaagaguuccuaacuacaacuuaauaauuauggacgaagcgcacuuuuccgauccagcuaguauagcagcgcgaggguauauaucaacaagggucgagaugggugaggcggcugguaucuuuaugacggcaacacccccgggaucgagagauccauuuccccaaucuaaugccccuauaauggacgaagaaagagagauaccagaacguuccuggaacaguggacaugaauggguuacugauuucaagggaaaaacgguaugguucguuccaaguauuaaggcagguaacgacauugcugcuuguuugagaaagaauggcaagaaagugauacaacucaguaggaaaaccuuugacagugaauacgucaaaacuagggcaaaugauugggacuuugucguuacuacagauaucagugaaaugggagcgaauuuuaaggccgaaagagucaucgauccuagacgauguaugaaaccagugauauuaacggacggugaggagcgaguuauacuagccggaccaaugccaguaacucauucgagcgcggcgcaacguagggggagaauugggagaaaucccaaaaaugaaaaugaucaauauauuuacaugggugaaccccuagaaaaugaugaggacugugcucacuggaaggaagcuaaaaugcuacuagauaacauaaacacuccagagggaauuauuccaucuauguuugaaccggaacgcgagaaaguggaugcaauagacggcgaauauagacuaagaggcgaagcgagaaagacauucguggauuuaaugcgccgaggagaccucccagucuggcuugcuuacaaagucgcggcagaaggaaucaacuaugcugacagaaaaugguguuuugauggaaucaaaaauaaccaaauacuugaagaaaauguagaaguugaaauauggacuaaagaaggagaaagaaagaaacugaaaccucguugguuagacgcaagaaucuauagcgauccauuagcgcuuaaagaguucaaagaguucgcugcuggacgaaagaguuuaaccuuaaaccuaauaacagaaauggguagauugccuacauuuaugacucaaaaggcaaggaacgcguuagauaaucuugcuguccuucacacagcagagguggguggaaaagcauauacgcaugcauuaaacgagcucccugaaacuuuagagacacuccuauuacuuacacuacuagcagcaguaaccggcggaauauuucuauuuuuaaugagcggcaaagguauaggaaaaaugacuuugggaauguguuguauaaucacagccagcauauuacuuugguacgcgcaaauacaaccccacuggauugccgcuucuauaauucucgaguucuuucugauaguauuacucauaccagaaccggaaaaacaaagaacuccccaagauaaccaacuaacauauguagucaucgcaauacuaacuguaguugccgcuacuauggccaacgagaugggcuuuuuagagaaaacuaagaaauaccuaggauuaggcaguaucacgacucaagaaagugaauccaauauucuugacauugauuugagaccagcgucggcauggacgcuuuacgcgguagcaacaacauuugugacuccaauguuacgacauucuauaguaaacagcucuguaaacguuacacugacggcaauagcuaaccaagcuacuguacuuaugggucuagguaaaggcuggccauuaucaaaaauggauauagguguaccguugcuugcaauuggauguuauucccaagugaacccaauaacacuuacggcagcauuacuuuuauuaguugcacauuaugcaauaauagggcccggacuacaagcuaaagcaacgagagaagcccagaaaagagcggccgcagggauuaugaaaaacccuacagucgaugguauuacaguaaucgacuuagagccuauuccauacgaucccaaauucgaaaaacagcuaggacaggugaugcucuuaauacuuugcguuacccaaguucuuaugaugcgaacaacaugggcauuaugcgaggcuuugaccuuggcuacaggaccuauuucuacucuaugggaaggaaauccugguagauuuuggaacaccaccauagcuguuucaauggcgaauauauuccgggggaguuacuuagcgggugcaggccucuuauuuucaauuaugaagaacaccacgaacacacggcguggcacagggaauguaggagaaacuuuaggagaaaaauggaaauccagacuaaacgcguuaggcaaaaacgaauuucaaaucuacaagaaauccggaauacaggaaguugaucgaacauuagccaaagaaggaaucaaacgaggagaaacagaucaucaugcaguaagucgagguagcgcaaaacuuaggugguucguagaaagaaacaugguaaccccagaagguaaaguagucgacuuagguuguggaaggggaggcuggucauacuauugcgguggacucaaaaacgucagagaaguaaaaggauuaacaaagggcgggcccggccaugaagaaccaaucccaauguccacuuacggauggaauuuagugagauuacaaucugguguugauguuuucuuuacaccgcccgaaaaaugugacacgcuguuaugugauauuggagaaucaagucccaaccccacaauagaagcaggacgcacguuacggguuuuaaauuuggcggagaacuggcuaaauaauaacacccaguuuugcauaaaggucuuaaauccuuauaugccaucgguuaucgagaaaauggaaacucugcaaaggaaauauggaggggcauuggugagaaauccauuaaguagaaauaguacgcacgagauguauugggucucgaaugccacuggaaauauaguaagcagugucaacaugauaucacguauguuaauuaaccgauucacuaugaaacauaagaaagcaaccuaugagccagacguugaccuaggaagcggaacacggaacaucggaauagaaucagagauuccgaauuuagacauaaucgggaaacgaaucgaaaagauaaaacaagaacaugaaaccaguuggcauuacgaucaagaccacccauauaaaacgugggcauaucaugguuccuacgaaaccaaacaaacagggucagcuagcucaaugguuaauggcgucgugcgacuccuaaccaaaccuugggacguugugccaaugguaacccaaauggccaugacugauacaaccccauucggacaacaaagaguauucaaggagaaagucgauacccguacacaagagccaaaagagggaacgaagaaacuaaugaaaaucacggcagaaugguuauggaaagaauuaggaaaggagaaaacaccgagaaugugcacucgagaggaguucacgagaaaaguaagguccaacgcagcguuaggugcgguuuucacagaugagaauaaauggaagucggcucgagaagcaguugaggauggacgcuucugggaauuaguugauagggaaaggaaccugcacuuagaagguaaaugugagacauguguuuauaacaugaugggaaaaagagagaagaaacuuggagaguuugguaaagcgaaagguaguagagcaauaugguacaugugguuaggggcuagauuucuagaauuugaggcgcuugguuuucugaacgaggaucacugguuuucgagagaaaauucucuaucgggaguagagggugagggccuucauagacuaggguacauauugagagacgucagcaagaaagaaggaggagcaauguacgccgaugauacagcagggugggauacaagaauaacauuagaggaccuuaaaaaugaggaaaugguaacgaaucauaugaaaggggagcacaagaaacuagcugaggcaaucuuuaagcugaccuaccaaaauaagguagugcgcguucaacguccgaccccaaggggaacggucauggauauaaucucuagacgcgaccaaagaggauccggacaaguaggaacuuacggauuaaauacuuucacuaauauggaggcacaauuaauaagacaaauggagggagaaggaauauuuaaaucuauacaacaucuuacugcuacagaggaaauugcggugcagaauuggcuagcacgggucgggcgugaacgacuuucucgaauggcaauuuccggagaugauugcguugugaaaccuauagaugauagauucgcgucagcauugacggcacugaacgacaugggaaaaguucgcaaagacauacaacaaugggaaccuaguagaggauggaaugacuggacgcaagugccauucugcucacaucauuuucaugaguuaguaaugaaagauggacgcguccuaguaguuccuuguagaaaccaagacgaguuaauuggacgcgccaggauaucucagggagcaggauggucacucaaagagacugcauguuugggaaaguccuacgcccaaauguggacguuaauguacuuccaucgacgagaccuacgcuuagcggcuaacgcgauuuguucagcuguaccuucacacugggugccuacgucacggacaacuuggucaauucacgcuaagcaugaauggaugaccacagaagauaugcuagcuguauggaaccgaguauggauucaagaaaacccauggauggaagauaaaacuccaguugaauccugggaagaaauuccauacuuaggaaaacgcgaggaucaauggugcggaucacucauaggacuaacaucaagagcuacuugggccaaaaauauacaaacagcaauaaaucaaguucgcaguuugauugguaaugaaggcuauacggacuauaugccaaguaugaagagauuccgaagggaagaagaagaagcuggaguauuaugg

SEQ ID NO: 22900 - RNA, 9873 nt, Artificial Sequence
  derived and/or modified CDS sequence (opt6) from DENV-2__HQ012538__SS-prME
accgcugggguuauuauaauguuaauacccaccgcaauggcuuuccauuuaaccacgagaaacggagaaccgcacaugauaguagguagacaggaaaaagggaaaucauuauuauucaaaacagaagacggaguaaauauguguacuuuaauggcaauagaucuuggagaacucugugaagacacuauaacuuauaaaugcccuuuacugagacaaaaugaaccugaagauauugacuguugguguaauucuacuucaaccuggguaaccuacggaacgugcacgaccaccggugaacauagaagagaaaaacgcucaguagcauuaguaccgcauguggguaugggguuagaaacccguacagaaacauggaugucuucagaaggugcauggaaacacguucaaagaauugaaacuuggauauuacggcauccuggcuucgcaaucauggcggcaauccuugcauauacuauuggaacuacgcacuuucaaagagcguugauauucauauuguugacugccgucgcaccuucaaugacaaugaggugcaucgguauaucaaauagagacuuuguagagggggucagcggagguagcuggguagacaucguauuggagcaugggucuugcguaaccacuauggcuaaaaacaaaccgacucuagauuucgaacugauaaaaacugaggcaaaacaaccugcuacguuacgcaaauauugcauagaggcaaaauuaacuaauaccaccacagaaucacgaugccccacacagggcgaaccaagccuaaacgaggaacaagauaaaagauucauuuguaaacauagcaugguagauaggggauggggaaauggcuguggucuauucggaaaaggcggaauuguuaccugugccauguuuacguguaagaaaaauauggaagggaaaguagucuugccagaaaaucuagaauacacaaucguaauuacuccacacucuggcgaggaacacgcagugggaaacgauacggggaaacauggagaggaaauaaaaaucacgccucaguccucaauuaccgaagcggaauugacaggguacggcaccgucacaauggaauguaguccaagaacgggauuggacuucaacgagaugguauuacuucaaauggaggaaaaagccugguuaguccaucgacaaugguuccuagauuugcccuuaccaugguuaccuggggcugauacucagggaucuaacuggauacagaaagaaaccuuagugacauuuaaaaacccacaugcuaagaaacaagacguagugguauuaggcagucaggaaggcgcuaugcacacugcgcuaaccggagcaacugaaauacaaaugucuucuggaaaccucuuauucacaggucaucuaaaaugcagguuaaggauggauaaacugcaacuuaaaggaaugucauacuccauguguacuggaaaauucaaaauaguuaaagagauagcugaaacacaacaugguaccauugugauacgaguacaauaugaaggagauggcaguccuugcaaaauaccuuuugaaauaauggauuuagagaaacgucaugucuugggcaggcuaauaacaguaaacccaauaguuacggagaaagacucuccgguuaacauugaagcggaaccaccguuuggggauaguuauauaauaauaggaguagaaccugggcagcuaaaacucaauugguucaagaaagguucgucuauaggucagauguucgaaacgacaaugagaggagcgaaacggauggcgauuuugggagauacugcaugggauuucggaagucucggagggguauucacaucaauuggaaaagcucuacaucaagucuuuggcgccauauauggggcagcauuuucgggcgucaguuggacaaugaaaauacucaucgggguaauaauaacauggaucggcaugaauagccgcagcacgucguuaucaguaucguugguguugguuggcgucguaacuuuauaucuaggagcgauggugcaagcagacaguggaugugugguuaguuggaaaaacaaagagcuaaaauguggaucuggaauuuucaucacagauaacgugcauacauggaccgagcaauauaaguuccaaccagaaagcccauccaaguuggcgucagccauacaaaaggcacaugaagaggguaucuguggaauuaggucagugacaagauuagaaaacuuaauguggaaacaaauaacgccugagcuuaaccauauuuugucggagaaugaaguuaaguuaacaauaaugacaggggauauaaaaggaauaaugcaagccggaaaacgaucacuaagaccacaaccaaccgaauuaaaauauucauggaaaacuuggggaaaggcaaagaugcuaucaaccgaaucacauaaucaaacauuuuuaauagauggcccugagaccgcagaauguccaaacacaaacagagcauggaacagcuuagaaguugaagacuaugguuuugggguauucacuacuaauauaugguuaaaguugcgagaaaaacaggauguauucugcgacucuaagcucaugagcgcagccauaaaagauaaucgagcaguucaugcugauaugggauacuggauagaaucugcgcuuaacgauaccuggaagauggaaaaagcgucguucauugaagucaaaucaugucacuggccaaagucacauacucuguggucgaacggcguauuagaaucagaaaugaucauccccaaaaauuucgcaggaccggugucacaacauaauuauaggccaggcuaucacacucaaacugcggggccuuggcacuugggcaaacuugaaauggauuuugauuucugcgaaggcacaacuguugugguaacagaggacuguggaaacagaggaccaagucugcguaccacaacggcaucggguaaauuaauaacugaaugguguugccggaguuguacucucccaccacucagguauagaggugaagauggguguugguacggcauggaaauaagaccccugaaagaaaaagaagaaaaucugguuaauagucuagucacagcaggacauggacagauugacaauuuuuccuuaggaguuuuaggaauggcauuauuucuugaagaaauguuaagaacacgagucgguacuaaacaugcaauacuuuugguagcaguaaguuuugugacccuuauaacaggaaauaugucguuucgcgaccuagggagagucauggugauggucggcguuacuaugacggacgauauuggaaugggagucacauauuuagcauuacuggcggccuuuaaaguaagaccaacuuucgcggcaggauuauuacucaggaaacuaacuucgaaggaauuaaugauggccacaaucggaauugcgcugcucucucaaagcacuauuccugagacgauccuugaacucacggaugcacuugcauuaggaaugaugguacugaaaaucguccgaaauauggaaaaguaucagcuugccguaacgaucauggcaauaucauguguaccgaaugcagugauacuauuaaacgcauggaagguuuccuguacaauccucgcagcaguaaguguaaguccacuucuucuuacaaguucacaacagaaaaccgauuggauuccguuggcauuaacaauaaagggauuaaauccaacagcuauauuuuuaacaacauugucaaggacgucuaagaagcgaaguuggccguuaaaugaagcagucauggcgguuggaauggucuccauucuagcaaguagucugcuuaaaaacgauauaccuaugacaggaccauugguugcaggaggguuacugacugucuguuacguauuaacgggccggagugcugauuuagaauuggaaagggcggcggacguuaaaugggaagaccaagccgagauaagcggauccucaccaauacuaucgauuacuauuucagaagaugggagcaugagcauuaaaaaugaagaggaagaacagacguuaacuaucuuaauacguacaggguuguuaguaaucagcggaguuuuuccaguaaguaucccaauaacugcggcggccugguaucugugggaaguuaagaaacaaagagcuggaguauuaugggauguuccuaguccacccccaguagaaaaagcagaauuggaagauggcgcuuaucgaauuaaacagcguggaauuuuagguuauucgcaaauaggugcaggaguuuauaaggagggaacuuuucacacaauguggcauguaacucgaggagcuguuuugaugcacagaggaaaacguauagaaccgucuugggcagacguuaagaaagacuuaauaucauacggaggaggauggaaacuggagggugaauggaaagaaggggaagagguacaaguccucgcguuagaaccugggaaaaauccucgugcuguucagacgaagccaggguuguuuaaaacaaacacagggacaauaggggcaguaagucuugauuuuucuccuggaacgagugguucgccaauaguugauagaaaaggaaaggucgucggauuauacggaaauggagugguaacuagaucaggagcauauguuagcgcaaucgcucaaacugaaaagucuaucgaagauaaccccgagauagaagaugacaucuuucgcaagaaaagacuaacaauaauggauuuacacccaggagcaggcaaaacuaagagguaccuaccugcaauagugagggaagccaucaaaagagggcuaagaacguugauucuagcgccuacccgaguaguagcagcagaaauggaggaggcgcuacgaggcuuaccuauacgcuaccagacuccagccauuagggcagaacacacagggagggaaauaguugacuugaugugucaugcaacuuucacaaugcgcuuacuaucaccaguaagagugccuaauuacaauuugauuaucauggaugaagcacauuuuaccgauccagccucaauugcagcuagagguuacauaucgacgagagucgaaaugggagaagcagccggcauauuuaugacggccacacccccugggucucgagauccuuuuccccaaaguaacgcgccuauaauggaugaggaaagagaaauccccgaaaggagcuggaauaguggccaugaauggguuaccgauuucaagggcaagacuguuugguuuguuccaucuauaaaagcugguaacgacaucgcagcauguuugagaaagaauggcaagaaagugauacaacuaucacguaaaacauuugacagugaauacguuaaaacuagggcaaaugacugggacuucguuguaacaacagacauuagcgaaaugggugccaauuuuagagcugaacgaguuauagauccacgaagauguaugaaaccuguuauacuaaccgacggcgaagaaagaguaauacuugcaggaccgaugccgguaacacauucaagcgcagcucaacggaggggucgcauaggucgaaaccccaaaaaugaaaacgaccaauacaucuacaugggggaaccacuggaaaaugacgaagacugugcacacuggaaagaagcaaaaaugcuccucgauaacaucaauaccccagaaggcaucauaccuucgauguucgaaccugaacgugaaaaaguagaugcuaucgauggugaguauagauuacguggagaagcuaggaaaacauucguagaucucaugaggcguggagauuuaccuguauggcuggccuaccgcguggcggccgaagggaucaacuaugcugauagaagaugguguuuugacgggaucaaaaauaaccaaauuuuggaagaaaauguugaaguagagauauggacaaaagaaggagaaaggaagaaacucaaaccgagauggcuggacgcacgaaucuacuccgauccauuggccuuaaaagaauuuaaggaguucgcugccggacguaaauccuuaacuuugaauuugaucaccgaaaugggacgauuacccaccuuuaugacacagaaagcgcgugaugcccuggauaaucuagcaguucuacacacagcugaggcuggugggagagcauauaaucacgcguugagcgaacucccagaaacccuagaaacacuccuacuucuaacucuucuggcaacuguaacgggaggcauauuccucuuccuaaugucuggaaaggguaucggcaaaaugacucuggggauguguugcaucauaaccgcgucuauuuuguuaugguacgcucaaauucaaccacauuggauugcagcaucuauuauauuggaguuuuuccuuauaguucugcugauuccagaaccugaaaaacaaagaacaccacaagauaaucaauuaacauaugugguaaucgcgauauugacgguaguggccgcuacaauggcgaaugaaaugggauuccuagagaaaacgaagaaagauuuaggucuggggaguauuacuacccaagaguccgagagcaacaucuuagauauagaucuuagaccagccagcgcauggacacuauacgcaguagcaacuacauuuguaaccccgauguuacggcacucaauagaaaauagcucuguuaacguaucauuaacagcuauagcaaaccaagcuaccguauuaaugggacugggcaaaggcuggcccuugucaaaaauggauaucggggucccauuguuagcgauugguuguuauucacaagugaauccuaucacucuaacggcagcuuuauuacugcucguagcgcacuaugcuauuauagguccgggacuacaagcuaaagcuacucgagaagcccaaaaacgagcugcagcggggauuaugaaaaauccaaccguugaugguauuacuguaauagaucuagaacccauaccauaugauccaaaauuugaaaagcaauuagggcaaguaauguugcugauacuuugcgucacacaaguuuuaaugaugcggacaacgugggcccuaugugaggcucuaacacuugcaacaggaccaauuaguacccuaugggaagggaauccaggucguuucuggaacacaacaaucgcaguaucaauggcgaauauuuuuaggggauccuaucuagccggugccggauuauuguuuaguaucaugaaaaauaccacuaacaccagacgaggaacaggaaauauaggcgaaaccuuaggcgagaaauggaaaagucgcuuaaaugcuuuggggaagagugaguuucaaauauauaagaaaucaggcauacaagagguagacaggacacuagcuaaagaaggaauaaaacggggagaaacugaucaucacgcggugucgagaggcagugcaaagcugagaugguuuguagaacgaaauauggucacuccagaaggaaaaguaguugauuuaggaugcgggcgaggcggcuggucuuacuauugcggaggucucaaaaacguucgagaaguaaaaggacuuacgaagggugggcccggucacgaagaaccaauuccaaugaguacuuacgguuggaauuuagugagauuacaaagcggcguagauguguucuuuaccccgccugaaaaaugugacacgcuuuuaugugacauaggagaguccucacccaauccgacaauugaagcuggucguacuuuacguguccucaacuuggucgaaaacugguuaaauaauaauacucaauuuuguaucaaaguacuuaaccccuauaugcccagcguuauagagaaaauggagacuuuacaaagaaaauauggaggugcucuagucagaaaccccuuaucacgcaacagcacucacgagauguacuggguaucaaacgcuacuggaaauauagugucuucaguaaauaugauaagccgaaugcugauaaacagauuuacaaugaaacauaagaaggcaacauaugaacccgauguagacuugggaagugguaccagaaauauaggaauugagagcgaaauccccaauuuagacauuauagguaaacguauugagaaaauaaaacaagaacaugaaacgucauggcauuacgaucaagaucaucccuauaaaacgugggcauaccauggaucuuacgaaacuaaacaaacaggcucagcuagcuccaugguaaacggcguaguuagacugcuaacuaagccgugggauguuguucccaugguaacccaaauggcuaugacagacacaacaccguuugggcaacaaaggguauucaaagagaagguagauacaagaacucaagaaccuaaagaagguaccaagaaacuuaugagaauaacagcagaaugguuauggaaggaauugggcaagaagaaaacuccgagaaugugcacuagagaggaguucacucgaaaaguuagaagcaaugcagcgcugggcgccauuuuuacugaugagaauaaauggaagucagcuagggaagcaguagaagauagucguuuuugggaauugguagauagagagagaaauuuacaccucgaagguaaaugugagaccugcgucuauaacaugauggguaaaagagaaaagaaacucggagaguucggcaaagccaagggcucccgugcuauuugguauauguggcuuggggcccgcuuucuugaguucgaagcucuaggauuucugaaugaggaccauugguucucacgcgggaacucuuuaagcggaguagaaggugaggguuuacacagauugggauauauacuacgagacguuagcaagaaagaaggaggggccauguaugcugaugauacagcuggaugggauacaagaauaacauuagaagauuuaaagaacgaagaaaugguuacaaaucauaugaagggcgagcauaagaaacuugcggaagcgauuuuuaaacuuacguaucaaaauaaggugguuagggugcagaggccaacgccuagaggaacaguuauggacaucaucucucgaagagaucagcgaggaagcggucaagugggcaccuaugguuuaaauaccuucacaaauauggaggcgcaacuuauucgucagauggaaggagagggcauuuuuaaaaguauucaacaccugaccguuacugaggagaucgcuguucaaaauuggcuugcacgcgugggaagagaaagauugaguagaauggcuauaagcggcgacgauugugucguaaaaccucucgacgacagguuugcgagcgcauuaacggcuuuaaaugacauggguaaggugaggaaggauauacagcagugggaaccgucacgcggauggaacgauuggacccaagucccuuuuuguucucaccauuuucaugaauugguaaugaaagaugggagagugcuugucguaccauguagaaaucaggacgaauuaaucggccgagcaaggauaucccagggggcgggauggucuuuaaaggagaccgcuuguuuggggaaaucguaugcacaaauguggacucucauguauuuccaucgaagagaucugcguuuggcugcaaaugcuauaugcucagcaguaccuagccacuggguuccuaccaguagaaccacauggagcauucaugcuaaacaugaguggaugaccacggaagacauguuggcgguauggaauagaguauggauacaagagaauccuuggauggaagacaaaacuccaguagaaaguugggaagaagugcccuauuuaggaaaaagagaagaucaauggugcggaucauuaauaggccuuacaagucgagcuacgugggcgaaaaacauacagacggcaaucaaccagguacgaaguuuaauaggaaacgaagaauauaccgauuauaugcccucuaugaaaagguuccggcgugaagaagaagaagcgggaguacuuugg

SEQ ID NO: 22901 - RNA, 9873 nt, Artificial Sequence
  derived and/or modified CDS sequence (opt6) from DENV-2__HQ012533__SS-prME
acagcaggaguaaucauuaugcugauaccgaccgcuauggccuuucauuugaccacaagaaauggggaaccacauaugauaguaggacgucaagaaaaaggaaaaucuuuauuauucaaaacugaagaugguguuaauaugugcacauugauggcaauagacuuaggagaacuuugcgaagauaccauaacguauaaauguccacuccuuagacaaaaugaaccggaagacaucgauugcugguguaacucaacaaguaccuggguaacauaugguacuugcacaacgacaggugaacacagaagagaaaaacgcucagucgcacugguuccacacgugggaauggguuuggaaacuagaacugaaaccuggaugucaucggaaggugcguggaaacaugugcaacggaucgaaacauggauauugcgacauccgggcuucgccauaauggcugcuauuuuggcuuacacaaucgggaccacccauuuccaaagggcauuaaucuucauuuuauuaacagcaguugccccgucaaugaccaugagauguaucgggauaucuaaucgagauuuugucgaaggaguaucuggugguucauggguugauauaguacuggaacacggauccugcguuacaacaauggccaaaaauaaaccaacgcuugacuuugaauuaauuaaaacugaagcgaaacaaccagcgacauuaagaaaauauuguaucgaagccaaauuaacaaauacuacgacggaaagucgcugcccgacacaaggagaaccaucccuuaaugaagaacaagacaaaagauuuauuugcaaacauuccaugguagaucgagguuggggaaacgggugcgguuuauuugguaaaggaggaauaguaacaugcgcaauguuuacauguaagaaaaauauggaagguaaaguuguauuacccgaaaauuuggaauacacgauugucauuacaccgcauucuggagaggaacacgcuguagguaaugauacuggcaaacauggagaagaaauaaaaaucacuccucaaaguagcauaacagaagcagaacuaacugguuaugggacagugaccauggagugcaguccucgcacuggacuagauuuuaaugagaugguacuucuccaaauggaggaaaaagcguggcucguacacagacaaugguuucuagaucuuccucuaccuuggcuuccuggcgccgauacccaagguagcaauuggauacaaaaagaaacauuaguaacauucaaaaauccacaugcgaagaaacaagacguaguuguccuuggaagucaagaaggggcgaugcauacggcacuaacaggagcaacugaaauucaaaugagcuccggaaaucuguuauuuacuggucaucugaaaugcaggcuaaggauggauaaacuucaacuaaaaggaaugucauauaguaugugcacuggcaaauuuaaaaucgucaaagaaauagcagaaacacaacauggaacgauaguuauaaggguucaauaugagggggauggcucaccuuguaaaaucccauucgaaauuauggaccuagaaaaacgucauguccuuggacgacuaauaacagugaauccgauaguuacagaaaaagauucuccgguuaacauagaagccgaaccaccauucggcgauaguuauauaauaauagggguugagccuggacaauuaaaauugaauugguucaagaaaggcaguucgaucggucaaauguucgaaacgacgaugcguggugcaaaacgaauggcaauacuuggcgacacagcgugggacuuuggaaguuuggguggcguauuuacuuccauaggcaaggcacugcaccaaguauucggugcgauauauggcgcugcuuuuagcggggucucauggacaaugaaaauuuuaauaggaguaaucauaacuuggauaggaaugaacucuagaaguacuucccuuucaguaucuuuaguccuagucggagugguaacguuauauuuaggggcaauggugcaggcagauucuggaugcguaguuucauggaagaacaaagaacuaaaaugcggcuccgguaucuuuauaaccgacaacguccauaccuggaccgaacaauacaaauuucaaccggaaaguccuucaaaauuagccucagcuauacaaaaggcacacgaggaagggaucugcggaauaaggagcgugacacgccuggagaaucuaauguggaaacaaauuacgccugaauuaaaucauauacucagcgaaaaugagguaaaacuuaccauaaugaccggagacauaaaaggaauuaugcaggcagguaaacgcucccuaagaccucaaccaacugaauuaaaguacucguggaaaacauggggaaaagccaaaaugcuuagcacagaaucacauaaucaaacauuucuaauagacggaccggaaacggcagaauguccaaacacaaauagagcuuggaacucccuugaaguggaagacuauggguuuggcguguuuacaacuaauaucugguuaaaacuuagagaaaagcaggacguauuuugugacaguaaacucaugagcgcagcaauuaaggauaaucgagcaguccaugccgacaugggcuauuggauagaaucggcuuuaaacgacaccuggaaaauggaaaaagcaucguucauagaaguuaagucaugccacuggcccaagucacacacacuauggagcaaugguguguuagaauccgaaaugauuauaccaaagaauuucgcagguccuguuucacagcacaacuauaggccaggauaccacacgcagacugccggacccuggcaccucggaaaacucgaaauggauuuugauuuuugugaagggacaacggugguagucacggaagacugcgguaaccgcggcccuucucuucgcacaacuaccgcuaguggaaaacuuauaaccgaauggugcugucggucguguacgcuaccaccucuucgauacagaggcgaagaugguuguugguacggaauggaaauaagaccgcuuaaagagaaggaagaaaacuuggucaacucgcucguuacagcaggucacggacaaauugauaauuuuucauuaggcguauuaggcauggcccuauuuuuagaagaaauguuaagaaccaggguaggaacaaagcaugcaauauuauugguagcuguaucuuucgucacccucauuacgggcaacaugucguuuagggaccuaggccggguuauggugaugguaggaguaacuaugacagacgauauugguauggguguaaccuaucuggcauuguuggcagcauuuaaagugagaccgacauuugcagccggucuauugcugagaaaacuuacuuccaaagaauuaaugauggccacaauaggaauagcacucuuaagucaaucaacaauaccagaaacgauauuggagcuaaccgaugcuuuagcuuuggggaugaugguccuuaaaauaguacggaacauggaaaaguaccagcuggcugucacuauaauggcaauuuccugcgucccuaacgcaguuauacuucuaaaugccuggaaggugaguuguaccauccuagccgcuguuucaguauccccacuacugcuuacguccucucaacagaaaacugacuggauaccuuuagcuuuaacuauaaaaggauuaaauccuacggcaauuuuucuuacaaccuuaucucgaacaagcaagaaaagaaguuggccacugaaugaggcagucauggcggucggaauggucagcauacuagcuucaagccuucugaaaaacgacauuccuaugacuggaccucuaguugccggaggucuacuaacaguuuguuauguucuaacuggacgaagugcagaccucgaauuggagagagcugccgacguaaagugggaagaccaagcagagaucucuggaucaaguccaaucuuaucaauaacaauaucggaggacgguucaaugaguauuaaaaacgaagaagaggaacaaaccuuaacuauuuuaauaagaacaggauugcugguuauuaguggcguuuuuccuguguccaucccgauaacggccgcugcuugguauuuaugggaagucaagaaacaaagagcugguguccuaugggacguuccaagcccaccaccuguaggaaaagccgagcuagaagacggagcauaccgaauaaaacagcgaggaauacuuggguacucgcaaauaggugcugguguuuauaaagaaggaacuuuccacacaauguggcacguuacuaggggcgccguguuaaugcaucguggcaagcguauagaaccuucaugggcagaugucaagaaagaccuuauaagcuauggaggaggauggaaauuagaaggugaauggaaagaaggggaggaaguucagguauuggcuuuagaaccgggcaaaaacccacgagcgguucagacuaaaccugguuuauuuaaaacuaacacugguacgaucggcgcuguaucucucgauuucaguccaggaacuagcggcucaccuauaguagauagaaaagggaaagucguaggucuauauggaaauggaguuguuacccgaaguggugccuacguaucagcgauagcacaaacagagaaaaguauagaagacaauccggaaauugaggaugacaucuuuaggaagaaaaggcuuacgauaauggaucuacauccaggcgccgguaaaacaaaaagauacuuacccgcaaucguuagagaagcuaucaaaagaggccuucguacauuaauccuugcaccaacgcguguagucgcagcagaaauggaggaagcauuacguggauuaccuauacgcuaccagacaccagccauuagagcggaacacacagggagagagauuguggaccugaugugccaugccacauucacaaugagacugcucaguccuguacggguaccuaauuacaaccuuauaauuauggacgaagcucacuuuacugauccagcaucuauagcggcucgaggauacauuaguacacguguugaaaugggugaggcggcuggaaucuuuaugacugcgacaccaccuggcucgagggacccauucccgcagucaaaugcaccaaucauggacgaagaacgggaaauucccgaaagauccuggaacucugggcacgaauggguaacagacuucaaagguaagacuguuugguucgugcccaguaucaaagccggaaaugacauugcggcaugucuuaggaagaaugguaaaaagguaauucagcucucucgaaaaacauucgauucggaauacguaaaaacacgagccaaugacugggacuucguggucacaacggauauuuccgaaaugggcgcgaacuuuagggcagaacgcgugauagacccaagacguuguaugaaaccuguuauucuuacggacggggaggaacgcguuauccuugcaggaccgaugccaguuacgcauagcagugcagcacaaagaagagguagaauuggucggaaucccaaaaaugaaaacgaucaguauauuuacaugggcgaaccacuugaaaacgaugaggauugugcucacuggaaagaggccaaaauguuacuugauaauauaaauacacccgagggaauaauaccuucaauguucgaaccagaacgggagaaagucgacgcgauagauggugaguauagacuccgcggagaggcccgaaagacuuuuguugauuuaaugaggcgaggagaccuaccugucugguuagcauacaggguagcagccgaagguauuaacuaugccgauagaagauggugcuuugauggaauuaaaaauaaucaaauuuuagaggaaaacguggaaguagaaauuuggaccaaagagggugaaaggaagaaacuaaaaccccguuggcuugacgcuagaaucuacucagauccgcuugccuuaaaagaauuuaaagaauuugcggcaggccggaaaucauuaacucuuaauuuaauaacugaaauggguagguugccuaccuucaugacccaaaaagcucgagaugcacuagauaacuuagcuguucuccauaccgcagaagcaggaggucgggcauauaaucacgcauuaagcgaacugcccgaaacacuagaaacacuucuacuucuaacacucuuggcaacaguuacagguggaauauuucuauuuuuaaugucuggaaagggaauuggcaaaaugacacucggaauguguugcaucauaacugcuucgauucugcugugguacgcgcaaauccaaccacauuggauagccgcgaguauuauacucgaauuuuuccugauaguccuacuaauuccugaaccugaaaaacaaagaacgccacaagacaaucaauuaaccuauguagucauagccauacucacgguaguugcagcaacaauggccaacgaaaugggauuuuuggagaaaaccaaaaaggauuugggauugggcaguauuacuacacaggaaucugaaaguaauauucuggacauugacuuacgcccugcaagugccuggacuuuauaugcgguagccacuaccuucgucacaccaaugcuccgucauaguauagaaaacaguagcguaaauguaucgcugaccgcuauugcaaaucaagccacgguacugaugggguuaggaaaaggcuggccacuuaguaaaauggacauuggcguaccccuacuagcgauagguugcuauagccaaguaaaccccaucacauugacugcggcccuccugcuauuaguagcacacuaugcaauaauagggccugguuuacaggcuaaagcgaccagggaagcgcagaaaagagcagcggcaggaauuaugaaaaacccaaccguagauggaauaacggugauagauuuagaaccaauuccauacgacccuaaauucgaaaagcaacugggccaaguaauguuacuuauauuguguguaacccaaguucucaugaugcguacaacaugggcccuaugugaggcuuuaacacuagcuacggggccuaucucuacacugugggaaggcaauccuggacgauucuggaauacuacaauugccguaucaauggcaaauaucuuuagagguucguaccuggcuggugcaggccugcuauuuucuaucaugaaaaacacaacuaauacucgccggggaaccgguaauauaggagaaacuuugggcgaaaaauggaaaucuagacuuaaugcacuaggaaaaucugaauuucaaauuuauaagaagagugggauccaagaaguggacagaacacuagccaaagagggaauaaaaaggggcgaaaccgaucaccaugccguuucgagagguagugcuaaauuaagaugguucguagaaagaaauaugguaacaccggaagggaaaguaguugauuuaggaugcggaagaggaggauggaguuauuacugugggggucuaaagaacgugagagaagucaaaggacugacaaaaggagggccuggccaugaagaaccaauacccaugagcacguacggauggaaucuuguaagauugcaaaguggcgucgauguauucuuuacaccacccgaaaaaugcgauacgcuacuuugcgacauaggagaaucaucgccaaacccaacaauagaagcaggaagaacucuacgggugcuuaacuugguagagaacugguuaaacaauaauacccaauuuugcauaaagguguuaaacccuuacaugcccagcguaauagagaaaauggaaacguuacaaagaaaauauggaggugcguugguccguaauccauuaucccgaaacaguacacacgagauguauuggguaucuaaugccacaggcaauauaguuucaucaguuaacaugauaagccgaaugcucauuaauagguucacaaugaaacauaagaaggcaaccuaugaaccagaugucgaccuaggaucaggcacaagaaauauaggcauugaaucagaaauaccaaaucucgacauaauaggaaaaagaauugagaaaaucaaacaagagcaugaaacaagcuggcacuaugaucaagaucauccauacaaaacuugggccuaccaugguucauaugagacaaagcaaacggguagugccucuucuaugguaaauggaguuguucgucuacuaacuaaaccaugggauguagugccaaugguaacacagauggcuaugacagacacaaccccauuuggccagcaaaggguauucaaagaaaaaguagacacacgaacacaagagccaaaggagggcacgaaaaagcucaugagaauaacugccgaauggcuauggaaagaacuuggaaagaagaaaaccccgagaaugugcacaagagaagaguuuacuagaaaaguuagaagcaaugcagcauuaggggcaauuuuuacggacgaaaacaaauggaaaagcgccagagaagcaguagaagauucucguuucugggaauuaguggaccgcgaaagaaaucuccauuuagaaggcaaaugugaaaccuguguauauaauaugauggggaaaagagaaaagaaacucggagaauuuggaaaagcaaaagggucacgagcaauuugguauauguggcuaggagcgagguuccuagaauuugaagcgcugggauuucuaaacgaagaucacugguuuucucgugggaauagucuaagugggguagaaggggaaggauuacaucgucuggguuacauucugcgugaugucagcaagaaagaaggaggugcaauguaugccgacgauaccgccggaugggacacaagaauaacucucgaagaucuuaaaaacgaagaaaugguuacgaaucauaugaaaggagaacacaagaaacuagcugaagcgauauucaaacuaacguaucaaaauaaaguaguacgugugcaacgcccaacgccaaggggaacagucauggacauaauaaguagacgagaccaacgagggaguggacagguaggcacguacgguuugaauacuuucacgaacauggaagcucaauugauacgacaaauggaaggugaaggaaucuuuaaauccauacaacaucuuacgguuacagaagaaauagcaguacaaaacugguuagcacgaguuggaagagaaagauugagccgaauggcgauaucuggggacgauugcguaguaaaaccucuagaugauagauuugcaucagcuuugacugccuugaaugacaugggaaaggugagaaaggauauacagcaaugggaacccucacgaggauggaaugacuggacacaaguaccuuuuugcucgcaccauuuucaugaauuggugaugaaagacgggagagucuuaguagugccgugcagaaaccaggaugaauuaauuggcagagcaagaauaucacaaggagccggauggaguuugaaagaaacagccuguuuaggcaaaagcuacgcucagauguggacauuaauguauuuucauaggagggaucuaagacuggcugcaaacgcaauaugcagcgcaguaccuagccauuggguaccuacgucgcgaacaacuuggagcauccaugcuaaacaugaauggaugacuacugaagacauguuggcuguuuggaacagaguauggauccaagaaaaucccuggauggaggacaaaacacccguagaaaguugggaagaagugccuuaucucgguaagagagaagaucaauggugugguucacuuauaggcuuaacaagcagagcaacgugggcgaaaaauauacagacugccaucaaucaaguaaggagccucaucggaaaugaagaguacaccgacuauaugccguccaugaagcgauucagaagggaggaggaggaagcaggcguccuaugg

SEQ ID NO: 22902 - RNA, 9873 nt, Artificial Sequence
  derived and/or modified CDS sequence (opt6) from DENV-2__HQ012534__SS-prME
acagcgggugugauuauuauguuaauaccuacagcgauggcauuucaucuuacgacuaggaauggugaaccucauaugauuguggguaggcaggagaaaggaaaaucacuucuuuuuaaaacagaggaugguguuaauaugugcacucuuauggcaauagacuuaggugagcuuugcgaagacaccauuacguacaaaugucccuuacuacgucaaaaugaacccgaggacauagauugcuggugcaacucuacguccacauggguaacauacggaacuuguacuacaacuggggaacacaggagagaaaaacgcucaguagcauugguaccccacgucggaauggguuuagaaacucgcaccgagacuuggaugaguucagaaggagcauggaaacacguacaacgaauagagacuuggauuuuaaggcauccaggauuugcaauaauggcggccauacuagccuacacaauagguacaacgcacuuccagagggcacuaauauucauuuugcuaacugcuguagcaccgaguaugacaaugagauguauaggaauauccaauagagauuucguugaaggaguaucugggggaucauggguagauauuguacuagaacacggauccuguguuacaaccauggcuaaaaauaaacccacucuagacuuugagcuaauaaaaacggaagcaaaacagccagcaacuuuaagaaaauacugcaucgaggcaaaacuaacuaacaccacaacggaaucuagaugcccaacccaaggcgagccuaguuugaaugaggaacaagacaaacgauucauuugcaaacacucgaugguagauagaggauggggaaauggcugcggucuauuugguaaaggaggaauuguaaccugcgccauguucacuuguaagaaaaauauggaagguaaaguuguauuaccagaaaaccuugaauauacgaucguaauuaccccucacucaggugaagaacacgcagucgggaaugauacaggaaaacauggggaggagauaaaaauaaccccgcaaucaucgauuacagaagcggaauugacuggcuaugguacaguuacuauggaauguucuccucgaaccggacuugacuuuaaugagaugguuuugcuacaaauggaagaaaaagcauggcugguacacagacaaugguuucuggaucuuccauuaccauggcugccaggggcugauacacaagggucaaacuggauacaaaaagaaacacuugucacauucaaaaauccccaugcuaagaaacaggauguugugguacugggcagucaagaaggagcaaugcauacugcacugacgggcgcaacggagauacagaugucuucagguaaucuucuauuuacgggacacuuaaaauguagauugcgaauggacaaacuacaauuaaaaggaaugucauauaguaugugcaccggcaaauuuaaaauagugaaagaaaucgcagagacacaacaugguacaauugugauacguguucaauaugaaggagauggcuccccauguaaaauaccauuugagauuauggauuuagagaaacgacacguuuuaggcagauuaauuacuguaaacccgauagugacagaaaaggacagcccagucaacauagaagcggaaccaccauucggugauaguuauauaauaaucgguguagaaccaggacagcuuaaauuaaauugguucaagaaaggaucaagcauaggucagauguuugagacaacaaugagaggggcaaaaagaauggccauacugggggacacagcaugggacuuuggaagucuuggaggaguuuuuacaucaauagguaaagcacugcaccaaguauuuggcgcuaucuauggagcugcauucaguggcgugucuuggaccaugaagauuuugauaggaguuauaaucacuuggauuggcaugaauaguagaucuaccucacuguccgugucguugguucuaguagggguaguuacauuguacuugggagcuaugguacaagcugauucaggauguguuguaagcuggaaaaauaaagaauugaaauguggcucuggaauauucauaaccgauaauguccauacguggacggaacaguacaaauuucaaccagaaucuccgagcaaacucgccucggcuauccaaaaagcacaugaagagggaauauguggaauaagaucgguaacacgauuagaaaaucuaauguggaagcaaauaacaccggaacuuaaccauauauuauccgaaaacgaaguaaaauuaaccauaaugaccggagauauaaaagggauaaugcaagcgggaaaacgcucauugcguccacaacccacugaauuaaaauacucauggaaaacauggggaaaggcuaagauguuaucaaccgagagccauaaucaaaccuuucucauugacggucccgaaacugccgaauguccaaauacuaaucgagccuggaacucauuagaaguugaggacuaugguuucgguguauuuaccacaaauauuugguuaaaacugagggagaaacaagauguauucugugacaguaaauuaaugagugcagccaucaaagacaauagggcaguacaugcagauaugggauauuggauugaaagcgcuuugaaugacacauggaaaauggagaaggcaucauucaucgaaguaaaaucuugucacuggccaaagagucauacuuuguggucuaaugggguuuuagaaucggagaugauaauuccuaagaauuucgcaggcccggucagccaacacaauuaccgaccugguuaucauacucaaacggcagguccuuggcauuugggcaaauuagagauggacuuugacuucugcgaagguacuaccgugguggucacagaagauugcggcaauagaggacccucacuacgaacaacaacggcaucagggaaauuaauuacagaguggugcugcagaaguuguacuuuaccaccccuaagguauagaggagaagacggauguugguauggaauggagaucagaccuuuaaaggagaaagaggaaaauuugguaaauucuuugguuacagcuggucauggacagauagauaauuuuagucucgguguacuugggauggcauuauuucucgaggagauguuacgaacgagagugggcacaaagcaugcaauacugcugguagccguuuccuucguaacucuaauuacggggaacaugagcuuucgagaucuugguagggucaugguaaugcuaggcgugccuaugacagaugauauagguaugggagugacauauuuagcguuauuggcugcauuuaaggugagaccgaccuuugccgccggucuacuacuacgcaaacuuacuuccaaagaauuaaugauggcgacgauuggcauugcauuacuaucacaaagcaccauaccagagaccauacuagaauuaacagaugcacuugcuuuggggaugaugguuuuaaaaauuguccgaaauauggagaaauaucaauuggccguuacgauuauggcaauaucauguguuccuaacgcaguuauuuuacuuaaugcauggaaaguuaguuguacaauacuagccgcuguaucuguaucaccuuuacuauuaacaucuucacaacagaaaacagacuggauuccauuagcuuugaccauaaaaggcuuaaauccuacggcgauauuccuuaccaccuuaagcaggacaucuaaaaagcggucguggccucuaaaugaagccguaauggcugucggaauggugagcauucuugcgucgucacuucucaaaaaugauauuccgaugacugguccccugguugcaggcggucuucuaacagucuguuauguauugaccggaagaucagcagaucuggaacuagaaagagccgcagacguaaagugggaggaccaagccgaaauaucaggaucaucgccuauuuuaucaauaacaaucucugaagacgguagcaugucaaucaaaaacgaagaagaggaacaaacguuaacaauauuaauaagaacaggcuuacucguuauuucgggaguauuuccggucagcaucccaaucacagccgcggcgugguaucuaugggaggugaagaaacaaagagccggugucuugugggauguaccuucaccuccuccaguggguaaagcagaauuagaggauggcgccuaucguauuaaacaacgcggaauacucgguuacucacaaaucggcgcggguguuuacaaagaaggaacauuucacacaauguggcauguaacuagaggagccguacugaugcaccgagguaaaagaauagaaccgucaugggccgacgucaagaaagacuuaauaucauauggaggcggauggaaacuagagggugaauggaaggaaggggaagaaguacagguguuagcccucgaaccuggcaaaaacccaagagccgugcaaacaaaaccgggccuauuuaaaacgaacaccgguacaauaggcgcaguaucacucgauuucucuccagguacaucggguucgccuaucgucgaccguaagggaaaaguaguugguuuauacggaaauggaguagucacuaggaguggugcuuauguauccgcuauugcacagaccgaaaagucaaucgaagauaauccggagaucgaagacgacauauucagaaagaaaagauuaacuauuauggauuuacauccaggagcaggaaaaacaaaaagauacuugccagcaauaguccgagaggcuauuaaacgaggcuuaagaacacugauacuggcuccuacgagagugguagcagccgagauggaagaagcacuaaggggucuaccgauccgauaccaaacuccagccauacgagcggagcauacuggcagggaaauaguugaucugaugugucacgccaccuuuacgaugaggcuacuaagcccagucagaguaccuaauuauaacuuaauaaucauggaugaagcgcauuucaccgacccagcaucaaucgcugcaaggggauacauuucgacaagaguagaaaugggcgaagccgcuggcauauucaugacagcuacaccuccaggaucacgugauccuuucccucaauccaaugcaccaauaauggaugaagaaagggaaauacccgaaagauccuggaacucaggacacgaauggguaacagacuuuaaaggcaaaacagugugguuuguaccaucuauaaaggcagggaacgauauagcggccugccuuaggaaaaacgguaagaaaguaauucagcucucaagaaagacauuugauucagaauauguaaagacaagggcuaacgacugggauuuuguagugacuaccgauauuucggagaugggggcaaacuuuagagccgaacgagucaucgacccgaggcgguguaugaagccaguuauauuaacagauggagaagaacgugugauacuagccggcccuaugcccguaacgcauucuagugcagcgcaacgaagaggaaggauugguagaaacccgaaaaacgagaaugaccaauauauuuauaugggcgaaccuuuagaaaacgaugaagauugugcacauuggaaagaggccaagauguuguuagauaauaucaauaccccagaagguauaauucccagcauguuugagccugaacgugaaaaaguggaugcaauugacggugaauacagacugagaggcgaagcaagaaagacuuuuguagaccuaaugcgcagaggugaccucccaguaugguuagcguauaggguagcagcugaaggaauaaauuacgcagacagaagguggugcuuugaugguaucaaaaauaaucaaauacuggaagaaaauguagaaguggaaauauggacuaaagaaggggaacgcaaaaaguuaaaaccgagauggcuagacgcccgaauauauucggauccucuagcacugaaagaauuuaaagaguucgcugcagggcguaaauccuugacgcuuaaucuaaucacugaaauggggagauugccaacauucaugacucaaaaagcacgagacgcccuagauaacuuggcaguucugcauacugcggaagcgggaggacgugcauacaaucaugcacucagugaauugccagagacacucgaaacccuuuugcuacuaacccuauuagcaacggugacaggaggaauuuucuuauuuuuaauguccgggaaggguauaggaaaaaugacgcugggaauguguugcauaauaacugcaaguauauuacuaugguaugcacaaauccaaccucauuggauugcagcgaguaucauauuagaguucuuuuuaauaguauuguuaauuccugaaccugaaaaacaacggacaccacaggacaaucagcucaccuaugucguaauagcaauccuaacaguuguugcugccacaauggcaaaugaaaugggcuuccuagaaaagacuaaaaaggaccugggguuaggaucaauuacaacccaagaaucagaauccaauauauuggacauagaccuacggcccgcaucugcuuggacgcucuaugcaguugcgacaacauucgugaccccaaugcuaagacauucaauugaaaauucuagcguuaacguaucacuaacugcaauugcuaaucaggccacaguucuuaugggacuugggaaaggcuggccacuaucuaaaauggauauagggguuccccuccuagcgauaggaugcuauucucagguaaacccgauaacacuaacugcagcauuauuacucuuggucgcacacuacgcaauaauagguccaggcuuacaagccaaggcaacaagagaagcucagaaacgagcggcggcuggcauaaugaaaaauccaacaguggacgggauaacggugauugacuuggaacccauaccauaugauccaaaauucgaaaagcaauuaggccaagugaugcuacuaauuuuaugcguaacacaaguucuuaugaugcgcaccacgugggcacuaugcgaagcguuaacccuggcgacaggaccgauaucgacccugugggaaggcaauccaggacgauuuuggaacacaacuauugcugugaguauggcaaauauuuuuaggggguccuaccucgcgggugcaggccuucuauucaguauuaugaaaaacacaaccaacacaagaagggggacgggaaacauaggagaaacgcucggcgaaaaauggaaaagcaggcugaaugcacuuggaaaauccgaguuccagauauauaagaagaguggaauacaagaggucgauagaacauuggcgaaagaaggaauuaagcguggugagacagaccaccaugcuguuucaagagguucagccaaacuccgcugguucguggaaagaaauaugguuacuccugaaggcaaaguaguagaucucggcuguggaaggggaggguggagcuacuacugcggaggacucaaaaacguacgagagguaaaagggcuuacaaaggguggacccggacacgaagaaccaauaccaaugucuacuuauggguggaaucucguaaggcuacagagcggaguugauguauucuuuacuccaccagagaaaugugacacguugcuaugcgacauaggugaaagcucaccaaacccaaccauagaagccggaagaacauuaaggguguugaaucucguggaaaacugguugaacaacaacacucaauuuuguauaaaaguauuaaacccuuacaugccaucgguaauugagaaaauggagacguuacaaagaaaauacggaggagccuuagugcgaaacccguuauccaggaacaguacgcaugaaauguauugggucagcaaugcaacgggaaauauugucucguccgucaacaugauaagucgaauguuaauuaauagauucaccaugaaacauaagaaagccaccuaugagcccgauguagaucuaggaucgggaaccaggaacauaggaauagaaucagaaauuccaaauuuagacauuauagggaaaagaauagagaaaauaaaacaggaacaugaaacuuccuggcauuacgaucaggaucacccuuacaaaacuugggcauaccaugggucauacgaaacaaaacagaccggaucugcuagcucaauggucaauggcgucgucagauuguuaacaaaaccuugggaugucgugccaaugguaacacagauggcuaugacugauacaaccccauuuggacaacagcgcguauuuaaggaaaaaguagacacaagaacacaagagccaaaggaggggaccaagaaacuaaugcgaauaacagcugaguggcuauggaaagaacugggcaagaagaaaacgccuaggaugugcaccagagaagaauuuacaagaaaaguuagguccaacgcugcguuaggggcgaucuucacagaugaaaauaaauggaaaagugcccgagaagcgguugaggacaguagauuuugggagcuaguagacagagagagaaacuuacaccuagagggcaaaugcgagacaugcguuuacaacaugauggguaagagagagaagaaacuuggcgaauuuggaaaagcgaaagguagccgggcuauaugguacauguggcuuggugcacgguuucuagaguuugaggcauuaggauuuuuaaacgaagaucacugguuuucuagagguaauagucuaucggguguugaaggagaaggacuacacagguugggauacauacuccgagacguaaguaagaaagaagggggagcgauguaugcagaugacacugcagggugggacacgagaauaacauuagaagaccuaaagaaugaagaaaugguuacaaaucacaugaaaggugaacauaaaaaguuagcugaggcaaucuucaaacucacauaucaaaacaaagugguacgaguacagaggcccacaccaagaggcacggugauggauauuaucagcagaagggaccaaaggggcaguggacaaguugguacauacggauuaaacacguucacaaauauggaggcgcaacucauucgucaaauggagggugaaggcauuuucaaauccauacaacaccugacuguuacagaagaaaucgcgguccagaauuggcuagcuagaguaggccgagaaagacugucucguauggcuauuagcggcgacgauuguguaguaaaaccacucgacgacagauuugcaucggcacuaacggccuuaaacgacaugggaaaaguaaggaaagauauucaacaaugggaaccuagucgaggguggaacgauuggacucaagugcccuuuuguucacaccauuuccacgagcucguaaugaaggacggucgaguucuuguaguuccguguagaaaucaggaugaguuaaucgggagagcgcguaucagccagggcgcaggauggucauugaaggagaccgcaugucuaggaaagucauaugcccagauguggacccugauguauuuucacagaagagacuuaagauuagcagcaaaugcaauauguagugcaguaccgucacauuggguaccuacuucaaggacgaccuggucuauacaugcaaaacaugaauggaugacuacagaggauaugcuugcuguuuggaacagaguuuggauacaggagaaucccuggauggaagauaaaacaccgguagaaaguugggaagaagugccauaucuagguaagagagaagaucaauggugcgguagucucauuggacuuacguccagggcaacuugggcuaaaaauauccaaacagcgaucaaccaaguaaggagcuuaaucggcaacgaggaguauacugauuacaugccaaguaugaaaagauuucgaagggaagaagaagaagcggggguacuaugg

SEQ ID NO: 22903 - RNA, 9873 nt, Artificial Sequence
  derived and/or modified CDS sequence (opt6) from DENV-2__HQ012535__SS-prME
acugcuggugucauaauaauguuaauucccaccgcaauggcauuccacuugacaacgaggaacggagaaccucacaugauaguggggcgacaagaaaaaggaaaaucguuacuguucaaaacugaagacggagucaacaugugcacucuaauggcgauagaccucggugaauuaugugaggauaccauuacauauaaaugcccacuauuacgacaaaaugagccggaagauauagacugcugguguaacuccacuucaaccuggguuacauauggaacguguacaacgacgggugaacauagaagagagaaacgcucaguugccuuagucccacauguaggaaugggucuggaaaccagaacggaaacuuggaugagcagcgaaggugcauggaaacacguccagagaauagaaacauggauauuaaggcauccagguuucgcuauaauggcagcuauauuagcauacacuauaggaacuacgcauuuucaaagagcucugauauucauuuuacugacggcuguggcacccagcaugacaaugcggugcaucgggauuaguaacagggauuuuguagagggaguaucugggggaaguuggguagauaucguacuagagcauggaucuuguguaacaacaauggcuaaaaacaaaccaacguuagauuucgagcucaucaaaacggaagccaaacagccagcaacucugcguaaauauugcauagaggcuaaauuaacgaacaccacgacagagaguagaugucccacucaaggggaacccaguuuaaaugaagaacaagauaaaagguuuauaugcaaacauucaaugguugaucguggauggggaaauggauguggacuauuugggaaaggaggaauaguaacaugcgcgauguucacaugcaagaaaaacauggagggaaaaguaguacuuccagaaaaucuagaauacacaauaguaauuaccccacauagcggcgaagaacaugcuguugggaacgauacuggaaaacauggugaagaaauaaaaauaaccccucagaguuccauaacugaagcggaguugacaggguaugggacugugaccauggaaugcucaccacggacaggcuuagacuucaaugaaaugguauuacuacaaauggaggagaaagcaugguuaguacaucggcaaugguuucucgaucuuccauuaccuuggcuaccaggagcagacacgcaggguagcaauuggauucaaaaagaaacccuaguaacauuuaaaaauccccaugccaagaaacaggaugucgucgucuuagguagccaagaaggugccaugcauacagcauuaacaggagcuacugaaauccaaaugucuagcgguaaucuguuauucacagggcauuugaaaugucgccuaagaauggauaaacuccaguuaaaaggaaugucauauucuauguguacaggaaaauuuaaaauuguaaaagaaauagcagaaacacaacauggcacuauagucauacgaguucaauaugaaggagauggauccccgugcaaaauucccuuugagauaauggauuuagaaaaacgucacguuuuaggccgguuaauuacaguaaacccaauuguaacugaaaaagacucaccaguaaauauagaagcagaaccaccauuuggugauucguacaucauaauaggcguagaaccuggacaacuuaaacugaacugguucaagaaaggaucuagcauaggacagauguuugaaacaacuaugaggggcgcuaaacgaauggcaauacucggcgacacagccugggacuuuggaucauugggcgguguauuuaccaguauaggaaaagcacuacaucaaguuuucggcgccauuuacggugcagcauuuagcgguguaucauggacaaugaagauacuaaucggcguaaucauaacuuggauagguaugaacuccagaagcacgucucuuagcguaucauuagucuuaguaggcgugguaacccuuuauuuaggugcaaugguucaagcagauuccggguguguagucagcuggaaaaacaaggaacugaaaugcggcucagguauauucauuacagauaacguacacacuuggacggaacaauauaaguuccaaccggaaucaccaucgaaauuagcaucugcaauacagaaagcccacgaagaagguaucuguggcauacggagugucacacgacuugagaaccuuauguggaaacaaauaacgccugaacuuaaccauauccuguccgagaaugaaguaaaauuaacaauuaugacuggcgauauaaaagguauaaugcaggccgggaaacguucgcuaagaccucagccaacugaacucaaauacuccuggaaaacguggggaaaagccaaaauguuaaguacagaaagucauaaccaaacauuucucauagauggaccugagaccgcagaauguccaaacacuaaccgagccuggaauagucuagaaguugaagauuacgguuuuggcguauuuaccacaaauauuuggcuaaagcuccgagaaaaacaagacguguucugcgacagcaaacuuaugagcgcggcaauaaaggacaauagagcaguucaugcggacaugggauacuggauugaaucagcauuaaaugauacguggaaaauggaaaaagcuagcuucauugaagucaaauccugucacuggcccaaaucacacacauuauggucaaacgguguuuuggagagcgaaaugauuauacccaaaaauuuugcgggacccguuagccagcauaauuaucgcccuggauaccacacucagacagccggaccguggcacuuagggaaguuagagauggacuucgauuucugugaaggaacaacgguugucgucacggaagacugcgguaauagagggcccucauuacguacuacaacagcgucagguaaguuaaucacggaguggugcuguagaucaugcacacugccuccgcuaagauaccgaggagaggaugguuguugguacgguauggaaauacguccacucaaagaaaaagaagaaaaucuaguaaauuccuuaguaacagcaggacacggacaaauagauaauuucagccuaggaguauuagguauggcguuguuccuggaggaaaugcuaaggacacggguaggaacgaaacaugcgauucuuuuaguugcggugucauucgucacucucauaacaggcaacaugucauuuagagacuuagguagggucaugguuaugguuggaguaacuaugacugaugauaucggaauggggguaaccuauuuggcauugcuagccgcuuucaaagugcgacccaccuuugcugcgggacuauuacuccguaagcuaacaucgaaagaacucaugauggcuacuauuggcauugcauugcuuagccaaucaacgauaccugaaacaauucucgagcugacugaugcucuagcacuugggaugaugguucugaagauaguccgaaauauggaaaaauaucaauuggcuguaacaauuauggcgaucaguugcgucccaaaugccguuauccugcuaaaugcuuggaagguuucuugcacaauuuuagcugcaguuucuguuucgccgcuauuacucacuucgucacaacaaaagacagacuggauucccuuagcuuuaaccauaaaagguuugaauccaaccgcaauauuccucacuacauuaucacgcacaucuaagaaacgaucauggccacuaaaugaggcugucauggcaguuggaaugguaucaaucuuagcaagcucauugcugaaaaaugauauuccuaugacugggccuuuagucgcuggcggcuuauuaacaguuugcuauguuuuaacaggcaggagugcggaccuagaacuagagagggcggcugacguuaaaugggaagaucaagcagaaaucucugggaguuccccaauacuuucaauuaccauaagcgaggacgguaguaugaguaucaaaaaugaagaagaggaacaaacgcuaacaauuuugauacggacuggucuccugguaauaagcgguguauuuccggucucaauaccgauaacagccgcagcaugguacuuaugggaaguuaagaaacagagggccggagucuuaugggacguacccucuccuccaccggucgaaaaagcagaacuagaagauggugcguauagaauaaaacagagagguauuuuagguuauagccaaauuggggccggcguauauaaagaagguacauuucauacuauguggcauguuacuagaggcgcaguacuuaugcauagagguaaacgaauugagccuuccugggcagaugucaagaaagaucuuauaucauaugguggaggguggaaacucgaaggcgaguggaaagagggagaagaaguucaaguauuggcauuggaacccgguaaaaacccgcgggcgguucaaacaaaaccuggguuauuuaaaacaaauacagguacgaucggugcaguaucucuagauuuuagccccggaacaucaggaaguccgauagucgaucgaaagggaaaagugguaggguuauacggaaaugggguaguaaccagaagcggagcauaugucagugcuauagcacaaacagagaaaagcauugaagauaauccggagauugaagaugauaucuuuaggaaaaagcgauuaacuaucauggaccuccacccaggggcaggaaaaacuaaacguuacuugccagcaauaguuagggaagccauaaagcgagggcuaagaacauugauauuagcuccaaccagagugguagcggcugaaauggaagaagcauuacgcggcuugcccauacguuaucaaaccccugcaauacgagcagaacacacuggacgagaaauuguugaucuaaugugccacgcuaccuucacaaugagacuucuuucaccagucagaguuccuaauuauaauuugauaauuauggacgaagcgcacuuuacagaccccgcuagcaucgcggcaaggggauauauuaguacaagagucgaaaugggagaagcugcgggaauauucaugacugcuacuccaccagguagucgugauccauuuccacaaucaaaugcuccaauuauggaugaagaaagagaaauucccgaacgaucguggaacucugggcacgaauggguuacugacuucaagggcaaaaccgugugguuugucccaagcauuaaagcggguaacgauauagcagccugucugcgcaaaaauggcaagaaagugauccaauuaucgaggaagacuuuugacucugaauauguaaaaacacgugccaaugacugggacuucguagucacaacugauaucucggaaaugggagcgaacuuucgggcugaaaggguaauagauccacgcagauguaugaagccaguaauucuuacugauggcgaagaacguguuauccuggcagggccaaugccaguuacccauagcucagcagcacaaagacgaggaagaaucgggcgaaaccccaaaaacgagaaugaucaguacauauacaugggagaaccuuuagaaaacgacgaggauugcgcgcacuggaaagaggcaaaaaugcuacuagauaacauuaauacgccagaaggaauaauuccaaguauguuugaaccagaacgugaaaaagucgaugcgauugauggugaauaucgauuacgaggagaggcgagaaaaacuuuuguugacuugaugagacguggagaccuuccaguaugguuagcuuauaggguugcugcagaaggaauuaacuacgccgaucgacggugguguuuugacgggaucaaaaacaaccaaauauuagaagagaauguagaaguggaaauauggacaaaggaaggggagaggaagaaacuaaagccuagguggcuggaugcacgaauuuacucagauccguuagccuugaaagaguucaaagaauuugcugcggguagaaagagcuugacuuugaacuuaauaacagaaauggguagauugccgacauucaugacccaaaaagccagagacgcauuagauaauuuagcaguucuacacacugccgaagcuggugggagagcauauaaccacgcauuaagcgaguuaccagaaaccuuagaaacauuauuauuacucacucuucuagcaacugucacugguggcauauuccuauuuuuaaugaguggaaaaggcauuggcaagaugacacucggaauguguuguauaauuacugcaucgauuuuacuaugguaugcacaaauucagccacauuggaucgcagcgagcauaauauuagaguucuuuuuaauaguuuugcuuauacccgaaccugagaaacagaggaccccgcaagauaaucaacuaacuuacguggucauugcgauccuuaccguaguagcagcgaccauggcuaaugaaaugggauuccuggaaaagacaaagaaggauuuaggguuaggcucaauaacaacacaggaaagugaaagcaacauacuagauauagaccuuaggccagcaucagcauggacucuuuaugcgguggcaacgacuuuuguaacccccaugcucagacauucgauugaaaauucaagcgucaacguauccuugacugcgauugccaaccaggcaacagucuuaaugggacucgguaaaggauggccgcuuagcaagauggauauagguguaccauuauuggcgaucggauguuacagucaaguaaauccuauaacucuaacggcugcacuguuguuauuaguagcccacuacgcuauaauagguccaggucuucaagccaaagcaacucgagaagcgcagaagcgagcugcagcggggaucaugaaaaaucccacagucgaugguauaacuguaaucgaucuagaaccuauaccguaugauccuaaguucgaaaaacaauuagggcaaguuaugcuuuuaauacucuguguaacacaggugcuaaugaugcgaacaacaugggcgcuaugugaagcucuaacucuggcuacagggccgauuaguacccuaugggaaggcaauccuggaagauuuuggaauacaacuauagccgucagcauggcaaauauauuccgagguagcuaucuagcaggagcaggguuacuauuuuccauaaugaaaaauacuacgaauacuagaagaggaacuggaaacauaggagaaacgcucggagagaaauggaaguccagguugaacgcauuaggcaaaagcgaauuucaaauauauaagaaaaguggcauucaagaaguagauaggacccuugcaaaagaagggaucaaaaggggagaaacugaucaccaugcagugucuagagggucggcuaaacuaagaugguuuguagaaaggaacaugguuacuccagaagguaaaguugucgaucugggcuguggaagggguggauggagcuacuauuguggcggacuaaagaacgugagagaagucaaaggucucacgaaaggaggaccgggacaugaagaaccgauaccaaugucaacuuauggcuggaaccucguaagauugcaaucggggguagacguauuuuucacaccgccagaaaaaugugauaccuugcucugcgacauaggcgaaucuucacccaauccaacuauagaagcaggacgcacacuaagagucuugaaucucgccgagaauuggcuuaacaacaauacgcaauuuuguauuaaaguauuaaacccauacaugccauccguaauugagaaaauggaaacguugcaaagaaaauaugguggagcgcucguucggaacccacuuucgagaaauucaacucacgaaauguacugggugaguaacgcaacuggaaauauugugucuucgguaaacaugauaucuagaauguuaauaaauagguuuaccaugaaacauaaaaaggcgacuuaugaaccagauguggaucucgguaguggcacuagaaauauaggaaucgaaagugaaauaccuaacuuggacauaauaggcaagcgaaucgagaaaauaaaacaggaacaugaaacaagcuggcacuacgaucaagaucauccauauaaaacaugggccuaucacggaagcuacgaaacuaaacagaccggcucugcaucauccaugguaaacggaguagugcggcuccuaacgaaaccaugggaugugguacccaugguaacacagauggcaaugacggauacuacucccuuuggccaacaaaggguauuuaaagaaaaaguugauacuagaacacaagaaccaaaggaaggaacuaagaaacuaaugaggaucacagcagaauggcucuggaaggaauuaggcaagaagaaaaccccacggauguguaccagagaggaauuuacaaggaagguaagaucaaaugcggcacuaggugcaauauuuacggacgagaacaaguggaaaucggcacgagaggcgguagaggauucaagauucugggaguuaguggauagagaaagaaaucuucaucuagaaggaaaaugcgagacuugcguguacaacaugaugggaaagagagagaagaaacugggggaguucggaaaagcaaaaggaucucgagcuauaugguauaugugguuaggugcaagauuuuuagaauuugaagcacuugguuucuuaaaugaagaucacugguuuucgcguggaaauagucugagcgguguugaaggugaaggccuacauagauuagguuauauacucagagauguuaguaagaaagagggaggcgcuauguaugcggacgacacggcuggcugggacacuagaauaacauuagaagacuugaagaacgaagaaaugguuacuaaucacaugaaaggggagcauaagaaauuggcggaagcaauauuuaaauuaacauaccaaaauaaagucguacgcguucagagaccaacaccccgagguaccguuauggauauaauaagucguagagaccaacgaggaagcgggcaaguaggaacuuauggacuaaauaccuucacaaacauggaggcacaacucauaagacaaauggagggcgaaggaaucuucaagaguauucagcacuuaaccguuacugaagaaauagccguacaaaauugguuagcacgugucggacgugaaagguuaaguaggauggcaauaucaggagacgacuguguagucaaaccauuagacgacagguuugcuagcgcacuaacggcauuaaacgacauggggaaaguucguaaggauauacaacaaugggaaccauccagaggauggaaugacuggacacaaguucccuuuugcagucaucauuuucaugaacuugucaugaaagacggaagaguuuugguugucccuuguaggaaucaagacgaguuaauagggcgagcaagaauaucacaaggggcuggguggucgcucaaagagacagcuugcuuggggaaaucauacgcucagauguggacucuuauguauuuucauaggcgugaucuacgacuagcugcaaaugcaauauguuccgccguacccagucacuggguuccaacuucccgaacaacuuggagcauucaugcuaagcacgaauggaugacgacagaagacauguuagcaguauggaacagaguguggauccaagaaaaucccuggauggaagauaaaacaccaguagagucaugggaagagguaccuuacuuaggaaagagggaggaccaaugguguggaucacugauuggucucacgucgcgcgccacaugggcuaaaaauauucaaaccgcaauaaaccaaguaagaucgcuaauaggaaacgaggaauauacagauuauaugccaagcaugaaaagauucagacgugaagaagaagaagcgggaguauuaugg

SEQ ID NO: 22904 - RNA, 9873 nt, Artificial Sequence
  derived and/or modified CDS sequence (opt6) from DENV-2__HQ012536__SS-prME
acagcugguguuauaauaauguuaauuccuacggcaauggcauuccaucuuacaacgagaaauggggaaccccauaugauaguaggaagacaagaaaaaggaaaaucuuuguuauuuaaaacggaagacgguguuaacaugugcacauugauggcuauugaccuuggggaauuaugcgaagauacaauaacguauaaaugcccccuccuucgccaaaacgaaccagaagacauagacuguuggugcaacucaacuagcacguggguaacauacggaacaugcacaacaacuggugaacaucgaagggagaaaagauccguagcacuggugccucauguuggaauggguuuagaaacgcguaccgaaacauggaugagcucagaaggugcguggaaacacguucaacguauagaaacuuggauuuuacgacaccccggauucgcaaucauggcagcaauucuugcuuauaccaucggaacaacacacuuccaacgagcuuuaaucuuuauacuacucacggcaguggcgccuagcaugacaaugcgauguauuggaauaucaaacagagauuucguugaagguguuucaggagguucguggguagacauaguacuggaacacggaucuugcguaacaacaauggccaaaaacaaaccaacgcuagacuucgaacuuauaaaaacagaagcaaaacagccagcuacauuaagaaaauauugcauagaagcaaaacuaacaaauaccacuacugaauccagauguccaacgcagggugagccaaguuugaaugaggagcaggacaaacgauuuauuugcaaacauaguauggucgauagggguuggggcaacggauguggguuauuuggaaaaggcgguauuguaacaugugcaauguuuacuugcaagaaaaacauggaagguaaaguugucuugccagaaaacuuagaauacacaauaguuauuaccccacacucgggugaagaacacgcaguaggaaaugacacaggaaaacauggcaaagaaauaaaaauuacuccucaaagcagcauaacagaggcggagcucaccggcuacggaacugucacuauggaauguucgccgagaacgggauuggauuucaaugaaaugguucuacuccagauggaggagaaagcauggcuaguacaucgacagugguuuuuagauuugccgcuuccgugguuacccggugcagauacucagggaaguaauuggauacagaaagagacacugguuacauuuaaaaauccacacgccaagaaacaagacguagucguuuuaggaucgcaggaaggagcaaugcauacagcacuuaccggugcaacggaaauacagauguccucugggaaccugcuauuuacuggacaccugaaaugcagacuacgacuugacaaauugcaacucaaaggaaugaguuacaguauguguacugggaaauucaaaauagucaaagaaaucgcggagacucaacauggaaccauaguuauuagaguacaguaugaaggcgacgggucaccaugcaaaaucccauucgagauaauggaccucgagaaaagacacguacuggggcgccuuaucacuguaaauccuauuguaacagguaaagacucgcccguaaacauugaagcagaaccaccuuuuggagacagcuauauuauuauugggguagaaccaggacaacucaaauuaaauugguucaagaaaggaucgaguauuggucaaauguucgaaacaacgaugcgaggcgcuaaaagaauggcaaucuuaggagauaccgcaugggacuuuggguccuugggagguguauuuacuucgauagguaaagcacuucaccaaguuuuuggugcaauauauggagcggcuuuuagcggugucucauggacaaugaaaauucuuauugggguaauaauuaccuggauaggcaugaacucuagaaguacaaguuuaucuguuucccucguccugguggguguuguaacacuauaccugggagcgaugguccaggcagauaguggguguguaguaagcuggaaaaacaaagaacuaaaaugcgggucgggaauuuucauaacagauaaugugcacacuuggacagaacaauauaaguuccaacccgagagccccucgaaguuggcuucagcuauccaaaaggcucacgaagaggggauauguggaauaaggagcgugacuagacucgagaauuugauguggaagcagauuacuccggaauuaaaccauauccuuuccgaaaaugaaguuaagcuaacaauaaugacuggagacauaaaaggaauaaugcaagcagggaagcggagccuacgcccacaaccgacagaguuaaaauacucauggaaaaccugggguaaagcaaaaaugcuaaguacagaaucacacaaucaaacuuuccuuauugaugguccagaaacugcugaauguccuaauacaaacagggccuggaacucucuagaagucgaggacuacggauuuggaguauucacaacaaauauuuggcucaaacugagagagaagcaagauguauuuugugacaguaaauuaaugagugcggcaauaaaagauaacagagcgguacacgccgauaugggauacuggauagaaucugcguuaaaugggacguggaaaauggaaaaagcaucauuuauagaaguuaaaucuugucacuggccgaaaucgcacaccuuauggucaaacgguguucuugaaucagagaugaucauaccaaagaauuucgcuggaccagucucccaacacaauuauagaccaggcuaucacacacaaacagccggcccguggcaccuagguaaauuggaaauggauuuugauuuuugugaaggaaccacuguagucguuacagaagacugugggaaccgggguccuaguuuacggacaacaacugccagugggaagcucaucacagaaugguguuguagauccugcaccuuaccaccacuaagguaucguggugaagacggguguugguaugguauggaaauaagaccacuuaaagaaaaagaagagaaucuaguuaauuccuuggucacggccggacauggacagaucgauaacuuuagucucggaguacuagggauggcucucuuucucgaagaaaugcuucgaacacggguagggacaaaacaugcuauccucuugguugcuguuagcuuuguaacuuuaauaacugggaacaugaguuuuaaagaccuugggcgcguuaugguaauggugggaguggccaugacagacgacauaggaaugggcguaacauaucuagcacuguuggccgcuuuuaaaguacgccccacauuugcagcaggacuacuucuaagaaaauuaacaucuaaagaauuaaugauggcaacuauuggaauaacacuacuuucacaaaguacaauaccagagacaauacuugaguugaccgacgcucuggcacuuggcaugaugguuuuaaaaauugucagaaauauggaaaaguaccaauuagcuguaaccauuauggcgauaaguugcguacccaaugcuguuauacuucuaaaugcuuggaaaguauccugcacaauacuagcugccgugaguguaucgccauuacucuuaacgucaagucaacagaaaacugauuggauaccccuugcacuaacaauuaaaggacuaaauccaacagcaauuuucuugacaacauuaaguaggacgagcaagaaaagaaguuggccccuuaaugaagcggugauggcaguagggaugguuagcauccuugcuagcagcuuguugaagaacgauaucccuaugacugggccgcuagucgcagggggacucuuaacaguauguuacguacuuacuggccguucagcggacuuagaauuagaaagagcagcugacguuaaaugggaggaucaagcagaaauuucggguucaagucccauauuaagcauuacaauauccgaagacgggaguaugucuaucaaaaacgaggaggaagaacaaacccugacuaucuugauuagaacaggacuuuuaguuauaucuggugucuuuccuguaagcauaccaaucacggcagccgccugguauuuaugggaaguaaagaagcaaagagcaggaguauugugggacguaccuucgcccccgccaguagggaaagcugaacuagaagacggggccuaucggauaaaacaaagaggaauccuaggauauucccaaauuggcgcgggcgucuacaaagaagguacauuccauacgauguggcaugucacuaggggugcaguacuaaugcacagaggaaaaagaauugaaccgucaugggcagaugucaagaaagaucuuauaagcuauggcggaggauggaaacuugaaggagaguggaaagagggcgaagaaguacaaguucucgcauuagagccggguaagaacccgcgagcaguacagacuaaaccuggcuuauuuaaaacaaauacggguacgauaggagcagugucauuggauuucagcccaggaacauccgggucgccaauaguagaucgaaaagggaaagucguuggucucuauggaaaugguguuguaacaagaaguggagcauauguaucugccauugcccaaacugagaaaagcauugaagauaauccagaaauagaggaugauauauucaggaagaaacgauugacgauaauggaccuacauccaggagcuggcaaaaccaaaagauaucuuccagcgauuguaagagaggcgauaaaaagagggcuacguacgcuaauacucgcuccaacaagagucguagcggcggaaauggaggaagcgcuacguggccuaccuauacguuaucagacgccugcgauaagagcggaacauacgggaagggagauuguagacuuaaugugucacgcuacuuuuacaaugcgcuuauugucaccaguacgaguuccaaauuacaaccuaauaauaauggaugaagcacauuuuacagauccagccagcauagcggcaagaggauacauaucuacaagaguggaaaugggugaagcggcaggaauuuucaugacggcaacgccuccggguucaagagauccauucccucaauccaacgcuccaauuauggaugaggaaagggaaauucccgaaagaagcuggaacucuggucaugaaugggucacugauuuuaaagguaagacgguaugguuugucccgucaauaaaagcagggaaugauaucgcagccugccuuaggaaaaacggcaagaaaguaauccaguugucacggaaaacauucgacucagaauaugucaagacaagggcaaaugauugggauuucgugguuaccacagacaucagugaaaugggggcgaauuucagggcugagcgagugauagacccgagaagaugcaugaagcccgugauauuaacagacggagaggagcgagucauacuggcagggccuaugccaguaacacacucaagugcugcccaacgacgaggaagaguaggacgaaacccuaagaacgagaaugaucaauauauauacaugggggagccacuugaaaacgaugaagauugugcgcacuggaaagaagcuaaaaugcuacuagacaauauuaauacuccggaaggaauuauuccgucaauguucgagccugaaagggaaaaaguugacgcuauagacggugaguaucgacuaaggggcgaagcucgaaagacauucguggaccuuaugaggcguggugauuuaccgguuuggcucgcauauagaguagccgcagaaggaaucaauuaugcagauagaagaugguguuucgacgguauuaagaauaaccaaauuuuagaggaaaacguagaagucgaaauuuggacgaaagaaggagaacgaaagaaacuuaaaccuagauggcuugacgcacgaauauauagugacccccucgcacuaaaggaauuuaaagaauuugcugccgguagaaaaagucugacauuaaaucucauaacagaaauggguagauuaccgacuuuuaugacgcaaaaggcacgcgacgccuuagauaaccuugccguacuacacacagcagaggcuggaggacgcgcguauaaucaugccuuaagugaauuaccagagacacucgaaacauuguuguuauuaacucucuuggcuaccguaacaggugguauuuuccucuucuuaauguccggaaaagguauaggcaaaaugacccucgguauguguuguauaauaacggcguccauauuauuaugguacgcgcaaauacaaccucauuggauugcggcuagcauuauucuugaguucuuucucaucguucuacucauucccgaaccagagaaacaaagaacuccccaagauaaucaacugacguaugucguaaucgcuauacuuaccguaguggccgcuacaauggcgaaugagaugggcuuucuggaaaagacgaagaaagaccuuggccuggguagcauaacaacacaggaaucagaaucaaauauauuagauauugaucuucgcccggcaagugcuuggacguuauaugcaguagcaacuacauuugugacaccuauguuacgucauucaauugaaaacucaagcgucaaugucaguuuaacugccauagcaaaucaagccaccguacuuaugggacucggaaaaggauggccacuguccaaaauggauauuggugucccuuuacuggccauaggauguuauucacagguuaauccaauaacguuaacagcagcguuacuacugcuuguggcgcauuacgcuauaauaggaccagguuuacaggcgaaagcaacucgagaagcccagaaaagggcggcggcagggauuaugaaaaaccccaccguagaugguauaaccgugauugacuuagaaccaauaccauaugaucccaaguuugagaaacaacucgggcaagucaugcuuuuaauacuaugcguaacccaaguauuaaugaugaggacgacuugggcauuaugcgaggcuuuaacuuuagcaacaggaccuauuuccacccuuugggaagggaacccaggcagguuuuggaacacaacgauagcaguuucaauggcaaacauuuucaggggauccuaucuugcuggugcaggacuuuuguuuaguauuaugaagaauacaacaaauacacgucgugguaccgguaauaucggagaaacauuaggugagaaauggaaaucacggcuaaaugcccuggggaagucugaguuccagauauacaagaaaucaggcauucaagagguagacaggacacuagcuaaagaggguauaaagcgcggugagacggaucaccacgcgguauccagagggucagcaaaacuucgcugguuuguagaaaggaacaugguuaccccugaaggaaaaguaguugauuuaggauguggaagaggggguuggucuuacuacuguggaggccuuaaaaaugucagggagguaaagggucuaaccaaagggggcccaggucaugaggaaccaauccccaugucuacuuauggauggaauuuaguacgacuacaaucuggaguugacguuuucuuuacucccccugagaaaugugauacauuacuuugugauauuggagaaucgagcccaaaucccacaaucgaagcgggacgcacuuuaagaguuuugaauuuaguggaaaacuggcuaaauaacaacacacaauuuuguauaaagguucucaauccauauaugcccucagugauagagaaaauggaaacguuacaaaggaaauaugggggagcauuggugagaaauccuuuaucaagaaauucuacucaugagauguauuggguuuccaaugccaccggaaauauugugucuucaguuaauaugaucucgaggaugcuaauaaaucgauuuacaaugaaacauaagaaagcuacguaugaaccugacgucgauuugggaagcggaacgagaaacaucgguauugaaucagaaauacccaaccuagacauaauaggaaaacgaauagagaaaauuaagcaagaacaugaaaccuccuggcacuaugaucaagaccauccauauaagacaugggcuuaccaugggucauacgaaacaaaacagacuggaagugcaucgucaaugguuaauggaguaguaagguuguuaacgaaaccaugggacgucguaccaauggugacacaaauggccaugaccgauacgaccccuuuuggacaacagaggguauuuaaagaaaaggucgacacacgcacucaagagccgaaagagggcaccaagaaacuuaugagaaucacagcggaauggcuguggaaagaguuggguaaaaagaaaacgccaagaauguguacuagagaggaauuuacaagaaaaguacgaucgaacgcugcguugggagcaauuuucacagacgaaaacaaauggaaaucagcacgagaagcaguugaggauucaagauucugggagcuuguagaucgugaaagaaaucuccacuuagaaggaaaaugcgaaacuuguguauacaauaugauggggaaaagagagaaaaaguuaggagaauuugggaaagcaaaagguucaagagcuauuugguauaugugguuaggcgcacgauuuuuagaguuugaagcacuuggcuuccuaaaugaagaccauugguucucacggggcaauagucuaaguggaguagaaggugaaggauuacauagauuaggauauauauuaagggauguaagcaagaaagaaggaggggccauguaugcggacgauacugcagggugggauacacgaauaacucucgaagaucucaaaaaugaggaaaugguuacaaaucacaugaaaggagaacauaagaaacuagccgaagcaauauucaaacugacauaccaaaacaaaguaguaagaguccaacggcccaccccgaggggaacgguaauggauauaauuucuagaagagaucagagaggaaguggccaaguagguaccuauggacucaauacauucacaaauauggaagcgcaguuaauucggcaaauggaaggagaagggauuuuuaagucgauacaacacuuaacuguuacggaagaaauugcgguacagaauugguuggcccgagucggacgagagcgacucuccagaauggcuauaagcggagacgauuguguaguaaaaccucuggaugaccgguucgcaagcgcacuaacagcucuaaacgacauggguaaaguacgaaaagacauacagcaaugggagccuaguagaggcuggaaugacuggacucaaguacccuuuuguucacaucauuuucacgagcuggugaugaaagacggucgaguauuaguaguaccauguagaaaccaagacgaacuaaucggacgggcacguauaagccaaggcgcuggguggucccugaaggaaacagcuuguuugggcaaaagcuacgcucaaauguggacccucauguauuuucaucgcagggaucuacgacuugcugcaaacgcuauaugcucagccguccccucccauugggucccuacaagcaggacgacuuggucaauacaugcuaaacaugaauggaugacuacugaagauauguuagcaguauggaaucgagucuggauucaagagaacccuuggaugggggacaagacgccuguggaaaguugggaagaaguuccauacuuggggaaaagagaagaucaaugguguggaucucuaaucggauuaacguccagagcaacaugggccaaaaacauacaaacagcaauaaaucaaguacggucauugauagggaacgaagaguauacagauuacaugccgucuaugaaacgauuuaggagagaggaagaagaagccggagugcuuugg

SEQ ID NO: 22905 - RNA, 9873 nt, Artificial Sequence
  derived and/or modified CDS sequence (opt6) from DENV-2__HQ012537__SS-prME
acggcggggguuauaauaaugcuaauuccaaccgcaauggcauuucaccuaacuaccagaaacggugaaccccauaugauaguuggcagacaagagaagggaaaaucacuauuauucaaaacugaggauggcgugaacaugugcacauugauggcaauagauuuaggugaauuaugugaggauacaauaacauauaaauguccauuacugagacaaaacgaaccugaagacauagacugcugguguaauucaacuagcacaugggucacguaugguacauguacuacuacaggagaacaccgccgagaaaagaggagcguagccuuagucccucacgucggcaugggcuuagagacacguacagaaacauggaugaguagugagggagcauggaaacaugugcaacgaauagaaacauggauauuaagacauccgggauucgcaauaauggcggccaucuuagccuacacuauugggacuacccauuuccaacgggcauuaauuuuuauauuauugacggcugucgccccuucuaugaccaugaggugcaucggcauaucuaacagggauuucguugaaggagugagcggggguucauggguagacauaguucucgaacauggaucaugcguaacuacaauggccaagaacaagccuacccuagauuuugaacuaaucaaaacggaagcaaaacaaccagcuacacuuagaaaauauuguauagaagcaaaacucacuaauacaacuacugaauccagaugucccacucaaggcgaaccgucauuaaaugaagagcaggacaaacguuuuaucugcaaacauaguaugguugacaggggauggggcaauggaugcggacucuuuggcaaaggggggaucguuacuugugcaauguuuacauguaagaaaaacauggaggguaaaguaguacugccagaaaaucuugaauauacaaucguaaucaccccacauucaggcgaagagcacgcagucgguaaugacacuggaaaacaugguaaggaaauaaaaauaacaccacaaucaucgauuacagaagcugaacuaacagguuaugggacuguaacuauggaaugcucgccaaggacggggcuagauuuuaaugaaauggugcuacugcagauggaagaaaaagcuugguugguacaucgacagugguuucuggaucucccauuaccaugguuaccuggagcagacacccaagguuccaauuggauccaaaaagaaacauuaguaacauuuaaaaacccucaugcuaaaaaacaagacguaguuguacuuggaucgcaggaaggggcaaugcauacagcucuaacuggugcgacagaaauacaaaugagcucuggaaaccugcuuuucacgggacauuugaaaugccgacuuagaauggacaaacuccaacucaaagguauguccuacuccauguguacggguaaauuuaaaauaguaaaagaaauagcagagacucagcaugggacuauaguuauacgaguucaauaugaaggggacggguccccauguaaaauaccauucgaaaucauggacuuggaaaagagacauguacucggaaggcuuauuacgguaaaucccauuguaacagaaaaagauucaccuguaaacaucgaagcagagccuccauucggugauuccuauauaauuauuggagucgaacccggccaauuaaagcugaacugguuuaaaaagggauccaguauuggccaaauguucgagacuacaaugaggggagcaaaaagaauggcaauauuaggcgacacugcgugggauuuugguucauugggaggaguauucacaagcauuggaaaagccuuacaccaggucuuuggugcaaucuauggcgcagcauucucugguguuaguuggacuaugaaaauacuuauagguguuauaauaacauggaucggcaugaacaguaggucuacaagcuuauccguaagucucguacuuguuggggugguuacgcuauaucuaggugcuaugguucaagcagauucaggguguguagugagcuggaaaaacaaggagcuaaaaugugggagugguauuuuuauuacagacaauguacauacguggaccgagcaauacaaauuucaacccgaaagcccuucuaaauuagcuucugcaauacaaaaagcacaugaagaggggauuuguggaauucgcucggugacucgucuugaaaauuugauguggaagcaaauaacaccagaacuuaaucacauacuuagcgaaaacgaggugaaguugacaauaaugacuggugauauaaaaggaaucaugcaggcaggcaaaagaucguuaaggccucagccaacagaauuaaaauacaguuggaagacauggggaaaggcaaagaugcuuaguacagaaucccauaaccagacguuucuaauagauggcccugaaacagcagaauguccaaauacuaaccgagcuuggaacagcuuagaaguggaagacuacggauuuggcguauuuacgacuaacaucugguuaaagcuccgagaaaaacaggauguguuuugcgauucaaaacugaugucagcugccauuaaagauaaccgagcuguucaugcugauaugggcuauuggauagaaagcgccuuaaaugauacauggaaaauggaaaaagcuaguuucauugaaguaaaaaguugccacuggccaaagucacauacccuauggagcaacggaguauuagaaucagagaugaucaucccuaaaaauuucgccgguccagucagucaacacaauuauaggccugguuaucacacccaaacggccggacccuggcauuuagguaaacuagaaauggauuuugacuuuugugaagggacgacgguaguaguuacggaagauugugggaaccgcggaccuagucuucgaacaacaacggcuagcgguaaauuaauuaccgagugguguugucggaguuguacccuuccuccacugcgguaccgaggagaagacgguuguugguacgggauggaaauacggcccuugaaggagaaagaggaaaaccuuguaaauucguuaguuacugccgggcauggccaaauugauaacuuuucacuagguguauuaggaauggcucuuuucuuagaagaaaugcuccggacgcgcguaggaaccaagcaugcaauacuauuaguggcaguguccuucguaacccuaauuacuggaaacaugaguuuccgugacuuagggagaguuauggugaugguagguguuacaaugacagacgacauuggaaugggaguaaccuaucuugcccuguuagcagcuuucaaaguaagaccaaccuucgcagcuggacuuuuauuaagaaaauugacuaguaaagaacucaugauggcaacuauuggaauugcccugcuuucacaaaguaccauaccagaaacaauucuggaacuaacggaugcgcuagcacuuggcaugaugguguugagaauaguccguaauauggagaaauaucaauuggccguuacgauuauggcgaucucauguguuccaaacgcagucauucuauuaaaugcauggaaagucaguugcaccaucuuagcggcggucagugucaguccucuguuacucaccucaucacaacaaaagacugauuggauuccuuuggcacugacaauaaaagggcucaauccaacagcuauauucuuaacaacucuaagucguacuucgaaaaagagauccuggccauuaaaugaagcuguuauggccgugggaaugguaucuauccuugcaaguucguugcuaaagaacgacauaccaaugacaggaccucuaguggcaggaggccugcuuacaguuugcuacgugcuuacugguagaagcgccgauuuagaauuggaaagagcugcagaugucaaaugggaggaucaagcagaaauaagcgggucuagcccuauucuaaguauuacaauuucagaagacgguucaaugucaauuaaaaacgaagaagaggaacaaaccuuaacgauacucauaagaaccggccuguuagugauaucaggaguauuucccgucagcauuccuauuaccgcagcagccugguaucugugggaggugaaaaagcaaagagcaggaguguuaugggauguacccucaccucccccagucgaaaaagcagaacuagaagauggugcauaucgaauaaaacagcguggaauacucgguuacagccagauaggagcaggcguuuauaaagaggguacauuccacacaauguggcauguaacucgaggggccguuuuaaugcauagaggaaaaagaauugaaccaucaugggcagauguuaaaaaagacuugauaucuuacgguggaggauggaaauuagaaggggaguggaaagaaggagaagaaguccagguacucgcccucgaaccaggcaaaaaccccagagcugugcaaacaaaaccuggucucuuuaaaacaaauaccggaacaauuggugcuguaucucuggauuuuagcccuggcacgucugguagcccgauaguagauagaaaggggaaagucguaggacuauauggcaacggcguuguaaccagaucgggugcguacguuucagcaauagcgcaaacagaaaaguccauugaggacaaucccgaaaucgaagaugauaucuucagaaagaagagacugacaauuauggaccuacauccaggugcuggaaagacaaagagauacuuaccggcuauuguacgugaagcuauaaagaggggacuacgaacacuuauuuuagcaccuacuagaguaguagcggcugaaauggaagaggcucuucgagggcuuccaauaagauaccagacuccagcuauucgagccgaacacacaggcagagaaauuguugaucuuaugugccaugccacuuucacuaugcgucuacuuucaccggugagagucccgaauuauaaccuaaucaucauggacgaagcacacuuuacagauccagccuccauagccgcgagaggauauauaucgacacgcguagaaaugggagaagccgcagguauauuuaugaccgcaacaccaccaggcucacgggauccguuuccacaaucuaacgcuccgauaauggaugaagagagggagauuccagagcgaucuuggaacuccgggcacgaauggguuaccgauuucaaagguaaaacgguaugguuuguaccaagcauaaaagccggaaaugacauagccgcauguuugcguaagaaugguaaaaagguuauccagcuuaguagaaaaacuuucgauucagaauauguaaaaacacgagcuaaugauugggauuuugucgucacaacagauauuucggaaaugggcgccaauuucagagcagaacgaguuauagaucccagaaggugcaugaaacccguaauuuugacagacggugaagaaagaguaauacucgcgggaccaaugcccguaacacauuccucagcggcacaaagaagaggaagaauaggucgaaauccaaaaaaugaaaacgaucaauauauuuauaugggggaaccacucgaaaaugaugaagauugcgcgcacuggaaagaggcaaagaugcuuuuagacaacauuaauacaccagaggguauaaucccaaguauguucgagccagaacgagaaaaaguggaugcaauagauggagaauauagacuaagaggagaggcccgcaaaacauucguugaucuuaugaggaggggcgaccuuccaguguggcuugcuuaucguguugcugcugaaggaauaaauuacgcagacagacgauggugcuucgacgggaucaaaaacaaucaaauccuagaagaaaacguggaaguagaaauauggacaaaagaaggugaaagaaagaaacuuaaaccacggugguuagacgcaagaaucuauagcgauccgcuagcguuaaaagaauucaaagaauuugcggcuggacgaaaaucacucacacuuaaucuuauaacugaaaugggcaggcugccaacauuuaugacucagaaagcaagggaugccuuggacaaucuugcggugcuacacaccgcagaagccgguggucgugccuauaaacacgcacuaagcgaacuccccgaaaccuuggaaacauuauuacuucuaacucuacuugccacuguaacuggagggaucuuucuauucuuaaugucagguaaaggaauaggcaagaugacacuaggaaugugcugcauuaucacagcaagcauacugcugugguaugcacaaauacagccgcauuggauagcagccucuauuauuuuagaauucuuuuugauuguguugcuaauaccagagccugagaagcaacgcacaccgcaggacaaucaacucacauauguagugauugcuauccuuacugucguagcagcaaccauggcaaaugaaaugggguuucuugaaaagacuaaaaaagauuuaggccucgguaguaucacuacacaggaaucggagagcaauauauuagauauagaccuucggccugcguccgcauggacguuguaugccgucgccacaaccuuuguuacgccaauguuacgacauaguauugaaaacucauccguaaacguuagcuuaacugccauagcaaaccaagcaacuguccugaugggcuuagguaaaggguggccauuaucaaagauggauauaggagucccccuguuagcgauagguuguuauagccaagucaauccuauaacauuaacagcagcacuacuauuacuaguagcacacuacgcaauaauagguccuggauugcaggcaaaagcgacacgggaagcucaaaaacgcgcggcagcaggaauaaugaaaaauccaacaguagauggaauuaccguaauugaccuagaaccaauacccuacgaucccaaauucgaaaaacaauuaggccaaguaauguugcuaauuuuaugugugacucagguacuuaugaugaggacaacaugggcauuaugugaagcucuuacacuugcuacaggaccgauaucaacuuuaugggaagggaauccugguagauucuggaacacaaccauagcagugucaauggcuaacauauucagaggaagcuauuuggcgggagcaggacuguuguucucuauuaugaagaauacgacaaauacuagacgaggcacaggaaauauaggagagacauuaggagagaaguggaaaucaagacucaaugcuuuaggcaaaagcgaauuucaaauuuauaaaaagucuggaauacaagaaguggauagaacacucgcaaaagaaggaauaaaaagaggagagacugaucaccaugcaguuucaagggguagugccaaacuacggugguuugucgagcgaaauaugguaaccccagagggaaagguaguugaccucgguugcggaagggguggauggucauacuauugcggagguuuaaaaaacguucgugaaguaaagggauuaacuaaaggagggccuggacaugaagagcccaucccuaugucaacuuacggguggaaccugguucgucugcaauccggaguagacgucuuuuucaccccgccugaaaagugugacacgcuauuaugcgacauuggagagagcucaccaaauccaacuauagaagcugggagaacacuaagaguauuaaaucuagcugaaaacugguuaaauaacaauacucaguuuuguaucaaaguucuaaacccuuacaugccgucuguaauagaaaaaauggaaaccuugcagagaaaauaugguggagcacucguacgaaauccacuguccaggaauucaacucaugaaauguauuggguuucuaacgcaacgggcaauauaguauccucuguaaacaugauuagcagaauguuaauuaaccgcuuuacaaugaaacauaaaaaagcaacuuaugaaccugauguggauuuaggaaguggcacaaggaacauugggauugaaucagaaauaccaaaucucgauauaauaggaaagaggauugaaaagauaaaacaagaacaugaaacaucuuggcacuaugaucaagaccacccauauaagacuugggcauaucacgguuccuacgaaaccaagcagacagggucagcauccagcaugguaaacgggguaguaaggcugcugacaaagccuugggacguagugcccauggugacccagauggcgaugacagacaccaccccguuuggacaacaaagagucuucaaggaaaagguagacacgaggacccaagaaccaaaagagggaacaaaaaaacuuaugagaaucacagcugaaugguuauggaaagaacuggggaaaaaaaaaacaccgcgaaugugcacaagggaagaauuuacucgaaaaguccgcagcaaugccgcguuaggugcgauauucaccgacgaaaauaaauggaaaagugcccgugaagcuguagaagauagccguuucugggaauuaguagauagggaaagaaaccuacaucuugaggguaaaugcgagacauguguauauaacaugaugggcaagcgggaaaaaaaacucggcgaguuugggaaggcaaaagguaguagagccauuugguauauguggcucggagcuagauucuuggaauuugaagcacuuggauuccuuaacgaggaucauugguuuucacgaggaaacucacuuucaggaguagagggagaagggcuccauagauuaggguacauauuaagagacgucucaaaaaaagaaggcggagcuauguaugcugaugacacggcuggcugggauacacguaucacauuggaagacuuaaaaaaugaagaaaugguaacaaaucauaugaaaggcgaacacaaaaaauuagccgaagcuauuuucaaauugacauaucaaaacaaaguagugcgcguccaaaggccaacucccagagggacuguaauggacauaauaagccgaaaagaucagcgugguaguggucagguaggaacguauggacuuaauaccuucacaaauauggaggcacaauuaauuagacaaauggaaggagaaggaaucuuuaaaucaauacaacaucuuacagugacugaagagauagcgguacaaaauugguuagcuaggguaggcagagaacgcuuaagucgaauggcuauaucaggggacgacugugucguuaaaccguuggacgaucgcuuugcaucagcccuuaccgcacucaacgauaugggaaaggugcgaaaagacauacaacaaugggaaccaucccgaggauggaaugacuggacucagguacccuuuuguagccaucauuuccacgaacuaguuaugaaagaugguagaguccuaguuguuccuugccgaaaccaagaugagcuaauagggcgcgcacgaauuucacagggagcuggauggagcuuaaaggaaacagcgugucuagguaaaagcuaugcgcaaauguggacccugauguacuuucacagacgagaccuucgcuuagcggcaaacgcuauaugcagugcggucccaucucacugggugccuacaagucguacaacauggucaauacaugcgaaacaugaauggaugacaaccgaagacaugcuggcaguuuggaacaggguauggauucaagaaaauccauggauggaagauaaaacaccaguagaaucaugggaagaaguuccauaccucggaaaaagagaagaccaguggugcggauccuuaauagggcuaacaucacgugccacaugggcgaaaaacauacaaaccgcaauaaaucaagucagaucauugauugguaaugaagaauauacggacuacaugccaucgaugaaaagauuccgcagagaagaagaagaagcuggaguucugugg

SEQ ID NO: 22906 - RNA, 9876 nt, Artificial Sequence
  derived and/or modified CDS sequence (opt6) from DENV-2__KU365901__SS-prME
acggccgguaucauaauaaugaugaucccaacgguaauggcauuucacuuaacaacucguaauggagaaccacacaugauagucucaagacaggaaaaaggaaaaucuuuguuauucaaaacugaaaauggaguaaauaugugcaccuuaauggccauggaucuaggggaacuuugugaagauacgauaacuuacaauuguccgcuuuuacgucagaacgaaccagaagacauagacuguugguguaauaguacaaguaccuggguaaccuacgguacgugcacagcuacuggagaacaucggagagagaaacgaagcgucgcauuagugccucauguuggaaugggacuagaaacccggacugaaacauggaugucgucagagggugccuggaaacacgcgcagcguauagaaacuuggguauuacgucacccaggauucaccauaauggccgccauucuugcauacacgaucggaacaacauauuuucaaagaguucuuauuuucauacuccuaacugcugucgcaccaucaaugacuaugagaugcauugggauauccaaccgagacuucguagaaggagugagcggaggcucuuggguugauauaguacucgagcacggaaguugcgucacgacuauggccaaaaacaaaccuacauuagauuuugaacuaauaaaaacagaggcuaaacauccugcuacguuacgcaaauauuguauugaggcuaaacucacaaauacuaccacagcaagucgcugcccgacgcaaggagaacccagucuuaacgaagaacaagacaaacgauucguauguaaacacucaauggucgaccgugggugggguaacggguguggacucuucggaaaagguggaauagugacuugcgcaauguuuacaugcaagaaaaauauggagggaaaaaucguccaaccggaaaaccuagaguauacgauuguaauuacuccacacaguggagaagaaaaugccguagguaacgauacagguaaacacgggaaagaaauuaaaguaacgccgcaaaguagcauaacugaagccgagcuaacgggguaugguacuguuacaauggaauguucaccgcguacaggacuagacuucaaugaaauggugcuuuuacagauggagaauaaagcauggcuaguacauagacaaugguuuuuagauuuaccuuuaccauggcuuccaggggcugauacccaggguagcaacuggauacagaaagagaccuuaguaacauuuaaaaauccacaugcgaagaaacaagauguuguaguucuaggcagucaggaaggagcaaugcauaccgcucuaaccggugcuacugagauacaaaugucgucagggaaccuacuauuuacgggacaccuaaaaugucgguuacggauggacaaacugcaauugaaaggaauguccuauucuauguguacaggcaaauucaaaguagucaaagagaucgcugaaacucaacacgggacaaucguaauuagagugcaauacgaaggugauggaagucccugcaaaauaccauucgaaauaauggaucuggaaaagagacacguccuuggaagauugaucacagugaauccaauaguuacagaaaaagacagcccaguaaauauagaggcugagccacccuucggagauucguacauaaucaucgggguagaacccggacagcuaaaacuaucaugguuuaaaaagggaaguuccaucggccaaauguuugaaacaaccaugcgaggagcaaagagaauggcaauacuaggcgauacggcgugggacuucgguucccuuggugguguauucacaucuaucgguaaagcacuacaucaagucuuuggugccauauauggcgccgcauucucgggaguaaguuggaccaugaaaauucugauuggcguaguuauaacuuggauuggaaugaacagccgaucuacaucuuuauccguauccuuagugcugguaggcguaguuacuuuguacuuaggcguaauggugcaagcggauucagggugugucguaagcuggaagaauaaagaauugaaaugcgguucaggcaucuuuauaacugauaauguucauacguggacggaacaauauaaauuucaacccgagagcccuucgaaacuggccucagccauccagaaagcacacgaagaaggaauuuguggcauuagaucaguaacuagacuagaaaauuugauguggaaacaaauuacgcaagaacuaaaucacauacuaucggaaaaugaagucaaauuaacaauaaugacaggagauaucaaagggauaaugcaagcuggcaaaagaaguuuaagaccgcaaccuaccgaauuaaaauacucguggaaaacaugggggaaggcgaagauguuaaguacagaacugcauaaccacacguuuuuaauagacgggccggagacagcagagugcccaaauacaaaucgagcauggaacucauuagaaguugaagacuauggauuugguguauuuaccacuaacauaugguuaaaauuaaaggaaaaacaagaugucuucugugauagcaaauuaaugagugcagcuauaaaagacaaucgugcaguucacgcggauaugggauauuggaucgagucugcauuaaaugauacguggaaaauugaaaaggcuucauucauagaaguaaagaguuguaacuggcccaaaucacauacccuauggagcaacgguguccuugaaucggaaaugaucauacccaaaaacuuugcaggccccguuucacaacauaauuaccgcccaggcuaucacacucaaacagcuggucccuggcauuuaggccguuuggagauggacuucgaauuuugcgagggcaccacugucguaguuaccgaagacugcggaaauagaggaccaagucuacgcaccaccacagcaaguggaaaauuaauaacugagugguguugucgaucauguacucuacccccauuaagauaccgaggcgaagacggguguugguacggaauggaaauacgaccucuaaaagaaaaagaagaaaaucugguaaacucucugguaaccgcuggucauggucaaauagauaauuuuucauuaggaguacucgggauggcucuauuccuagaggagauguuacggacuaggguaggaacaaaacaugcaauuuuacucguagcuguuacauuugucacacuaauuaccggaaacauguccuucagggaucuaggucgaguaaugguaauggugggcgcuaccaugacagacgauauugguaugggaguuacguauuuggcacuucuggcggcauucaaaguacgcccgacguucgcagcuggacuccuucuuaggaaacugacuucuaaggaauugaugauggcgacaauaggaauuguauuauuaucacaaucaacgaucccugaaacaauauuagaauuaacagaugcacuggcacucgggaugaugguauugaaaauaguacguaacauggaaaaauaucaguuagcgguuacgauaauggcuauucuauguguaccuaaugcgguuauacuccagaaugcuuggaggguuagcugcacaacucucgcuguaguaucagucucaccucuauuauuaaccagcagucaacaaaaagcagauuggauaccucucgccuuaacgaucaagggauuaaaucccacagcaaucuuccuuacuacuuuaagccguaccaguaagaaaagaucauggccacuaaaugaggcgaucauggcggucgggaugguaucuauacuagcgucgaguuuacugaaaaacgauauaccaaugacagggccguugguagcuggaggcuuacugacaguuuguuacguucuaacagggagaucagcugauuuagaacuagagcgugcagcagauguuagaugggaagaacaagcagagauaaguggcagcucaccuauauuaucuaucacgaucucagaagauggaucaaugaguaucaaaaaugaagaagaggagcaaacucucacaauauuaauaaggacaggacuccuaguuauuagugggcuuuuuccugucucuauaccaauuacagcugcugcaugguacuuaugggaggucaagaaacaaagagcgggaguauuaugggauguucccaguccgccuccaguuggcaaagcagaacuagaagacggagcuuaccgaauaaaacagaaagguauacuaggguacucucaaauaggggcaggaguauacaaagaaggaacauuucacacgauguggcacguaacaagaggcgcgguucuaaugcacaaagguaaacguaucgaaccuucgugggcagacgugaaaaaggauuuaauaucguauggaggcggguggaaauuagagggcgaauggaaagaaggugaagaaguacaggucuuagcucuagagccagguaaaaacccacgcgcuguacaaacaaaacccggauuguuuaaaacgaauaccggaacaauaggggcagucagccuagacuuuaguccuggaacaagugguucgccaauaguagacaagaaaggaaagguagugggacuguacggaaauggaguuguaacuagaucagguacauacguaucagcaauagcccaaacugagaaaaguaucgaagauaauccugagauagaagaugauauuuuucggaaaaagcgcuugacaaucauggacuugcauccaggagccgguaaaacaaaacgcuauuuacccgcuauuguaagagaagcuauuaaacgcgguuuacguacucuuauacuugcaccgacacgaguaguagcugcggaaauggaggaggcacuaagaggguuacccauaagguaucagacaccggcgauacgagccgaacauacagguagggaaauuguggacuuaaugugucaugcgacauucaccaugcgguugcuuagcccaaucagaguacccaacuacaaccuuaucauaauggacgaagcccauuuuacagaucccgcuaguauagcugcaagaggauacauaucuacucggguagaaaugggagaagcagcaggaaucuuuaugacagcgacuccaccaggcucccgcgacccguuuccgcaaagcaacgcaccuauaauggacgaagaaagagagauaccggaaagaucguggaacagcggucaugaauggguaacagacuuuaaagggaaaacugucugguucguaccuucuauuaaagcaggcaaugauauugcagccugcuugaggaaaaauggcaagaaaguaauucaacucagccgaaagacguuugauucagaauauaucaaaacgcguacuaaugauugggacuuuguaguuacuacugauauuagcgaaaugggagcaaauuuuaaggcagaacgaguaauagacccacgcagauguaugaaaccaguaauucuuacggacggugaagaaagaguuauauuggcggguccaaugccaguaacucacucuucagcggcccagaggagaggaaggguaggucggaauccuaaaaaugaaaaugaucaauauaucuacaugggagaaccacuagagaacgaugaagauugugcacacuggaaggaggcaaaaauguuguuagacaacauuaacacgccugaagggauaauacccagcauguuugaaccugagcgagaaaaaguugaugccauagauggagaauacagauuacguggagaggcgcgcaaaacauucguagauuuaaugagacguggggauuuaccuguaugguuggcauauagagucgcagccgaagguauuaauuaugcggauagacgaugguguuucgauggaguuaaaaauaaucaaauuuuagaggaaaauguggagguugagauauggacuaaagaaggagaaaggaagaaauuaaaaccacggugguuagaugcgcgcauauauucugauccacuugcacuaaaagaguuuaaggaguucgcagcuggcagaaaaaguuuaacucuaaauuugauaacagaaaugggcaggcucccaacauuuaugacgcaaaaagcaaggaaugcacuagauaaucuggcgguucuucauacagccgaagcaggcggcagagcauauaaccaugcauuaagugaacuaccagaaacguuggaaacacuucuacuuuuaaccuuacuggcaacaguaaccgggggaaucuuccuguuuuuaaugagugguaaagggaucgguaaaaugacguuggggauguguugcauuauuaccgcauccauauugcugugguaugcacaaauacagccucauuggauagccgcaaguauaauauuggaauuuuuccucaucguccuccuuauaccagaaccggaaaaacaaagaacaccgcaagauaaccaacuaaccuacguuguuauagcaauauuaacaguuguagccgcaacaauggccaaugaaaugggauuuuuagagaaaacgaagaaagauuuuggcuuaggauccauaacaacccaacagccagaauccaauauauuggacauugaccuacguccugccucggcguggacuuuguacgcgguggcgacuacauuuauaacuccuauguuaagacauaguauagaaaauucauccguaaaugucagcuuaacugcaaucgcuaaccaagcgaccguucuuaugggccugggaaaggguuggccacuaaguaaaauggauauuggcguccccuuauuagccauaggguguuacagucagguaaaucccauaacguuaacagcggccuuacugcuauuaguugcccauuaugcaauaauuggaccaggauuacaagcaaaagccaccagagaagcccagaaaagagcugcagcaggcauaaugaaaaacccaacuguggacggaauuacuguuauagacuuagauccaauaccauacgaucccaaauuugaaaaacaguugggacaaguaaugcugcugguacugugugucacacaaguuuuaaugaugcguacuacaugggcguuaugcgaagccuuaacuuuagcaacaggcccaauaucgacuuuaugggaagguaacccuggccgguucuggaacacaacgauagcuguuaguauggcaaauauuuucagagggaguuaucuagccggcgcuggcuuacuauuuaguauaaugaaaaacacagcgaauacgaggagggguacgggaaauaccggcgaaacgcuaggggaaaaauggaaaaacagauugaaugcucuagggaaaucugaguuccaaauauacaagaaaagcggcauacaagaaguugauagaacguuagcaaaagaaggaauuaaaagaggugagaccgaccaccacgcaguuuccagaggaucagcuaaauuaagaugguucguggagcguaaccuuguaacuccugaaggaaaaguuguagacuuggguugcggaagaggaggcuggucauauuauugcggggguuugaaaaauguaaaagaaguaaaaggcuuaacgaaaggaggaccaggacaugaagaaccaauuccaaugaguacauacgguuggaauuuagugcgauuacaaucuggaguagaugucuuuuucaccccaccugaaaagugcgauacauugcuuugugauauaggagaaagcucgccaaacccuacugucgaagccggaagaacgcucagggucuugaaucuaguggaaaauuggcucaauaauaauacacaguuuugcauuaaaguucuaaauccauacaugccaagcguuaucgagaaaauggaagcauuacaacggaaauaugggggugcgcuagugagaaauccacugucaaggaacuccacacaugaaauguacuggguaucaaacgcaagcggaaacauagucaguucaguaaacaugauuucucgaauguugauaaaucgcuucacuaugagacauaagaaagcaacauaugaacccgauguugacuuagggucagguacgcguaauauaggcauagaaagcgaaacgccuaaccucgauaucauagggaaaagaauagaaaagauuaaacaagaacacgagacauccuggcauuaugaucaagaucauccuuauaaaacuugggcauaucauggaucauacgaaacaaagcaaaccgggucagcaagcucaaugguuaacggagugguuagauuacuaacaaaacccugggacgugauccccaugguaacacaaauggcaaugacugauacaacuccauucggacaacaacguguguucaaagaaaaagucgauacaaggacgcaggaaccaaaagagggcacaaagaaacugaugaaaaucaccgcugaguggcuguggaaagaacuugguaggaagaaaacaccaagaauguguacacgcgaagaauuuacucgaaaaguacgaaguaacgcugcccucggggcuauauuuacagaugaaaauaaauggaagucugcacgagaagcaguagaagauaguggcuuuugggaauuaguggacaaagaacgaaaccuucauuuagaaggcaagugugaaacguguguauacaauaugaugggcaaacgugagaagaaacuaggagaguucggaaaggcaaaaggaucaagagcgauaugguacaugugguuaggggcccgauucuuggaguucgaagcacucggcuuucugaaugaagaccauugguuuucuagagaaaacucucugaguggaguugaaggugaaggcuuacauaaacuugguuacauccugcgagacguauccaagaaagaaggaggcgcuauguaugcagaugacacagcuggcugggauacacgaaucacgcuagaagaucugaaaaacgaagaaaugguuacgaaccacauggagggagagcacaagaagcuagcggaagcuauauuuaaacucaccuaucaaaauaagguaguccgaguacaaagacccacaccaaggggaaccguuauggacauaauaucgcgacgggaccaacgugguucaggucaaguaguaacauauggacuaaacacguucaccaauauggaagcucaacucauacggcaaauggaaggugaagggguauuuaaaucaauccaacaacuaacaguaacugaggaaaucgccguuaagaauugguuggcgcgugucgggcgagagagauugaguaggauggcuauaucgggugaugauuguguuguuaagccuuuagaugaucgauucgccagcgcauugacggcacuaaaugauaugggaaaagucagaaaagauauucaacagugggaaccuucccgaggcuggaacgauuggacucaaguaccuuuuugcagccaucauuuccacgaauugaucaugaaagauggaagaguauuggucgucccauguagaaaucaggaugaauugaucggucgugcaagaauuucccagggagccggauggaguuugagggaaacagcuuguuuagguaagucuuaugcccaaauguggucauugauguauuuucaccgaagggauuuacgacucgccgcaaaugcuauauguucugcaguaccaucacauuggguaccuaccagcagaaccacauggucuauacaugcgacucacgaauggaugaccacagaagacaugcuaacgguauggaaucgaguuuggauacaggaaaacccauggauggaggauaaaacuccgguagaaucaugggaagaaauuccguaucuuggcaaaagagaggaucaauggugcggaaguuugaucggguugacuucacgcgcuacaugggcuaagaacauacaaacggccauuaaucaagugcgaucccuaaucgggaacgaagaauacacagauuauaugccaucuaugaaacgguuucgccgagaagaggaagaagcaggcguucuaugguag

SEQ ID NO: 22907 - RNA, 9876 nt, Artificial Sequence
  derived and/or modified CDS sequence (opt6) from DENV-2__GQ398258__SS-prME
acggcagggaugaucauuaugcugauucccacuguaauggcauuccaucucacuaccagaaauggagaaccucauaugauaguuagucgucaagaaaaaggaaaaucguuacuauucaaaacugaagacggaguaaacauguguacguuaauggcuauggauuuaggagaacugugcgaggauaccaucacuuauaauuguccuuugcuaagacagaaugaaccugaggacauagauugcuggugcaauucuaccagcacuuggguaacuuauggaacauguacugcaacaggugaacaccgacgagagaaaagaaguguggcauuaguuccucacguugguaugggcuuagaaacuagaacagaaaccuggaugucaagugaaggggcuuggaaacaugcccaacgaauagaaacguggauauuaaggcacccagguuuuacuauaauggcugcgauacuagcauauacgauuggaacuacauauuuucaacgaguauuaauuuuuauucuauuaacggcuguugcaccaucaaugacaaugaggugcaucgggauaucuaauagagauuucguagagggagugucagggggauccuggguugauauugugcucgaacacggcagcugcguuacgacaauggcuaaaaauaaaccgacauuggauuucgaacucauaaaaacugaagccaaacaacccgcgacauuacggaaauauuguauagaagcgaagcuaacuaauacaacuacagccagucgaugcccaacacaaggcgagccaagucuaaaugaagaacaggacaaacgguucgucugcaaacauucaaugguugaccggggauggggcaacggaugcggccuuuucggaaaaggggguaucguaacaugugcuauguuuaccugcaagaaaaacauggaggguaaagucguccaaccugaaaaucuagaauauacuauagucauaacaccacacucaggagaagagaacgccgugggcaaugauaccgggaaacacggaaaagaaauaaaaauaacaccacaaagcuccaucacagaggcagaacuaacaggguacggaacugugacuauggaaugcuccccaagaacuggacuugacuuuaaugaaaugguacuauuacaaauggaaaacaaagcguggcucguacacagacaaugguuccuagacuuaccauuaccauggcugccgggagcggauacgcaagggagcaauuggauacaaaaagaaacauuggugacauuuaaaaauccacacgcuaagaaacaagacguaguugugcuuggaucccaagaaggcgcuaugcauacugccuugaccggggcuacagaaauucaaaugagcagcggaaaccuccuuuuuacgggucaucugaaaugccgacuacguauggauaaauugcaacuuaaaggaaugucauacaguauguguacuggaaaauuuaaaguaguuaaagaaauagcagaaacacaacacggcacaauuguuauaagagugcaauaugaaggugauggauccccuuguaaaauccccuucgaaauaauggaucuggagaaaagacacguuuuagguagacuuauaacaguaaacccuauaguaacugagaaagauaguccaguuaauauagaagcggaaccaccauucggagauucguacauuaucaucggaguagagcccggccaguuaaaacuaaauugguuuaagaagggaucaagcauaggacaaauguuugagaccacaaugcgaggcgcaaagagaauggccauauuaggggauaccgccugggauuuuggcagcuuaggaggagucuucacgagcauagguaaggcacuacaucaaguguuuggcgcgaucuacggggccgcuuucucuggagucucuuggacaaugaaaauauuaauagggguugucaucaccuggauagguaugaacucgcgaucaacaucauuaucggucucacuuguccuaguuggcguuguaacucuauauuuaggcguaauggugcaagccgauagcgguugcguaguuagcuggaaaaacaaggaacuaaaauguggaucaggaauauucaucacugacaacguacacacauggacugagcaguauaaauuucaacccgaaagcccaucuaaacuugccagcgcgauucagaaagcacaugaagaagguauaugugggauaagaagcgugacacgcuuagaaaauuugauguggaaacaaauuacaccagagcuaaaccauauauugagugaaaaugaagucaaacuuacgaucaugacgggagacauaaaggguauaaugcaagcaggaaaacggucacuacgcccacagccuacugaacuuaaauacucauggaaaacaugggguaaagcaaaaaugcuuucgacugaauuacacaaucaaacauucuuaauugaugggccagaaaccgccgaauguccaaacacuaacagggccuggaacucauuagaaguagaagacuacgguuuuggaguguuuacaaccaauaucuggcugaaacucaaagaaagacaggacguauucugcgauccaaaauugaugagugcugccaucaaagauaaccgggcuguacaugccgauaugggcuacuggauagaaucagcauugaaugacacauggaaaauagaaaaagcaucuuuuaucgagguaaaaucuugucauuggccuaaaucacauacacuuuggucgaaugguguauuggaauccgaaaugaucaucccgaagaauuuugcuggaccuguaagccaacauaauuauaggccagguuaccauacgcaaacugcaggaccauggcacuuaggaaaacuugaaauggacuucgacuuuugugaagguacgacagucgucguaaccgaagauugcggaaacaggggaccaagccuacgcacaacaacugcaucgggaaaauuaauaacggaaugguguuguaggucauguacacuuccgcccuuaagauauaagggugaagaugguuguugguacggaauggaaauacgaccauuaaaggaaaaagaagaaaaucuaguaaacagcuuagugacugccgggcacggucagauagauaauuuuucguuagguguguuaggaauggcacuguuucucgaggagauguuacguacgaggguuggaacaaaacaugccauuuuauuaguggcaguuucguucguuacacuaauuaccgguaauauguccuuucgugauuuaggaaggguaaugguaauggugggagcaacuaugacugaugacauaggaaugggggugacuuacuuagcauuacuagcagcauucaaagugagaccuacauuugcugccggccuucuacucagaaaauuaacuucaaaagaacuaaugaugacgaccaucggcauagugcuccugagccaaucgacgauaccugagacaauccuagaacucacagaugcacucgcacuggguaugaugguauugaaaauaguaaagaacauggagaaauaccaacuugcaguaaccauuauggcaauacuauguguuccuaacgcaguuauucuacagaaugcuuggaaaguuagcugcacuauucuugcuguuguuaguguaaguccgcuacugcuuacaucuucucaacaaaaagcugauuggauuccucuagccuuaacuaucaagggucuuaaccccacagcaauauuuuugacuacgcuuucaaggacaaguaagaaaagaucuuggccguuaaaugaagccauuauggcaguaggaaugguaucuauucuugcgaguucccuucugaaaaacgacauaccgaugacggggccgcuagucgcuggagggcuacuuacaguuugcuauguguuaaccggccgaagcgcagacuuagaacuagaaagggccgcggauguacggugggaagaucaagcugaaauuagcggaucaucuccaauucuaucaauaacaauaagugaggacggaucgaugucuauuaagaaugaagaagaagaacaaacguuaacaauucuaauacguacuggacucuuaguaauauccggacuuuuuccaguaaguauuccaauaacggcagccgcgugguaucuaugggaagugaagaagcagagagcugguguauuaugggauguaccaaguccaccucccguggguaaagcagaacuagaagauggggcauauagaauuaaacaaaagggcauacucggguacucccagauaggggcaggaguauacaaagaaggcacauuucauacaauguggcaugucacaaggggagccguccuaaugcauaaaggcaagagaauugagcccucgugggcugacguuaagaaagacuuaaucagcuacggggguggguggaagcuggaaggugaguggaaagaaggugaagaaguacaaguacuagcacuagagccaggcaaaaacccaagggcuguucaaaccaaaccugggcuauuuaagaccaacacaggcaccauaggugcugucucacuagauuuuagcccuggaaccucuggaaguccuaucguugauaagaaagggaaagucgucggccuauauggaaauggugugguaacccguucggguacuuacguguccgcaaucgcacaaaccgaaaagaguaucgaagacaacccagagauagaggaugauauuuuccgaaagaaacgacuuacaauaauggauuuacauccuggagcagguaaaaccaaacguuaucucccugcaaucguucgagaagcaauuaaaaggggauuaagaacccucauucuugcaccgacacgaguaguagcggcagaaauggaagaggcguuaagaggacucccaauacgauaucagaccccggccauucgagcagagcacacaggacgagagauaguugaccucaugugucacgcgacauucacaaugagacuacucucucccguaagaguuccuaauuacaacuuaauaauuauggaugaagcgcacuuuacugauccugcgaguauagcggcaagggguuauauaagcacuagagucgaaaugggcgaagcugcgggaaucuucaugaccgcaaccccaccugguagcagagauccauuuccacagucaaaugcuccuauaauggaugaggaacgugagauuccggaacgaucauggaacagcggacacgagugggucacagauuuuaaaggaaaaacugugugguuugugccgucaauuaaggcagguaaugacauagcagcuuguuuaaggaaaaauggcaaaaagguaauacagcugucgagaaaaacauucgauucggaauauauaaagacgagaacuaaugauugggacuuuguaguaacaacggacauuucggaaaugggagcgaauuucaaagcggaaaggguuauagauccuaggagauguaugaaacccguaauauugacagauggagaggaacgcguaauuuuagcugguccuaugcccguaacucacucaagugcggcacagaggagaggaagaauuggaagaaaucccaaaaaugaaaacgaccaguacauuuauaugggugaacccuuggaaaaugacgaagacugugcacauuggaaggaagcgaaaaugcuucuugauaauauuaacacaccagagggaauuauaccaucgauguuugaaccggagcgagagaaaguugacgcuauugacggagaauacagacucagaggggaagcaaggaagacguucguagacuugaugagaaggggcgauuuaccuguuuggcuagcguauagaguagcagcugaaggaaucaauuaugcagauagaagaugguguuucgaugguaucaaaaauaaucaaauuuuagaagagaauguggagguggaaauuuggaccaaggaaggagaacguaagaaacuaaaacccagauggcuugaugcaagaaucuauucagauccuuuagcauugaaagaguucaaagaauuugcugcgggaagaaaaagccucacuuugaaucugauaacagaaauggguagacuacccacuuuuaugacacaaaaagcucggaaugccuuagacaauuuagcaguauuacacaccgcugaagccggugggcgagcauacaaucaugcccuaagugaacuaccugaaacucuagaaacauuauuacuucuuacauuacuggcaaccguaacaggagguauauuuuuauucuuaaugaguggaaaagggauagggaaaaugacgcuagggauguguuguauaauaacagccagcauucuacuuugguaugcacagauacaaccacauuggauugcagccucuauuauucuagaguucuuuuugauaguacuguugaucccagaacccgagaagcaaagaacaccccaagauaaccaacuaacguacgucguuauagcuauacuaacagucguagcagcaacuauggccaaugaaaugggauuuuuagaaaagacaaagaaagauuuuggucuagguagcauugcuacacaccaaccagaauccaacauacuggacauagaccugagacccgcaucagccuggacccucuacgcuguagcaacaacuuuuauaacuccgauguugcgacauuccaucgaaaacuccaguguuaacguaucauugacggcaauugcuaaucaagcaacgguuuugauggggcuaggcaaaggauggccguuaucuaaaauggacaucgguguuccgcuauuagcuauaggcuguuauagccaggugaacccgauaacccugacugcagcauugcugcuauuaguagcgcauuacgcgaucauaggaccaggucuccaggcaaaagccacacgugaagcacagaaaagagcagcagcugguaucaugaaaaauccgacgguagacggaauuacuguaauugauuuggacccgauuccuuacgaccccaaguuugaaaaacagcuaggacaaguaaugcuuuuaguucucugugugacucagguacugaugaugaggacuacuugggcauuaugugaagcacuaacauuagcuacaggacccaucucgacccuaugggaaggaaauccuggacgguuuuggaauaccaccauagcaguaucuauggccaauauuuuuagagguuccuaucuggccggggcaggauuacuauuuaguauaaugaaaaauaccgcgaacacucgucgagguacugggaauaccggagagacguuaggugaaaaauggaagaacaggcuaaaugccuuaggaaaaucggaguuccaaauuuacaagaaaaguggcauacaagaaguagaucguacacuggcaaaagaaggcauuaaacggggagaaacagaccaccaugcuguaucgagaggaagcgccaaauugcggugguucguugaaagaaaccuagugacuccggaagguaaaguaguugauuuaggauguggccgagggggcuggucuuacuauugcgggggauugaaaaaugucagggaagugaaaggacuuacgaaagggggaccuggacaugaggaaccaauuccaaugaguacauaugguuggaacuuaguaagacuccaguccgggguagauguguucuucacaccaccugaaaaaugcgauacgcuacuaugcgacauuggagaaagcucuccaaauccgacuguugaagcugggagaacacuaaggguauuaaauuuaguagagaauuggcuaaauaacaacacacaauucuguauaaaaguauuaaacccguauaugcccucaguaaucgagaaaauggaagcauuacaacgaaaguacggcggggcacuggugcguaauccucuauccagaaacaguacacaugaaauguauugggucagcaacgcauccgguaacaucgugucuucaguaaacaugauuaguaggauguuaaucaacagguucacaaugagacauaaaaaggcuacguaugaaccagacguagaucuuggcucagguacacguaauauaggcauagaaucagaaacuccgaacuuagacauaaucggaaaacguauagaaaagauuaaacaggagcaugagacaagcuggcacuaugaucaagaccauccuuacaagacuugggcauaucacggaaguuacgaaacuaaacagacgggaagugccaguagcaugguaaacggcguagugcgcuuauuaacaaagccuugggauguuaucccaauggugacccaaauggcgaugacugauacaacucccuuuggucaacaaagaguguuuaaagaaaaaguggauacaagaacucaagagccuaaagaaggaacgaagaaauuaaugaaaaucacugcugaauggcuauggaaagaauuagggaaaaagaaaaccccgcgaauguguacacgcgaagaguuuacacgaaaagugagaucgaaugcggcguuaggagcuauauuuaccgaugaaaauaaauggaaaagugcaagagaagccguagaagauuccagauucugggaauugguugauaaagaaagaaauuuacaccucgaaggaaaaugugaaacuuguguuuacaauaugaugggaaaacgagaaaagaaacuaggugaguuugguaaagcuaaaggaucaagagcaauaugguauaugugguuaggggcacguuuucuagaguuugaagcauuaggauuccucaaugaggaccacugguucucccgugaaaauaguuugucagguguugagggcgaaggcuuacacaaacuuggauacauauuacgugauguuaguaagaaagaaggaggagcaauguaugcggacgacaccgcagggugggacacaaggauuacuuuggaggaucuuaaaaacgaagagaugguuacuaaccacauggaaggggaacacaagaaacuagccgaggcaaucuucaaacugaccuaucaaaacaaggucgucagaguacaaagaccaaccccaagaggaaccguaauggacaucauuucuagaagggaucagcggggguccggccaaguuggaacauaugguuuaaauacauuuacgaauauggaagcccaauugauuaggcaaauggaaggugaagggguauucaaaaguauacaacaucuaacaguuacugaagaaauagcaguacaaaauugguuggcgagaguugguagagaaagacuaucuagaauggcaaucagcggcgaugacugcguuguaaaaccccuagacgaccgauucgcaucugcccucacugcuuugaaugauauggguaaaguacgaaaagacauucagcagugggaaccuucgagaggauggaaugacuggacccaaguucccuucugcucgcaucacuuccacgaacugauaaugaaggacggucgggugcuuguaguuccauguaggaaucaagaugaauuaauaggccgggcuaggauuagucagggcgccgguuggucauuaagagaaacggcaugccucggaaaaucauacgcccagauguggucuuuaauguauuuccacaggagagaccucaggcuagcagcgaaugcuaucugcucugcuguuccuucacauuggguaccgacaagucgcaccacauggaguauacaugcaagacaugaauggaugaccacagaggauaugcuaacaguuuggaacagagucuggguccaagaaaacccuuggauggaagacaaaacuccaguggaguccugggaagaaaucccguaucuugguaaacgcgaggaucaauggugcggaucacuaauaggucuaacaucuagagcaacaugggccaagaacauacaaacggcuaucaaucaaguuaggagucuaaucggaaacgaggaauauacggacuauaugcccaguaugaaaagauuuaggcgagaggaagaagaagccgggguucuaugguaa

SEQ ID NO: 22908 - RNA, 9876 nt, Artificial Sequence
  derived and/or modified CDS sequence (opt6) from DENV-2__GQ398259__SS-prME
acugcaggaaugauuauaauguugauuccaacaguaauggcauuccaucugaccacucggaauggagaaccucauaugauuguaagccggcaagaaaaagguaaaagucuauuguuuaaaacagaagaugguguaaacaugugcacucuaauggcgauggauuuaggugaacugugcgaagacacgaucacauacaauugcccguugcuacgacaaaaugaaccugaagauauugacuguugguguaauaguacauccaccuggguuacauacggaaccuguaccgcuacuggagaacaucgcagagagaaacgaaguguggcauugguaccacaugucgggaugggcuuggaaacuagaaccgaaacuuggaugagcucagaaggagcauggaaacacgcgcaacgaauagaaaccuggauucuacgccauccggguuuuacgauuauggcggcaauacuagcguauaccauuggaacuacuuauuuccaaagaguguuaaucuucauauuauugacugcagucgcaccuagcaugacuaugagaugcauuggaaucucuaaucgugacuuuguagaagggguuagcggaggaucuuggguggauauaguucuugaacauggaaguugcgucaccaccauggcgaaaaacaaacccacuuuagacuuugaauugauuaaaacagaagcaaaacaaccagcuacucugcgcaaauauugcauugaagcgaaacuaacaaauacuaccacagcaaguagaugcccuacccaaggcgaacccucccucaaugaagaacaagacaaacgauucguuuguaaacacaguaugguugaccggggauggggaaaugggugcggucuauuuggcaaaggaggaauaguaacaugugcaauguuuaccuguaaaaagaauauggaagggaagguaguacaaccggagaacuuagaauauaccauaguaauuaccccucacucgggagaagagaaugcugucggcaacgauacggguaaacauggcaaagaaaucaaaauuacuccacaaucauccauuacagaagcugagcucacaggauauggcacugucacaauggaauguucaccgagaacaggucuugacuuuaaugaaaugguucucuuacagauggaaaauaaagccuggcuuguccacagacagugguucuuagacuugcccuugccuugguuaccuggagccgauacacaaggaaguaacuggauccaaaaagaaacucuagugaccuucaaaaauccacacgccaagaaacaagaugucgugguauuaggaucacaggaaggcgcuaugcauacagcccugacaggagcuaccgagauucaaaugucaucagguaaucuauuguuuaccggucacuuaaaaugccguuuaaggauggacaaacuacaguuaaaagguaugaguuacagcaugugcaccggaaaauucaaaguggucaaagaaauagccgagacacaacaugguacuauaguaauacgggugcaguaugaaggggaugguucuccuugcaaaaucccauuugaaaucauggaucuugagaaaaggcauguacucggaagacuaauaacuguaaacccuauaguaacagaaaaagacaguccugugaauauugaagcggaaccgccuuucggugacucguacaucauuauaggaguagaaccggggcagcuaaaacucaacugguuuaagaaagguucuucuauuggucaaauguuugaaacuacgaugagaggcgcaaagcguauggcuaucuuaggggauacagcuugggacuuugguucgcuagggggaguguuuacaucuaucgguaaggcuuugcaucaaguuuucggagcaauauauggagcagcauuuagugguguaagcuggaccaugaagauacuaauaggaguuguaauaaccuggauuggaaugaauagcagaucaacuucauuguccguuucauugguccugguugggguuguaacauuauacuugggaguaaugguucaagcagacucugggugcgucguuaguuggaagaauaaagaacuaaaaugcgguagcgguauauucaucacagacaacguacacacauggacagaacaguauaaguuucaaccagaaaguccauccaaacuugccagcgcgauacaaaaagcccaugaagaaggaauaugcgguauaagaucuguaacaaggcuagaaaaucuaauguggaaacaaauuacccccgagcuaaaucacauuuuaagugaaaaugagguuaaacucacaauuaugacuggcgauauaaaaggaauaaugcaagccggaaaaagaucuuugcguccgcaacccacagaguuaaaauacaguuggaagacuuggggaaaagcaaaaauguugagcacagaacuacacaaucaaaccuuuuuaauugacgguccugaaacggcugaauguccaaauacuaauagagcguggaacucguuagagguagaagauuauggauuugggguauuuacaacaaauauauggcuuaaacugaaagaaagacaggacguguucugugauucuaaauuaauguccgcagccaucaaggacaauagggccguacacgcggacaugggauacuggauagaaucugccuugaaugauacauggaaaaucgagaaggcgaguuucauagaaguaaaaagcugucauuggcccaaaucacacacauuauggucuaauggaguacuugaaagugaaaugaucauucccaaaaauuuugcaggaccaguuagccaacauaacuaccgaccuggcuaccacacccagaccgcaggcccuuggcacuuggggaagcuagaaauggauuuugacuuuugcgaaggaaccacaguuguaguuacugaagacugugguaaucggggaccuucauugaggacgacaaccgccuccgguaaauuaauuacagaauggugcugcagaucaugcacauugccaccacugagauacaaaggagaggacggauguugguauggcauggagauucgaccacuuaaagaaaaggaagagaacuuagugaacuccuuaguaacggcuggacauggacaaauugauaacuuuucacuaggaguccuuggaauggcucucuucuuagaagaaaugcuaagaacaagggucggaacuaagcacgcuauacuuuuaguagcggugucauuugucacucuuauaaccggaaauaugaguuucagggacuuagguaggguaauggugaugguaggagcaacuaugacagaugauauagggaugggggucacauacuuagccuuacucgcagcauuuaaagugcgaccuacauucgcagcugguuuacuacuacgcaaacuaaccucaaaagaauugaugaugaccaccauuggcauaguuuuacugucacagucaacuauacccgaaaccauacuagaauuaacagaugcauuagcauuagggaugaugguccucaaaaucguuaagaauauggaaaaauaucagcuagcaguaacuauaauggcaauauuaugcgucccaaaugcaguaauauuacaaaaugcauggaaggucucguguacuauauuagcuguggucucaguuaguccacuauuacuaacuucaucacaacaaaaggcagauuggauccccuuggcgcucacaauaaaaggacuuaacccuacagcaauauuucuuacuacguugagucguaccuccaagaaaaggagcuggccauuaaaugaagcgauaauggcgguaggaauggucucuauuuuagcaucuuccuugcuuaaaaaugauauaccgaugacuggaccgcuaguugcagggggacuuuugacagucugcuacgugcuuacggggaggagcgcugacuuggaauuggaacgagcagcagauguacgcugggaagaucaagccgagauauccggcuccucuccuauauuaagcauaacgauaagugaagacgguaguaugucgauuaaaaaugaggaggaagaacaaacauuaacuauccuaauacgaacaggacuacuuguaauaucgggucuauucccugugucaaucccaauaacugcagcagcaugguaucugugggagguuaagaaacaaagggccggaguacuaugggauguucccucacccccaccuguagggaaagcagaacuagaagacggugcauauagaauaaaacaaaaagguauacucggauacagucaaauaggggcuggaguuuacaaggaaggaacuuuucacacgauguggcaugucacuaggggugcgguucuaaugcacaaaggaaaacgcauugaaccgucaugggccgaugucaagaaagauuugauaucauacgguggaggauggaagcucgaaggagaauggaaagagggcgaagaaguacagguacuggcauuggagccuggcaaaaauccuagggcaguccaaacgaaaccaggauuauucaaaacuaauacuggaacuauaggagcagucagcuuagacuuuucgccaggaaccagcggaagccccauaguagauaaaaaggguaaagucguagguuuauacgguaacgguguaguuacacgaagcggcacauacguaagugccaucgcacaaacugaaaagagcauugaagauaauccugagauugaagaugauauauucagaaagaaaagacuuacaaucauggacuuacauccgggcgcaggaaagaccaaacgcuacuugccagccauaguaagagaagcaauaaaacguggacuuagaacccuuauuuuagcuccgacaagagugguggccgcugaaauggaagaagcauuaagaggguuaccaauaagauaucaaacacccgcaauaagggcagaacauacaggaagggaaauaguagauuuaaugugucacgcuacguuuaccaugcgcuuauuaucaccagucagaguucccaacuacaacuuaauaaucauggaugaagcacauuuuaccgauccugcaucaauagcugcucgaggauauaucaguacaagaguugaaaugggagaagcggcagguauauucaugacagcaacaccaccaggaagucgggacccauuuccccaauccaaugcuccuauaauggacgaggagcgugaaauaccugaaagaagcuggaacuccggacacgaauggguaacagacuuuaaggguaaaaccguaugguucguaccaucgauaaaggcaggaaaugacauagcugcuuguuugaggaaaaacggaaagaaaguaauccaacuaucuagaaaaacguucgauagcgaauacauuaaaacaagaacuaacgacugggacuuuguaguaacuacggauaucagcgaaaugggggcaaacuuuaaagcagagagaguaaucgauccucgaagguguaugaagccggugauccuaacagauggagaagaaagggucauucuagcaggcccuaugccggucacccacagcagugcugcucagcgcagaggaagaauaggcaggaauccuaaaaaugaaaacgaucaauacauauauaugggugagccacuugaaaaugaugaggauugcgcccauuggaaggaggcaaaaaugcuucuagacaacauaaauacaccggaagggauaauaccaucgauguuugaaccugaacgcgaaaagguagacgcuauagauggagaauacagacuacgcggcgaagcaaggaaaacauucguugauuuaaugcguagaggagaccucccaguauggcuagccuaccgcgucgcagcugaagggauaaauuaugcagaucgaagaugguguuuugaugggauaaagaacaaccaaauccucgaagaaaacguugaagucgaaauauggaccaaagaaggugaacggaagaaauuaaagccacgauggcuagaugcucgcauuuacucugaucccuuagcgcugaaagaguucaaagaauuugcugcaggaagaaaaaguuugacucucaauuuaauaacugaaaugggucggcuaccaacguuuaugacucagaaagccagaaaugcuuuagauaacuuggcuguucuacacacugcggaagcaggaggccgugcauauaaccaugcacucuccgagcugccggagacacuugagacccuacuacuacuaacauuauuagcuacaguaacaggcggaauauuuuuauuucucaugucaggaaaggguauuggcaaaaugacgcuagguauguguugcauaaucaccgcaagcauacuauuaugguaugcgcagauccaaccucacuggauagcggcuucgaucauucucgaguucuuucuaauuguacuacucauaccugagccagaaaaacaaagaacuccucaagacaaucaauuaacuuauguaguuauagcaauacuaacagucgucgccgcaacuauggcaaaugaaaugggguuccucgagaaaacuaagaaagacuuugggcucgggucuaucgcaacccaucaaccagaaucuaacauacuagauauagauuuaagaccagccagugcauggacucucuaugcugucgcaacgacauucauaaccccgaugcugagacauucuauugaaaacuccuccgucaaugucagucugacugcuaucgcuaaucaagcaacuguccuaauggggcuuggaaaagguuggccucucuccaaaauggacauagggguuccccugcuugccauaggaugcuauagucaagucaauccaauaacacuuacagccgcuuuauuacucuuaguagcccacuacgcuauuauaggcccgggucuucaagcuaaagcuaccagggaagcgcagaagcgggccgcugccggaaucaugaaaaauccaaccguugacggcaucacaguuauugaucuagaucccauuccuuaugacccgaaauucgaaaaacaacugggucaaguuauguuguuaguuuuaugugugacccaaguacugaugaugcguacgacuugggcccuuugugaagcucugacucuagcaaccggccccaucucgacauuaugggagggaaauccaggcagauuuuggaacacaacgauugcaguaagcauggcaaauauauucagagggucauacuuagccggagcaggacuacuguuuucgauaaugaaaaacaccgcuaauacccgucggggcacaggaaauacaggcgaaacauuaggggaaaaauggaaaaauagacuuaaugcacuaggaaagucagaauuucaaauuuauaaaaagucaggcauccaagaagucgacagaacacuggcuaaagaagggauaaaacgcggagaaacagaucaucaugcaguauccagagguuccgcaaaauugcguugguucguagaaagaaaucugguuaccccagagggaaagguuguagaucuuggauguggaagagggggaugguccuauuauugugguggacucaaaaacguaagggaaguaaaagguuuaacuaaaggcggucccggacacgaagaaccaauuccgaugucaacguauggauggaaucucguaagauugcagucugggguagacguguuuuucaccccuccagaaaaaugcgacacauuacugugcgauaucggagaaaguucucccaaucccacgguggaggcgggaagaacauuacgcguauugaaucuugucgaaaacugguuaaauaauaauacucaauuuugcauuaaaguucucaacccuuacaugccauccguaauugagaaaauggaagcccuacaacggaaauauggaggggccuuaguaagaaacccacuaaguagaaauucuacucaugaaauguauuggguaucaaacgcaaguggcaacaucgugaguaguguaaauaugauuucacgaauguuaauuaacagauuuacaaugcgacauaagaaagccacauacgaaccagauguagauuugggaucugggacaaggaacauugggaucgagucugaaaccccaaaucuagauauuauagggaaacgaauagagaaaauuaaacaagaacaugaaacuucauggcauuaugaucaagaucaucccuacaagaccugggcguaccacggaaguuaugagacgaagcaaacaggaagcgcaagcucuaugguuaauggcgucguaagauuacuaacgaaaccuugggauguaauaccaauggucacgcaaauggcgaugacugacacaacaccuuuuggccagcagagaguuuuuaaggaaaagguagacacuaggacacaggaacccaaagaaggcacuaagaaauuaaugaagauaacugcagaauggcucuggaaagaacucgggaagaagaaaacuccgagaauguguacacgggaagaauuuacgagaaagguaaggucaaaugcagcauuaggagcaauauucacugacgaaaauaaguggaaaucagcuagagaggccguagaggauucaagauucugggagcucguugacaaagagagaaacuugcaucucgagggaaaaugcgaaacauguguuuauaauaugauggggaaaagagaaaagaaauuaggggaauuuggcaaagcaaaggguucacgggcaauaugguacaugugguuaggcgcacgguucuuggaauuugaagccuuagguuucuuaaaugaagaucauugguucucuagagaaaauucccuaucagguguagagggugaagggcuccauaaguuaggauauauauuaagagauguuucgaagaaagaaggaggugcgauguacgcugaugacaccgcugguugggauacaagaaucacgcuagaagacuuaaagaacgaggaaaugguaacaaaucauauggagggcgagcauaaaaaguuggccgaagcgauauucaaacuuacauaucaaaacaaaguaguucgaguucagcggccaacaccacgcggaacgguuauggacaucauaucaagacgagaucaaagaggcaguggccaaguggguacauacggcuuaaacacauucacaaauauggaagcucaacugauucgacagauggaaggugaggguguuuuuaagucaauacaacacuugacagucacggaagagauagccguacaaaauugguuagcacgaguagguagagaacgacucucacguauggcgauaucgggggacgacugcgugguaaaaccacucgaugauagguucgcuagcgccuuaaccgcauuaaaugacaugggcaagguuagaaaagacauacaacaaugggaaccgagccguggauggaacgauuggacacaagugccauuuugcagucaccauuuccaugaauuaauaaugaaagauggcagagucuuggugguucccugcagaaaucaagacgaauuaauuggaagggcaagaaucucacaaggagcaggauggagucucagagagacagcaugcuugggaaaaucuuaugcucaaauguggucacugauguacuuccaucgacgugaucucagauuagccgcuaaugcaaucugcagcgcgguaccaucucacugggugccuacuucuagaacaacauggucuauacaugcuagacacgaguggaugacgacugaagacaugcuaacuguguggaacagagucuggguacaagaaaaucccuggauggaagauaaaacaccuguagaaucaugggaagaaauuccauaccuagguaaaagggaagaucaaugguguggcagccuaaucggcuugacaagucgcgcaacaugggcgaagaacauacagacagcuaucaaucagguccgaagccuaauagggaaugaggaguacaccgacuacaugccuagcaugaaaagauucagacgcgaagaggaagaagcgggcgugcuaugguag

SEQ ID NO: 22909 - RNA, 9876 nt, Artificial Sequence
  derived and/or modified CDS sequence (opt6) from DENV-2__GQ398268__SS-prME
acugcagguaugauaauuauguuaauacccacuguaauggcauuucaucuaacaacacgaaauggagaaccacacaugauugucaguagacaagaaaaagggaaaucuuuauuguuuaaaacugaagacggagucaacaugugcacacuaauggcaauggauuuaggugaacuaugugaagauacuauaaccuacaaauguccauuacuucgucaaaacgaaccggaagauauugauugcuggugcaauucuacgucaaccuggguaacuuaugguacguguaccacuacaggugaacauaggagggagaaaaggucaguagcucucguaccacauguggguaugggcuuagaaacccgcacugaaacuuggaugaguagugagggagcauggaaacacgcacaaagaauagaaacguggauacuaagacacccagguuuuacaauuauggcagcaauacuagcauacacuauugguacaacucacuuucaacgagcucugauuuucauacuacuaacagccguagcaccgucaaugacaaugagauguauaggaauaucaaaccgggacuuuguggaggguguaucagggggaucauggguugacauuguuuuagaacauggcucaugcgugacuacuauggcuaaaaauaaaccaacguuagauuuugaauuaauaaaaacugaggcaaaacaaccggcaacccuucgaaaauauuguauugaagcgaaauuaacgaacacaaccacggagaguagguguccaacucaaggugaaccuucauuaaacgaggagcaagacaaaagguuuguauguaaacauaguaugguggacagaggcugggguaauggauguggucuauucggaaaaggcggaauugucacuugcgcaauguuuaccugcaagaaaaauauggaagguaaaguuguacagccggaaaauuuggaguauacaauagucauuacaccacauucaggcgaggaacacgcaguugggaacgacaccggcaaacaugguaaagagaucaaaaucacuccacaaaguucuaucacagaggcagaacuuacaggauaugggacuguaacaauggaguguucgccacgcacggggcuagauuuuaaugagaugguauuauuacagauggaaaacaaagccuggcuggugcauaggcagugguuucucgaccuuccacuaccaugguuaccuggugcagacacgcaagguaguaacuggauccaaaaagaaacauuagucacauucaaaaauccccacgcgaagaaacaagacgugguaguuuuaggaucccaggaaggggccaugcauacagcacucacuggggcuacagagauccaaaugagcaguggcaaccuauuauuuacagggcaucuuaaaugcagacuacgcauggauaaauuacaauugaaaggcaugucuuauaguaugugcacugguaaauuuaaaguaguaaaagaaaucgcagaaacccaacacggaacuaucguaaucagaguacaauacgaaggcgaugggucgccauguaaaauaccuuucgaaaucauggaucuggaaaagagacacguucuaggaagauugaucacaguaaauccaauaguaaccgagaaagauaguccuguaaacauugaagcugaaccaccauucggagauaguuauauaauaauuggaguugaacccggacaacuaaaguugaauugguuuaaaaagggaucgucaauaggucaaauguuugaaacaacgaugaggggcgcgaaaagaauggcaaucuugggcgacacagcgugggacuuuggaucacuaggaggggucuucaccaguaucggaaaagcgcuacaccaagucuuuggggcaauauauggagcggcauuuucaggugucuccuggaccaugaaaauccucauugguguaaucauuacauggauagggaugaacaguaggaguacaagucuuagugugagccuaguucucgugggaguuguaacccuuuaucuaggaguaauggugcaagccgacucaggauguguaguaucauggaaaaauaaagaauugaagugcggaagugggauauuuaucacugauaacguacauaccuggaccgaacaauacaaguuccaaccagaaagcccaucaaaauuagccagcgcgauacaaaaagcccacgaagaaggaauuugugggauucgaucaguuacucguuuagaaaacuugauguggaaacaaaucaccccagaacuaaaccauauauuaagugagaacgaaguaaaauugacaaucaugacuggagacaucaaagggauaaugcaagcagggaaacgcucauugcgcccacaaccaacagaacuaaaauauaguuggaaaaccuggggaaaggcaaagauguugucaacugagagucacaaccaaaccuuuuuaauugaugguccugaaacugcggaauguccgaauacgaaccgagcauggaacucucuugagguugaagacuauggguuuggugucuucacgaccaauaucugguuaaaacuuagagaaaaacaagauguguucugcgauagcaaguugaugucagcagcuauuaaagauaaccgagcuguacaugcugauaugggauauuggaucgaaucugccuuaaaugacacauggaaaauagaaaaagcaucguuuauagaaguaaaaagcugccacuggcccaaaagucauacccuauggucuaauggcgugcuggagucagagaugauuauaccuaaaaacuucgcagggccaguuagucaacacaacuacagaccaggauaucauacccaaacggccggccccuggcaucucgguaaacucgaaauggauuucgauuuuugcgagggaacgacaguugucgucacggaggauuguggcaacagaggacccuccuuaaggacgacaacugcaagcggaaaacuaauaacagaauggugcugucgcucaugcacccuuccaccacuaagguaucguggagaagacggguguugguacggaauggaaauuagaccauuaaaagaaaaagaagaaaaccuggucaacucucuaguuacugccggacauggucagauagauaacuucucucugggagugcuggguauggcacuauuucuugaggagaugcuucgaacucguguaggaacaaaacaugcuauauugcucguugcuguuaguuuuguaacacuuauuacgggcaacaugucauucagagaucuuggacgagugaugguaaugguaggagcaacuaugacagaugauauaggaaugggcguuaccuauuuagcacuauuagcugcuuucaaaguaagaccaacuuuugcagcaggucuauugcugcgaaaacuaaccuccaaagaauugaugaugacaacaaucgggauaguccuauuaucccaguccaccauaccugaaacaauccuggaauuaacagaugcacuagcucuuggcaugauggucuuaaaaaugguccgaaaaauggaaaaguaccagcuagcagugacuauaauggcuauacugugcguuccuaacgcagucauacuacaaaaugcguggaaaguuaguuguacgauauuagcaguaguaucggucucaccccuacuguuaacaaguagucaacaaaaagccgauuggauaccauuggcucuaacgauuaaaggacuaaaucccacggcaauuuuccuuaccacguuaagcaggacuaacaaaaagcgaucauggccuuuaaacgaagccauuauggcugugggaaugguuagcauccucgcauccagucuacugaagaacgauaucccgaugacugggccauuaguagcaggaggauuguuaacggucugcuauguauuaacgggacgauccgcugaucuagaguuagaaagggccgcugauguuaaaugggaagaucaagcagaaauuagcggaucaucuccaauauuaucgauaacgauaucugaagacggaucgaugagcaucaaaaaugaagaagaagaacaaacacuaacgauacuaauuagaacgggguuacuuguuauaucagggcuauuuccaguuaguauaccgaucacagcagcagccugguaccucugggaaguuaagaaacaaagagcaggaguucuuugggauguuccaagcccaccgccagucggaaaagcagaacuagaggacggagccuaccggauaaaacaaaaagguauucuuggauacagucaaauuggcgcgggggucuacaaagagggaacauuucacacaauguggcauguaacacgcggagcuguacugaugcacaagggaaagagaauagaaccaagcugggcugauguuaagaaagauuugauauccuacggaggagguuggaaacuagaaggugaauggaaagagggugaggagguucaaguacuagcauuggaaccaggcaagaauccaagggcuguacaaacaaaaccgggacuuuuuaagacaaaugcuggaaccauuggugccguuucauuggauuuuagcccugguacgagcgguaguccgauaaucgacaagaaagggaaggucguaggacuguacgggaacggcgugguuaccagaucaggugcuuaugugagcgcaauugcgcaaacagaaaaauccauugaggacaauccugaaaucgaggaugauauauuuagaaagaggaaacuuaccaucauggauuuacacccgggagcgggaaagaccaaaagauaucuuccugcaauuguaagagaagcuauuaagcgaggcuuacggacucuaauucuugcgccuacaagagugguggcagcagagauggaagaagccuuacguggcuuaccaauuagauaucaaacaccggccauuagagcagagcauacaggacgcgaaauagucgacuuaaugugccacgccaccuucacgaugagauuacuauccccagugcguguaccuaauuacaacuugauaauuauggacgaggcacauuuuaccgacccagcauccauugccgcaagaggcuauauuucaacucgcgucgagaugggagaggcagcgggcaucuucaugacagcgacaccacccggcucaagggacccauucccacaaucuaaugcacccauuauggaugaagaaagagaaauuccagagagaucauggaguaguggucacgaaugggucaccgacuucaaagggaagacugucugguucguccccucgauaaaagcggggaaugacauagcggcuuguuuaaggaaaaacgggaagaaaguuauucagcuuagccgaaaaacuuucgauagugaauaugugaaaaccaggaccaacgauugggauuuuguaguuacuacugacauuucagaaaugggagcuaauuuuaaggccgaaagaguuauagacccucgaagauguaugaagccaguuauauuaacagauggagaggaaagaguaauccuugcaggaccgaugccgguuacucauucaucagcugcucagagaagaggaaggauugguaggaaucccaagaaugaaaacgaccaguacauauauaugggagaaccguuagaaaaugaugaagauugcgcgcauuggaaagaagcaaaaauguuacuagauaauauaaauacaccagagggaauaauacccucaauguuugaaccggaacgcgagaaaguggaugccauugauggggaguaucggcuuagaggggaagcacgcaagaccuuuguagaucuuaugcgacguggagaucucccaguuuggcuugcauauagaguugccgcagagggaauaaauuaugcugauagaagaugguguuuugauggcaucaagaacaaucagauucucgaagaaaacguugaaguagaaauauggacaaaggaaggugagcguaagaaauuaaagcccagauggcuagaugcacgaauauacucugacccuuuggcauuaaaggaauuuaaagaauuugcggcagguagaaaaucacuuacauuaaaucuaauaacagaaaugggaaggcuuccuacuuucaugacacaaaaagcaagagacgcacucgauaauuuagcgguauuacacacagcggaagcaggagggagagcuuauaaccaugcuuugagcgaacuaccggagacgcuugaaacucuucuccuacuaacccuucuagcgacagucacagggggaauauuccuauuucucauguccgguagaggcauagggaaaaugacguuagguaugugcuguauaauaacagcgaguauacuguuaugguaugcacaaauccaaccacacuggauugcggcaucgauuauauuagaauuuuuccucauaguacuauugauccccgaaccagaaaaacaacgaacgccgcaagacaaccaacucacauauguaguaauugcuauuuugacaguagucgcagcaacaauggccaacgagaugggcuuucuggaaaagacaaagaaagaucuggguuugggaucaauaacaacgcaacaaccggaaagcaauauuuuggauauagacuuacguccagcuucagcuuggacucuauaugcaguugcaaccacauuuguaacaccaauguuaaggcauucuauagaaaauucgucgguaaacgugaguuuaacggcaauugcaaaucaagccacgguacuuauggggcuaggaaaagguuggcccuuaucaaaaauggacauaggaguaccauuacuggcgauaggauguuauagccaggugaauccuauaaccuugacagccgcgcugcuucuucuaguugcccauuacgcaauuauaggcccuggauuacaggccaaagcgaccagggaggcgcagaaaagagcugcagcuggaaucaugaaaaauccuaccguggaugggauaaccguuauugacuuagacccuauucccuacgacccaaaauuugagaagcaacuuggucaaguaaugcuguuaguucuuugugugacccaaguucugaugaugagaacaacuugggcguugugcgaggcgcuuacucuagcuacaggacccauauccacauuaugggaagggaaucccggaagauucuggaauacaacuauagcugucagcauggccaauauauuuagagggucuuacuuggcaggcgcgggucuacucuuuucaauuaugaaaaacacaaccaauacuagaagagggaccgguaauaucggugaaaccuuaggcgagaaguggaaaucucgauuaaaugccuugggaaaaagugaauuucaaauauauaagaaaaguggaauccaggaaguagaucguacucuugcaaaggaagguauaaagagaggagaaacagaccaccaugcugugucgcgugggagcgcaaagcuaagaugguuuguagaaagaaacaugguuacaccggaaggcaaaguugucgaucuuggaugcggacgcggaggcuggucuuauuauugcggugguuuaaagaacguucgugaaguaaaaggucucacuaaagguggucccggacaugaagaaccuauuccuaugucuacuuaugguuggaaccucguacgacugcaaaguggaguagacguauucuucacaccgccagaaaaaugcgauacauuauugugcgauauuggggaaucguccccuaacccaacuguggaagcuggucgaacacuuagaguauugaaccuugucgaaaauuggcucaauaauaacacucaauucugcauuaaggucuugaauccauauaugccuagugucauugaaaagauggaagcauuacaaagaaaguacggaggugcccuaguccgcaauccguugaguaggaacucuacacaugaaauguauugggucucgaaugcauccggcaauauuguuucauccguuaauaugauuagcagaaugcugauuaauagguuuacaaugagacauaagaaagccacauaugaaccagacguagaucuagguagugguacgcggaacaucggaauagagagugaaauaccuaaucucgacauuaucgggaaaagaauugagaaaauaaaacaggagcacgagacaaguuggcacuacgaucaagaucauccauauaaaaccugggccuaucacgggucauacgaaacuaaacaaacugguucugcaucaagcauggucaauggaguaguaagauuauuaaccaaaccgugggacgucguuccaauggugacucaaauggcaaugacugauacaaccccuuucggucaacaaaggguauuuaaagaaaagguugauacaagaacccaagagccaaaagagggcaccaagaaauugaugaaaauuacggcagaauggcuauggaaagagcucggaaagaaaaagacaccccgaauguguacuagagaagaguucacaagaaaaguaaggucuaacgcugcuuugggagcuauuuuuacugacgaaaacaaauggaaaagugcuagagaggccgucgaagauagucgauuuugggagcuaguugacaaggaaaggaaccuacauuuagaagggaaaugcgaaacauguguguauaauaugauggguaagagagagaagaaacuuggagaauuugguaaggcuaaaggaagccgugcaaucugguacaugugguuaggugcuagauucuuagaguuugaagcacuaggauucuugaaugaggaccauugguuuuccagggaaaauucccuaaguggaguugaaggcgagggucugcacaaacuaggauacauucugagagaugucucgaagaaagaaggcggagcgauguaugcagaugacacagccgguugggauacccgcauaacccucgaagacuugaaaaacgaagaaaugguaacaaaccauauggagggagaacauaagaaacuagccgaagccauauucaagcuaaccuaucagaauaaagugguccgaguacaacgaccuacuccgcgaggaacaguaauggauaucaucucaagacgggaccaacgcggaaguggucaagugggaacauacggacuaaacacuuuuaccaauauggaagcucaguugauuagacaaauggaaggagagggcguauuuaaaucgauacaacaucugaccgucacugaagagauagcaguacaaaacuggcuugcacguguuggaagagaaagacuauccaggauggcuauuaguggggacgacugcgucguuaaaccauuggaugaccgguuugcaucugcauuaacggcacugaaugacaugggaaaaguucguaaagauauacaacaaugggagccaagcagagguuggaacgauuggacucagguaccauucuguucucaucauuuccaugaacuaauaaugaaagauggacguguccuaguagugccuugucguaaucaggaugaauugauuggcagagccagaauaagccagggagcgggauggucacuaagagaaacggccugucuaggcaaaaguuacgcccaaauguggucacuaauguauuuccaucgacgugaccuucgccuugcugcaaacgccaucuguucugcaguuccgagccacuggguaccuacuucaaggacaacuuggaguauacacgccaaacacgaauggaugacgacugaagauaugcuaacuguauggaacagaguguggauucaggaaaauccuuggauggaagauaaaaccccugucgaaagcugggaagagauacccuauuuaggaaagcgggaagaccaauggugugggucauuaauaggcuuaacaucuagagcuacgugggcuaaaaauauacaaacagcaauaaaccagguacgaucacuaaucgggaaugaagaguauacagauuauaugccuucaaugaaaagauuccgacgugaagaagaagaagcaggaguccuuugguga

SEQ ID NO: 22910 - RNA, 9876 nt, Artificial Sequence
  derived and/or modified CDS sequence (opt6) from DENV-2__GQ398263__SS-prME
acugcuggcaugauuauaaugaugauaccaacggucauggcauuucauuuaacgacucgaaacggggaaccucacaugauuguaucacgacaggaaaaagguaaaucuuuacuuuuuaaaaccgaagaugggguuaauaugugcacauugauggcaauggaccugggagaauugugcgaggauacgaucacauauaacugcccacuauuaagacaaaaugaaccagaagacauugacugcugguguaacuccacguccacaugggucacauacgguacguguaccgcgacaggagaacauagaagagagaaaagaaguguagccuuagucccccacguaggaauggggcuugaaacaagaacugaaacauggaugaguucggaaggagcauggaaacaugcacaacgcauugaaacuuggguacugaggcaccccggcuuuaccauaauggcagcaauauuggcauauacaauagggaccacuuacuuccaaagaguacugauauuuaucuuauugacugcaguagcacccuccaugacaaugcgcuguaucgguaucucgaaucgggacuucguagaaggcgucaguggugguaguuggguagacauuguauuagagcaugggaguuguguaaccacuauggcuaaaaacaaaccaacacuagacuucgaauuaaucaaaacagaagcaaaacauccggcgaccuuaaggaaauacuguauugaagcaaaauugaccaacacaacuaccgcaucucgauguccaacacaaggcgaacccaguuuaaacgaagaacaagacaaaagauucguauguaaacauaguaugguggaucgagggugggguaacggaugugguuuauucgguaaaggcgguauagugacuugugcuauguucacauguaagaaaaacauggagggaaaagugguacagccugaaaaucuagaguacacaauaguuaucacaccccauaguggugaagaaaacgcaguuggaaaugauacaggaaaacacgguaaagaaauuaaaauaacgccccaaaguucaaucacagaagcugagcugacaggguacgguacaguaacaauggaauguucgccgcgaacaggauuagacuuuaaugaaaugguucuccuccaaauggagaacaaagccuggcugguucauagacaaugguuccuugaucuaccgcucccauggcuuccgggagcagacacgcaagggucuaacuggauacaaaaagaaacauuaguaacuuucaaaaacccacacgcgaagaaacaagacguuguuguacuggguucucaagagggggccaugcauacagcuuuaaccggcgcuaccgaaauccaaaugucaaguggaaauuuguuguuuacagggcaccuaaaaugucgacugcgcauggauaaauuacaauuaaaagguaugucuuauucaaugugcacuggaaaauuuaaagucguaaaagaaauugccgaaacucagcauggcacuauaguaguaaggguucaauaugagggugaugguucaccuugcaaaaucccauuugaaauaauggaucuugagaaacgccauguuuuaggccgauuaauaacaguaaauccaauagucacugaaaaagacucaccuguuaauauagaggcugaaccgccuuuuggagacaguuacauaaucaucgggguggaaccuggccaacuuaaacugucgugguuuaagaaagguucuucgauuggccagauguuugagaccacgaugagaggcgcaaagcgaauggcgauacugggcgacacugcaugggacuucgggucccuaggagggguauucacuucaauagguaaagcacuccaucaaguauuuggcgcuauuuacggugcagcauuuucgggcgucuccuggacuaugaaaauacuaaucggagugguaauuacguggauuggaaugaacucaagaagcacuucacugucgguaagucuaguccuagucggagucguaacacuauauuugggcguuauggugcaagcugauagugguugcguugucucauggaagaauaaagaguuaaaaugcggaucagggauauucauaacagauaauguccacacauggacagagcaguauaaguuccaacccgaaucaccaucuaagcuagcaagcgcgauacaaaaagcgcaugaagagggaauaugcggaauaagaucugucacacgauuggagaauuuaauguggaaacaaauaacucccgaauuaaaucauauacucagugaaaaugaaguuaaacuuacuauuaugaccggcgacauaaaaggaaucaugcaagccgggaagcggucacugagaccacaacccaccgaacuaaaauauucauggaaaacuuggggaaaagccaaaaugcuaucgaccgaacuacauaaccauaccuuuuugauugauggaccugaaacugccgagugcccaacuaccaauagagcauggaauagccuagaagucgaagacuauggauuuggcguuuucacaacaaacauuugguugaaacugaaagagagacaggacguauuaugugauaguaaauugaugagcgcagcuaucaaagacaaccgagccguacacgccgauaugggauacuggaucgaaagugcacuaaaugauacauggaaaauagagaaagccagcuuuauagagguuaaauccugccacuggccaaagagccauacacuuuggucuaacggaguccuugaaagugaaaugaucauacccaaaaauuucgccgguccuguuagucaacauaacuauagaccaggauaucauacgcaaaccgcugguccauggcaccuugggaaacucgaaauggauuuugauuucugugaagggacaacagucguugugaccgaagauugugguaauagaggaccaucauuaagaacaacaaccgcaagugggaaguuaauuacggaaugguguugcaggagcugcacacugccaccucuaagauacagaggagaggaugguugcugguacggaauggaaauaaggccguuaaaagacaaggaggaaaacuugguaaauaguuuaguuacugccggccacggacagauagacaacuuuucacuuggaguauuaggaauggcgcuauuccucgaagaaaugcuaagaaccaggguagggaccaaacacgcaauauugcucguagcaguaucauucguaacacugauaacugguaacaugagcuucagagaucuuggcagggucaugguaaugguaggugcaacaaugaccgaugauauaggcaugggggucacuuauuuagcucugcucgcagccuucaaaguacgccccacauucgcugcugguuuacugcugagaaaauuaaccucaaaggaacuaaugaugacuacaaucgggauaguccugcuaagucaaucaacuauaccagaaaccauacucgaacuuacugaugccuuggcuuuagggaugaugguccuaaaaauaguuagaaauauggaaaaguaccaauuggcgguuacgauaauggccaucuuauguguuccaaacgcagugauacugcaaaacgcuuggaaaguaaguugcacaauucuugccguugugaguguuagucccuugcugcuaacaucgucacaacaaaaagcagauuggauaccguuagcuuuaacuauaaaaggauuaaacccaacggcaaucuuuuugacaacacuuucgcgaacuuccaagaaaaggagcuggccccuaaacgaagcaauaauggcuguuggaaugguaucaauacuagcaucuucucuauuaaagaaugacauucccaugacagguccccuaguagcugguggucuacuaaccguguguuacgucuuaacgggucgcagcgcagauuuagaacuagaaagagccgcagacgucaggugggaagaucaggcagaaauaucagguuccucgccaauccuuucuauuacuauaucagaagacggcaguauguccauaaagaaugaagaagaagaacaaacauuaacaauucuaauacggacuggucuucuagucaucagcgguuuauuuccagucucuauuccaauuacagcggccgcaugguacuuaugggaaguuaagaaacaaagagcgggcguacugugggacgugccgucgccuccgccugugggaaaagcagaacuagaggauggggcuuauaggauaaaacagaagggaauuuuaggauacucccaaaucggagcaggcguguauaaagaagggacauuccacacaauguggcauguuacucgaggagcuguauuaaugcacaaggguaaaaggauagagccaucaugggcugauguaaggaaggacuuaauuagcuacgguggcggauggaagcuagaaggggaguggaaggaaggugaagaaguacagguacuugcuuuggaaccugguaaaaauccgagggcuguacaaaccaagccuggauuauuuaaaacuaacacuggaacaauaggggcagugucuuuagacuuuucaccaggcacaagugguagccccauuguugauaagaaaggcaaaguaguaggcuuauacgggaacgggguaguaaccaggucagguacauacguaagcgccauagcacaaacggaaaaaucaaucgaagauaauccagaaauagaggaugauaucuuccguaagaaacgauuaacaauaauggaccugcaucccggcgccggaaaaacaaagagauauuugccagcaauaguaagagaagcuauaaagcgugggcugaggacuuugauacuggcuccgacucggguuguagcagcagaaauggaggaagcucuacgugggcuaccgauaagguaccaaacucccgcaauacgagcugaacauacaggcagggaaauaguagauuuaaugugccacgcgacuuucacaaugagacuauuaucuccugucagaguacccaacuauaaucuaauaaucauggaugaagcacacuuuacagauccagcuaguauagcugcaagaggauacauaucgacgaggguugagaugggagaggcggcgggaauauuuaugacagcuacaccaccaggguccagagaucccuuuccucaaaguaaugcgccaaucauggaugaagaaagagaaauaccagaaagaagcuggaauaguggacacgagugggugacagauuuuaaaggaaaaacuguuugguuugugcccaguauuaaggcagggaacgauaucgcagcgugcuuaagaaagaacgguaaaaaggucauacaauuaagccguaagaccuuugauuccgaauacaucaaaacacgaacgaacgauugggauuuuguuguuacaacagauauaucagaaaugggcgccaacuuuaaggcggaaagagugauugacccccgaagaugcaugaaaccuguaauauuaacugauggugaagaacgcguaauccuggcaggcccaaugccaguaacccacucgucagccgcacaaagacguggucgaaucggaagaaacccgaaaaaugaaaaugaccaauauauauauaugggggagccgcucgaaaaugaugaggauugcgcacacuggaaagaagcaaagaugcuucuagauaacauaaauacgccugaagguauaauaccauccauguuugaaccugagagagaaaaggucgacgcaauugauggugaguauagauuacguggagaagcucgcaaaacuuuuguagauuuaaugagaaggggcgauuuaccagucugguuagccuaucgaguugccgcagagggaauaaacuaugcagauaggcgaugguguuucgauggaaucaaaaauaaucagauucuugaagagaauguagaagucgagauauggacgaaagaaggagaaaggaaaaagcuaaaaccgagauggcuagaugcgagaauauauagugacccauuggcuuuaaaagaauuuaaggaguucgcagcgggaaggaaaagucuaacccucaaucugaucacugaaauggguaggcuaccaacauucaugacgcaaaaagcuagaaacgcacuagauaaccucgcgguacuucauaccgcagaagcuggugguagagcauauaaucaugcacuuucggaguuaccugaaacgcuagagacauugcuacuauugacacuucuagcaacagugaccggaggaauauuuuuguuccuaaugucaggaaaagguauagguaaaaugacauuaggaauguguuguauaauuacagcaagcauccugcuuugguaugcacaaauacaaccgcauuggauugcagcuagcaucauacucgaguuuuuccuuauaguuuuauuaauuccagagcccgaaaagcaaagaacaccgcaggacaaucaacuaaccuaugucguaaucgcaauucuuacggugguggcggcgacgauggccaaugaaauggguuuccuggagaaaacuaagaaagauuucggguuaggcuccauugcaacucagcaacccgagaguaacauauuagacaucgacuugcguccagcguccgcauggaccuuguacgccgucgccaccacuuucaucacaccgauguugaggcauaguauagaaaauagcaguguaaacgugagcuuaaccgcuauugcuaaccaggcaaccguauuaaugggucuagguaaaggauggccuuuaaguaaaauggacauuggggucccauuacuugcaauuggcuguuauucacaaguaaauccgaucaccuuaacagcagcucuacuuuuguuagucgcgcauuacgcaauaauuggaccaggauuacaagcuaaagcaacacgcgaagcacaaaagagagcagccgcaggaauaaugaaaaaucccacaguugauggaauuacuguuauagaccuugacccaauacccuacgaccccaaauucgagaagcaauuagggcaaguuaugcuuuuaguuuugugugucacccaaguacuaaugaugagaacgacgugggcucugugugaagcucucacacuagcgaccggaccaaucaguacgcuuugggaaggaaauccagggcgcuuuuggaauaccacaauagcuguuaguauggcaaacauauuucgaggaucguaucuagcaggagcuggacuccuguuuuccauaaugaaaaauacugcgaacacgcgccggggaaccgguaauaccggcgaaacgcugggagaaaaguggaagaauagacuaaaugcauuagggaagagugaauuucaaauauauaagaaaagcgggauccaagaaguagacagaacauuagcgaaagaagggauuaaacggggugaaacggaccaccaugcaguuagucgaggauccgcaaaacuaagaugguuuguugaaagaaaucugguuacgccagagggcaaggucguggauuuggguuguggucgaggaggguggucuuauuacugugguggacuuaaaaauguuaaagagguaaaagggcuaacaaaagggggaccuggacaugaagaaccuauaccaaugucuacuuauggauggaaucuaguuagauuacagucugguguugaugucuuuuucaccccgccagaaaaaugugauacacuccuuugcgauauaggggaaaguucaccaaauccaacaguagaagcuggucgaacauuacggguauugaacuuaguggaaaacugguuaaacaauaacacacaauuuuguauuaaaguauuaaaucccuauaugcccagugugauagaaaagauggaagcguugcaaagaaaauaugggggcgcucuuguuagaaauccgcucucacgaaauucuacgcacgaaauguauuggguaucuaacgccuccggcaacaucguaucuuccgucaauaugauuucccgaauguuaaucaacagguuuacuaugcgacacaagaaagccacauacgagccugauguggauuuaggaagugguacaaggaauauaggaauugaaagcgagauuccaaacuuggaugugauugggaaacgaauagagaaaauaaagcaagaacaugaaacaagcuggcacuaugaccaagaccaucccuacaaaacaugggccuaucacggaucauaugaaacuaaacaaaccggauccgcaucauccauggucaacggcguuguuagacuuuuaacaaagccuugggauguaauucccaugguaacacagauggcuaugacggauacaaccccauucgggcaacaaagagucuucaaagaaaaaguagacacgagaacacaagagcccaaggaaggaacuaagaaauuaaugaaaauaacagcggaaugguuauggaaagagcugggaaagaagaaaacaccgagaauguguaccagagaggaauuuacaagaaaaguacgauccaacgcagcucuaggagcuaucuauacugacgaaaacaaauggaaaagcgcacgagaagcaguagaagacucuagauuuugggagcugguugacaaagaaagaaaccuccaucucgaaggaaaaugugagacaugcguuuauaacaugaugggaaaaagagagaagaaacuaggagaguuugguaaagcaaaaggcagucgcgcgauuugguauauguggcugggugcaagguuucuggaauuugaagcacuuggauuuuugaacgaggaucacugguuuaguagagaaaacucgcuuagugguguagaaggggaaggacuacacaaacuugguuauauauugcgugacguuucaaagaaggaaggaggugcuauguaugcagaugauacagcaggaugggauacucgaaucacauuggaagaccucaaaaaugaagaaaugguaacuaaccacauggagggugaacauaagaaauuagcugaagccauauucaagcucacauaccaaaacaaggugguacgaguacagagaccaacaccccggggcacagucauggacauaauaucccggcgcgaucaacggggaucaggacaaguuguuacguacggucuaaauaccuucacaaacauggaagcgcaacuaaucaggcaaauggaaggagaaggaguuuuuaagagcauacagcauuuaaccgugacggaagagaucgccgugaaaaauuggcucgcacgaguggggcgugaaagguuaagucguauggccauaaguggugaugacugugugguaaaacccuuagaugaucguuucgcaagcgcucuaacagcauuaaaugacauggggaaagugcgcaaggacauccaacagugggagccaucgagagguuggaacgauuggacccaaguaccauucugcucacaucauuuucaugagcuuauaaugaaagaugguagaguccuaguagucccuugccguaaucaggaugaacugaucggacgcgcucgcauaucacaaggagcagguuggaguuuaagagaaacugcgugucugggaaaaucguaugcacaaauguggucuuuaauguauuuccaucgacgugauuuaagacuugcugccaaugcgauaugcucagcuguucccucucacuggguacccacuucccggacuacauggucaauacaugcaacgcaugaauggaugacaacugaagacauguuaacaguauggaacagaguauggauccaagaaaacccuuggauggaagauaagacgcccguugaaucuugggaagagauacccuaucuggguaagagagaagaucaauggugcgggaguuuaauaggguugaccuccagagcaacgugggcuaaaaauauacagacugcuaucaaucaagucaggaguuuaaucgggaacgaagaguacacagauuacaugcccuccaugaaaagauucagacgcgaagaagaagaagcaggaguauugugguaa

SEQ ID NO: 22911 - RNA, 9876 nt, Artificial Sequence
  derived and/or modified CDS sequence (opt6) from DENV-2__GQ398264__SS-prME
acggcagguaugauuauaaugaugauaccuacaguaauggcauuucaccuaaccacuagaaacggagaaccacacaugauaguuucaaggcaagaaaaagguaaaucacuauuguuuaaaacugagaacggaguuaauauguguacacuuauggcuauggauuugggugaacuaugugaagauacgauuacguauaauuguccauuacuuagacaaaaugagcccgaagauauagacuguugguguaauucaacgucgacguggguaacguacggaaccuguaccgcaacaggugagcacaggagggaaaaacgaucaguugccuuaguaccccauguaggaaugggucuugaaacgagaacggagacguggaugaguucggaaggcgcuuggaaacacgcacaaagaaucgaaacaugggugcuacgucauccagguuuuacaauaauggcggcaauccucgcguacacaauaggcacaacauacuuccaacgagucuuaauauucauacucuuaacagcuguggcaccaaguaugacaaugcgauguauagguauuucuaauagagauuucguggagggagucucuggagggucuuggguagauaucguccuagagcauggaaguugcgucacaacaauggcgaaaaacaaaccuacauuggauuuugaauuaauuaaaacugaagcaaaacauccagcuacuuuaagaaaauauuguaucgaagccaaauuaaccaauacaacgacugcgucacgaugcccuacgcaaggggaacccucauuaaaugaagaacaggauaaacgauuuguauguaaacauagcaugguagacagggguugggguaauggaugcggccuguucggaaaaggaggaaucgugacuugugcaauguuuacaugcaagaaaaauauggagggcaaaguuguacagcccgaaaauuuagaauauacaaucguaauaacuccacauucaggcgaagaaaaugcaguaggaaacgacacagguaaacaugguaaagagauaaaaauuacaccgcaaucgaguauuacagaggcagaacuaacuggguaugggacaguaacuauggaauguuccccacgaacuggauuagauuuuaaugagaugguacuccuacaaauggaaaauaaggcuuggcuuguacacagacaaugguucuuggaccuaccucuaccauggcuuccaggagcagauacgcaaggcagcaauuggauacagaaagaaacauuagucacguuuaaaaauccucaugccaagaaacaagacgucguaguuuuaggaagccaagaaggcgcaaugcauacugcguuaacaggagcaacagagauucaaaugucuagcgguaauuuauuauuuaccggacaccugaaaugccgauugagaauggauaaauugcaguuaaaaggcaugagcuacucaauguguacagguaaauucaaaguugucaaagagauugcagaaacccagcacggaacaauuguaauuagaguacaauaugaaggcgaugguucccccugcaaaaucccauuugaaauuauggauuuagagaaaagacauguuuuaggaagacugauuacggugaacccaauuguaacagaaaaggacucaccugucaauauagaagcagaaccuccuuucggcgauagcuauauuauuauuggaguagaaccugggcagcuaaaauuaucaugguuuaaaaagggcucgaguauaggacagauguucgaaacgacaaugagaggagcaaaaagaauggcgaucuugggagacaccgcaugggacuuugggagcuuagguggaguguucacaucgauagguaaagcauuacaucaaguuuucggugcgauuuacggugcagcuuuuucagguguuucguggaccaugaaaauacuaauaggaguugucauaacauggauagggaugaacucaagaucaacuagcuuguccguuucacucguucuugugggaguggucaccuuauaucuaggcguaaugguacaggcugacaguggaugcguaguauccuggaaaaauaaagaacugaagugugggucaggaauauucauaacagacaaugugcauacuuggacugaacaauacaaguuucaaccagagucuccauccaaguuagcuagugcaauccagaaagcccacgaggaaggcauaugugggauaaggucagucacaagacuugaaaaucuaauguggaaacaaauuacaccagaauuaaaucauauauuaagugaaaacgaaguaaaguuaaccauaaugacuggagacauaaaaggaauaaugcaagcuggaaagcgaucucucagaccccaacccacagaacuuaaauauucuuggaaaaccuggggaaaagccaaaauguuaaguacagaauuacauaaccauacuuucuuaaucgauggucccgaaacugcagagugucccaauacaaauagggcuuggaacaguuuagaaguugaggauuauggguuugggguauucacaacgaauauauggcucaaacuuaaagaaaggcaggauguauuuugcgauucaaaauugaugucagcagcaaucaaagauaauagagcugugcaugcggauaugggcuauuggauagaaagugcacucaacgauacauggaugauagaaaaggcuucuuuuauugaaguaaaaucgugccauuggccuaaaagccacacacuauggucgaacgggguuuuggaaucugagaugaucauaccgaaaaacuuugcggggccugugucacaacauaacuaucguccaggcuaucauacucaaacagccgguccuuggcaguuaggcaaacuggaaauggauuucgacuuuugugaagggacgacgguaguagugacggaggauuguggaaauagaggaccgucacuaagaacaacuaccgccucagggaaacuuauuacagagugguguugcagaucaugcacauugccuccacuacgauaccgaggggaggacgggugcugguaugguauggaaauaagaccgcuuaaggaaaaggaagaaaaccugguaaacagccuagugacagcagggcacggucaaauugacaacuuuagucuugguguauuagguauggcucuauuucuggaagaaaugcucagaacuagaguugguaccaaacacgcaauucuguuaguagcuguaucguuuguuacucuaauuacuggaaauaugaguuuuagagauuuaggaagaguuaugguaaugguaggggcaaccaugacugaugauaucggaauggguguuaccuaucuagcccuguuagcggccuuuaagguuagaccaacauuugcagccggauuguuauuacgaaaauugacauccaaagaguuaaugaugacuacuaucggaauaguucuauugucacaauccaccauuccagaaaccauauuagaacuaacagaugcacuagcgcuugggaugaugguauuaaaaaucgugagaaacauggaaaaauaccaacuggcuguaacuaucauggcuauauuauguguucccaaugcuguuaucuuacaaaaugcguggaaaguaagcugcacaacgcuagccguuguuucuguaagcccacuacuacuuaccaguucacaacagaaagcagauuggaucccacuugcauuaacuaucaaagggcugaauccgacugcaaucuuucuuaccacgcugagucgaacgucuaagaaacgguccuggccgcuaaaugaagcaauaauggcgguuggaauggugaguauucuugcaucuucuuuacucaaaaacgauauaccgaugacggggccccuuguagcugguggccuucuaacuguaugcuauguccucacagguagaucggcagaucucgaacuggaaagagcugcagauguaagaugggaagaucaggcagaaauuagugggucaucuccaauauuaucuauuacaaucucagaagauggaagcaugucaauaaagaaugaggaagaagaacaaacacuuaccauccucauccggacagguuuguugguaauaaguggacucuuuccgguaaguauaccaauuacggcugccgcaugguaccuaugggaggugaagaagcagcgagcgggaguauugugggauguucccucgcccccaccuguaggaaaagcugaauuggaggacggugcguacagaauaaaacagaaggguauccuuggcuacucucagauuggcgcgggggucuauaaggaagggacguuccauaccauguggcaugucacccgaggagcaguccucaugcauaaagggaaaagaauugaaccuagcugggcggacguaaggaaggaucuuauaucguaugggggagguuggaaauuagaaggugaauggaaagagggugaggagguucaaguuuuagcccuggaaccugguaaaaauccgagagcuguucaaaccaagcccggacuuuuuaaaaccaauaccggaacuauaggcgcaguaucacucgacuuuucaccgggaacaagcgguuccccaauuguagacaaaaaggguaaaguaguaggcuuauacgggaacggaguagucaccaggagcgggacauauguuucagcaaucgcacagaccgaaaaaucuaucgaggacaacccugagauagaggacgacauauuuagaaagaaacgauuaacgauaauggacuuacauccuggagcaggaaaaaccaaacgguaucucccggcaauaguucgagaggcuauaaaacguggucuaagaacguuaaucuuagcuccuacuagaguaguugcagcagagauggaagaagcacugaggggucuaccaauacgguaucaaacuccggcaauaagagccgaacauacggguagggaaaucguagaucuaaugugucaugcgaccuuuaccaugcgcuuauugucuccggucagggugccuaauuauaaccuaauaauaauggaugaagcacauuuuacugacccggcgucgauugcagcucguggauauauuaguacucgaguagaaaugggugaagcagcgggaauauuuaugacggcuacgcccccaggaucacgggauccuuuuccacaaaguaaugcaccaauaauggacgaggaacgggagauuccggagaggucauggaacucaggacacgaauggguaacugauuuuaaaggcaaaaccguaugguucgugcccucuauuaaagccgggaaugauauagcagcaugucuaaggaaaaaugguaagaaaguaauacaacugucaagaaaaacauuugacagcgaguauauaaaaacaaggaccaaugacugggacuucguugucacaacggauauuagugaaaugggggcaaauuuuaaagcagaaaggguuauugaucccagacgcuguaugaaacccgucauccuaacggauggagaggaaagagucauucuagcagguccuaugccagugacccauaguagugcagcucaaaggcggggacggguuggcagaaaucccaaaaaugaaaaugaccaguacauauauaugggugaaccgcuagaaaacgacgaagauugugcgcacuggaaagaagcaaaaauguuacuugacaacauaaacacuccagaaggaauuauucccaguauguucgaaccagaacgcgaaaaaguagacgcaaucgauggagaauauagacuacgcggagaggcgagaaaaaccuuuguagaucuaaugagaagaggagaucugccaguauggcuagcauaccgaguagcagcggaaggaauaaacuacgccgauagacguugguguuucgacgguguaaagaacaaccaaauauuggaagagaauguugaaguagagaucuggacuaaggaaggugaaagaaagaaauuaaaaccgagaugguuagacgcaagaaucuacuccgauccgcucgcccuaaaagaauuuaaggaauuugcagcuggucgaaaaaguuugacacuaaaucuaauaacagagaugggcagguuaccuacauucaugacacaaaaagcacgaaaugcucuagacaacuuagcagugcuucauaccgcugaagcaggcgguagagccuacaaccaugccuuaucagaauuacccgaaacauuagaaacacuucuguuguuaaccuuauuggccacagugacaggcggaauauuuuuauuccuaauguccggcaaaggaauugguaaaaugacgcuagguaugugcuguauaauaacagccaguauauuacuuugguacgcucaaauccaaccccacuggauagcagcaaguauaauauuggaguucuuccugaucgugcuacucaucccagagccugaaaagcagagaacaccacaggauaaucagcuaacauacguuguaauagccauucuaacagucguugcagcaacuauggcaaaugaaaugggauuuuuggagaaaaccaagaaagauuuugggcuagguucaacugcgacucaacagccagaaaguaacauccuagauauagaucuccgaccugcaucagccuggacccuauaugccguagcuacaacguucauaacuccgaugcuaaggcacucgauugaaaauucaucugugaacguuucucuuacggcaauagcuaaucaagcaaccguucucauggggcuaggcaaagguuggccacuaaguaaaauggauauuggaguaccacuccuggcaauaggauguuauagccaaguuaauccuauuacacuuacggcagcccuauuauuauugguggcucauuaugccaucauagggccagguuuacaagcaaaagcgacacgcgaagcgcagaagcgugcagcggcaggaauaaugaaaaauccuacaguagacggcauuaccguaauagaccuagacccuauaccguaugaccccaaauuugaaaagcaauuaggccaagucaugcucuuaguauuaugcguaacucaaguauuaaugaugcgaacuacuugggcauuaugugaagcgcucacauuagcgaccggaccaauuucaacccuaugggaaggaaauccagguagauucuggaacacaacgauugcaguaucuauggcuaacauuuucagaggauccuauuuagcuggugccggauuauuauuuagcaucaugaagaacacagccaacacuagacgcggaacugggaacacaggugaaacacugggagaaaaauggaaaaauaggcuaaaugcucuuggaaaaucugaauuucaaauauacaagaaaucuggcauacaagagguagauaggacuuuagcaaaagaaggaaucaaaaggggagaaacugaccaccaugccguuucgcgggggagcgcuaaacuaagaugguuuguggagcgcaacuuaguuacaccagaggguaaaguaguugaccuagguugcggcagaggcggcuggaguuauuauugugggggucuuaaaaauguaaaagagguaaaaggucuaacaaaagggggucccgggcaugaggaaccaauaccaauguccacuuauggauggaaucuaguccgguuacagucaggugucgacguauucuuuacgccuccagagaaaugcgacacacuuuuaugugauauuggggaaagcuccccgaauccaacuguugaagccggaagaacauugcgugucuuaaaucucgucgagaacugguuaaauaacaacacacaauuuugcauaaaaguucucaacccuuacaugccuucuguuauagagaaaauggaggcacugcagcgcaaguauggaggcgcucuuguuaggaaccccuuaagccggaacaguacacacgaaauguacuggguuucaaaugcuucaggcaauauaguguccuccguuaauaugauaagucgaaugcuaauuaaccgauuuacaaugaggcacaagaaagcaacguacgaaccagacguagauuuaggcucaggaacacguaauauugguauugaaucggaaacaccgaaucuggauauuauagguaaaaggauagagaaaauaaaacaggaacacgagacaucauggcauuacgaucaggaucauccuuauaagacaugggcauaucauggaucauaugaaaccaaacaaacaggcucagcaaguucuaugguaaaugguguaguccgucuucuaacaaaacccugggaugugaucccaauggucacacaaauggcuaugaccgacacaacccccuuuggucagcaaagaguauucaaagagaaaguggauacccggacccaagagccaaaggagggaacuaagaaacuuaugaaaaucacugcggaauggcuuuggaaggaguuaggcaagaagaaaacaccaagaaugugcacaagagaagaguuuacacgcaaggucagaucuaaugccgcguuaggugcaauuuucacagaugaaaacaaguggaaauccgccagagaagcgguagaagacaguggguucugggaauuaguugacaaggaacgaaacuuacaucucgaagguaaaugugaaacauguguuuacaauaugaugggcaaaagggagaagaaauuaggcgaauuugggaaagcuaaaggcaguagagcaauaugguacauguggcuaggugcacgauuccuagaguuugaagcucuuggcuuuuuaaaugaagaucauugguucaguagagaaaacucacuuaguggaguagaaggggaagguuuacauaaacucgguuacauucuaagggacgucucuaagaaagagggaggcgcaauguacgcagacgauacggccgggugggauacuagaauuacguuagaggaucuaaagaaugaggaaaugguuaccaaucacauggaaggagaacauaagaaauuagcagaagcgauuuuuaaacuaaccuaccaaaauaaggugguaagagugcagagaccaacuccgcguggcacgguaauggauauuauuucuagacgcgaucagagaggaaguggacaaguuguuaccuacgggcuuaacacauuuacuaauauggaagcucaauuaauuagacagauggagggagaagguguuuuuaaauccauucaacaucuuacggugacggaggaaauugccgucaaaaauuggcuggcacgcguagggagggaacgacugucaaggauggcuauuagcggagaugauugcguaguuaaaccgcuagacgacagguuugccucggccuuaacagccuuaaaugauauggguaaaguacgaaaagauauucagcagugggaaccaaguagaggauggaacgacuggacacagguucccuuuuguagucaucauuuucacgaacuaauuaugaaagacggaagaguuuuaguuguacccuguagaaaucaagaugaacucauaggacgagcacguauaucgcagggggccggauggucacuaagggaaacagcaugcuuaggcaaaucuuacgcucagauguggucccuuauguauuuucaccgaagggaucugagacucgcugcaaacgcaaucuguagugcaguaccuagucacuggguaccuacguccagaaccacguggucaauacaugcuacccacgaauggaugacuaccgaagauaugcugacaguauggaaucgcguuuggauucaggagaacccuuggauggaagacaaaacacccguggaaaguugggaggaaauuccauauuuaggcaaaagggaagaucaaugguguggcaguuugauaggacuaacuucacgugcgaccugggccaaaaacauucagacagccauaaaccaggugagaagucuuauaggaaacgaagaguacaccgauuacaugcccucaaugaaacgauuuagaagagaagaagaagaagcuggcguacuaugguaa

SEQ ID NO: 22912 - RNA, 9876 nt, Artificial Sequence
  derived and/or modified CDS sequence (opt6) from DENV-2__GQ398260__SS-prME
acugcggguaugauuauuaugcuuauuccgacaguuauggcuuuucaucuaacuacgaggaacggcgaaccgcacaugauagugucucgacaagaaaaagggaaaucucuauuauuuaaaacugaagacggaguuaauaugugcacauuaauggcuauggaucuaggggaauugugcgaagacacaaucaccuauaauugcccccuacugcgacaaaacgaaccagaagacaucgacuguuggugcaauagcacgaguacuugggugacauauggaaccuguacagcgacaggcgaacaucgacgagagaaaaggagcguagcauuaguaccgcaugucgguaugggacuugaaacccgcaccgaaacauggaugucuagcgaaggggcuuggaaacacgcgcaacgaauugaaacauggauucugcgacaccccggauuuacaauaauggcagcaauucuagcauauacuaucgggacaaccuauuuucaaagggugcugauuuucauauuguugacggcaguugcuccauccaugaccaugcggugcauagggauaucaaaucgagauuucguugaagguguaucuggaggcaguuggguagacaucguuuuggaacacggcucauguguaacaacgauggccaaaaauaaaccuacacuggauuuugaauuaauuaaaacggaagcaaaacaaccggcaacccuaagaaaauacugcauugaagccaaacugaccaacacaaccaccgcaucccgaugucccacucagggagagcccucauuaaaugaagaacaagauaaaagauuuguguguaaacacaguaugguggaucgggguugggguaacgguugcggauuauucgguaaaggaggaauugugacgugugcaauguuuaccuguaagaaaaacauggaagguaagguagugcaacccgaaaauuuagaguacaccauaguaauuacaccacacucaggggaagaaaacgcaguaggcaacgauacaggaaaacacgguaaagaaauaaaaauuacuccucaaucgaguauaacagaagcagaauuaauaggguauggcacagucacaauggaaugcagccccaggacugggcuagauuuuaaugaaaugguacuacuucaaauggaaaauaaagcaugguuaguacauagacaaugguucuuagaccucccacuccccuggcuaccgggagcagauacacagggcaguaauuggauccagaaagaaacacuugugacauucaaaaauccgcacgcuaagaaacaagauguagucgugcuggguucucaagaaggugcaaugcauacagccuuaacgggcgcuacugaaauacaaaugagcucuggaaaccucuuguuuacgggccaccucaaauguagauuaaggauggauaaacuacaacuuaaagguaugucuuacucaaugugcaccgggaaauucaaaguaguaaaagaaauagcagaaacucaacaugggacaauagugaucagaguacaauaugaaggugacggcucaccuugcaaaauaccauucgaaauaauggacuuagaaaaacgacauguauuaggaaggcucauaacaguuaacccaauagucacagaaaaagauucaccuguaaauauagaggcugaaccaccuuucggugauucuuauauuauaauugguguagagccaggacaauuaaaacuaaacugguuuaagaaagguuccaguaucggacagauguucgagacaaccaugagaggagcaaaacggauggccauuuugggagauacagcuugggacuuuggcucccuagguggaguuuuuacgucaauugguaaggcuuuacaccaaguauuuggagcaauauacggagcggccuuuuccgguguuaguuggacaaugaaaauucuaauaggaguugugauaacuuggauagggaugaacagccgaucaacuagcuuaucuguuagucuagucuuaguuggagucguaacacuuuaucuugggguuaugguucaagcagauucaggaugcguuguuagcuggaaaaauaaagaguugaaauguggaagcgguauauuuguaacagacaacguacacacuuggacagaacaguauaaauuucaaccugaaucaccaucgaaacuagcaucagcuauacaaaaagcucaugaggaggggaucuguggaauaaggucaguaacucgcuuagagaaccuuauguggaagcaaauuacgcccgaacuuaaucauauccuaucggaaaaugaggucaagcugaccaucaugacaggagauauuaagggaauuaugcaagccggcaaaagaagucuacgcccgcaaccaacagaacuuaaauacaguuggaagacuuggggaaaggcuaagauguuaucaacggaacuucacaaucagacauuccuaauugauggaccggaaacggcagaaugcccuaauaccaaccgagcauggaauaguuuagagguagaagacuauggauuuggagucuuuacuaccaacauaugguugaaauugaaggaaagacaagacguguuuugugauucuaaacucaugucagcagcaaucaaagacaacagagcuguacaugcugacaugggcuauuggauagaaagugcacuaaaugacacauggaaaauagaaaaagcaucauuuauugaagugaaaagcugucauuggccaaaaagucauacacuuuggaguaacggcguuuuggaaucggaaaugauaauaccaaagaacuuugcaggaccgguuagccaacacaauuacaggccaggauaucauacgcaaacggcuggaccuuggcacuuaggaaaacuagagauggacuuuaacuucugugaagggacaaccguuguagucacugaagacugugguaaccgagguccaagccugagaacuacuacagcaucuggaaaacugauaacugagugguguugcaggucuuguacccuaccaccacucagguacaggggagaggauggcuguugguauggcauggagaucagaccuuugaaagaaaaagaagaaaaucuaguuaacagcuuggucacugcuggacacggucagauugacaacuucucucuagguguauuaggcauggcccuauuuuuagaagaaaugcuucgaacuagaguaggaacaaaacaugcgauuuuauuggucgcuguaucuuuuguuaccuuaauuacgggcaauaugagcuuccgagaccuuggacgggucauggugauggucggcgccacuaugacagacgauauaggcaugggcguaacuuacuuagcgcuacuagcggcauuuaaagucaggccaacauucgcagccggauugcuguugagaaaguuaacaaguaaagaacugaugaugacgaccauaggaauuguacuauugagucagucuacaauaccggagacaauacuagaacuaacggaugcauuagcguugggaaugaugguacuuaaaauaguuagaaacauggagaaauaccaguuagcaguuaccauaauggcaaucuugugugucccaaacgcuguuauucuucaaaaugcuuggaaaguaucauguacaauacuagcaguuguaagcguaucaccacuauuacuaacaagcucgcaacagaaagcagacuggaucccguuagcucuaaccauaaaagguuuaaacccgacagcaauauuucuaacaacguuaagucguacaagcaagaaacgaaguuggccucuaaaugaagcuaucauggcggucgguaugguuaguauccuugcaucuuccuuacucaaaaaugauaucccgaugacagguccauugguggcggguggauuauuaacuguaugcuaugucuuaacagggagaagugcggacuuagaacuagagagagcagcggauguuaggugggaagaucaggcagaaaucaguggcuccucaccaauacuaucaauuaccauaucagaggauggcucaaugaguaucaaaaaugaagaagaggaacaaacguuaacgauucucaucagaacagguuuauuagucauuucaggguuauucccagucaguauacccauaacugcagcagcaugguaucuaugggaagucaagaaacaacgugcuggcguuuuaugggacguacccaguccaccgccaguaggcaaagcagaguuggaagacggagcauaucgaauaaaacaaaaagguauucucggcuauucccaaauuggagcggggguauacaaggaagggaccuuccauacaauguggcauguaaccagaggugcaguacuuaugcacaaaggaaaaagaauugaaccaagcugggcugaugugaagaaagauuuaauaucauauggagguggauggaaacuggagggagaauggaaagaaggcgaagaaguacagguacuagccuuggaaccaggcaagaaccccagagcaguccaaacgaaaccaggauuauucaagacaaacacugguacaauaggcgcugugagucuugauuuuucaccagguacaagugggaguccuauuguggauaagaaagggaaaguaguggggcucuauggcaacggaguugugacaagaucaggaaccuauguaagcgcuauagcucaaacggaaaaauccauagaagauaauccagagauagaggaugauaucuuccgaaagaagcgauuaacgauaauggauuuacacccuggagcuggaaaaacgaaaagauaucuuccggcuaucguaagagaagcuauuaaacggggacucagaacacuaaucuuggcuccgacuagaguugucgcagcggagauggaggaagcacuucguggcuuaccaauaagguaccaaacgccagcaauacgugccgaacacacagguagggaaauuguagaccuuaugugccaugcaacauuuacaaugagauuguuaagcccagugcguguacccaauuacaauuuaauaauaauggaugaagcgcacuucacagauccagcgagcauagccgcgcgagguuacauaaguacaagaguugaaaugggagaagcagcuggaauauucaugacggcaacaccuccaggcagcagggacccuuuuccccaaagcaacgcuccuauaauggaugaggagagagaaauaccagaacgcagcuggaauaguggucaugaauggguuacggauuuuaaaggcaaaaccguaugguuuguaccauccauaaaggccggaaacgacauugcagcuugccuacguaaaaaugggaagaaaguaauacaauuaucgaggaaaacuuuugauucagaguauauaaaaacgaggacuaaugauugggauuuugucgucaccacagauauuucugaaaugggggcaaacuucaaagcggagcgggucauagacccucggcgauguaugaaaccaguaauuuuaacugacggggaggagaggguaauacuagcaggcccgaugccugugacacauucaucugcugcacaacgcagaggcaggauaggucgaaauccuaaaaaugaaaaugaucaguacauuuacaugggugaaccauuagaaaaugacgaagacugugcacacuggaaggaagcuaaaauguuacuggauaacauaaauacaccugaaggaauuaucccaagcauguuugaaccagaaagagagaaggucgaugccauugauggggaauauagacuacguggagaagccagaaagacauucguagaucuaaugcgucgcggugaccucccaguauggcuggcauauagaguagcugccgaagggauuaacuaugcagauaggcgauggugcuucgaugggauuaaaaauaaucagauacuggaagaaaaugucgaggucgagauauggacuaaagagggugaaagaaagaaauugaaaccucgcugguuagacgcucguauauauagugacccucuggcuuuaaaagaauuuaaggaauuugccgcagguagaaaaagccuaacacucaaucucauaacagagauagggagguugccgacauuuaugacgcaaaaagcgcggaaugcauuagauaaccuagcaguucuacauacugcagaagcagggggaagggcuuacaaccaugcucucucagaacuacccgaaacuuuagaaacacuacuucuauuaacgcuacuugcuacagugacagguggcauauuuuuauuucuaaugucagguaaaggcauagguaaaaugaccuuagguaugugcuguauaauuacggcaagcaucuuacuaugguacgcacaaauacagccacacuggauagccgcaagcaucauauuggaguucuuucuaauagugcuucucaucccagagcccgaaaagcaacgaacuccacaagauaaccaacuaacguauguagucauugcaauccucacaguuguagcagcgaccauggcgaaugaaaugggauuccuagaaaagaccaagaaagacuuuggccuagguucaauugcaacacaacagccagaaucgaacauucuugauauagauuuacgaccagcgucagcauggacccuuuacgccguugcuacgacauuuauaacaccaauguuaaggcacucuauugaaaauaguucuguaaauguuagccucaccgcuauugcuaaucaggccacaguucucaugggccucgggaaaggauggcccuuaucaaaaauggauauuggaguaccccuucuggcuauuggauguuacagccagguuaacccaauuacacuaacugcagcacuacugcucuuaguagcccauuaugccauuaucgggccaggacugcaagcaaaagcaacucgagaagcacaaaagcgagcagcagcugguauaaugaaaaacccuaccgucgauggcauuacuguaaucgauuuagaucccaucccguacgauccaaaauuugaaaagcagcuaggacaggucaugcuauuaguauuaugugucacacagguacuaaugaugagaacaacaugggcauuaugcgaggccuuaacacuugcaaccggucccaucaguacacuuugggaagguaauccgggacguuuuuggaauacaacgauagcaguuucuauggcgaacauauucagaggcucguacuuagccggugcaggcuuauuauuuaguaucaugaaaaacacagcaaacacaagaagagggacuggaaauacaggggaaacacuuggagaaaaauggaaaaaucgauuaaacgcauuaggcaaaucggaguuccaaauauacaaaaagagugggauucaagaaguugacaggacgcuggccaaagaagguauaaaaagaggagaaacggaucaucacgcgguauccaggggaagcgcuaaguuaagaugguuuguagaaaggaacuuaguuacaccggaaggcaaagucguugaucuggggugcggucgaggaggauggucauauuacugcggcggguuaaagaacguacgagaaguaaaagggcugacaaagggaggacccggacacgaggaaccuauaccaauguccacuuacggguggaauuuaguacgauuacagagcggaguugauguauuuuucacucccccagaaaaaugugauacacuacuuugcgauauuggugagucguccccaaauccgacgauugaagcaggacgaacacuccgaguacuaaacuuagucgaaaauugguugaacaauaacacacaauuuuguauaaaaguccuuaaccccuauaugccuaguguuauagagaaaauggaggcuuugcaaagaaaguauggaggcgcuuuagugagaaauccguuaucaagaaauucuacacaugaaauguacuggguuucgaaugcgucugguaacauugucucgucuguuaacaugauaaguagaaugcuaaucaaccgauucacuaugaggcacaagaaagcaaccuacgagcccgauguugaucuagguaguggcacaagaaauauaggaauugaaagugaaacccccaauuuggauauaauaggcaagagaauagagaaaauaaagcaagaacaugaaacgucauggcauuacgaccaggaucacccauacaaaaccugggcuuaucauggcaguuaugaaacuaaacaaacagguucagccaguucgauggucaauggcgucguaagacuauuaacaaagccgugggacguaaucccuacuguaacacaaauggcaaugacagauacuacuccuuuuggucagcaacguguauuuaaagaaaagguggacacaagaacccaagaaccuaaagagggaacuaagaaauuaaugaaaauuacugcggaauggcuuuggaaagaacuaggcaagaagaaaacuccuagaauguguacccgugaagaguuuacgcgcaaagugcguaguaaugccgcguugggggccaucuucacggacgaaaacaaauggaaaagcgcacgugaagcaguggaagacucccgauucugggaacuuguugauaaagaaagaaaccuacaccuugaaggaaaaugcgagacguguguauauaacaugauggggaagagagagaagaaacucggcgaguucggaaaagcgaagggcaguagagcuauuugguauauguggcuuggcgcuagauucuuagaguucgaggcauuaggauuucuaaaugaagaucacugguucaguagggaaaauucccucuccgguguagaaggagaagguuuacacaaacuaggcuacauuuugagagauguaagcaagaaagaaggcggugcaauguaugcagacgauacagcaggaugggacacccgaauuacacuagaggacuugaaaaaugaagaaaugguaaccaaucauauggaaggcgagcauaagaaacuagccgaggcaauauucaagcuaaccuaccaaaacaaaguaguucgggugcagagaccgacaccacgugggacuguuauggacauuaucucgcguagagaucaaaggggaagcggccaaguagguacuuaugggcugaacacguuuacaaauauggaagcgcaguuaauuaggcaaauggaaggugaagguguuuuuaagucaauucaacaccuaacaguuacggaggaaauagcugugcaaaauuggcuagcuagaguaggacgagagcgguugaguagaauggcaauuucaggagacgacuguguugugaaaccccuugaugaucgauucgcuagugcucuuacugcacucaacgacauggguaaaguacgaaaggacauucagcaaugggaaccaaguagaggauggaacgauuggacacaaguacccuucuguucgcaucauuuucacgaguuaaucaugaaagacggucgcgucuuggucgugccguguagaaaucaagaugaacugauaggcagagcaaggauaucucagggagcaggcuggaguuugagagagacugccuguuugggaaaaagcuaugcacaaauguggucccuaauguauuuccaucguagagaucuucgcuuggcagccaaugcgauauguucugcgguaccuucacauuggguaccaacaaguagaacuaccuggucaauucacgcaaggcaugaauggaugacgacugaggacaugcuaacuguguggaacagaguuuggauccaagagaaccccuggauggaggauaaaaccccaguagaaucaugggaagagaucccuuaucuuggaaaaagggaagaucaauggugcggauccuugauaggucuaacaaguagagcgacuugggccaaaaauauucagacagcgauaaaucaaguucgcucucuaauaggcaacgaagaguacacagacuauaugcccucuaugaagcgauuccgccgugaggaagaagaagccggagugcuuugguag

SEQ ID NO: 22913 - RNA, 9876 nt, Artificial Sequence
  derived and/or modified CDS sequence (opt6) from DENV-2__GQ398262__SS-prME
acugcgggaaugauuauuauguuaauuccaacgguuauggcguuucaucugacaacuaggaauggagaaccucacaugauuguaagcagacaagaaaaaggaaagagucuacuauucaaaacagaagacggaguaaauaugugcacauuaauggcaauggaccugggggaauuaugcgaagauacgaucacauauaauuguccccuucuucgucaaaacgaacccgaggauauagauugcugguguaacuccacaagcacaugggucacuuaugguacaugcacagcgaccggagaacauagacgcgaaaaaagaucaguagcguuaguaccucauguggguaugggucuggaaacacgaacugagaccuggaugucuagcgagggagcuuggaaacacgcucaaaggauugagacauggauacuucgucauccaggguucacuauuauggccgcgauauuagcuuacacuauuggaacgacauacuuucagagaguacugauauucauccuacugaccgcagucgcuccuucaaugacaaugagauguauaggcauaucuaaucgugacuuuguagaagggguuucggguggaucuuggguagacauaguacuggagcauggaagcuguguaaccacaauggccaaaaacaaacccacuuuagacuuugagcuaaucaaaaccgaggcuaaacaaccugcuacccucaggaaguauuguauagaagcuaaauuaacgaacacaacuacugcgucuagauguccaacacaaggugaaccguccuugaaugaagaacaagacaaacgauuuguaugcaaacauaguaugguugauagaggaugggguaacgguugcggguuguuugguaaaggagguauuguaacgugcgcaauguucacguguaaaaaaaacauggaggguaaaguaguacaaccugagaauuuagaauacaccaucguaauaacuccccacucaggagaggaaaaugccguuggaaacgauacgggaaaacauggcaaagaaauaaaaaucacaccucaaucgagcauaaccgaagcugaauuaacuggauacggaacuguaacaauggaguguucgccgagaacgggacuagauuucaaugaaauggucuuauuacaaauggagaacaaagcauggcuaguacaucgucaaugguuucuugaucucccgcuaccguggcuuccuggggccgauacgcaagguagcaacuggauacaaaaagaaacacuuguuaccuuuaagaauccgcacgcuaaaaaacaagauguaguaguucugggaucacaggaaggggcuaugcauacugcucucacaggugcaacagaaauacagaugucgucggguaauuugcucuuuacagggcaccuaaaaugucgauuacgcauggauaaauuacaauuaaaaggaaugucauauagcauguguacgggaaaauucaaaguugucaaagaaauagcggagacacaacacgguaccauugugauuaggguccaauaugagggagacgggucuccgugcaaaaucccguuugagaucauggauuuagagaaacgacacguuuugggaagacuuauaacaguuaacccaauugugacagagaaagacucuccugugaauauagaggcggaaccaccauuuggcgacucauacauaauuaucgguguagaaccuggccaauugaaacuaaacugguuuaagaaaggauccucuauaggacaaauguucgaaacgacgaugagaggcgcuaaacguauggcgauacuaggagacacugcuugggauuucggcucgcugggagguguauucacuucaauugguaaagccuuacaucaaguauuuggcgcaaucuauggugcugcuuuuucgggaguuuccuggacgaugaaaauacuaauaggagucguaauaacguggauaggaaugaacucgcgaucaacuucauuaucagugagccugguacucguuggaguaguuacuuuauauuuagggguaaugguacaagcugauaguggcuguguaguuagcuggaaaaacaaggaauuaaaaugcgguucaggaauauucaucacugauaacguucacacauggacagaacaguauaaauuccaaccagaaucaccaagcaaguuagcaagcgcuauacagaaagcucacgaagaagguauuugcggaauccgaucugugacgcgauuagaaaacuuaauguggaagcagauuacacccgaauuaaaccauauccuaucagagaaugagguaagacuuacaauuaugacaggagacauuaagggcaucaugcaagcaggaaaaagaagucuacggccucaaccaacugagcuuaaauauuccuggaagacguggggaaaagcaaaaaugcugaguacggagcuccauaaccaaaccuuucuaauagauggaccagagacagccgaaugcccgaacacaaauagggccuggaauucuuuggaggucgaggauuaugguuucggcguguucacaacuaauaucugguugaaguuaaaggaacgacaagauguauucugugacucgaaacuaaugucagccgcuauaaaggauaaccgcgcgguacaugcagacaugggguauuggauugaaagcgcauuaaaugauacuuggaaaaucgagaaagcgucguucaucgaaguuaaaaguugccauuggccaaaaucacauacccuuuggucaaauggaguacuagaaucagaaaugauaauaccaaaaaauuuugcaggaccaguaucacaacacaacuauaggcccgguuaucauacucagacagcaggaccauggcauuuaggaaaguuagaaauggacuucaacuuuugcgaagguacaacaguaguaguuacagaagauugcgguaaucgaggacccagcuuaagaacuacaacagcaagcggcaaauuaauaacugaaugguguugcaggaguuguacacuaccuccgcuaagauacagaggagaagacggguguugguaugguauggaaauaagaccccuaaaggaaaaagaagaaaacuuaguaaacucacuaguuacagcaggacauggucaaauugacaauuucuccuuaggugugcuagggauggcguuauucuuagaagaaauguuaagaacccgaguugggacaaagcacgcuauauuauuaguagcuguaucauuuguaacccuaauuacaggaaacaugucauuccgagaucugggucguguaauggucaugguaggggcuacgaugacugaugacauagguaugggaguuacuuaccuagcgcuguuagcagcauuuaaaguucgcccaacguucgcugcuggacuacugcuacgaaaguuaacuucaaaggagcucaugaugacaacaauagggauaguuuuacucucacaaagcacaauuccagaaacuauccuagaacuaacugaugcauuagcucuaggcaugauggucuuaaagaucguaaggaauauggaaaaauaucaauuagcgguaacaauaauggcaauacucugcguucccaacgcugucauucuccaaaaugcauggaaagugucaugcacaauuuuagcaguuguguccguaucaccauuacuuuugacaucgagccaacagaaggcagacuggauaccucuagcuuuaacaauaaagggucuuaauccaacggcuauauuccucacgacuuuauccagaacauccaagaaacguuccuggccguuaaaugaagcaauuauggcaguuggaauggucagcauacuagcaaguucucuauuaaaaaaugauaucccgaugacagguccuuuaguugcaggcggguuacucacuguuugcuaugugcucacaggaagaagcgccgauuuggaguuggaaagagcagcagauguccgaugggaggaucaagcggaaaucuccggaaguaguccuauucuuucaauaacaaucagcgaagauggcaguaugaguauaaaaaaugaagaggaggaacagacacucacaauucuaauaaggacuggacuguuaguuauaucaggucuuuucccugucagcaucccuauaaccgcagcagccugguaucuaugggaagucaaaaaacaacgcgcgggcguccuuugggacguaccaucacccccgcccguaggaaaagccgagcuggaggacggggcguauagaauuaaacaaaaaggaauauugggauacucacagaucggagccgguguguauaaagagggaacauuucauacgauguggcauguaaccagaggugcagugcuuaugcauaaagguaaaaggauugaaccgaguugggcggacguaaaaaaagaucuaauaagcuaugguggaggguggaaacucgaaggugaauggaaagaaggagaagaaguucaaguucucgcuuuggaaccuggcaagaauccgcgugcaguacaaacuaaaccuggguuauuuaaaacaaauacagguacaauaggugcuguuucucuugauuuuucuccagggacaucagggucaccgauaguugauaaaaagggcaagguuguuggcuuauauggaaauggugucguuacucgaagugguacauauguaagcgcgauagcgcagacagaaaaguccaucgaagauaauccagagauugaagaugacauauuucguaaaaagcgcuugacaauaauggauuuacacccgggagcggguaaaaccaaaagguaccuaccugcuauugugagggaagcaauuaaacguggauuaaggacuuuaaucuuggcuccuacucguguuguagcagcugaaauggaggaagcuuuacguggccuaccuauuagauaccaaacaccagcaauccgugccgaacauacaggucgugaaauaguugauuuaaugugccaugcaacauuuaccaugcgauuacuaucuccaguucgaguaccaaauuacaaucuuauuauuauggacgaggcacacuuuacagauccugcaucgauagccgcacgugguuauauuagcacaagagucgaaaugggugaagcagcaggaauauucaugacagcgacaccaccggggucuagggauccuuuuccgcaaucaaaugcaccuaucauggacgaagagcgugaaauaccagagcgaaguuggaacaguggacacgaauggguaacggauuucaaaggaaaaacuguuugguucguaccuucaauaaaagcaggaaaugacauagcagcaugcuuaagaaaaaacgggaaaaaagucauucaguugaguaggaaaacuuucgauagugaauacauuaagacacgaacgaaugauugggacuuugucguaaccaccgauauaucagaaaugggugcgaacuuuaaagcggaacguguaauagauccacgaaggugcaugaaaccgguaauauuaaccgauggugaggaacgaguaauuuuggcaggacccaugccuguaacucacagcucagcagcacaacguagaggcagaaucggaaggaauccaaaaaacgagaaugaucaauacaucuacaugggggaaccacuagaaaaugaugaagacugcgcacacuggaaagaggccaaaaugcuauuagauaauaucaacacuccagaaggaauuauaccgaguauguucgaaccugaacgugaaaaaguagacgcaauagauggcgaauacaggcuaaggggagaggcucgaaaaaccuucguggauuugaugcggagaggugauuuaccaguguggcuggcguaucguguagccgcggaagguauuaauuaugcagaccgcagaugguguuuugauggcauaaaaaacaaccagauacucgaggaaaauguugaaguagaaauauggacuaaagaaggggagagaaagaaacuuaaaccuagaugguuagaugcgaggaucuacagugauccacuggcuuugaaagaauuuaaagaguuugcugccggaagaaaaucauuaacguuaaaccuuauuacagagauggguagacuacccacauuuaugacucagaaggcaaggaaugcauuagacaauuuggcgguauuacauaccgcagaagcagguggcagagcuuauaaucacgcauuaagcgaacuccccgaaacucuagaaacacuucuauuacuaacauuauuagcaacuguaacgggcggcaucuuccucuucuuaaugucuggaaaaggaauaggaaaaaugacguuagguauguguuguauaaucacagcgagcauuuuacuaugguaugcccaaauucaaccccacuggaucgcagcuucaauuauauuagaguucuuccuaauuguccuacucauaccagagccugaaaaacaaaggacuccucaggacaaccaguuaacauacguuguaauagcuauccuaacuguuguggccgcuacgauggcgaaugaaauggguuuccuagaaaaaacaaagaaagauuuuggacuagguucuaucgccacacaacaaccggaaucaaacauccuagauauugaucucagaccagcuuccgcauggacuuuauaugcaguugcgacaacauucauaacaccaauguugaggcauucgauagaaaauucguccguaaaugucucauugacagcuauugcaaaccaagcaacaguguugaugggacuugguaaaggguggccacugaguaagauggacaucggcgugccguuauuggcaauuggcugcuacucgcaaguaaauccuauaacauuaacggcagcccuucuauuauuaguagcacauuaugcaaucauaggucccggauugcaagccaaagccacgagggaagcacaaaaacgagcugcagcgggcauuaugaagaauccgacgguggauggaauuacgguuauagaucuugacccuauacccuacgacccgaaauucgaaaagcaacuaggacaagucauguuauuagugcuuugugucacacaaguauuaaugaugcguacuacaugggcuuuaugcgaagcgcugacucuugcuacggggccuauaucaacucuuugggaagguaacccuggccgcuucuggaauacuacaaucgccgucucgauggcaaauauauucagaggaucauauuuggcuggagccggauuguuguucagcauuaugaagaauacagcuaacacuagacgcggcacugguaauacuggggaaacgcugggagaaaaauggaaaaacagauuaaaugcuuuaggcaaaagugaguuucaaauauauaagaaaucgggaauucaagaaguagacaggacacuggcaaaggaaggaauaaaaagaggugaaaccgaucaucaugcuguaucacgagggucagcuaaauuaaggugguucgucgagcgaaauuugguaacaccagaagggaagguuguggaucuuggauguggaagagguggauggaguuauuauugugggggguuaaagaaugucagagaagucaaaggcuuaacuaaaggcggaccaggccaugaagagcccauaccaaugucgacauacgguuggaaucuaguaagacuccaaagugguguugauguauucuucaccccaccugaaaaaugugauacacuuuuaugugacauaggugaaucaucuccgaacccaaccguggaagcaggucggacgcuacguguguuaaaccucguagaaaacugguuaaauaacaauacccaauuuugcauaaaaguacugaauccauacaugccaaguguaaucgaaaaaauggaagcacuucaacgaaaauaugguggcgcacuaguaagaaauccacuuaguaggaacaguacgcaugaaauguauugggucucaaacgcuucaggcaacauuguaaguagcguaaauaugauaucccgcauguuaauuaaccgauucacuaugcgccauaagaaagccacguacgaaccagauguugaucucgguaguggaacuagaaauauuggcauugaaucugaaacgcccaaucuagauauaaucgguaagaggaucgaaaaaauuaaacaggaacacgaaacuucuuggcauuaugaccaagaccauccguacaaaaccugggccuaucauggcaguuaugaaacaaaacaaacaggaagcgcuucgucgaugguaaacggaguagugagauuacuaacaaagccuugggacguaauuccaaugguaacccaaauggcuaugacagauacaacgccauuuggacagcaacguguuuuuaaggaaaaaguagauacgagaacgcaagaaccgaaagaagguaccaagaagcuuaugaaaauuacggccgaaugguuauggaaagagcuagguaaaaagaaaaccccucgcauguguacacgcgaagaguuuacaagaaaaguuagaaguaaugcggcgcuuggggcgaucuucaccgaugaaaacaaauggaaaucagcaagggaagcaguugaagauagcagauuuugggaacucguugauaaggaacgaaauuuacaccuugaagggaaaugcgagacauguguguacaauaugaugggaaaacgugagaagaaacuaggggaauuuggcaaggcuaaagguaguagagcuauaugguauauguggcuuggggccagauuuuuggaauuugaggcguuggguuuucuaaacgaagaucauugguucucuagagaaaauucacucucuggaguugaaggagagggacuucauaaauuaggguauauacuacgagauguuucgaaaaaggagggaggcgccauguacgccgacgauacagcagggugggauaccagaauaacccuagaagaccuuaaaaaugaagagauggucacuaaccacauggaaggugagcacaaaaaacuagcagaggcuauauucaaacucacuuaucaaaauaagguaguacgugugcaaagaccuacucccaggggaacaguaauggauauaauuucgcgccgagaccagcgggggucggggcagguaggcacuuauggauuaaauacuuuuacgaauauggaggcccaauuaauaagacaaauggagggugaaggaguauucaaaucaauccaacaccucacuguuacugaagaaauugcuguucagaacugguuggcacguguuggacgagagagacuuucaagaauggcuauuucuggagacgacuguguaguuaaaccuuuagacgaccgauuugccagugcccuaacggcacuuaacgacaugggaaaaguacggaaggacauccaacaaugggagccuucacggggcuggaaugauuggacgcaaguaccguuuuguucacaucauuuucaugaacuuauaaugaaagauggacggguauuaguaguuccuugucgaaaccaggacgaacuaauugggcgugcacgcauuucacaaggagcagguuggagcuugagagagacggcaugucuaggcaagaguuacgcacaaauguggagucuaauguauuuucauagaagggauuuacgacuagcagccaacgcuaucuguucugcaguaccgagccauuggguaccaaccucaaggacaacauggucuauacaugcacgucacgaauggaugacaacagaggacaugcuaaccguguggaaccguguguggauacaagaaaacccuuggauggaggacaagacaccagucgaaucaugggaagaaaucccguauuuaggcaaaagagaggaucaaugguguggaucucugaucggauuaacgaguagagcgacgugggcuaagaacauacagacagcaauaaaucaggugcgaagucucaucggcaacgaggaauauacugacuacaugccgucaaugaagagauuucgucgugaagaggaagaagcugguguguuaugguaa

SEQ ID NO: 22914 - RNA, 9876 nt, Artificial Sequence
  derived and/or modified CDS sequence (opt6) from DENV-2__GQ398261__SS-prME
acagcuggaaugauaauaaugcuaauaccaaccgucauggcauuucaucugacaacacgcaauggagaaccgcauaugaucguaagucggcaagaaaaaggaaaaucucuucuauuuaaaaccgaagaugguguuaauauguguacucuuauggcuauggauuuaggugaauugugugaagacacgauaacguauaauugcccauuauuacgacaaaaugaaccagaagacauagacuguugguguaauagcacaaguacguggauaacguacgguacauguacagcaacuggugaacauagaagggaaaaacguucugucgccuuagugccacaugugggaauggguuuagaaacuagaacugaaacuuggaugucgagugaaggagcguggaaacaugcacaaagaaucgaaacguggaucuuaagacauccuggcuucacuaucauggccgccaucuuagcuuauaccauagguacaacauacuuucaaagaguacucaucuucauacuucuaacagcaguggcuccaucaaugacgaugcggugcaucggaauaaguaaucgagacuuugucgaaggaguauccggagguuccugggucgauauuguacuggaacaugggucuuguguaacaacaauggccaaaaauaaaccaacauuggauuuugaauuaauaaaaaccgaagcuaaacaaccagcaacgcucagaaaauacugcauagaagcgaaacugacgaauacgacaacagcuucucgauguccaacacaaggagaaccuagucuuaaugaagaacaagauaaaagauucguauguaaacauucuaugguagauagaggaugggggaacggaugugggcuuuucggaaaaggcgguauuguaacgugugcgauguuuacuuguaagaaaaauauggaaggcaaagucgugcaaccugagaacuuagaguauacaauaguuauaacaccgcauucuggggaagaaaaugcaguuggaaaugauacaggaaaacacggaaaagaaauaaaaauaacaccccagucgucaauaacggaggcagagcuuacaggcuauggcacgguaacuauggaauguagcccacgaacgggacuagauuuuaacgaaauggucuuacuucagauggaaaacaaagccuggcuaguucacagacaaugguuccucgauuugccauugcccuggcuaccgggugcagauacacaaggaagcaauuggauacagaaggaaacucuagucacuuuuaaaaauccucaugcaaagaaacaggacguugucguauuagguucccaagaaggagcuaugcacacugcgcugacuggggcaacugaaauccagaugucuaguggaaaucuauuguuuacaggacaucucaaaugucgucuuagaauggauaaguuacagcucaaggguaugucauacucaauguguacugggaaauuuaagguggucaaagagaucgcugaaacgcaacauggaacaauagucguuaggguacaauaugagggugacggcucaccaugcaaaauaccuuucgaaauaauggaucuugaaaaacggcacgugcuuggucgacuuaucacgguaaaccccauuguaaccgaaaaagacuccccugugaauauagaggcggaaccgccauucggugacucauacaucaucauugggguagagccagggcaacucaaauuaaacugguucaaaaagggcucgucgauuggacaaauguucgaaacaacaaugagaggugcuaagagaauggcaaucuugggagacacggcaugggacuucgguaguuuaggagguguguuuacaucaauagguaaggcguuacaccagguuuuuggagcuauauacggugcggcauuuucuggagugucauggacaaugaaaauucucauagggguagugauaacguggauuggaaugaacucacgaucuacaucuuugucagugucccugguguuaguaggagucguaacauuguaccuaggugucaugguucaggcagacucagguugcgucguaaguuggaaaaauaaggagcucaaaugcggaucagggaucuucguaacggauaauguccauacguggaccgaacaauacaaauuucaaccugaaucuccaucuaaauuagcgucagcgauacaaaaagcucaugaggaggguauauguggaauaagaagugucacgcgguuagaaaaccuaauguggaaacaaauaacaccggaacuaaaucacauccucucggaaaaugaaguaaaacuaaccauaaugacuggugacaucaaaggcaucaugcaggcaggcaaaagaucacucagaccgcaaccuaccgaacucaaguauucauggaaaacauggggaaaggcaaaaaugcugucaacagaauuacauaaucagacuuuucuaauagacgguccugagacggccgaguguccaaacacaaacagggcauggaauagucuugagguugaagauuauggguucggagucuuuacuacaaacauaugguuaaaauuaaaagagcgccaagacguauuuugcgacucaaaacuuaugagcgccgcaauaaaagauaauagagcuguccacgcagauaugggcuauuggauagaaucugcauugaaugauacauggaaaauugagaaggcuucuuuuauagaagucaaaagcugucacuggccuaaaucccacacguuguggaguaauggaguacuggagucugaaaugauaauccccaagaacuuugcugguccugucagccaacauaacuaucgaccgggcuaucacacucaaacugcgggccccuggcaccuugguaaacuagagauggauuuuaauuucugugaaggaacuacgguuguagucacgggcgacugcgggaauagagggccggcuuuacguacaaccacugccucaggcaagcucauuacggaaugguguuguagaucuugcacauuaccucccuuacgcuauagaggggaagacggauguugguauggcauggagauacguccgcuuaaggaaaaagaagaaaauuuaguuaauagcuuaguaaccgcaggacauggacaaaucgauaacuucucguuagguguacuugguauggcacuauuucuugaggagauguuacgaacucgaguggguacuaaacaugcaauacuccuuguugccguaucguuuguaacacucauuacagggaauaugagcuuuagggaccuaggaagaguaauggucaugguaggagcuacaaugacugacgauauaggcauggggguuaccuacuuagcacuuuuagcagcauuuaagguucgaccaacguuugcggcaggccuccuauuaagaaaacucaccaguaaagaauuaaugaugacgacaaucggaauuguuuuacuaagucaaaguacuauuccugaaacuauccuugaguuaacagaugcuuuagcguugggcaugaugguccuuaaaaucguccguaacauggaaaaauaucaauuggcaguaacuaucauggcaauauugugcgucccaaacgcugugauccuucaaaaugcauggaaagucucgugcaccauuuuagcagucgugaguguuucuccgcuguuauuaaccaguucucagcaaaaagcagauuggaucccgcuagcacuuacuauaaaaggucuuaacccaacagcgauauucuuaaccacccuaucucguacaaguaaaaagcgaagcuggccguuaaaugaagcuauaauggcaguaggcauggugagcauucuugcuucaucuuuacugaagaacgacauaccaaugacuggaccucucguagcuggaggccuuuuaaccgucuguuauguacucacaggucgaucggccgauuuagaacuagaacgagcggcugauguaagaugggaggaucaagcagagauaucugguaguucaccuauacuuuccauaacgauaucagaggaugguucaaugagcauaaagaaugaagaggaagaacagacacuaacgauacugauaagaacgggacuauugguaauaucaggauuauucccuguuagcauuccaauaaccgcggcggcaugguauuugugggaggucaagaaacaacgcgcaggaguuuugugggaugucccuucgccacccccagucggaaaagcagaacuagaagauggagcuuaucggaucaaacagaaggguauacuugguuauagucaaauuggugccgggguauauaaagaaggaacuuuccauacaauguggcaugugacuagaggagccguauuaaugcacaagggaaaaagaaucgaacccucaugggccgauguuaagaaagaucuuauaaguuacgggggagguuggaaacuagaaggggaguggaaagaaggagaagagguccaaguacucgccuuagaaccugguaaaaauccaagagcuguucagacaaaacccggacuauucaaaacaaacacaggaacaauaggcgcugugucguuggauuuuucaccagguacgagcggaucucccauuguggauaaaaagggcaaaguuguagggcuguauggaaacggcgucgugacgcgcucaggaacuuacgucucggcaaucgcccaaacagagaaaaguauagaagauaauccagaaauagaagaugacauauuuaggaagaaacgguugaccauaauggaucuacacccuggggccggcaaaaccaaacgauauuuacccgcaauagucagggaagccauaaaaagaggcuuaagaacgcuaauacucgcgccuacgagaguugucgcugcagaaauggaagaggcauuaagaggccucccaauuagauaucaaacaccagcuauuagggcugaacauacaggucgcgaaauaguugauuuaaugugccacgcaaccuucacuaugagguuacuuagccccguaagaguaccaaauuacaaucucauuauuauggaugaagcacauuucacugauccugccaguauugcugcucgugguuacaucucgaccagaguugaaaugggagaggccgcuggaauauuuaugacugcaacgccuccuggaucaagagauccauucccgcagucaaaugcgcccauuauggaugaagagagggaaauucccgaaaggucauggaacuccggccacgaauggguaacagauuuuaagggcaagacaguaugguuuguucccucaauuaaagcuggcaacgacaucgcagcgugcuuaaggaaaaauggcaagaaagucauacagcuuucuaggaaaaccuuugauucagaauacauuaaaacgaggacaaacgacugggacuuugugguaacaacugauaucagcgaaaugggagcuaacuucaaagcggaacgaguuauugaccccaggcgcugcaugaaacccgugauauuaacagauggagaagaaagaguaauucuugccgguccuaugccugugacacacagcucagcugcucaaagaagaggaagaaucggucgcaaucccaaaaacgaaaacgaucaauacauauauaugggagaaccgcuagaaaaugacgaagacugcgcucacuggaaagaagcaaagauguuacuugauaacauuaauacaccagagggcauaauaccgaguauguucgaaccugagagggaaaaagucgacgcaauagauggagaauauaggcucaggggugaagcccgaaaaacuuuuguagaccuaaugcgaagaggggacuuacccguguggcuagcauacagaguggcagcagaagguauuaauuacgcagaucgaagaugguguuucgacggcauaaagaauaaucagauauuagaagagaacguagaaguggagauuuggaccaaagaaggcgaaaggaagaaacuaaaaccucguuggcuugaugcaagaauauauucugauccauuggcucugaaagaauuuaaggaguuugcugcuggccggaagucccuaacucuuaacuugauaaccgaaauaggacguuuaccaacuuuuaugacgcaaaaagcuaggaacgcucuugacaauuuagccguacuacauacagcugaagcagggggacgagcuuauaaccaugcacuaucagaauugccggagacauuagaaacauuauuacucuugacuuuacuggcuacuguaacugguggaauuuuccuguuuuugaugucugguaaaggcaucgguaaaaugacuuugggaauguguuguauaauuacagcgucaauauuacucugguaugcacaaauccagccgcacuggaucgcagcuuccauuauacuggaauuuuuccuuaucguucuacugauaccagaaccagaaaaacaacgcacgccucaagauaaucaacucacguaugugguuauagcaauacuaacagugguagcagcaacaauggccaaugaaaugggauuccucgaaaagacgaagaaagauuuugggcuuggcaguauagcaacacaacaaccggagucaaauauauuggauauugaucugcgaccugcuagcgcguggacauuguaugcuguugccacaacauucauuacuccaauguugagacacaguauagagaauagcagugugaaugugaguuuaaccgcaaucgcaaaccaagcuacaguucuaaugggacuuggaaaaggauggccacucaguaaaauggauauaggggugccucuucuagccauuggcugcuacagccaaguuaaccccauaacacuuacugcagccuuguuacuccuagucgcucauuacgcgaucauaggcccaggauugcaagcgaaggcgacucgugaagcacagaaaagggccgcagcugguaucaugaaaaauccgacuguagacggaauaacuguuaucgauuuagauccaauaccauaugacccaaaauuugaaaagcaacucggucaagugaugcucuugguacuuuguguaacgcaaguauugaugaugcgcaccacuugggcacuaugugaggcauuaacucuugcaacgggaccuauaagcacccuuugggagggaaaccccggacgauucuggaauacaacaauagcagucuccauggcaaacauauucagaggaucuuacuuagccggugcagguuuauuauuuaguauuaugaaaaauaccgcgaauacucgacguggaaccggcaacacaggagaaacuuuaggagaaaaauggaaaaaccgauuaaaugcacuagggaagagugaauuucaaauauauaagaaaucagggauccaagaagucgaucgaacccuagcaaaggaggguauaaaaaggggcgaaacggaucaccaugcgguaucccguggaagcgcuaaacuccgaugguucguagaaagaaauuuagucacaccugaaggaaagguaguagaccucggcugcgguagagggggauggaguuacuacuguggaggacucaaaaauguaagagagguaaagggauuaaccaagggugguccuggccacgaagaaccaauaccaauguccacuuauggcuggaauuuggucagguuacaaucuggcgucgauguguucuuuacaccgccagaaaagugcgauacacuguuaugugacauaggagaaucuucaccaaacccuacaauugaagcaggacggacuuuaagagucuugaaccuuguugaaaacuggcuuaacaauaauacccaguuuugcauaaagguacuuaacccuuauaugccaucaguuauugagaaaauggaagccuuacaaagaaaauaugggggugcccugguacggaaucccuugaguagaaauucaacgcacgagauguauugggucucgaacgcaucuggaaauauaguaucuaguguuaauaugauaucacggauguuaauuaacagguucacuaugcgacacaagaaagcgaccuacgagccagauguugauuuagguucaggaacaagaaauaucggcauugaaagugaaaccccaaacuuagauaucauagguaagcgaaucgagaaaaucaaacaagagcaugagacuucauggcauuacgaucaagaucaucccuacaaaaccugggcauaucauggauccuaugaaacuaaacaaaccgggucugcuaguaguaugguuaacggcguaguacguuuauuaaccaagcccugggauguaauccccacaguaacccagauggcuaugaccgauacuacaccguuuggucagcagcgaguauucaaagagaaaguagauacaagaacacaggaaccgaaagaagguacuaaaaaguugaugaaaaucaccgcagagugguuauggaaggaacuuggaaagaagaaaacuccaaggaugugcacccgugaagaguucacuaggaaaguacgcucaaacgcagcgcucggggcuaucuucacagaugagaauaaauggaaaucugcacgagaagcgguggaagauucccgauuuugggaauuaguagacaaagaaagaaacuuacaccuugaagguaaaugcgaaacaugcguauauaacaugaugggcaaacgugagaagaaacucggagaguucggaaaagcaaaagggucacgggcaauaugguauauguggcugggugccagauuccuagaguucgaagcacuugguuuccuuaacgaagaccauugguucucacgugagaauagcuuaucugggguagagggugaaggucuucauaaacuuggguauauucuacgggaugugaguaagaaagagggcggcgcaauguacgcugaugacacagccggcugggauacgagaauaaccuuagaagaucuuaaaaaugaagaaaugguaacaaaccacauggaaggagaacauaagaaacuagcagaagccauauuuaaacuaacuuaccaaaacaagguuguccgaguacaacgccccacaccccggggaaccguuauggacauaaucaguagaagagaccaacgaggaucgggccaggugggaaccuaugguuuaaacacuuucacaaacauggaggcacaacucauacgacaaauggagggugaaggugucuucaaaaguauccaacaccuuacuguaaccgaagaaauagcagugcaaaacugguuggcuagagugggacgugagagacugaguagaauggcaauaucaggagaugacuguguuguuaaaccacuggacgauagauuugcaagcgcgcuuacugcauuaaaugacauggggaaagucagaaaggacauacaacaaugggaaccaucccguggauggaaugacuggacccaagugccauuuuguagucaucacuuccacgagcucauuaugaaagacggaagaguauugguagucccuugccgcaaucaggacgaauugauaggacgagcgaggauaucacaaggcgcagguuggucacuuagagagacagcaugucuggguaaaagcuaugcacagauguggagccucauguauuuucaucguagagaucuucgauuagcugcuaaugcaaucuguucagcgguuccaagccauuggguuccaacuucucggacaacauggucaauccaugcucgacaugaauggaugaccacagaagauaugcuaacagucuggaaccgaguauggauucaggaaaacccuuggauggaagauaagacucccguagaaucaugggaagagauccccuauuuaggaaaaagggaagaccaaugguguggcagccugauaggccuaacgaguagggcaaccugggcgaaaaauauucaaaccgcaauaaaucaagugagaucgcucauaggaaacgaggaauacaccgacuacaugcccucuaugaaacgauuucgccgcgaggaagaagaggccgguguacucugguag

SEQ ID NO: 22915 - RNA, 9876 nt, Artificial Sequence
  derived and/or modified CDS sequence (opt6) from DENV-2__GQ398313__SS-prME
acggcgggcguuauaaucauguuaauuccaacagcaauggcauuucauuuaacaacgagaaacggagaaccacauaugauaguggguagacaagaaaaaggcaaaucuuugcuauuuaaaacggaagauggaguuaacauguguacuuuaauggcgauagaucugggugaacugugcgaagauacgauaacguacaaaugcccgcuuuugagacaaaacgaaccggaagauaucgacuguuggugcaacucgacuucaacauggguuacuuaugggacuuguaccaccacaggcgagcacagaagagagaaaagaucagucgcauugguuccacacguaggcaugggauuagaaacucgaacugaaacauggaugaguagugagggcgccuggaaacauguucaaaggauugagacauggauccuaagacauccuggauuuacgauuauggcagccauauuagcauauacuauugguacaacacauuuccagagagcucuaaucuuuauacuccuuacggcgguugcuccaucaaugaccaugcguuguauuggaauuagcaaccgagauuucguugaagggguuucagguggauccugggucgacauaguauuggaacauggcaguugcguaacgacuauggccaaaaauaaaccaacuuuagacuuugaacuuauaaaaacagaagcaaaacagccugcuacgcuacguaaauacugcauagaagcgaaacugacaaacacuacuacagagagccgcugcccaacacaaggagaacccucauuaaacgaagaacaggauaagagguucgucuguaaacauaguaugguugauagaggaugggggaacggaugcgguuuauuugguaaaggugguauaguuacaugugcgauguuuaccugcaaaaagaauauggaagguaaagugguauuaccagaaaaccuugaauauaccauagugauuaccccgcauucgggugaagaacacgcuguaggaaaugauacgggaaaacacgggaaagaaauaaaaauaacaccacaaucgaguauaaccgaggcggaauugacuggcuaugguacagucaccauggaauguucaccucgaacugguuuagacuucaacgaaaugguauuacuucaaauggaagauaaagcguggcuaguacacaggcagugguuucuggaucuaccacuaccauggcuaccuggcgcggauacgcaaggaagcaacuggauacagaaggaaacauuagucacuuuuaagaacccccacgccaagaaacaagacgugguaguacuagggucccaagaaggagccaugcauacagcuuuaaccggagccacugaaauucagaugaguaguggaaaucuauuauucaccggacaccuaaaaugcagguuaagaauggauaaacugcaacucaaaggaaugaguuacaguauguguacuggcaaauuuaaaauuguuaaagaaauagcagaaacacagcacggaacaauagugauccgaguacaauacgaaggugaugggucacccugcaaaauuccuuucgaaauaauggauuuggaaaagaggcauguccuuggacgauugauaacaguaaauccuauaguugcagagaaagauagcccaguaaacauagaagcagaaccacccuucggagauaguuauauaaucauaggaguagagccgggucaauuaaaacucaauugguucaagaaaggcaguaguauugggcaaauguuugaaacgacaaugcggggagcaaaaaggauggcuauacuaggcgauacagcaugggauuuuggaagucuagggggaguauuuacgaguauagguaaggccuuacaucaaguauucggcgccauauauggagcagcguucaguggaguaucauggacaaugaaaauccucauuggaguuauaauaacauggauuggaaugaacucgcgaucuacgagucucagcguuucucuuguucuaguuggaguaguaaccuuauaccuaggugcuauggugcaagcagauucggguugugugguuuccuggaagucuaaagaauugaaauguggcaguggcauuuucauaaccgacaacguacacacauggacagaacaguauaaauuucaaccugaaaguccuagcaaacuagcuucggcaauacaaaaagcgcaugaggaagguaucugugggauaagauccguuacucgacuagaaaaucuuauguggaagcaaaucacgccggaguugaaccauauucuuucagaaaacgaagucaaauuaacuaucaugacuggagacauuaaagggauuaugcaagcaggaaaacguucuuugagaccacaaccuacagaauuaaaauauucauggaaaaccuggggaaaagcgaaaaugcucuccaccgaaucgcacaaucaaacauuccugauagacggacccgaaacagcugaaugucccaacacgaaucgugcauggaauagccuagaaguugaagacuauggauuuggaguauucacaacgaacaucugguugaaauuaagagaaaaacaagauguguuuugcgauagcaaauuaauguccgcagcaauaaaggauaacagggcuguucacgcugacaugggauauuggauugaaagcgcacucaaugauacguggaaaauggaaaaagcgucuuuuaucgaagucaagaguugucauuggccaaagagccacacacuuuggucaaacgggguacucgagagcgaaaugauuauucccaaaaauuucgcaggucccgugagucaacacaacuaccgaccuggauaucauacccaaacugcgggaccuuggcaucuuggaaaauuagaaauggauuuugacuuuugcgaagggaccacugucguaguuaccgaagauuguggaaaccgagggccuucacucagaacaacaacagccagcggaaagcucaucacagaaugguguugccggaguugcacacuaccgccauugcguuacagaggugaggaugguuguugguaugguauggaaauaagaccacuuaaagaaaaagaagaaaaccucguaaauucauugguuacugcaggacacggucaaauugauaauuucagucuugguguucuaggcauggcacuauucuuggaagagauguuaagaacacggguaggaacuaagcaugcaaugcuacuuguagcuguuucuuuugucacuuuaauuacagguaacaugaguuucagagaccuagggaggguuaugguaaugguuggggcaacuaugacggacgauauuggaaugggaauaaccuauuuggcgcuauuggcggcauucaaagugaggcccacuuucgcugcaggauuauugcuuagaaagcugacguccaaagaacuuaugauggcgaccauagguauagcauuauuaucccaaaguacaauaccagaaaccauauuggaauuaacagacgcuuuagcauugggcaugaugguguugaaaauuguucggaauauggaaaaauaucaauuggcugucacuauaauggcaauauccugugucccuaaugcaguaauacuucaaaaugccuggaaagugucauguacgauucuagcagcaguaagcgucuccccacugcugcuaacaaguucacaacaaaaagccgacuggauaccccuagcucuaacaaucaaagguuugaacccaaccgcaauauucuuaacgacucuuuccagaacaagcaaaaagagaagcuggccacucaacgaagcaguuauggcaguugguauggugucuauacuugccagcagccuacuaaagaaugacauuccaaugacggggccuuuagucgcugggggacuguugaccgucuguuauguacuaacagggagaucagcggacuuggaacuagagagagcagccgacgugaaaugggaagaccaggccgaaaucagcgggucuucuccaauacuuaguauaacuauaucggaggauggaagcaugaguaucaaaaaugaagaagaagaacagacuuuaacuaucuuaauacggacaggacuucuagucauuagcggaguuuuuccagugaguauaccaauuacugcugccgcuugguaccugugggaagugaagaaacaaagagccggaguauuaugggaugucccgaguccgccaccugucggaaaagcugagcuugaggauggagcuuaccguauuaaacaaagaggaauuuuggguuacagucaaauaggggcggguguauauaaagaaggaaccuuccauacuauguggcauguaacuagaggagcgguauugaugcaucgaggaaaacgaauagagccuucgugggcugaugucaagaaagaucuuaucaguuacggaggugguuggaagcuagaaggugaguggaaagaaggagaagaggugcagguacuggcauuggaaccagggaagaauccuagagcgguucagacgaagccugguuuauucaaaacuaauacaggaacgaucggagcagucagccuggauuuuagcccaggaaccucugguaguccaaucguugacagaaagggaaaagugguuggguuauauggaaacggaguaguuacacgcaguggagcauauguaagcgcaaucgcacaaacagagaaaaguauugaagacaauccagaaauagaggacgauauuuuccgcaaaaagcgacucacaauuauggacuuacauccaggugcaggaaaaacgaagcgguaucuuccagccauuguaagggaggccauuaagcgugggcuccgcacucuuauuuuggcucccacacgaguaguugccgcagagauggaagaagccuuaagaggcuuaccaauuagauaccaaacacccgcaauuagagccgaacacacaggacgagaaauaguagauuuaaugugccaugcaacguuuacaaugaggcuacucagcccagugcgcguucccaauuauaaccuaauuauaauggaugaggcgcauuuuacugacccugccucuauugcagccagaggauauauaucaacacgaguugaaaugggggaggcugcagguauauucaugacagccacuccuccagggucacgcgauccguuuccucaaaguaacgcaccaauaauggacgaggaaagggaaauuccagagagaucuuggaacuccggucaugaaugggucacggacuucaaaggcaagacaguaugguucguaccguccaucaaagcugguaaugacauagcagcuugccuaaggaaaaaugguaagaaagugauacaauugucgagaaaaacuuucgauucugaauacgucaagacaagagcgaaugacugggauuuugugguaacaacggacauaagcgaaaugggugcuaauuucaaagcagagcggguaauugacccgcgacguuguaugaaaccggucauauuaacagauggugaagaacgugucauacuagcgggcccgaugccugucacacacucaagugcugcucaaagacguggccguauaggaagaaaccccaaaaaugagaacgaucaauacauauauaugggagaaccauuagagaaugacgaagauugugcgcacuggaaagaagcaaagaugcuuuuagauaauauuaacacgccagaaggaaucauccccagcauguucgagccggagagggaaaaaguugacgcaaucgauggagaauaucgucuaaggggagaagcaagaaaaacuuucguagaucuaaugagaagaggagauuuaccaguaugguuggcuuauagagucgcggccgaaggaaucaauuaugcagauaggaggugguguuuugacggcauuaaaaauaaucaaauauuagaagaaaauguugaaguagagauauggacgaaagagggggaaaggaagaaauuaaaaccgagauggcuugaugccagaauauauucagauccccucgcucuaaaagaauuuaaagaguucgcagccggcaggaaaucacuaacacuaaaucuuaucacugagauggguagacuacccacuuuuaugacucaaaaagcaagagaugcacuagauaaccuugcagucuugcacacugcugaagcaggaggacgagcuuauaaucacgcgcuuagugaacuucccgaaaccuuggaaacuuuauugcuucuaacuuuacuugcaacaguaacaggagguaucuuuuuauuuuuaaugucagguaaggggauuggaaaaaugacacuggggaugugcuguaucauuacagcuucuauuuuacuuugguacgcacaaauacaaccacacuggaucgcggcaagcauuauacucgaguucuuuuugauugucuuacucaucccagagccugaaaaacaaagaacuccacaggacaaucagcuaacuuacguugucauagcaauacugacgguggucgcugcuacuauggcuaaugaaaugggauuucuagagaaaacuaagaaagaucuaggguuagguucuauagcaacucaagaaagugaaaguaacauuuuagauauagaucuccgaccagcaagugcauggacucuauaugcaguagcaacaacauucguaacaccgauguuacgucacagcauagaaaacucaucagucaacguaagccugaccgcgauagcaaaucaagcgacaguuuugauggggcuaggaaaagguuggccacuaucaaagauggauaucgggguccccuuguuagcaauuggguguuauucacaaguuaauccaauuacgcuaacugccgcacuuuuacuauuaguggcacacuacgcaauuaucggaccugguuuacaggcuaaagcaacuagagaagcgcagaaacgagcagccgcaggaauaaugaaaaauccaacuguugauggaaucacuguaauugacuuagagccuauacccuacgauccaaaauucgaaaaacaacuaggacaaguaaugcugcuaaucuuaugugucacacaaguacugaugaugagaacuacuugggcgcuaugcgaagcauuaacuuuggcaacagggccaaucaguacucucugggaaggcaauccuggacgauuuuggaauacuacuauagcuguuucaauggcuaauauauuucgaggaucauaccuagcaggagcaggacuacuauuuucaauaaugaaaaauaccacaaauacaagaagggggacaggcaauauuggggaaacgcuaggcgagaaauggaaaaguagauuaaaugcguuagggaaauccgaguuucaaauuuauaagaaaagugguauucaagaaguagaccgaacgcuagcaaaagaaggaauaaaaagaggugaaaccgaccaucaugcaguaucaagagguucggccaagcuaaggugguuuguggaaaggaauaugguaacaccagagggcaaagugguugauuuggguugcgggcguggcgguuggucauauuacugugguggucuuaaaaacguaagggaagugaagggucucacaaaagggggaccaggucaugaagaaccaauuccaaugucuaccuacggguggaaucuaguaaggcuacaguccgguguugauguauucuucacaccuccagaaaaaugugauacacuauuaugcgauauaggugaauccucaccuaaucccacgauagaagcggggaggacucuacguguacuaaacuuagucgaaaacugguuaaacaauaauacacaauucuguauaaaaguuuuaaauccuuacaugccuaguguaauagagaaaauggagacuuugcaaagaaaauauggaggagcauuagugagaaauccucugucuagaaauucuacgcaugaaauguauuggguaucuaacgcaacaggaaacauaguaucgaguguaaauaugauuagcagaauguuaauaaacagauucacaaugaaacacaaaaaggcuacguaugaaccagaugucgauuuggggucagggacacguaauauugguauagaaucagagauaccuaaucuagacaucaucgguaaacgaauugagaaaauaaaacaggagcaugagaccucauggcauuacgaccaagaccaccccuacaagacuugggccuaucaugggucuuaugaaacgaaacagacagguagugcaucaucuaugguaaacggcguagugaggcuccucaccaaacccugggauguaguaccaaugguaacacaaauggcuaugacugauacgacaccauuuggucaacagagaguauuuaaggagaagguagacacuagaacacaagagccgaaggagggaacaaagaaacucaugaaaaucacggccgaaugguuguggaaagaacuaggaaagaagaaaacaccaagaauguguaccagggaagaauuuacccggaagguaagaaguaaugcggcauugggugccauauuuacagaugaaaauaaauggaaaagcgcgagagaagcaguagaagauagcagauuuugggaauuaauagauagggaaagaaacuuacacuuagaaggaaaaugugaaacguguguguauaauaugaugggcaaaagagagaaaaaguugggagaguucggaaaagcaaaaggaagucgcgcaauuugguauaugugguuaggugcacguuuccuugaguuugaagcacuuggguuucugaaugaagaucauugguuuucccgaggaaauucguugucuggcguagagggggaagggcuccauagacugggcuacaucuugcgagauguaaguaagaaagagggaggagcuauguacgccgaugacacagcaggaugggauacacgaauuacauuagaggaucucaagaaugaggaaauggucacuaaccacaugaaaggagaacacaagaaacuggcugaggcuauauuuaaacuaacauaccaaaacaaaguaguuaggguccaaagacccacaccacgugguaccguaauggauauuauuucacguagagaccaaaggggaucaggacaaguugggacauaugggcuuaacacauucacaaauauggaagcgcaguuaauaagacaaauggaaggggaagguauauuuaaaucaauacaacaucugaccgucacagaagaaauugcgguacaaaacugguuagcgagaguuggcagagaaagacuuucucguauggcaauaaguggggaugacuguguaguaaagccuuuggacgacagauuugcaagugcgcuaacggcuuuaaacgacaugggcaaagucagaaaggauauccagcagugggagcccucaaggggguggaaugauuggacucaaguaccauucuguagccaucauuuccaugaacugguuaugaaggacggaagagugcucgucguaccuugucgaaaucaagaugaacuuaucggucgagccagaauuagccaaggcgcaggauggagucugaaagaaacugcgugccucggaaaaucuuaugcgcagauguggacucuaauguauuuccaccgacgagaccuucguuuggcugcaaacgcuaucuguucugcgguuccuagucauuggguacccacaucacgaaccacguggucaauacaugcuaagcaugaauggaugacaacagaagacauguuagcugucuggaacagaguuuggauucaagaaaauccuuggauggaagauaaaacuccgguagagucaugggaagaaguuccguauuuaggaaaacgugaggaccaauggugcggaucccugauuggucucacaagccgggcgacaugggccaaaaauauacaaacagcaauaaaucaagucagaucauuaauuggaaaugaggaauauacagauuauaugccaagcaugaaaagguucagacgagaagaagaagaagcuggaguacuaugguga

SEQ ID NO: 22916 - RNA, 9876 nt, Artificial Sequence
  derived and/or modified CDS sequence (opt6) from DENV-2__GQ398285__SS-prME
acagcaggaguuauaauaaugcuaauuccgacugcaauggcguuucacuuaaccacaagaaauggcgaaccgcacaugaucgucgguagacaggagaaaggaaagaguuuacuauucaaaacugaggaugguguaaauauguguacgcuaauggcuauugaccugggggagcugugugaagacacgaucaccuacaaauguccucuacuacgacaaaaugaaccagaggacaucgacugcuggugcaauucaaccucaacaugggucacuuauggaacguguacuacgaccggcgaacaccggagagaaaagcgaucaguagcccuuguaccacacguagguaugggccuugaaacaaggaccgaaacauggaugucgucagaaggcgccuggaaacauguacaacgaauugaaacuuggauauuaagacauccggguuuuacaauuauggcugcaauucuugccuauaccauaggcacaacgcauuuucaaagagccuuaauuuucaucuuauuaacagcaguugcgccaucgaugacuaugcgcuguauagggauaagcaacagagauuuuguggaaggaguaucgggaggguccugggucgacauugugcucgaacauggaaguugugugaccacuauggcgaaaaacaaaccaacacuagacuuugaauuaauaaaaaccgaagcuaaacaaccggcuacccugaggaaauauuguauagaagcuaaacuuacaaauacaacuacagaaucucguuguccuacacaaggagaaccauccuuaaacgaggaacaggauaaacgauuuguauguaagcacucaaugguggaccgcggauggggaaacggaugcggacuguucggaaaagguggaauuguaacaugugcaauguuuaccuguaaaaaaaacauggaagggaaaguaguacugccagagaaccuagaguacacuauaguaauuaccccucauaguggggaagaacacgcugucggaaacgacacaggaaaacauggaaaagagaucaaaaucacuccucaauccuccauuacugaagcagaguugacaggguauggaacaguaacuauggaaugcucgccuagaaugggauuagauuuuaacgagaugguacuuuuacagauggaagauaaagcauggcucguacacaggcagugguucuuagauuuaccauuaccaugguuacccggagcagauacccaagguagcaacuggauccaaaaagaaacucucgucacauucaaaaacccgcacgcaaaaaagcaagauguaguugugcuugggagucaagaaggagcgaugcauaccgcacuaacuggcgccacugaaauacaaaugagcucaggaaacuuauuauucacgggacaucucaagugucgacuucgaauggauaagcuacaacuaaaagguaugucauauagcauguguacaggaaaguucaaaaucguaaaagaaaucgcugaaacacaacauggaaccauuguaauccgcguccaguaugaaggagacggaaguccuuguaaaauaccauucgagauaauggaucuggaaaaacgacauguauuaggacggcucaucacaguuaauccaaucgucacagaaaaagauucgccuguaaacaucgaggcugagccgcccuuuggugauagcuauauaaucauuggaguagaaccgggccaacuaaaacucaauugguuuaaaaaagggagcagcauaggucagauguucgagacuacaaugagaggagcaaagaggauggcaauucucggcgauacagcgugggauuucgguucauuaggugggguuuuuacuaguauugguaaagcgcuacaucaaguauuuggcacuaucuacggagcagccuuuuccggcgugucuuggacuaugaagauccuaauuggaguaauuauaacauggauuggaaugaacagucgcaguacaucuuugucagugucgcuaguucuaguuggggugguuacuuuauaucugggagccaugguacaagcugacucuggguguguugucucauggaaauccaaggaacuaaaaugcggaucugggauuuucaucacagacaacguucacacauggacagaacaguauaaauuccaaccggaguccccgucgaaacuagcaagcgcuauucaaaaagcucacgaagaggguauauguggaauaaggagugucacucgacuugaaaaucucauguggaaacaaauuacuccagaacucaaccauauuuuaucggagaaugaaguuaaacuuaccauuaugacuggcgguauaaaaggcauaaugcaggccggaaaaaggagucucagaccacaaccaacagaacuuaaauauagcuggaagacauggggaaaggcuaaaauguuaaguacggaaagucauaaucaaacuuuuuuaauagacgguccugagacagccgaauguccuaauacaaaucgcgccuggaacucacuagaaguggaagacuauggauuugguguuuuuacaacuaacauauggcuuaaacuacgagaaaaacaagauguuuucugcgauaguaaguugaugagcgccgcgauaaaagacaacagggcaguucaugccgacaugggauacuggauugaaagugcuuugaaugauaccuggaaaauggaaaaagcaaguuuuauagaaguaaaaucgugucauuggccuaagucgcacacauuauggaguaauggaguucuagaaagcgaaaugauuaucccuaagaaucuagcagguccuguaagucagcauaauuaucgcccuggauaucacacccaaaccgcaggaccuuggcaucuugggaaacuugaaauggacuucgacuuuugugagggaaccacuguuguggucaccgaggauugcgguaaccgggguccaucccuacgaacaacuacugcgucagguaaacucgugacagaauggugcugcagaucauguacauuaccccccuugagauacagaggugaagacggauguugguacggaauggaaauuaggccacuaaaagaaaaggaagagaaucucgugaacagucuaguaacugcgggacaugggcagaucgacaacuucagucucgggguauuaggaauggcucuauuucuugaagaaauguuaagaacgcgaguaggaacgaaacaugcaauacuacugguagcgguaucguuuguaacacugauaacuggaaauaugaguuuuagagaccugggcagaguaaugguaaugguuggcgcuaccaugacugaugauauagguauggguguuacuuacuuagcuuuacuagcagcauuuaaaguaaggccuacuuucgccgcgggauuacugcuacgcaaacuuacuaguaaggaauugaugauggcuacgaucgggauagcuuuauuaagccagagcacuauacccgagacuauccucgagcuaacagacgcgcucgccuuaggaaugauggugcuaaagauuguaaggaacauggaaaaauaccaacuugcgguuaccauaauggcuauauccugcguccccaacgcagucauacuacaaaaugcuuggaaagucagcugcacaauacuggcggcggucucaguuuccccauuacuacugacaucaagucaacaaaaggcggacuggauaccacuagcccuaacaauaaaagggcuuaaccccacagcaauauuccuuacuacacuaagcaggacgagcaaaaaaagaaguuggccuuuaaaugaagcgauuauggcgguuggcaugguaaguauacuggcuucuagccuucuaaaaaacgauaucccaaugacagguccacuagucgcaggugggcuauuaaccguauguuauguauugacggguaggucggcagauuuagaauuggaacgugcagcggaugugaagugggaagaucaagcagaaauaaguggcagcaguccaauauuaucaaucacaaucuccgaggauggaagcaugucaauaaagaaugaagaggaagagcaaacuuuaacgauacuaauacgaacagggcuccuaguaauauccggcgucuuucccguaucaauuccaauuacagcggcagccugguaucuaugggaagucaaaaaacagcgugcaggaguguuaugggauguuccuucuccuccucccguugggaaagcugaacucgaagauggugcauaucgaauuaaacaacggggaaucuuaggauauucucaaaucggggccggcguuuauaaggagggaacauuucacaccauguggcauguuacuagaggugcgguccuaaugcacaggggaaaaagaauagaaccuucgugggcugauguuaaaaaagaucucauuaguuaugguggcgguuggaagcucgaaggugaauggaaagaaggagaagaaguacaagugcuugcuuuagaaccaggcaaaaauccgcgcgcaguccaaaccaaacccggauuauucaaaacaaacacugguacgauaggggccguuucgcuggauuucucaccagggacuaguggcucuccaauaguggaucgaaagggcaaaguugucgggcuguauggaaauggaguaguaacacguaguggcgccuauguaucagcaaucgcacagacagaaaaaaguauagaagacaauccagagauugaggaugauauuuuccgaaaaaagcgacuaacaaucauggauuugcauccaggagccggaaaaacuaagcguuaucuaccagcaaucgugagagaggcaaucaaaagaggguugagaacccuaauauuagcgccaacucgaguaguagcugcugaaauggaggaggcucuacgaggacuaccuauucguuaucaaacgccagcgauacgugcugagcauacugggcgugaaaucguugauuuaaugugucaugcaacauuuacuaugagauuacuaaguccaguucggguuccaaauuauaacuugauuauuauggaugaggcccauuuuacagauccagcuucuauagcagcaagaggauauauaagcacaagaguagagaugggugaagcagcuggaauauuuaugacugcaacaccacccggcagccgagauccauucccucaaaguaacgcaccuauuauggacgaagagagggaaauuccugaaagaaguuggaacucaggccaugaguggguaacagauuuuaaagguaagacgguaugguuuguuccaucaauuaaggcugguaaugacaucgccgcaugcuugcguaaaaacgguaaaaaaguaauccaacuaucacgaaaaaccuuugauagcgaauacguuaaaacucgcgcuaacgacugggacuucgucguaacuacugacaucagcgagaugggcgccaacuucaaagccgaaagaguaauagaucccagaagguguaugaagcccguaauacuaacggauggagaggaacgaguaauucuggcaggcccaaugccaguuacgcauucgagugcugcccaaagacgaggaaggauuggacguaacccaaaaaaugaaaacgaccaguauauauauaugggcgagccacuugaaaaugaugaggacugcgcacauuggaaggaagcuaaaaugcuguuagauaacauuaauacgccugagggaauaauaccgagcauguuugagccagaacgggaaaaaguggaugcuaucgauggugaauaucgccugagaggagaggcacguaagacuuuuguagaucucaugcgccgaggcgaccuaccaguaugguuagcuuacagagucgcugcugagggaauaaacuaugcugaucgaagauggugcuuugacggaauuaagaauaaucaaauccuggaagaaaacguagaaguagaaauauggaccaaagaaggugaacgcaaaaaauuaaaaccucgcugguuagaugcacgaauauauuccgacccauuggcuuuaaaggaguucaaagaauucgcagcgggucguaaaucuuuaacauugaauuuaauaacggaaaugggaagguuaccaacguuuaugacacaaaaagccagaaacgcacuagauaauuuagcaguacugcauacagcagaagcgggugguagggcauauaaccaugcauuaucggaauugccugaaacacuagagacgcucuuauuacugacccuauuggcaacuguuacaggcgguauuuucuuauuucuaaugucaggcaaaggcauaggcaaaaugacacuaggaaugugcuguauaauaacggcuuccauuuuauugugguaugcccaaauucaaccucauuggauagcagcuaguaucauacucgaauuuuuucugauagucuuauuaaucccagaaccagaaaaacaaaggacaccacaggauaaucaauugacguauguggucauagcaauuuuaaccguuguggcugcuacuauggcuaacgaaaugggauuucucgaaaaaacaaaaaaagaccuaggguuggguuccaucaccacacaagaaucagaaucaaauauccucgacauagaucuucgcccugccucagccuggacucucuaugcaguagccacgacauucguaacuccaauguugagacauuccauagaaaacaguucuguuaacguaucucuuacagcuauagcaaaccaagccacaguacucaugggucuagguaagggauggccucucucgaaaauggauauagguguuccauuacuagcgauuggauguuauagccaaguaaauccgauaacccuaacagccgcguuacuccuccuuguggcucauuacgcuaucauaggaccuggcuuacaggcaaaagcgaccagagaagcacaaaaaagagcggcugcaggaauaaugaagaauccuacaguugauggaauaacaguuaucgauuuagaaccuaucccguaugacccaaaguucgagaaacaauugggucaaguaaugcuucuaauacugugcguaacacaaguguuaaugaugcguacaacuugggcucuaugugaagcgcuaacccucgcaacuggaccuauaagcacacuaugggaaggaaauccuggacgauucuggaacacaacuauagcaguaucaauggcaaacauuuuucgugguucguaccuagcuggugcaggccuacuauuuucaauaaugaagaacacgacaaauaccaggagagguacagggaauauaggagaaacucucggcgagaaguggaaaucuagauugaacgcgcucggcaagucagaguuccaaaucuauaagaaaagcggaauucaggaagucgaccgaacacuugcaaaggaggguaucaaaagaggggaaacagaucaccacgcugucagucggggaagugcgaagcuucgaugguucgucgagagaaacaugguaacuccugaggggaaaguaguugaucuaggcugcggcagaggaggaugguccuauuauuguggaggucucaaaaaugucagagagguuaaaggccuuacaaaaggagggccuggacaugaagaacccauuccuaugagcaccuauggguggaaccuugugcgacuacaaaguggugucgacguauucuuuacaccgcccgaaaagugcgauacgcugcuuugugauauuggagaaucgaguccaaaucccacuaucgaagcuggccgaacacuaagaguacugaauuuaguagaaaacugguuaaauaauaacacucaauucuguauaaaggugcuaaaucccuacaugccaagcguuauagagaaaauggaaacucuucaaagaaaguaugggggagcauugguuaggaacccauuaucgcggaacaguacucaugagauguacugggugucaaacgcaacaggaaauauagucucaucugucaacaugauaucuagaauguuaauuaaucgauuuacuaugaaacauaaaaaagcgacauacgagccagauguagaucuggggagcgggacgcgaaacauagggauagaaagugaaaucccaaauuuggauauaauuggaaagcgaauagaaaaaaucaagcaagaacacgagacgucuuggcauuacgaccaagaccauccguauaaaacaugggcguaccauggaucuuacgaaaccaagcaaacaggaucugccucaagcauggugaacggggugguucgucuauuaaccaaaccaugggacguuguaccaauggugacacagauggcuaugacagacacaacgccauuuggucaacagcguguauucaaggagaaaguagauacgaggacacaggaacccaaagaaggaacaaaaaaacugaugaagauaacagcagaauggcuauggaaagaacuuggaaaagaaaaaacaccaagaaugugcacaagggaagaguucgcacguaaaguacgcucuaaugcggcacucggggcgaucuuuacggacgaaaacaaauggaaaagugcuagggaagcuguggaagauaguagauucugggaacucauugaucgugagcgaaaucuacaucuagaggggaaaugugagacauguguuuauaauaugaugggaaaaagagagaaaaaauugggagaguuuggaaaggcgaaaggcucuagggcuaucugguacaugugguuaggagcuagauucuuggaauuugaggcauuaggauucuuaaaugaggaucauugguuuucuagagaaaacagccuauccggcguagaaggagagggacuucaccgucuugguuauauauuaagagauguuaguaagaaggaaggaggagcaauguaugccgacgauacugcgggcugggauacgaggauuacccuagaagauuuaaaaaacgaagaaaugguaacgaaucauaugaaaggcgaacacaaaaaauuagcagaagcaauuuuuaaguuaacauaucaaaauaaagugguaaggguacaacguccaacuccuagagguacgguuauggacauuaucagucgaagagaucaaagaggaucaggccaagugggaacauauggacugaacacguuuaccaacauggaagcccaacugauucgucaaauggagggagagggaauauuuaaaucgauacaacacuuaacagcaacugaagaaaucgcgguacaaaauugguuagcaagaguuggacgcgaaagauugucucgcauggccauaucaggagaugauugcguugucaagccuuuagaugauagauuugcaucugcccuuacugcucuaaaugauaugggcaagguacgaaaagacauacagcagugggaaccuucccggggcuggaacgacuggacucaggucccauucuguucacaucacuuccaugaacuagugaugaaagauggaaggguacuaguuguuccauguagaaaccaagacgaauugaucgggagagcaagaauuucccagggugcagguuggucuuuaaaggagacggcauguuuagguaaaaguuacgcccaaauguggacucugauguauuuucauagaagagaccuucgguuagcugcaaaugcuauuuguuccgcuguaccuagccacugggugccuacaucaagaaccacuuggucaauacaugccaaacacgaauggaugacgacggaggacaugcuagcaguauggaauagaguauggauucaggaaaauccguggauggaagauaagacaccaguagaaagcugggaagaaguaccauauuuagguaaaagggaagaucaaugguguggaucucugauaggauuaacuucgagagcaacaugggcuaaaaauauccagaccgcaauaaaccaaguacgaucgcuaauugggaacgaagaguacacggauuacaugccgagcaugaagagauucagacgagaggaagaagaagcaggaguguuaugguag

SEQ ID NO: 22917 - RNA, 9876 nt, Artificial Sequence
  derived and/or modified CDS sequence (opt6) from DENV-2__GQ398298__SS-prME
acagcggggguuauaauuauguuaaucccaacagcaauggcuuuccaucuaaccacacggaacggugaaccgcauaugauaguaggaagacaagaaaaaggaaaaucacuuuuauuuaaaacugaagacggaguaaauaugugcacacuuauggcgaucgaucuuggagaacuuugugaagauacaaucacuuacaaauguccacucuuacgacaaaaugaaccugaagauauugacuguugguguaacucaaccuccacguggguaacauacggaaccuguacgacaacuggugaacacagaagagagaaacgaaguguggcacuugugccccacguuggaaugggucuagaaacgcgaacugaaacuuggaugaguucagaaggagcauggaaacauguacagagaauagagaccuggauauugagacauccugguuucacuauaauggcggcaauauuagcuuauacuauugggacuacacacuuucaacgagcacuaauauuuauauuguugacagcaguugcuccuucaaugacaaugagauguaucgguauaaguaauagagacuuuguagaaggggugucgggaggauccuggguagauauuguacuugagcauggguccugcguaacaaccauggcgaaaaauaaaccaacuuuagacuuugagcuaauaaaaacggaagccaaacagccugcaacgcuacgaaaauacuguaucgaagcgaaacuaacaaauaccacaaccgaaucuagauguccaacacagggagaaccgaguuuaaacgaagaacaggauaaacguuuuguauguaaacauucgaugguugaucgaggauggggaaauggauguggcuuauuuggaaaaggugggauugugaccugugcaauguucacuugcaagaaaaauauggaagggaaaguaguauuacccgaaaauuuagaguacacuauaguaauuacaccacacucaggagaggaacacgcuguaggaaacgauaccgguaaacaugguaaagaaauaaaaauaacgccacaaucaucaauaacggaagcugaacuaacuggguaugguacaguuacgauggaauguagcccuagaacaggacuugauuuuaacgaaaugguuuuacuacaaauggaggauaaagccugguuaguucacaggcaaugguuuuuagaccuuccucuaccuugguuaccuggcgcggauacgcaaggaucgaacuggauacaaaaagaaaccuugguaacuuuuaaaaauccacacgccaagaaacaggacguaguuguacuaggaagucaagagggggccaugcauaccgcccugacgggagcaaccgagauucaaauguccucagggaauuuauuauuuacgggucaccugaaaugccgauuaagaauggauaaauuacagcugaaaggaaugucguauaguauguguaccgggaaauuuaaaaucguaaaagagauagccgaaacacaacaugguacuaucguaaucagaguacaauaugagggagacggaucgcccuguaagaucccguucgaaauuauggacuuagagaagagacauguucuaggaaggcuuauaacuguaaaucccauaguagcagagaaagacucgcccguaaacauagaggcugaaccucccuuuggagauaguuacaucauuauaggaguagagccuggucaguuaaaacuuaauugguucaagaaagguagcuccauaggacaaauguuugagacuaccaugcgaggagccaaacggauggcgauccugggagacacugccugggauuuuggaucucuaggggguguuuuuacaucaaucgguaaagcacuacaucaaguauucggagcuaucuauggagcagcuuucucaggagucucuuggacuaugaaaaucuugauaggggugauaauaacauggauaggaaugaauagcagaaguacaucucuaucgguaucgcucgugcuaguuggaguuguuacauuauauuuaggggcaaugguccaggccgauagcggguguguaguuagcuggaaguccaaagaauuaaaauguggaaguggaauuuuuaucacugauaacguucauacuuggacagaacaauacaaauuucagccagaaucacccucgaaacuagccagugcaauccagaaagcucacgaagaaggaauauguggaauaagaucggucacccgauuggaaaaucuaauguggaaacaaauaaccccagaguuaaaccauauuuugagcgaaaaugaaguaaaacuaaccauuaugacaggggauauaaaagggauuaugcaagcagggaaaagaucauuaagaccacagccgacagaauuaaaauacagcuggaaaacauggggaaaagcaaaaaugcuuagcacugaaucacauaaccaaacuuuucuaauugacgggccugaaaccgccgaaugccccaauacaaauagagcguggaacucuuuagaaguagaggacuacgguuuuggaguuuucacuacaaauauuugguuaaagcuacgagagaaacaagauguguucugugacuccaaacuuaugucggcugcgauuaaagauaaccgugcgguccaugcugacaugggauacuggauagaaucagcccuaaacgauacauggaagauggaaaaagcgucauucauugaagucaaaaguugccauuggcccaaaagccacacauuauggagcaacggcguacucgagucagaaaugauaauaccuaaaaacuuugcuggaccagucucacagcacaacuauagaccaggauaucacacacagacagcagggcccuggcaucuagggaaauuagaaauggauuucgacuucugcgaaggaacaacaguuguuguuacugaagauugcgggaauaggggaccgagcuugcgaacuacaacggcuuccggaaaacuaauaaccgaaugguguuguagauccugcacuuuaccuccucuacgcuauagaggcgaggauggaugcugguaugggauggaaaucaggccccuaaaagagaaggaggagaaucuagugaacagcuugguuacggcaggucauggacaaauagauaacuuuucgcuaggguuacuaggcauggcauuauuuuuagaggaaaugcuacgaacccggguagggacuaaacaugcaaugcuucuagucguugucagcuuuguuacucuaauuaccggaaauaugagcuucagagauuuaggacgagugaugguuauggucggugcuacgaugacagacgacauuggaaugggaaucacauaccuggcauuacuagcagcuuuuaaaguuagaccaacuuucgcagcaggacuccuuuugagaaaauuaacaucaaaagaauuaaugauggcuacaauaggaauugcguugcuaucucaaaguacuauucccgaaacaauuuuagaacucacagaugccuuagcacucggaaugaugguguuaaaaauuguacgaaacauggagaaguaccagcuagcggugacaauuauggcaauuaguugcguaccuaacgcgguaauacuucaaaacgcauggaaagugucuuguaccauuuuggcugcuguaucgguaucuccacugcuucuaacgucuagccagcaaaaagcagacuggauaccacuagcuuugacaauuaaaggauugaaccccacugcuauauuccugacuacuuuaucacgaacaucaaagaagcgcucuuggccgcuaaacgaagcuauaauggcgguugggauggucagcauacuugccucuagccuacugaaaaaugacauuccuaugaccggccccuuaguggcgggaggucuucucaccguuuguuauguauuaaccgguagaucugccgauuuagaauuggaacgagcugccgacguuaaaugggaagaccaagcagaaauaucgggaucauccccgauucuaagcauuacgauaagugaagauggcaguauguccaucaaaaaugaagaagaagaacagacauuaaccauauuaauaagaacggggcuacucguaauaagcgguguguuuccgguuucgauuccaauuacugccgcggcuugguaucucugggaagucaagaaacaaagagcagggguacuaugggacgugccaucaccgccaccaguugggaaagcggagcuagaggacggcgcuuaccguauaaaacaacgaggcauacuaggcuauucgcaaauaggcgcgggaguuuacaaagaaggaacauuucacacuauguggcacguaacaaggggcgcaguacucaugcauagaggaaaaagaauagaacccucaugggcugauauaaagaaagauuuaauauccuauggagguggguggaaacuugaaggcgaauggaaggaaggagaggagguacagguacuagcacuagagccuggcaaaaauccuagagcaguccagaccaaaccuggacuguuuaagacaaauacagguacaauuggagcgguaaguuuagauuuuucgcccggcacaucaggaaguccuauaguugauagaaaaggaaaagucguaggcuuauacggaaauggaguaguaacucguucuggagcuuauguauccgcuaucgcccaaacagaaaaaucaaucgaagacaacccagaaauugaggaugacauauuuaggaagaaacgauuaacgauuauggaucuucauccgggagcagguaagaccaagagguauuuaccggcgauaguucgugaagcaauuaaacgaggccuaaggacucuuauccuagcacccacacgcguugucgcggcagaaauggaagaagcacuaagaggccucccuauacgguaccaaacuccagcuauucgggccgagcauacagguagagagauuguagaucugaugugccaugcgacauucacaaugagauuauuaucaccugucagaguuccaaauuauaauuugaucauuauggaugaagcucacuuuaccgacccugcaucgauagccgccaggggauacauaucaacacgagucgaaaugggugaggcugcaggcauauucaugacagcuaccccgcccggaucacgugauccuuuuccgcaauccaacgcgccgauaauggaugaagagagagaaauacccgaaagaaguuggaauaguggucacgaauggguaacagauuucaaggguaagacaguaugguuuguacccucuaucaaggccgggaacgacaucgcugcaugcuugcguaaaaauggcaagaaagugauccaacugucuagaaagacuuucgacagugaauauguaaaaacacgagcaaaugacugggauuucguuguuacaacagacauuagugagaugggcgcaaauuuuaaagcugaacgcguaauagauccgcgaaggugcaugaaaccgguaauauugacggauggggaagaacguguaauuuuagcgggccccaugccagucacacacucuucagcagcccaacggcgugguagaauuggacgaaauccuaaaaacgaaaaugaucaauauaucuauaugggggaaccccuagagaaugaugaagacugcgcucacuggaaagaagcuaaaauguuacuagacaacauaaacacuccagaaggaaucauccccucaauguucgagccagaaagagagaaagucgaugcuauagauggugaauauagguuaagaggcgaagcaagaaaaacauuuguagaccucaugcggcgaggagaucucccgguguggcuggcauauagaguugcagccgaagggauaaauuaugcggaucgaagaugguguuuugauggcauaagaaauaaucaaauauuggaggaaaacgucgaaguugagaucuggacuaaggaaggcgaaagaaagaaauugaaaccaagguggcuggaugcaagaauuuacagugauccacuggcguuaaaagaguucaaagaguucgcugcaggaagaaaaucauuaacgcuaaaccucauaacagaaaugggacgauuaccaacauucaugacacaaaaagcaagggaugcauuagauaauuuagccguccuccauaccgcugaagcuggcgguagagcuuauaaccacgcauuaagcgagcugcccgagacacuagaaacuuuacucuugcuuacauuacuagcgacgguaaccggaggaauuuuccuuuuucuaaugagcggaaaaggaaucgguaagaugacccuaggcaugugcuguaucauaacagcgagcauucuccugugguaugcccagauucaaccacacuggaucgcagcaucaauaauacuagaguucuuuuugauaguacugcuaauaccggaaccugaaaaacaacgaacaccacaagauaaccaguuaacauauguagugaucgcuauuuugacugucguagccgcaacgauggcgaaugaaaugggguucuuagagaaaacuaagaaagacuugggacucggcucuaucgcaacgcaggagagugaaucaaacaucuuagauauagaucuaagaccagcaagugcuuggacacuauaugcgguugcuacuaccuuuguaacaccaaugcucagacauucuauagagaacucaagcguaaauguaagccucaccgcaauugcaaaucaagcaacaguucuaauggguuuggggaaagguuggccacuauccaaaauggauauuggaguaccucuuuuagcaauaggauguuauucucaaguaaauccuauuaccuuaacugcugcucuauuauugcuggucgcgcacuacgcaauaauaggaccuggacuacaggcaaaagcgacaagggaagcccaaaaacgggcugcugcuggaauaaugaaaaauccuacaguagacggaaucacuguaauagaucuagagcccauccccuacgacccaaaguucgaaaaacaacuaggacaggugauguuauugauauuguguguaacacaaguauuaaugaugagaacuacuugggcacuuugugaggcuuugacccuugcuacaggucccaucucaacacuaugggaaggaaauccgggacgcuucuggaauacuaccauagccguaagcauggccaacauuuuuagagguucuuaucuugcgggagcuggacuucuauuuucuauaaugaagaacaccacgaauacaagaagagguacaggcaacauuggugagacacugggagaaaaauggaagagucgguuaaacgcacuuggcaagucagaguuccaaauuuauaagaagucagguauacaagaaguugacaggaccuuggcaaaagagggaauuaaacgaggcgaaacugaucaucaugcaguaagucgaggaagugcaaaacuaagaugguucgucgaaagaaacauggucacuccggaggguaaagugguagacuuagggugcgguagagggggaugguccuacuauugcggagggcucaagaacguacgggaagugaaaggacuaacaaagggugguccaggccacgaggaacccauuccuaugagcacauaugguuggaauuugguuagacugcagagcggcguugauguauucuucacaccgcccgaaaaaugugacacccuauuaugugacauuggggaaucaagcccaaacccaacaauagaagcuggucgaacauuaagagugcucaauuugguagagaauuggcuaaacaauaauacgcaguucuguauaaaaguacuaaauccauacaugccaagcgugauagagaaaauggaaacacugcaaaggaaauacgguggagcccuuguacgaaauccgcuaucacguaacaguacacaugagauguauuggguaaguaacgcaacagguaauauaguaucaaguguaaacaugauaucgcguauguuaauaaaucgauucacaaugaagcauaagaaagcuacauaugaaccagacguagauuuggguagcggaacucgcaacauaggaauugaaucugaaaucccgaacuuagacauaauaggaaaaaggauagagaaaauaaaacaagaacaugaaacaagcuggcacuacgaccaagaccacccauacaaaacgugggcuuaccacggaucuuaugaaacuaaacaaacaggaucagcuuccucuaugguaaacgggguuguuagauuauuaacaaagccaugggauguaguaccaaugguuacccaaauggcuaugacugauaccacacccuuuggacagcaacgcguguuuaaagaaaaaguagacacgagaacucaagaaccuaaggaagguacuaagaaauuaaugaagauaaccgccgaaugguuauggaaggaacucgguaagaagaaaacaccaagaauguguacuagagaagaauuuacgaggaaaguccggaguaacgccgcucuaggagcaauauuuacggacgaaaauaaauggaaaagugcuagggaagcaguugaagacagucgcuucugggaacuuauagauagggaaagaaaccuacaccuggaaggaaaaugcgaaaccugcguauacaacaugaugggaaaacgugagaagaaacugggggaguucggaaaagcuaaaggcucaagagcaauuugguacauguggcucggcgccagguuccuugaguucgaagcgcuaggauuucugaacgaagaccacugguuuucuagaggaaauucucuauccgguguugaaggcgaaggacuacauaggcuugguuauauuuuacgagauguaucgaagaaagaaggaggagccauguaugcggacgauacggcaggcugggacacuaggauaacauuagaagaucucaaaaaugaggagaugguaacgaaucauaugaaaggugaacauaagaaauuggcugaagcaauauuuaaacuuaccuaucaaaauaaaguagugcgaguucaaagaccgacgcccaggggcacagucauggauaucaucucaagacgcgaccagagggggaguggucaagucggcacuuaugguuuaaacacauucacuaauauggaagcgcaguugaucaggcaaauggaaggagaagggauuuuuaaaucaauucaacauuugaccgugaccgaagagauugcgguccaaaauuggcuggccagaguaggcagagaaagauuaagucguauggcaauaagcggagaugauuguguugugaaaccccuugaugacagguucgcuucagcucuuacagcguuaaacgacaugggaaagguuaggaaagacauacagcaaugggaacccagucggggcuggaacgauuggacgcaaguuccuuucuguucucaccauuuucaugaguuggucaugaaagauggucguguauuaguaguuccaugccgaaaccaggaugaauuaauagguagggcaaggauuucacaaggggcaggauggucauuaaaagagaccgcaugccuaggaaaaucauaugcacaaauguggacauuaauguacuuccaccgacgggauuuacgccuagcugcaaacgcaauauguuccgcugucccgucacacuggguaccaacuucgagaacuacuuggaguauacacgccaaacaugaguggaugaccacugaagacauguuagcaguguggaauagaguauggauacaggaaaauccauggauggaagauaagacucccguugaaaguugggaagaaguaccguauuuagguaaaagagaagaucagugguguggaaguuuaaucggccucacuucacgugcgacgugggcaaagaauauucaaaccgcaauuaaccagguacggagccucauaggaaaugaagaauacacugacuacaugccuagcaugaaaagauuccguagagaagaagaagaagcaggagucuuaugguag

SEQ ID NO: 22918 - RNA, 9876 nt, Artificial Sequence
  derived and/or modified CDS sequence (opt6) from DENV-2__GQ398301__SS-prME
acugcaggaguaauaauuaugcuaauaccuacggcuauggcuuuucauuuaacgacuagaaacggcgaaccacacaugauaguaggaagacaagaaaaaggaaaauccuuacuuuuuaaaaccgaagauggcguuaacauguguacuuuaauggcuauagaucuuggagaacuuugugaagauaccauaacuuauaaauguccacuacuucgucagaaugaacccgaagacauagauuguugguguaacucgacaagcaccuggguaacguauggaaccuguacuacaacgggcgaacauagacgcgagaaaagauccguagcacugguaccucauguaggaaugggauuagaaacuagaacugaaacuuggaugucauccgaaggggcauggaaacacguacaacgaauugaaacauggauacugcgucacccaggcuuuacaauuauggcagcuauuuuggcuuauacaauagguaccacacauuuccaaagggcucucauuuucauacuacugacagcuguugcaccaucaaugacuaugagaugcauuggaauaucaaacagagauuuuguggaaggcgucucaggaggcaguuggguugauauagugcuugaacauggaagcugugugacuacaauggccaaaaauaaaccaacauuggauuuugaauugauaaaaacagaagcgaaacagccugcuacacuacguaaauacuguauagaagcgaaauuaacuaacacaacgacggaaaguagauguccuacacaaggugaaccgucuuuaaacgaagaacaggauaaaagauuugucuguaaacauaguaugguagaucgaggauggggaaaugguugcggacucuucggcaaaggagguauaguaacaugugcaauguuuaccugcaagaaaaauauggaagguaaaguggucuuaccugaaaaucuugaauacaccauagugauaacaccccacagcggugaagaacaugcaguugggaaugauacaggcaaacauggcaaagaaauuaaaauaacgccacaaaguucaaucacggaagcugaacuaacgggguauggaaccgugacaauggaaugcagcccacguacuggucuugacuuuaacgagaugguacuucuacaaauggaagacaaagcgugguuaguacaucgucaaugguuuuuggaucucccauuacccuggcugccuggugcugauacacaaggaucaaacuggauccagaaagaaaccuuaguaacuuucaaaaauccccacgcaaagaaacaagauguuguggugcuugguagucaggaaggagcaaugcacacagcuuugacaggugcaacagaaauccaaaugagcucaggcaaucuucuauucacaggacaucuuaaaugucgucuuagaauggacaaacuacagcuuaaagggaugaguuauucaaugugcacaggaaaauucaaaaucgugaaagaaauugcggagacacaacauggaacuauagucauacggguacaguaugagggagacggaagcccuugcaaaauaccuuucgaaaucauggaucuugagaaaagacauguucuuggaagguugauaacuguaaauccuaucguagccgaaaaggacucgccaguuaauaucgaagcagagccgccauuuggagauucguauauaauaauuggcguugaacccgggcaguuaaaacucaauugguucaaaaagggaagcucaaucggacaaauguucgaaacaacaaugagaggugcgaaaagaauggcuauauuaggagauacagcuugggacuucggaagucuaggagguguuuuuaccucgauaggaaaagcacuccaccaaguauuuggcgcgauauacggugccgcauucaguggaguaucauggacaaugaaaauauuaauagguguuauaauaaccuggauaggaaugaauaguagaucaacuagccugagugugucauugguccuaguagguguaguaacacuauaucuuggggcaaugguacaagcagauagugguugcguuguuaguuggaaaucaaaagaacuaaaauguggaucagggauauucauaacagauaauguacacacauggacugagcaauacaaauuucaacccgaaucaccuucuaaacuagcuuccgcaauucaaaaggcgcaugaagaagguauuuguggaauacgaucaguaacacgauuggaaaaccuuauguggaaacaaauaacuccagaauugaaccacauacugagugagaaugaagucaaauuaacuaucaugacuggagacauaaaaggcauaaugcaagcaggaaaacgaagccuuagaccacaaccaacugaacuuaaauacaguuggaaaacguggggaaaagcaaaaaugcugaguacagaaucacauaaucagacuuuccugauagacggaccagaaacagcugagugccccaauacgaauagagcguggaacuccuuagaaguagaagauuauggcuucggaguuuucacaacaaacauuuggcuaaaacuaagagaaaaacaggauguuuucugugauagcaaguuaaugucagcagccauaaaggauaaucgagcaguccacgcagauaugggcuauuggauagagucugcccuuaacgacacauggaagauggaaaaggcaucuuuuauugaagugaaaaguugucacuggccgaaaagccauacuuuauggucaaaugggguguuggaguccgaaaugauuaucccuaaaaauuuugcgggacccguaucccagcauaauuauagaccuggauaucauacccaaacagcugguccauggcaccuaggaaaacuugaaauggacuucgauuuuugugaaggaacaacaguuguugugacagaagacugcggaaaccgaggacccucgcuuaggacaacuacugcaucagggaagcuaauuacagaaugguguuguagaaguuguacauuaccaccccuaagguaccgaggugaagacggauguugguacggaauggaaauccgaccauugaaagagaaagaagaaaacuuaguaaacucauuaguuaccgccggacacgggcagauugauaauuuuagucuaggcguuuuaggaauggcacuuuuucuagaggagauguugcgaacccgcguaggaaccaagcaugccaugcuccuaguugcggcaaguuucguaacacuaauaacaggaaacaugucauucagagacuuggguagaguaaugguaauggugggcgcaacaaugacggaugauaucgguaugggaauaacauauuuggcacuguuagcugccuucaaagugagaccuacuuuugcagccgggcuauuauuacggaaguuaaccuccaaagagcugaugauggccaccaucggaaucgcucuacucagucaaaguacaaucccagaaacaauucucgaacucacagaugcauuagcacucggaaugaugguguugaagaucguacgcaauauggaaaaguaucaacuagccguaaccauaauggcuauuuccugcgugccaaaugcugucauauugcagaaugcauggaaaguaagcuguacaauuuuagcagccgugaguguaucuccauuguuauuaacaucaucgcaacagaaagcugacuggauuccauuggcuuuaacgauaaaaggccuuaauccuacagccauauuuuuaacaacccuuaguagaaccagcaagaaaagaaguuggccauuaaacgaagcgauaauggcaguuggaauggucucuauuuuagcaagcucccuacucaaaaacgacauaccuaugacuggaccacuugucgccggaggguuacuuacagucuguuacguauuaacuggacguucagcagacuuagaguuagaaagagcugccgauguaaaaugggaagaucaagcugaaauaagcgggucuucaccaauacuuucaauuaccauuucugaggauggcuccaugaguaucaaaaacgaagaagaggaacagaccuuaacaauucugauucgaaccgggcuauuggugauaagcggggucuuuccaguaucuauaccaauaaccgcugcugcuugguaucuuugggaagucaagaaacaacgugcaggagucuugugggauguuccuucaccaccucccguugggaaagcugaguuagaagauggcgcauauagaauuaaacaacgaggcauucuaggauauagccaaauuggcgcugguguguauaaagaagguacauuccacacgauguggcauguaacuagaggagcgguccuuaugcacagagggaagcgaauugaacccucgugggcggauguuaaaaaggaccuuauuagcuacgggggcgguuggaaacuagagggggaauggaaagagggagaggaaguacaaguuuuggcacucgaaccaggcaagaacccaagagcaguacaaacuaaaccuggucucuuuaaaacuaacacaggcacaauaggggcgguaucucuagacuuuucuccagggacaucuggaucgccaauaguagauaggaaagggaaaguggucgguuuguauggaaaugguguaguuacgagaucaggugcauauguuucagccaucgcgcagacugaaaaaucaauagaggauaauccggaaauagaggaugauauuuuccguaaaaagcgauuaacaauaauggauuugcauccaggagccggaaagacaaagagauauuugccagcuaucguacgagaggcgauuaaaagaggcuugcgaacucuaauucuugcgccaacccgugucguagcugcagagauggaagaagcauuaagagguuuacccauaagauaccaaacaccggcuauaagagcagagcauacuggccgagaaauaguugaucucaugugucacgcgacuuuuacaaugagauuauuaagcccuguucguguaccgaacuauaaccugauaaucauggaugaagcucacuuuaccgacccagccucaauugcagcucgcggcuacaucucaacacgaguugaaaugggggaggcagccgguauauuuaugacagcgaccccucccggaaguagagauccauucccucaguccaacgcgccuaucauggaugaggaacgagaaaucccugagagguccuggaacucaggacaugaguggguaacugauuuuaaaggaaagacuguuugguuuguuccuaguauaaaagcagguaacgacaucgcagcuugucuaaggaagaacgggaagaagguuauacaguugucaaggaaaaccuucgauuccgaauaugucaagacgagggcaaaugauugggauuuuguaguaacaacagacaucagcgaaaugggugcuaacuucaaagcagaacgcgugauagauccacgacgaugcaugaaaccaguuauauuaacggacggcgaagaacgagugauauuggcuggcccgaugccaguaacacauucaucagccgcacagcguagggggcggaucgguagaaacccuaaaaaugagaacgaccaguacauauacaugggagagccguuagagaaugaugaagauugcgcucauuggaaagaagccaaaaugcuacuagauaacauuaauacgccugaagggauuauaccaucgauguuugagccagaaagagaaaaaguagaugcaauugauggagaauaccgucuaagaggugaagcaaggaaaaccuuuguugauuugaugcgacgcggugaccuccccguauggcuagccuauagaguagcagccgaagguauaaauuaugcugacaggagauggugcuucgacggaaucaaaaacaaucaaauauuggaagaaaacguagagguugaaauauggacaaaggagggagaaaggaagaaacuaaaaccaagaugguuggacgcacgaaucuacagcgauccacuagcacugaaggaguucaaagaauuugcagcggggcguaaaagccucaccuuaaaucucauuaccgaaaugggacgacuuccgaccuuuaugacacaaaaggcccgagaugcauuagacaauuuagccguauuacacaccgcugaagcgggugggcgagcauacaaccaugcguugucugaacuuccugaaacgcuggaaacacuauuguuauuaacuuuguuagcaacagucacggguggcauauucuuguuuuuaaugagugggaaagguauagguaagaugacgcugggcauguguuguauaauaacugccucaaucuugcuuugguacgcucaaauucaaccacacuggauagcagcuaguauaauuuuagaguucuucuuaaucguacucuuaauuccagaaccugaaaagcaacgaacgccacaagacaaccaauuaacuuacguaguaauugcuauacuaacagucguagcagcgacaauggcuaaugaaaugggguuucuugagaaaaccaagaaagauuugggccuaggaucuauugcuacccaggaaagugaaaguaauauacuagacauagaucuacgaccagcgagcgcuuggacgcuuuacgcaguagcuaccacauuugugacuccaauguuacgacacuccauugaaaauaguucaguaaaugucagucuuacggcuauugcaaaucaagcuacggugcugaugggguuagggaaaggguggccacuuagcaagauggacauuggcguaccgcugcuagcuauagggugcuauagucaagucaacccuaucacgcuaacugcugccuugcuauuauuaguagcacauuacgcaaucaucgggccagguuugcaagcaaaagccacucgagaagcacagaaacgugcggcagccgguaucaugaagaacccaaccguggacgggauaacaguaauagaucuagaaccuauuccauaugauccuaaauucgaaaaacaauugggucaaguaauguugcuuauucuuugcgugacucaaguauuaaugaugagaacaacaugggcauuaugcgaagcacugacauuagcgacagggccuauaucaacuuuaugggaaggaaaccccgggcgguucuggaacacgacgauugccguuagcauggcgaauauuuuucgagggucauauuuggccggugcaggauuauuguuuaguauaaugaaaaacaccacuaacacuaggagaggaacagguaauauuggcgaaacucuaggugaaaaauggaaaucgagauuaaaugcucucgguaaaucagaguuucaaauauauaagaaaucugggauucaagaaguugacaggacucuagcuaaagaaggcauaaaaagaggggaaacagaucaucacgcaguaaguagagggucagcaaaauugagaugguucguggagagaaacaugguaacaccugaagguaaaguggucgaccuaggauguggcagaggggguuggaguuauuauugugguggucucaaaaauguccgagaagugaaagguuuaaccaaaggcgggccaggucaugaagaacccauuccaaugucaacauacggauggaaucuugugcguuuacaaucaggaguagacguauuuuucacuccaccugaaaagugugauacacuacucugugauauuggagagucgagcccaaacccgacaaucgaagcggguaggacucuaagagucuuaaauuuaguagaaaauugguuaaauaauaacacacaauuuuguauuaaaguauugaauccauauaugccuaguguaauagagaaaauggaaacacuacaacgaaaauacggaggugccuuaguaagaaacccccucuccaggaacuccacccacgaaauguauuggguuucgaaugcaacgggaaauauaguuucaagcgucaacaugauuucgcguaugcuuauuaaccgcuucacaaugaaacauaagaaagcaacuuacgaaccagauguagaucucgguagcggaacaagaaacauaggaauagaaagcgaaauaccaaaucuugauauuauaggaaaacgaaucgagaaaauaaagcaagaacaugagaccaguuggcacuaugaucaagaucauccauauaaaacaugggcuuaccacggauccuacgaaaccaagcaaaccgggucugccaguucaaugguuaacggagucguucgacuuuugacgaaaccgugggauguagugccuaugguaacacaaauggcuaugaccgacacuaccccauuuggacaacaaagaguauuuaaagagaaaguagauaccaggacucaagagccuaaggaggggacgaagaaacuuaugaaaauaacagcagaauggcucuggaaagagcuggguaaagagaaaacuccuagaaugugcacacgagaggaauuuacacggaaaguucguucuaacgcagcucuuggggcaaucuucacugacgagaauaaauggaaaucagcaagagaggcgguagaagacagcagauucugggagcuaauagacagagagcgaaaucuucaccuggagggaaaaugcgaaacaugcguuuacaauaugauggguaaaagggagaagaaacuaggagaauuuggaaaagcuaaaggaaguagagcaauaugguacauguggcugggcgcuagauuuuuagaauuugaagcucuaggcuuccuuaaugaagaccauugguuuucuagaggcaacucauugucagggguagagggugagggguugcaccgucucgguuacauauuaagagacgugaguaagaaagaaggaggggcaauguacgcagacgauacagcggggugggauacgcgaauaaccuuggaagaccuuaagaacgaggaaauggucaccaaccauaugaaaggagaacauaagaaacuggcagaagcuauauuuaaacuaacguaucagaacaaggugguaaggguucagcguccaacccccagaggaaccguaauggauauuauaucuaggcgagaccagcgagguucaggacagguggguacauauggccuaaauaccuuuacaaauauggaggcccaauuaaucagacaaauggaaggagaagggauuuuuaagagcauacaacaucucacaguuaccgaagaaauagcagugcagaacugguuagcgaggguaggacgagaacgguugucaaggauggcuauaucgggagacgauuguguagugaaaccccuagacgaucgguucgcgucagcauugacagcacuaaaugacaugggcaagguacgaaaagauauacaacagugggagccaucuagagguuggaaugauuggacacaagugcccuuuugcucacaucauuuucaugagcuuguaaugaaagaugggagaguauuagugguucccuguaggaaccaagaugaacuaauagggagagcaaggauaagucaaggggcaggcuggucuuuaaaagaaacggcauguuuaggcaagaguuacgcacaaauguggacacuaauguacuuucaucggagagaccuccgauuagccgcaaacgcaauauguucagcggucccaucccauugggugccgacaagccguaccaccuggagcauacaugcaaaacacgaauggaugacuacugaggauaugcuggcgguauggaaccgggucuggauucaggagaauccuuggauggaagauaagaccccaguugaaucuugggaagaagucccauauuugggaaaaagggaagaccaauggugugguucacuaaucggacugacaucccgggccacuugggcuaaaaacauccaaacagcgauuaaucaagucagaucguuaauuggcaaugaagaguauacugauuauaugccauccaugaaacgauuuagaagggaggaggaagaagcaggaguucuaugguaa

SEQ ID NO: 22919 - RNA, 9876 nt, Artificial Sequence
  derived and/or modified CDS sequence (opt6) from DENV-2__GQ398312__SS-prME
acggcugguguuauaauaaugcuaauucccacugcuauggcauuucaccugaccacucggaauggagaaccgcacaugauaguuggucgacaggaaaaagguaaaaguuuauuauuuaaaaccgaagauggagugaauaugugcacuuuaauggcuauugauuugggagaacuaugcgaagauacgauuacuuauaaauguccacugcugaggcaaaacgaaccagaagacauagauuguugguguaauaguacgucaacaugggugaccuauggcacauguacaacaacuggagaacaccgcagagaaaaacgaucaguagcgcugguuccacacguuggaaugggccuagaaacgcguaccgaaacuuggaugaguucagaaggggcguggaaacacguucagagaauugagacauggauuuuacggcaucccggauuuacaauuauggcagcaauauuagcguacacaauaggaaccacacauuuucaacgugcauugauauucauucuccuaacagcaguggccccuucgaugaccaugaggugcauagguauaucgaauagagauuuuguugaagguguuucaggagguucuuggguagacauaguauuagagcacggcaguuguguaacgacaauggcuaaaaacaaaccaacgcuagacuucgaguuaauaaaaacagaagcaaaacaaccagcuacauuaagaaaauacuguaucgaagcuaaacuuacaaauacaacuacugagucgagguguccuacucaaggugaacccagcuuaaaugaagaacaagacaaaagguucguuugcaaacacucaaugguagaucgcggguggggaaacggaugcggauuauuuggaaaaggaggaaucguaacgugugcaauguucacauguaagaaaaacauggaagguaaagucgucuuaccagaaaaccuagaauauacaaucguaauaacaccacacucuggggaagaacacgcuguaggcaacgacaccggcaaacaugggaaagaaauuaaaauaacuccucaaucuagcaucacugaagccgaacuaacggguuaugguacuguuacaauggagugcucuccuagaacaggauuagacuuuaaugaaaugguuuuauugcaaauggaagauaaagcauggcuggugcauagacaaugguuucuagaccucccgcuaccaugguuaccaggagcggauacacaagggucaaauuggauacagaaagaaaccuuagucacuuuuaaaaauccgcaugcgaaaaagcaggauguaguagucuugggaucucaagagggugcaaugcauacugcauuaaccggcgcaacagaaauucaaaugagcaguggaaaccuacuguuuacuggucaucuaaagugucgacuuagaauggacaaauuacaacugaagggaaugagcuauuccauguguacagguaaguuuaagauaguuaaagaaauagcagaaacacaacauggaacaaucguaauacgaguccaauacgaaggggaugguucacccuguaaaauaccauuugagauuauggaccucgagaagagacauguauuaggucgccuuauuacgguaaaccccaucguggcugaaaaagauucuccaguaaauaucgaagcagaaccaccauuuggagauucguauauuaucauugguguugagccaggucaguuaaaguugaacugguuuaagaagggaaguucaauaggacaaauguuugagacuacuaugcgcggagcaaaaagaauggcuauauuaggggauacagcgugggauuucgggucacuagggggaguauucacaucaauaggaaaggcccuacaccaaguauuuggugccauuuauggggcagcguucagcggcgucucguggacaaugaaaauauugauuggagucauaauuaccuggauugggaugaacucgcguucaacuucauuaaguguaucauuaguacuugucggaguuguuacccucuauuuaggggcaaugguacaagcggauucggguuguguuguuucauggaaaucaaaagaauuaaaaugcggcaguggaauauucauuaccgauaauguucacacauggacagagcaguauaaauuucagccugaaucaccuaguaaauuagcaucagcaauucagaaggcucacgaagaggguaucugcggaauacgcaguguuacacgauuagagaaucucauguggaaacaaauuacuccugaacuuaaccauauauuaagugaaaaugaaguaaaauuaacaauaaugaccggcgacauaaaagggauuaugcaagcuggaaagagaagucuaaggccgcaaccuacagaacucaaauacucuuggaaaacuuggggaaaagcgaaaaugcugucaacugaaucucauaaucaaacauucuuaaucgauggaccggaaaccgcugaaugcccuaauacuaaucgggcuuggaacucucuggaaguggaggacuacggcuucggcguauuuucgacaaauauuuggcuaaaacugcgagaaaaacaggacguauuuugugauuccaaacuaauguccgcagcgauuaaggauaacagagcuguacacgccgauauggguuauuggaucgagagugcauugaaugacacauggaaaauggaaaaggcgagcuucaucgaagucaaaucaugccauuggccuaaaucucacacucuauggucaaaugggguauuggaaagugaaaugauuauacccaaaaauuuugcagguccgguaagucagcacaauuaccgaccugguuaccacacgcaaacugcaggcccuuggcauuuggguaaacuagagauggauuuugacuuuugugaggggacgacaguagugguuacggaggacugugguaaccgaggaccuagccugagaacuacuaccgcgagugguaaauuaauuacagaaugguguuguagaagcugcacauugccaccacuaagauacagaggggaagauggcugcugguacggaauggaaauccgccccuuaaaagaaaaagaggaaaaucuaguaaacucauuaguaacugcaggacacggacaaauagacaacuuuagcuuaggugucuugggaauggcccuguuuuuagaggaaauguuacgaacucgaguggggacuaaacaugccaugcuucuaguggccguuucauuugucacucuuauaacaggaaauaugagcuuccgggaccuuggucgaguaaugguaauggugggugcaacgaugacggaugauauagggaugggcauaacauauuuggcacuguuggcggcuuuuaaaguccguccuacauuugccgcagguuuguuacuccggaaauuaacaucaaaagaguuaaugauggcaacaauuggcauagcucucuuaucacaaaguacuauaccugaaacuauauuggaacuaaccgaugcucuagcuuuaggaaugaugguauugaaaaucguaagaaauauggaaaaauaucaauuagcuguaacaauuauggccauaaguuguguuccaaacgcuguuauccuacaaaaugcauggaaaguuuccuguacuauacuugcagccguaagcgucaguccacucuuauuaacaucaagccagcaaaaagccgauuggaucccuuuagccuuaacaauaaaaggccuaaauccaacugcuauauuucugacaacucugucaagaacguccaaaaagaggucuuggccucugaaugaggcuaucauggcaguggguaugguaagcauacuagcaucaagucuucucaaaaaugacauuccuaugacagggccccucguagcagggggauugcugacggucuguuaugugcuuaccgggcgcagcgcagacuuagagcuagaaagagcagcugacguaaaaugggaagaucaggcagaaauaucaggcaguuccccaauuuuaucaauaacuauaucagaagauggguccauguccaucaaaaacgaagaagaggaacaaacucucacaauacuaauucgcacaggccuauuggugauaagugggguuuuccccguaucaauucccauaacagcggccgcgugguaucucugggaagucaagaaacaacgagcuggaguacuaugggaugucccgaguccgccgccagucgggaaggccgaacuggaagauggcgcauaucgaauaaaacagaggggaauacugggauauucacaaaucggagcuggcgucuacaaagaagguaccuuccacacaauguggcauguaacgcgcggggcuguucuaaugcacagagggaaaagaauagagcccagcugggcugaugugaagaaagauuuaauaaguuacgggggcggauggaaacuugagggggaauggaaagaaggggaggagguacaaguucucgcauuagaaccggggaaaaacccgagagccgugcaaacaaaaccuggcuuguucaaaacgaauacugguacuauaggagcaguaagucuagauuuuaguccagguacuucagguucaccaauaguagaucggaagggaaaggucguaggccuauacggcaauggaguagugacgcggucaggugcauauguuagcgcaauugcacaaacugagaagucaauugaagauaacccugagauagaggaugacauauucaggaagaaaagguuaacaauaauggaccuucauccaggcgcagguaaaacuaagagauaucuaccagccauuguucgagaagccauaaaaagaggcuugagaacauuaauauuagcgccuacccgaguuguagccgcggaaauggaagaagcguuaaggggauugcccaucagauaucaaacaccagcaaucagggcugaacauacgggccgggaaauuguggaccuaaugugccacgccacauucacgaugcgauuauuaagcccuguaagaguacccaacuauaaucugauaauaauggacgaagcucacuuuacagacccagcaagcauugcggcgcgagguuacauaucaacaaggguggaaaugggggaagcugcggggauuuuuaugacagcaacaccacccggcucccgugaccccuuuccccaaucuaaugcacccauaauggaugaagagagagaaauaccugaacguaguuggaacuccggucacgaauggguaacagauuucaaagggaaaacagucugguuuguacccucaauaaaagcaggaaacgauauugcggcgugccuucguaaaaauggcaagaaaguaauccagcucucgcguaaaacguucgacagcgaauaugucaaaacucgagcuaacgauugggauuuuguagucacaaccgacauaucugaaaugggagcuaacuuuaaagccgaacgaguaauagacccaagacgauguaugaaaccagucauucuuacagauggugaagaacggguaauacuugcuggacccaugccugucacccacuccucggcagcgcaaagaagagguagaaucgggagaaauccuaaaaaugagaacgaccaauauauuuauaugggcgaaccauuggaaaaugaugaagacugugcccauuggaaggaagcaaaaauguuacuagauaacauaaauacaccagaagggauaauaccgucaauguucgaaccagaaagggaaaagguggaugccauagacggagaauauagacuaaggggugaagcucguaagacauucguggaucugaugcguagaggggaccuuccaguauggcuugcauaccgcguugcagcagaaggcauaaacuaugcagaccguagaugguguuucgaugguaucaaaaacaaucaaauuuuggaggaaaacguagaaguugagaucuggacaaaagaaggagaaaggaaaaagcuaaagcccagauggcucgaugcaagaauauauagcgauccgcucgcucuaaaagaguucaaagaguucgccgcaggucguaaaucucuuacuuuaaaucugauaacagaaaugggcagacuaccaacauuuaugacgcaaaaagcaagagacgcucucgacaaucuagcuguauugcacacagcagaagcuggaggccgcgcuuauaaccaugcauuguccgagcuuccagagacccuagaaacccuccucuuauuaacacuauuagccacaguaacaggcggaauauucuuauuuuuaaugaguggaaaaggcauugggaagaugacacuuggaauguguugcauaauuacagcaaguauauuacucugguaugcacaaauacaaccucauuggauagcugcgaguaucauccucgaguucuuuuuaauaguacuauuaauaccggaaccagaaaaacaacgaacgccacaagacaaucaauuaaccuacguugucauagccauucuaacaguuguagcugcaaccauggcaaaugaaauggguuucuuggagaaaaccaagaaagaucuugggcuagguaguauugcuacucaagaauccgaguccaacauccucgacauagaucuacgaccagcuagugcauggacuuuauaugcaguugcgacuacguuuguuacgccaauguugcgacacucaauugaaaauucuuccguuaauguaagccucacugcuauagcuaaccaagcaacaguauuaaugggauuagggaaaggauggccguuaucaaaaauggacauagggguaccccuguuagcgauaggauguuauagccaaguuaauccaauaacauuaaucgcagcgcuucuauugcuggucgcccacuaugcgauuauuggaccuggccugcaagcaaaagcgacccgagaagcucaaaaacgagcagcagcaggaauaaugaaaaauccaacaguugacgguaucacuguaaucgacuuagaaccaauaccuuaugaucccaaauuugagaaacaacuuggucaagugaugcuauuaauauuaugcguaacgcaaguacuaaugaugagaacaacaugggcuuuaugugaagcacuaacccuugcgacuggaccaauaucgacguuaugggagggcaauccuggaagguuuuggaauacaacgauagccguuucgauggcuaauauauuucgcggcagcuaccuugccggugcgggucucuuauuuagcauaaugaaaaauacgacaaacaccagaagagguaccggcaacauaggugaaacccuuggagaaaaauggaagucacgacuuaaugcgcuugggaagucugaguuccaaaucuauaaaaagagcggaauccaggaaguagacagaacgcuagcaaaagaaggaaucaaacgcggagaaacagaucaucaugcaguaucccggggaucagcaaaauuaagaugguucguagaacgaaacaugguaacuccggaaggaaaagucguugauuuagguugcggcagagguggauggaguuacuacugcgggggacucaaaaauguccgggaagucaaaggacucacaaaagguggaccaggacaugaagaaccaauucccaugagcacauauggauggaauuuaguacguuuacaauccgguguagauguauucuucacaccaccugagaaaugugacacacuuuuaugugauauuggagagagcucaccaaaccccacaauagaagcaggucgaacacuuagggucuuaaaccugguugaaaauuggcugaacaacaacacgcaguucuguauaaaaguacuaaauccauauaugccauccguuauagagaagauggaaacauuacaacgaaaauacggaggugcguugguacgcaauccguuaucaagaaauucaacacacgaaauguauuggguauccaacgcuacgggcaauauaguaaguucuguaaacaugauuucgcggauguuaauaaacagguuuaccaugaaacauaagaaagcuacuuaugaaccagauguugaccugggaucugguaccagaaacauagggauagaaucugaaaucccgaacuuagacaucauaggaaaaaggauugagaagaucaaacaagaacacgaaacuagcuggcauuaugaucaggaucauccauacaagaccugggcauaucaugguucguacgaaacaaaacaaacaggaagugcauccagcauggugaacggaguaguucgauuacuaacgaagccaugggauguugugccgaugguaacucaaauggcuaugacagauacaacaccuuucgggcagcagaggguuuuuaaagagaaaguugauacuagaacacaagagccaaaggaagggacuaagaaacugaugaaaauuacagcggaaugguuauggaaagaacuaggcaagaagaaaacaccaagaaugugcacccgcgaggaguucacacggaaaguucgcucaaacgcagcauuaggagcuaucuuuacagacgaaaacaaauggaaaagcgcaagagaagcgguugaagauucacgcuucugggagcuaauagauagagaacgaaacuuacauuuagaagguaaaugugaaacauguguauauaacaugauggguaaaagggaaaagaaacuaggagaguucgguaaagcgaaaggaucucgagcgauaugguauauguggcuuggggcgcgauuccuggaguuugaagcgcucggauuccuuaaugaagaccacugguucucaagagguaauucccugagcgguguagaaggagaaggacuccaucgauuagguuacauuuuaagggacguaaguaaaaaggaagguggugcaauguaugcagacgacacagccggaugggacacacguauuacgcucgaagaucucaaaaaugaagaaaugguuacaaaccauaugaaaggagaacacaagaaauuagcagaagcuauuuucaaacugacuuaccaaaacaaaguaguucgaguacagagaccgacaccgagagguacagucauggauauaauuucucgacgugaucaacggggcagugggcagguugguacauauggacugaauacauuuacuaauauggaggcacaacuaauacgacaaauggaaggagaaggaaucuucaaauccauacaacaccuaacuguaacggaggaaauagcuguucaaaacuggcuugcaaggguggguagagaaagguugaguagaauggcuauaucaggcgacgacuguguggucaaaccguuagaugauagguucgccucagcacucacugcacuaaacgacauggggaaaguaaggaaagauauucaacaaugggagccuucccgaggcuggaaugauuggacacagguaccauuuugcagucaccacuuucacgaacuuguaaugaaggauggucgaguucucgucguacccuguaggaaccaagacgaacucauuggacgugcucggauaagccaaggcgcagguuggagucuuaaagaaacagcaugucuugggaaaucuuacgcacaaauguggacacugauguauuuucauagacgggaucucagauuagcagcaaaugcaaucuguuccgcagugccaucacauuggguaccuacauccaggacaacguggucuauacacgcaaaacacgaauggaugacgacggaagacauguuagccguuuggaaucgugucuggauccaggaaaaccccuggauggaagacaagacuccgguagaaagcugggaagaaguccccuaucuugguaagcgagaagaccaguggugugguagccuuauuggacuaacuagcagggcgacuugggccaaaaauauccaaacagcaauaaaucaaguacgaagccugauaggaaacgaggaguacacagacuacaugccuucaaugaaacgauuuaggcgagaggaagaggaagcggggguauuaugguaa

SEQ ID NO: 22920 - RNA, 9876 nt, Artificial Sequence
  derived and/or modified CDS sequence (opt6) from DENV-2__GQ398289__SS-prME
acagcugguguuauaauaauguugauuccaacagcaauggcauuucauuuaacaacaagaaauggggaaccccacaugauaguugguagacaggaaaaaggcaaaucauuguuauuuaaaacagaagauggagugaacauguguacacugauggcaauagauuuaggggaacugugcgaggauacaauaacauauaaaugcccacugcuaagacaaaacgagccagaagauauagacugcugguguaacucuacaagcaccuggguuaccuaugguacuugcacuaccaccggagaacacagaagagaaaaacgaagcguggcauuaguaccgcaugucggaaugggccuagaaacgagaacagaaacuuggaugucauccgaaggagcauggaaacauguucaacguauagaaacauggauacugcggcaccccggauucgcuauaauggcagcuauacuugcuuauacaauagguacaacacauuuccaaagagcguugauauucauuuugcuuacagcagucgcaccgucaaugacaaugcguuguauagguauauccaacagggauuuuguugaagggguuuccggaggauccuggguggauauaguauuagagcacggauccugugucacaacuauggccaaaaauaaaccaacguuggauuuugagcuaauaaaaacugaagcgaaacaaccagcaacguuaaggaaauauuguauagaggcaaaacuaaccaacacaaccaccgaaucaagaugcccgacacaaggugagccuucgcucaaugaagaacaagauaaacgcuuuguaugcaaacauagcaugguagacaggggauggggaaauggauguggcuuauuuggcaaaggggguauuguaacaugugcaauguuuacuuguaagaaaaacauggaaggcaaaguaguuuuaccagaaaaucuagaauacacaauaguuauuacuccgcacuccggagaagaacaugcgguaggaaaugauacugguaaacauggcaaagagauaaaaauuacaccucagucuaguauaacugaggcggaacuaacgggauacgguacagugaccauggaguguucuccacguaccggccucgauuuuaacgaaaugguacucuuacaaauggaggacaaagcauggcuugugcaucgacaaugguuuuuggaccuaccacugccauggcuaccgggagcagauacccagggaucaaauuggauucaaaaagaaacguuagugacuuuuaaaaacccacacgcaaagaaacaagauguggucguauuggggucacaggaaggugccaugcauacagcucuaacaggugcuacagaaauucaaaugucaagcgguaacuugcuguucacagggcaccuaaaaugcagacuaagaauggacaaauuacaacuaaaaggaaugucguauuccaugugcacuggcaaauuuaaaauaguaaaagaaauagcagagacacaacaugguacuauuguuauaagagugcaauaugaaggcgauggcucgccuuguaaaauaccauuugaaauaauggaccuagagaaacggcauguacuugguagguuaauaacaguuaacccaauaguaaccgagaaagauucacccguaaacauagaagcggaacccccguucggcgauucauauauaauuauuggaguagaaccagggcaauuaaaacuuaauugguuuaagaaaggaaguucgauugggcagauguucgaaacaacaaugagaggggccaaaagaauggcaauucuaggcgauaccgcaugggacuuugggucuuuaggaggaguauuuacaucgauaggaaaagccuuacaucaaguuuuuggggcaauuuacggcgcagcuuuuucugguguaagcuggaccaugaaaauauuaauaggugucauaauaacauggaucggaaugaauagccgaucuacgucacucucaguguccuugguccuaguuggagugguaacgcuguaucucggugcgaugguacaggcggauagcgguugcgugguaucguggaaaucuaaagagcuuaaauguggcucugggauuuuuauuacagauaaugugcacacuuggacagagcaauauaaauuucaaccagagucaccuucaaaacucgcgagugcaauccaaaaagcucacgaggaggggauaugugguaucagaaguguaacuagacuagagaauuuaauguggaaacaaaucacuccugaacuuaaucauauucuaagcgaaaacgaaguuaagcuaacaauaaugacuggugauaccaaaggaaucaugcaggcaggaaagaggagucuuagaccgcaaccuacugaacuaaaauacaguuggaaaaccuggggaaaagcgaaaauguuaucuacagagucucacaaucaaacauuuuuaauagacggaccggagacagcggaauguccaaauacaaauagagcuuggaacucauuggagguugaagauuauggauuuggagucuucacgaccaauauauggcuuaaacuuagagagaagcaagacguauuuugugauucaaaacuuaugagcgccgcaauaaaagacaauagggcuguacaugcagacaugggguacuggauagagucagcacugaaugauacauggaagauggaaaaagcaaguuuuauagagguaaaaucgugccacuggccuaaaucacacacucucuggagcaaugguguauuagaauccgaaaugauaaucccgaagaauuucgcaggaccggugucucagcauaauuauaggccuggauaucacacccagacagcaggaccauggcaccuggggaaauuggagauggauuucgauuucugugaaggaacuacuguugucguuacggaggauuguggaaauagaggcccgucucugcgcacaaccacggcgagcgggaaacuaauuaccgaauggugcugccguucaugcacauuaccaccucuuagguaucgcggcgaagacggauguugguauggaauggaaauacgcccuuuaaaagaaaaggaggaaaaucuagucaauucucugguuacagcaggucaugggcaaauugauaauuuuagccuuggaguauuggggauggcucuauuucucgaggaaauguuaaggacucguguagggacaaaacacgccauacugcuuauugcugugagcuuugucacacuaauaacaggaaauaugucuuucagagaucuagguagaguaaugguuauggugggugcaacaaugacggaugacauuggaaugggcguaacauauuuagcguuguuagccgcuuuuaaaguacguccuaccuuugcugccggauuguuacuacgaaaauugaccucaaaggaacuaaugauggcuaccauuggcaucgccuuacucagccaaucgacgauaccagaaacaauccuagagcuuacagaugcucuggcccuggggaugaugguuuuaaagauuguaaggaauauggaaaaauaucaacuagcaguaacaauaauggcuauaagcuguguaccgaacgcgguaauucuacagaaugcuuggaagguaaguugcacaauacuggccgccgucagcguaucacccuuacuacuuacuagcagucaacagaaggcggauuggauuccauuggccuuaacuauuaaaggacuaaacccaacggcgauuuuucuuacaacccuuucaagaacgucuaagaaacgaaguuggccgcuaaaugaagcaauaauggcaguuggaaugguaucgauacuagccucuagucuccucaaaaaugauauaccaaugacagggccucuaguagccgguggccugcuuaccguauguuauguauugaccggaagaagugcugaucuagaauuggagagagcugcggauguuaagugggaagaucaggcagaaaucucaggaucuagcccaauccuaucuauuacuauuucugaagaugggucgaugagcaucaaaaacgaagaggaggaacaaacccugacuaucuuaauaaggacaggauuauuggucauaaguggcgucuucccuguuagcauaccaaucacggcagcugcuugguaucuaugggaagucaagaaacagcgagcgggcguauuaugggauguccccucaccacccccuguagguaaagccgaacuugaagauggugcauauaggaucaagcagagagggauuuuaggguacucacaaauaggugcaggagucuacaaagaagggacauuccacacgauguggcaugucacuagaggagcaguucuaaugcauagaggaaaaagaaucgagccaucaugggcagacgucaagaaagauuugauuuccuacggagguggcuggaaacucgagggagaauggaaagaaggggaggaaguacaaguguuagcacuugaaccugguaaaaauccucgcgccguucagacaaaaccaggauuauuuaagaccaauacgggaacuauaggagcagucucucuagacuuuucgccgggaacauccggaucaccuaucguagaccggaaaggaaaagucgucggacuauauggaaauggaguaguaacgagaucaggagcguacguuagcgcaauugcacaaaccgaaaagucaaucgaggauaacccagagauugaagaugacaucuucagaaagaaaagacugacaauuauggaccuccacccaggagcugggaaaacgaaaagauacuugccagcgauagugagagaagcaauaaaaagaggguuacgcacacucauacuagccccgacccgagucgucgcagcugaaauggaagaggcacuucgaggccugccgauaagauaucagaccccugcuauuagagccgaacacacgggaagagaaauuguugacuuaaugugucaugcgacuuucacgaugcggcuauugagucccguaagaguacccaauuacaaucuaauuauaauggaugaggcacacuuuacagacccugcaucaauugcagcccguggcuacauaucaacacgaguagaaaugggcgaggcagcagggauauuuaugacagcaacacccccgggaucacgagaucccuuuccacaaaguaaugcgccaaucauggaugaagaacgggaaauaccugaacgaucuuggaacuccggucacgaguggguaacagacuucaaaggaaaaacuguuugguuuguaccaucuauuaaagcggggaaugauauugcugcauguuuaaggaaaaaugguaagaaaguaauacaacuuucucgaaaaacauucgauagugaauacguaaaaacucgggccaacgauugggacuucgucgugacaacugauauaagugaaaugggggcaaauuuuaaagcagaaagaguuauugauccaagaagguguaugaaacccguaauacuaacugacggcgaagagagaguaaucuuggcaggcccuaugccgguuacacauuccagugcggcacaaagaaggggacguauaggaagaaauccgaagaacgagaaugaccaguauauauacaugggggaaccucuugagaacgacgaagauugcgcccacuggaaagaagcuaagaugcuacuggacaacauuaacacaccagaaggaauuauuccgagccuuuucgagccagaaagggagaagguagacgcuauugacggcgaguacagacugaggggcgaagcucgaaaaacuuuuguagauuuaaugcguagaggcgaccuaccaguaugguuggcuuaucguguagcagcagaaggaauaaauuacgcagauagaagaugguguuucgauggaaucaaaaacaaucaaauccuugaagaaaauguugaaguugaaaucuggacaaaagaaggugaacguaaaaagcuaaaaccucgaugguuagacgcucgcauauacucggacccacucgcccuaaaggaauuuaaggaauuugcagccgggcgaaaaucacuaacacuaaaccugauaacggaaauggggagauugccaaccuuuaugacccagaaagcccgugaugcguuagacaauuuggcaguauuacauacagccgaagcaggcggcagggcuuauaaucaugcuuuaucggaacuaccagaaacacuagagacucuuuugcucuuaacacuguuggcgacagucacagguggcauauuccucuuccuuaugucagggaggggaauagggaaaaugacucuaggcaugugcuguauaaucacugcgucaauacuacuaugguacgcgcagauccaaccucauuggauagcggcuucaauuauuuuggaauuuuuccuaaucguccuucuuauucccgaaccugagaaacaacgaaccccacaagauaaucaauugacguacguaguuaucgccaucuuaacgguaguagcagcuacgauggcuaaugagaugggguuccuggaaaagacgaaaaaggaccuaggucuaggaaguauuacuacucaagaaagcgaaucaaauauuuuagauauugacuuacguccagcuuccgcguggacauuguaugcaguagcaacuacguuugugacaccaauguuaaggcacagcauugaaaauucuucagugaauguuucacugacugcaauagcaaaccaagcgacaguauuaauggguuugggaaaaggauggccauuaucuaaaauggacauuggaguaccacucuuagccauuggaugcuauucacaagugaaccccauaacgcugacagcagcauuacuauuguugguagcccauuaugcaauaauagggcccgggcuccaagcgaaagcaacacgugaagcucagaagagagcugcugccgguauuaugaaaaacccaacgguugacggcauuaccguaaucgauuuagaaccuaucccuuacgacccgaaguuugaaaagcaauuagggcaaguaaugcuguuaauauuauguguaacucaaguacuaaugaugagaacaacaugggcccuaugugaagccuuaacccuggcaacuggaccaauuucaacuuuaugggagggaaaccccgggcgguuuuggaacacuacgauagcggucucuauggcgaacauuuuuaggggcagcuaccuagcgggagcaggacuucuauucaguauuaugaaaaacacgaccaauacgcgaagaggaaccgguaauauuggagaaacacuaggugaaaaauggaagucuaggcuuaacgcuuugggaaaaagugaauuucaaauauauaagaaaagcggaauacaggaaguagacaggacuuuagcuaaagagggaauaaaacgaggcgaaacugaucaucaugcagucucaagagguagugcaaaacuucgcugguuuguugaacgaaacaugguaacacccgaggggaaagugguugaccuggguugcgguagaggaggaugguccuauuacuguggcggacuuaaaaauguuagagaaguaaaagggcuaacgaaaggggguccuggacacgaagaacccauaccuaugagcacguauggauggaaccuaguaaggcuucaaucuggaguugauguauucuuuacuccuccugagaaaugcgauacacuacuuugcgacaucggggaaucgagcccgaacccaacgauugaagcaggacgcacacuccgcguacuaaaucuugucgaaaauugguugaauaacaacacucaguuuuguauuaaggugcugaauccauauaugccaagcgugauagagaaaauggagacucuccagcgcaaauacggcggagccuuaguccgcaacccauuaagcagaaacaguacgcacgagauguauuggguauccaaugccacuggcaauaucguuuccagugucaauaugauaagucgcaugcuaauuaacagauucacgaugaaacacaagaaagcgacauacgaaccagauguagaucuagggucuggcacaagaaacauaggcauagaaagugaaauaccgaaucuagacauuauaggaaaaagaauagaaaagaucaaacaagaacacgaaaccaguuggcauuaugaccaagaucauccguacaagaccugggcauaccacggaagcuaugaaacgaaacaaacugguucggcaucuaguauggucaauggcguuguucgcuugcuuacaaaaccgugggaugucguuccaaugguaacccaaauggcgaugacagauacaacccccuuuggacagcagagaguuuucaaggaaaagguggacacucgcacccaagaaccaaaagaggguaccaagaaacuaaugaagauuacugcagaauggcuuuggaaagagcuugggaagaagaaaacaccuagaauguguacaagggaagaguucacacgaaaagugcgaaguaaugcggcguuaggagcuauuuuuacugacgaaaacaaauggaaaagcgcgagggaagcuguagaagacucucgauuuugggaacucauagauagagaacgcaauuuacaucuugaagggaaaugugaaaccugcguguacaauaugauggggaaaagagagaagaaauugggagaguucgguaaagcgaaagggagcagagcaauaugguauauguggcugggugcucgauuccuagaauuugaagcguuaggauuuuuaaaugaagaucacugguuuucgcgaagaaauagcuugagcggcguagaaggcgaaggacuucauagacucggauauauacuuagggacguaaguaaaaaggaaggaggagcgauguacgcagacgacacagcugguugggacacgcgaauaacccuagaagaucuuaaaaaugaagaaaugguaacaaaucauaugaagggugaacacaagaaacucgcagaagcaauauucaaauuaacuuaucaaaacaaaguaguccguguucaacggccaaccccaagaggaacugugauggacauuauaaguaggcgagaucaacgggggucuggacaaguagggacauauggguuaaauacguuuacaaauauggaagcacaauugauaaggcaaauggaaggagagggaauauucaaaucaauucaacaucuuacgguaaccgaagaaaucgcaguacaaaacugguuggcaagggucggaagagaacgucuaaguagaauggcgauauccggagaugacugcguuguuaaaccacucgaugauagguucgccucggccuuaacggcuuuaaaugacaugggcaaaguuaggaaggauauacagcaaugggaaccgucuagaggauggaacgacuggacacaggugccauuuugcucucaucauuuccaugagcuagugaugaaagauggaagagucuuaguuguuccuugcagaaaucaagacgaauuaauuggccgagcacgaauuucacaaggggcaggguggucuuugaaagaaaccgcuugcuuagggaaaucauacgcucaaauguggacucuuauguacuuucauagaagagaccuaagacuugcagcaaacgcuauaugcucggcaguaccaagucauugggugccuacuucaagaacuacguggagcauccacgccaaacaugaauggaugacgacggaggauaugcuagcaguauggaauagagucuggauacaagaaaauccguggauggaagauaaaacaccaguggaaaguugggaagagguuccuuaucucgguaaaagagaagaccaaugguguggaucuuugauuggacuuacaaguagggcaacaugggccaaaaauauacaaaccgcuauaaaucagguuaggucguuaaucggcaaugaagaauacacugauuauaugccaucgaugaaaagauuucgccgcgaagaagaggaagccgggguacugugguaa

SEQ ID NO: 22921 - RNA, 9876 nt, Artificial Sequence
  derived and/or modified CDS sequence (opt6) from DENV-2__GQ398290__SS-prME
acagcuggaguaauuauaauguugauaccaacugccauggcuuuucacuuaacaacacgaaauggagaaccacauaugauaguaggaagacaggaaaaagggaaaaguuuauuauuuaaaacugaagauggugugaacauguguacucuuauggcaauagaucucggagaacucugcgaagacacaauuacauauaaaugcccccuauugagacaaaacgaaccugaagauaucgauugcuggugcaauagcacguccacuuggguuacuuacgguaccuguacgacaacuggagagcauagacgagagaaaagaucaguagcccuaguuccacaugucgguaugggacuagaaaccagaacugaaaccuggaugaguucggaaggagccuggaaacauguacagcggauagaaaccuggauucuccgccauccaggauuuacaauaauggcugcaauacuugcuuacacaaucggcaccacccacuuucaaagagcacuaauauuuauacuuuuaacugcuguagcacccaguaugaccaugcgaugcaucggaauuagcaauagagauuuugucgaagguguuagcggaggaucauggguugauauuguauuggaacacgguucuugcgucacgacgauggccaaaaauaaaccuacacuggauuucgaauugauaaaaacagaagcaaaacaaccugcuacguuaagaaaauauuguauagaagcgaaauuaacuaauacuaccacagaaagucggugccccacccagggagaaccuucacugaacgaagaacaagauaaaagauuuguauguaaacauagcaugguagauagagguugggguaacggauguggucuauuugggaaaggcgguauugugacgugugccauguuuacauguaagaaaaacauggaagguaaagucguucuuccagaaaauuucgaauauacaaucguuauuaccccacauaguggcgaggaacaugcaguuggaaaugauaccggaaaacauggaaaagaaauuaaaauuaccccacaaucaucuauaaccgaagccgagcuuacaggauaugguacaguaacgauggaaugcagucccagaacuggacuggauuuuaaugaaauggucuuauugcaaauggaagauaaggcuugguuaguccaccgacagugguuuuuagacuuaccauugccuuggcucccaggugcagauacacaaggaaguaauuggauacaaaaagaaacauugguuacauucaaaaauccacacgcaaagaaacaagacguaguaguacuaggcagucaagaaggugcaaugcauacggcauuaacuggcgcaacugaaauccaaaugaguucagggaauuuacuauucacaggucauuuaaaaugcagacuuagaauggauaaacuacaacucaaaggcauguccuauagcauguguacaggaaaguucaagaucgugaaagaaauagccgaaacacagcacggcacuauaguuauaagaguucaauaugaaggcgacgguucaccgugcaagauaccauucgaaaucauggacuuggaaaaacgucauguauuaggaagacuaauaacaguuaauccaauagugaccgaaaaagacaguccuguaaauauugaagccgaaccaccuuucggcgacucuuacauaauaauagguguagagccaggucagcuuaaacuuaacugguuuaaaaagggguccucaauaggucaaauguuugaaacaacaaugagaggggcaaagagaauggcgauacuaggugauacagcgugggauuuuggaucgcuaggcgggguuuuuacaagcauugguaaagcguuacaucagguguuuggagcaauuuacggagcugcuuuuagcgguguaaguuggacuaugaaaauucuuauagguguuauaauaacuuggauagguaugaacucuagaaguacuucauuaucgguaucacuuguccuagucggcgucguaacucuuuaucuuggagcgaugguccaagcugauaguggauguguuguaagcuggaaaaguaaggaauuaaaaugugguagugggauauuuauuacagauaauguccauacuuggaccgaacaauacaaauuccaaccggaaagcccaaguaaacucgcauccgcuauacaaaaagcacacgaagaagggauuuguggcauucguagcgugacuagauuagaaaaccugauguggaaacagauaacuccugaacugaaucacauauuaucggaaaaugaaguuaaauuaacuauuaugacuggagacauuaaaggaaucaugcaagcaggaaagaggagucuuaggccucaacccacagaauuaaaguauuccuggaaaacaugggguaaagccaagauguugucaacagagucacacaaucaaaccuuucuuauugaugggcccgaaacugcagagugcccuaauaccaauagagccuggaacucccuugaaguagaagacuacgguuucggagucuucacuacuaacauaugguuaaaacucagagaaaaacaagauguauuuugcgauucaaaauuaaugucugcagccaucaaagacaauagagcuguacacgcggacaugggauauuggauugagucagcacuaaacgacacauggaaaauggaaaaagcgucuuucaucgaaguaaaaaguugccauuggccaaaaucacacaccuuguggagcaacggagucuuggaaagcgaaaugauaauacccaaaaauuuugcgggcccggucagccagcacaauuacagaccugguuaucauacgcaaaccgcaggaccauggcauuuaggcaaguuagagauggauuucgaccucugcgaaggaacuacaguuguggugacugaaaacugugggaaucguggcccuagcuuacgaaccacaacagcuucagggaaacugauuacugagugguguugucguucaugcacgcuacccccacuuagauaucgcggugaggacggauguugguauggaauggaaauaagaccguuaaaggaaaaggaggaaaaucuuguuaacucacucgugacagcugggcauggccaaauagacaacuuuucccuggggguauugggcauggcucucuuucuugaggaaaugcuuagaaccaggguagguacuaagcacgcaauauuacuuguagcaguuuccuuuguaacacuaauuacagggaacaugagcuuucgugaccuaggaaggguaauggucauggucggcgcaacuaugacagaugacauaggaaugggaguaacauacuuagcacuucuagccgcguuuaaaguucgaccgacauuugcggccgguuuacuacugagaaaacucaccagcaaagaauuaaugauggcuacaaucgguauagcauugcucucccaaaguacuaucccagaaacuaucuuggaauugacggaugcucuagcucuuggaaugaugguauuaaaaaucgucaggaacauggaaaaguaccaguuagcagugacgaucauggcgauaucgugcguaccgaacgcggucauacugcaaaaugcuuggaaaguuagcugcacaaucuuagcugcugucaguguaucaccgcuguuguuaacaucaagucagcaaaaagcagauuggauaccauuagcacuaacgauaaagggucuaaacccaacagccauuuuucuaacgacuuuaucgagaacuucaaagaaaaggagcuggccacuuaacgaagcaauaauggcugucggaaugguuagcauacuagcgucuucuuuacuaaagaaugauauaccaaugacggguccauuaguagcgggaggacuauuaacaguauguuauguccuuaccggcagaagcgccgaucuugaauuagagagggcugcagacgugaaaugggaagaucaagccgaaauuuccggaaguucacccauauuaucgauuacaaucucugaagaugguaguaugagcaucaaaaaugaagaagaagaacagacucugacuauucugauaagaacagggcugcuagugauaucagguguuuuucccguuagcauaccaauaacugcugcugcgugguaccuaugggaagugaagaaacaacgggcaggaguucuaugggacguaccaaguccacccccaguuggcaaagcugaacucgaggacggagcauauagaauuaaacaaagaggcauucucggauacagccaaauaggagcgggaguguauaaggaaggaaccuuucacacgauguggcacguaacacguggagcaguauuaaugcaccggggcaaaagaauagagccgucaugggcugacguuaaaaaggauuuaauaaguuauggagguggauggaaauuggaaggugaauggaaagaaggggaagaaguacaaguccuggcguuggagccuggcaaaaauccgcgggcagugcaaacuaagccgggucuuuucaagacaaauacaggcacaauuggagcagucucgcuagauuuuucuccuggcaccagugguucccccauaguagauagaaaaggaaaagucgugggguuguacgguaaugggguuguaacuagaucaggagcauauguuagcgcaauagcccaaaccgagaaaaguauagaagauaaucccgaaauagaagaugacaucuuuaggaagaaacgucuaacaauuauggaucuccaucccggugcuggaaaaaccaaaagauauuugccggcgauagugcgugaagcaauuaaacggggacuccggacguuaauucuggcuccaacuagaguggucgccgcagaaauggaagaggcuuugcgaggguuaccgauacgauaucagacuccugcaauaagggcagagcauaccggccgagaaauugucgaucuaaugugucaugcuacuuucacaaugaggcuuuuaagccccgugagaguaccaaauuauaauuugauaauuauggaugaagcccacuucacugauccugccaguauagccgcuaggggauacauaaguacaaggguugaaaugggcgaggcggcggggauuuuuaugacagcgacgcccccugggagccgagacccauuuccccaaucuaaugcgccuauuauggacgaggaaagagaaauaccagaaagguccuggaacucaggccaugagugggugacugacuuuaaaggcaagacagugugguucguucccuccauaaaagcaggaaaugauauagcggccugccuaaggaaaaauggcaagaaaguaauacaguuaucucgaaagacauuugauagugaauacguaaagacaagagccaaugauugggauuuuguaguaacuacggacauauccgagaugggggcuaacuuuaaggcagaacguguaauagauccaaggcgaugcaugaagcccgugauacuaacggacggggaagaaagaguaauccucgcagguccaaugccagugacgcauaguagugccgcucaaagaagaggucgaauagguagaaauccuaaaaacgaaaacgaucaauauaucuauaugggagaaccccuugaaaaugaugaagacugcgcacauuggaaggaagcuaagaugcuacuugauaauaucaauaccccagaagggauaauaccuucaauguuugagccagagagggaaaaaguagaugcuauugacggugaauauagauugagaggagaagcucgaaaaacauucguugaccucaugagacggggagaucucccuguauggcuagcauauagaguggccgccgaaggaauaaauuaugcggaccgaagaugguguuuugaugguauuaaaaauaaucaaauacuagaagagaauguggaaguugaaauauggacgaaagagggggaaaggaaaaaguuaaaaccaagguggcuagaugcccgaauauauagcgacccccuugcccugaaagaguucaaggaauuugcugccggcaggaagagucucacauuaaaccuaauaaccgaaauggguagacuacccaccuuuaugacucagaaagcaagagacgccuuagauaacuuagcaguccuacauacagcugaagcaggagguagagcguauaaucacgcguugucagaauuaccagaaaccuuggaaacgcuauuacuacuuacccugcuugcgacaguaacugguggaauuuuucuguuucuaaugaguggcagggguauuggcaaaaugaccuuaggaaugugcugcauuauaacugcaaguauuuugcuaugguaugcacaaauucaaccgcacuggauugcugcuuccauaauccuugaauuuuuccuaauaguacuauugauaccagaaccagaaaaacaacgaaccccucaagacaaccaauuaacauauguaguuaucgcgauacuuacaguugucgcggcaacaauggcuaaugaaaugggauucuuagaaaagacgaagaaagaccuuggucucggaucuauaaccacgcaagaaucagaaucaaacauauuggacauugaucuucgcccagcuagugcauggacacuuuaugccguugcgaccacauuuguuacaccaaugcucagacauuccauagaaaauaguagcguuaacgucucacucacagcgauagcaaaucaagcaacaguacuuaugggguugggcaaagguuggcccuuaagcaaaauggacauaggcguaccucuacuagccauaggauguuauucacaaguaaauccgauaacccuaacagcugcauuauuacuguuagucgcccauuaugcgaucauagguccggggcuacaggcaaaagcaacuagagaagcccagaaacgcgccgcugccgggauaaugaagaauccuacuguagacgguauuacuguaauagauuuagaacccauucccuacgauccaaaauucgaaaaacaacuaggccaaguaaugcugcuuauccuaugugucacccaaguauuaaugaugaggaccacaugggcacuaugugaagcacuaacucuugcaacaggcccaauaucgacguuaugggaggguaaucccggaagauucuggaauacgacuaucgcaguuucgauggccaacauuuucagaggcucuuaccuagcaggggcggguuuacucuuuucuauaaugaagaacacaaccaauacuagaagaggaacagguaacaucggggaaaccuuaggagaaaaguggaaaucucgucugaacacguuaggaaaauccgaauuucagaucuauaagaaaucuggaauacaggaaguggauagaacauuggcgaaagaggggauaaaaagaggugaaacugaucaucacgcuguuucuagagggagcgcgaaacuacgaugguucguggagaggaauauggucacaccugaaggcaaagugguggaccuuggcugcggaaggggaggguggucauauuacugugguggucugaaaaacguuagggaaguuaagggacuuacaaaaggggguccuggucaugaagaaccuauaccuauguccacauauggauggaauuugguuagacuccaguccggaguagauguuuucuucacaccacccgagaagugugauacucuacuuugugauauaggggaaagcuccccaaauccaacaaucgaagcuggccgcaccuuacgaguauuaaaccuaguggaaaacugguuaaacaacaauacgcaauucugcauaaaagugcuaaacccauauaugccuucagucauugagaaaauggaaacccuacagaggaaauacggaggugcauuaguccgaaacccccuuucgcgaaacagcacacaugaaauguauuggguauccaaugcaacaggaaauaucguuaguucaguuaacaugauuucuagaaugcuuauuaaucgauucacuaugaaacacaagaaagcaacuuaugaacccgauguagauuuggggucgggaacaagaaacauagguaucgaaagcgaaauccccaaucuggacauaauagggaaacguaucgagaaaauuaaacaagaacacgaaacaagcuggcauuacgaucaagaccaucccuauaaaacaugggcuuaucauggcucuuacgaaaccaagcaaacagggagcgcuucuagcauggucaacggaguagugagauuacucacaaagcccugggauguuguaccuauggucacccaaauggcuaugacagauacuacaccuuuuggccaacaaagagucuuuaaagaaaaagucgacacgcgaacccaagaaccaaaagaagguacuaaaaagcuaaugaaaauaacugcugaauggcuauggaaagaacuaggcaagaagaaaacucccagaauguguacuagagaggaauuuacacguaaaguccgcucaaaugcagccuuaggagcaauuuuuacggaugagaacaaauggaaaagugcaagagaagcaguggaagauucucguuuuugggaguuaauagacagagagagaaaccuccaccuagaaggcaaaugugaaacauguguauauaacaugaugggaaaaagagaaaagaaacuuggagaguucgguaaggcgaaaggaucuagagcaauaugguauaugugguuaggugcuagauuccuagaguucgaggcccuaggauuccuuaaugaagaccauugguucucuaggggcaacucucucucagggguagagggagaaggacuccauagacuaggauacauuuuacgagacguaucuaagaaagaaggcggagcuauguacgcugaugacacggcuggcugggacacacgaauuacauuagaggacuugaaaaacgaggaaaugguaacuaaccacaugaagggggaacacaagaaacucgccgaagcuauauuuaagcucaccuaucaaaauaaaguaguaagaguucaacgaccuacgccuagaggaacaguuauggauauaauuaguaggagagaccagcgaggcaguggacaaguuggaacauacggucuuaacacauuuacaaacauggaagcacaacucauacgacaaauggaaggagaagguauauuuaaaagcauacagcaccuaacugcuaccgaagagauugcuguccaaaauugguuggcaagaguaggaagagaaagacuaucuaggauggccauaagcggagacgauuguguugugaaaccguuggaugacagauuugcuuccgcacucacagcauuaaacgacauggggaaaguuagaaaagacauacaacaaugggagccgucacgagguuggaaugauuggacacaaguacccuuuugcucacaucauuuccaugagcuaguaaugaaagauggucgaguauuaguugugccauguagaaaccaagaugaacucaucggacgggcuagaauuucgcagggagcuggauggucacuaaaagaaacagcuugcuuaggaaaaucauaugcccaaauguggacauuaauguacuuccacagaagagaucuacguuuagcagcaaaugcgaucugcagugcgguaccaucgcacuggguucccaccucgagaacaacuuggucuauacacgcaaaacacgaguggaugaccaccgaagacaugcucgcuguauggaauagagucuggauucaagaaaaucccuggauggaggacaaaaccccaguggaguccugggaagagguucccuaccuuggaaagagagaagaucaauggugcgggucacuaauuggguugacuagccgcgcaaccugggcaaagaauauucagacugcaauaaaucaaguucgaucucuuauaggaaaugaagaauacacagauuacaugccaucuaugaaaagauuucgucgggaagaagaagaagcugguguauuaugguaa

SEQ ID NO: 22922 - RNA, 9876 nt, Artificial Sequence
  derived and/or modified CDS sequence (opt6) from DENV-2__GQ398284__SS-prME
acugcaggaguaauaauuaugcugauaccgacagcaauggcauuccaccuaaccacucgaaacggagaaccucauaugauuguagguaaacaagagaaagguaaaucccuuuuauucaaaaccgaagacggaguuaacauguguaccuuaauggcaaucgaccuuggagaauuaugugaagauacaauuaccuacaaaugcccgcuauugcgccaaaaugaaccugaagauaucgacuguugguguaauucaaccaguacauggguaacguauggaacaugcacuaccacuggggaacauagaagagagaaaaggucaguugcccuuguuccacacguagggaugggacucgaaacucguacagaaacauggaugaguucggaaggugcauggaaacacguacaaagaauugaaacuuggauucugagacauccuggauuuacuaucauggcagcaauuuuggcuuauacaauaggaacaacgcauuuccaaagagcucuaauauuuauuuuauuaacagcaguugccccuucaaugacaaugaggugcauugguaucaguaaucgagacuucgucgaaggaguauccggaggaagcuggguagacaucguccuggaacaugggucaugcgucacaacgauggcgaaaaacaaaccuacauuagauuuugaacugauaaaaacagaagccaaacaaccagcgacgcuacgcaaauauuguauugaagcgaaacuaacuaacacaacgacggaaaguagguguccaacgcaaggcgaaccuucacuuaacgaagaacaagacaaaagguucuuauguaaacauaguaugguagaucgagggugggguaaugguuguggacuguuuggaaaaggaggcauaguuaccugugccauguucacaugcaagaaaaacauggaagguaaagucguccagccugaaaaccuagaauacacaauaguuauuacaccccacaguggagaggagcaugccguggguaaugauacagguaaacacggcaaagagauaaaaauaaccccgcaaucaucaauaacagaagcugaacuuacuggcuaugguacagucacgauggaguguagcccaaggacuggauuagauuucaaugaaaugguccuuuugcaaauggaagacaaagcaugguugguucauagacaaugguucuuagauuuaccgcuucccugguuacccggugcagacacucaagggagcaauuggauacaaaaagaaacccuugugacauuuaaaaacccacaugcaaagaaacaagacguaguagcacuagggucacaagaaggagcaaugcauacagcucuaacuggagcuacggaaauacaaauguccucugguaauuuauuauuuaccggccauuuaaaauguagacuuaggauggauaaauuacaauugaaaggcaugucauauucaauguguacggggaaauucaaaauuguuaaagaaauugcagaaacgcaacacgguacaauugugauccgaguucaguaugaaggugauggcucaccuuguaaaauuccguuugaaauaauggacuuagaaaaacgucauguacuugguagacuaauaacugugaacccgauagucaccgaaaaagauagcccggucaauauugaagcagagccgccguucggagauagcuacauuauaauagguguggagccuggccaguuaaaacuaaacugguuuaagaaaggaucaucaauaggccagauguucgaaacaacaaugagaggggcuaaaagaauggcaauacugggggauacagccugggacuucggaucguuaggaggcguguuuacaaguauagggaaggcuuugcaccaaguauucggagccauauaucgagcugccuuuucaggaguaucauggaccaugaaaauacuaauuggaguaauaauuacauggauagguaugaauagucgaagcacgucacuaucuguaucauuaguccuaguuggaguugugaccuuguaccugggggcgauggugcaagcagacucgggaugcgucguuaguuggaaaaacaaagaauuaaaauguggcucaggaauuuucauaaccgauaacgugcacaccuggacugaacaguauaaauuucagccagaaagcccaucaaaacuggccucagcgauacaaaaagcucacgaagaaggaauauguggcauacguucuguaacgagacuagaaaaucucauguggaaacaaauaaccccagagcuuaaccauauuuuauccgaaaacgagguaaaacuaacaaucaugacaggugacaucaaaggaauuaugcaagccggcaaacgaagucucaggccccaaccgaccgaacuuaaauauucauggaagacuugggguaaagccaaaauguugucgaccgaaagucauaaucaaaccuucuugauagauggcccugagacagcagaaugcccuaauacgaaucgagcauggaauagucuagaaguagaagauuacggauuugguguauucacuacaaauauaugguuaaaauuaagggagaaacaagauguauucugcgauuccaaauuaaugucugcugcaauuaaagauaauagggcuguucacgcugacaugggguauuggauugaaagcgcucuuaacgauaccuggaaaauggaaaaagcaucuuucaucgaagucaagaguugccacuggcccaaaagccacacauuauggaguaauggaguacuagaaagugaaaugauaauacccaaaaauuucgcggguccaguaagucagcacaauuauaggccgggauaucauacacaaacugccggcccauggcaucuaggaaaacuugaaauggauuucgauuuuugcgaaggaacuacaguagucgucacugaggacugugguaaucggggaccuucgcuaaggacaacaacagcaagcggaaaacuuauaacagaauggugcugcagaucauguacccugccuccccugagauaucgaggggaggacgguugcugguaugguauggaaauaagaccuuuaaaagaaaaagaagaaaaucucguuaacucuuugguaacggcaggacacgggcaaauugauaauuuuucauuagggguucucggaauggcacuguuuuuggaggagauguuaagaacaagggucgggacaaaacacgcaauauuauugguagcaguuucauucguuacguuaauaacgggaaauaugaguuuuagagaucuaggaagagugauggucauggucggggcgacaaugacagaugacauugguaugggcgucacauaucuagcacuuuuagcagcauuuaaaguacgacccacauucgcagccggccuauuauuacgaaaacucacauccaaagaacuuaugauggcuaccauugguauugcauuauuaagucaaucuaccauaccagaaacaauuuuagaacuuacugacgcccuagcacucggaaugaugguacuuaaaauagucagaaauauggaaaaauaccaacuugcaguaacaaucauggccaucucgugcguaccuaacgcagugauucuccaaaaugcauggaaaguaagcugcacuauauuagcugcaguaucaguaucgccauugcuauuaacgaguucacagcaaaaggcagauuggauaccauuggcucuaacaauaaaaggacuuaacccaaccgccauauuuuuaacaaccuuaucacgcaccaguaagaaaagguccuggccguugaacgaagcaauaauggccguggggauggugaguauacuugcuagcagcuugcuaaagaacgauauaccuaugacugguccacuugucgccgguggucuccuuacuguuuguuacguauugacagguagaagugcggaccuagaacuggaacgagcugccgauguuaagugggaagaucaagcagaaauuagcgguucgaguccuaucuuaagcaucacaauaagcgaagauggaucaaugucaauaaagaacgaagaagaagaacaaacgcugacaaucuuaauuagaacgggguugcucguuauuucaggcguuuuuccagucaguauuccaauaacugcggccgccugguauuuaugggaagucaagaaacaaagagcuggaguccucugggauguaccgagucccccuccuguugggaaggcugaacuagaagauggugccuauaggauaaaacaacgagguaucuuaggcuauagccaaauaggugcugguguauacaaagaagguacauuucauacaauguggcauguuacgcgaggagcuguuuuaaugcacagaggcaaacgaaucgaaccaucuugggccgaugucaagaaagauuuaauuaguuauggagggggauggaagcuagagggagaauggaaagaaggugaagaaguccaaguacuugcgcuggaaccuggaaagaaucccagagcugugcaaacgaaaccaggauuguuuaagacuaacacaggcacgauuggggcaguuucgcuagauuuuaguccagguaccuccggcucgccaauaguagauaggaaaggaaaaguaguuggacuauaugggaacggaguuguaacccggagcggggcauauguuagugcgauagcacaaacagaaaaaucuaucgaagacaauccggagauagaagaugacaucuuuaggaagaaaagauugacaauaauggacuugcauccgggggcagguaaaacgaaaagauaucugccggcgauuguacgagaagccaucaaaagggguuuacgaacacuuauucucgcaccuacgagagugguugcugccgaaauggaagaagccuugagagggcuacccauuagguaucaaacuccagcaauaagggcugagcauacuggaagagaaaucgucgaucugaugugccaugcuacuuuuacaaugcgucugcucucccccguuagaguuccgaacuauaaucugauaauaauggaugaagcacacuuuacugaccccgccuccauagcagcuagaggcuacauaaguacuagaguagaaaugggcgaagcugcagguauauucaugacugcuaccccuccaggcucuagagauccuuuuccgcaaagcaaugccccaaucauggaugaagaaagagaaauacccgagcguucauggaacagugggcaugagugggugacagacuuuaaagggaagacagugugguucguaccaucaauuaaagcuggcaacgauauagcagccugccucagaaagaauggcaagaaaguaauucaacuaucuagaaaaacuuuugauagugaguauguaaagacaagggcaaaugauugggauuuuguagucaccacggauaucucagaaaugggugcaaacuuuaaggcugaacgagugaucgauccaagaagauguaugaagccaguuauuuuaaccgauggggaagaacgggucauacuagcagggcccaugcccguaacucauuccagugcagcucaaaggagaggaagaauuggacgaaacccgaaaaacgaaaaugaucaauauauauacaugggugaaccauuagagaaugaugaagacugcgcucauuggaaagaggcaaaaauguugcucgacaacauaaacacuccagaaggaauaauuccaucaauguuugaaccagaaagagaaaaaguagaugccauagacggugaauauaggcucagaggagaagcgcguaaaacauuuguugaucuaaugagaagaggugacuugcccgucuggcuagcuuaucgcguggcagcagaagggaucaauuacgcggacagaagaugguguuuugauggaaucaaaaacaaccaaauccuagaagaaaaugucgagguagaaauauggacuaaagaaggugagcgaaagaagcuaaagccccguuggcuugaugcaagaauuuauagugacccacuagcgcugaaagaauuuaaagaauuugcagcagguagaaaguccuuaacccugaaucuuauaacugaaaugggaagguuaccaaccuuuaugacgcagaaagcgagggaugcacuggauaaucuugcuguucuacacacagcagaagcagggggaaaggcuuacaaucacgcgcuuagugaacuaccagaaacacuggagacuuugcuacuacugacccuccuugcuacuguaacgggcggaauauuucuuuuucugaugucuggcaaggguauagguaaaaugacccuagguaugugcuguauuauaacggccucgauauuacuaugguaugcccaaauucaaccccauuggauugccgcuucgauaauuuuggaauuuuuccuuauaguauugcucauuccagagccggaaaaacaacguacuccacaagauaaucagcuaacguacguugucauugccauucucacugucguagcugcuacuauggccaaugaaaugggauuccuggaaaagacaaagaaagacuuaggcuuagggucaauaauaacucaagaaagugaaaguaauauccuugauauagaucuacgaccugcaucagcuuggacacuuuaugcgguagccacaaccuucguuacaccaaugcuuagacacaguauugagaacucaagcgugaaugugucauugacagcaauagcuaaucaagcgacaguucuaaugggucuuggaaaaggcuggccucuauccaaaauggauauagggguaccacuucuggccaucgggugcuacucacaagugaauccuauaacacuaacugccgcccuucugcuauuaguagcacacuaugcaaucauagguccaggauuacaagcuaaagccacucgugaagcucagaaaagagcagcagcagguauuaugaaaaacccuacuguagauggcauuacugugauagaucuagaaccaauacccuacgauccuaaauucgaaaaacaguuaggccaggugauguugcuuauauuaugcguaacucaaguccuaaugaugaggacgacuugggcguuaugugaggcacucacauuagcaacaggaccaauaaguacuuugugggaagggaauccuggaagauuuuggaacacaaccauagcuguuagcauggcaaauauauucagaggaucauaucucgcaggcgcaggacuucuauuuucaauaaugaaaaauacgacaaauacuaggagggguacaggcaauauaggugagacgcugggugaaaaauggaagucaagacuaaaugcuuuagggaagagugaguuucaaauauauaagaaauccgguauacaggaaguagaucggacauuagcaaaagaaggaaucaaacgcggagaaacggaccaucaugcgguaagccguggaagugcuaaguugcggugguucguagaaagaaacauggucacaccugagggaaaaguaguagauuuaggcugcggcagaggaggauggaguuacuacugcggaggccuuaaaaauguacgugaggucaaaggcuuaacaaaaggagggccuggccaugaggaaccuauccccaugagcaccuacggcuggaaucuuguucgauuacaaucggguguugacguauucuuuacaccucccgagaagugcgauacccuucuaugcgauauaggcgaauccagucccaaucccacaauagaagcuggucggacgcugcguguucucaacuuaguagagaauugguuaaauaacaauacucaguuuugcaucaaaguacucaacccuuauaugccuagugugaucgagaagauggaaacauuacaacgcaaauacggaggggcccuaguucguaacccacuaucuaggaauaguacgcaugaaauguacuggguauccaacgccacagggaauauaguaaguagcguaaauaugauaagcagaaugcuaauaaaucguuuuacaaugaaacacaaaaaggccacauaugaaccugaugucgauuuagggucagggacgaggaauauaggcaucgaaagugaaauaccuaauuuagacauaauaggaaagcgcauagagaaaauaaagcaggaacaugaaacuucguggcacuaugaucaagaucacccauacaaaacuugggcauaccacggaagcuacgaaacuaaacaaacuggauccgcuuccuccauggucaauggugugguccgguuacuaacaaaaccuugggauguuguacccaugguaacucaaauggcaaugacagauaccacgccuuuuggucaacaacguguguuuaaggaaaaaguagacacacggacacaggaaccuaaagaagguacgaagaaacucaugaagaucacggcagaguggcuguggaaagaacugggcaagaagaaaacuccaagaaugugcaccagggaagaauuuaccagaaaaguuaggagcaaugcugcuuuaggagcgauuuucacagaugagaauaaauggaagucggcucgagaagcuguagaggauucccgguuuugggagcuuguagacagggaacgcaaucuccaccuagaagguaaaugcgaaacauguguauauaauaugaugggaaaacgcgagaagaaauuaggggaauuugguaaagcaaaagguucacgugcgauaugguacauguggcuaggagcgcgcuuucuagaauuugaagcgcucggcuuccuaaacgaagaucauugguucucgaggggaaauucacuauccggcguagaaggugaagggcuucauagacuagguuacauacugcgagacgucucuaagaaagaaggaggugcaauguaugcugacgauacagcggguugggauacgagaauuacuuuagaagaccuuaaaaacgaagaaaugguuacaaaucauaugaaaggggaacacaagaaauuagcagaggcgauuuuuaaauuaaccuaucaaaauaaaguagugaggguucaaagaccuacccccagaggaacgguaauggauauaaucucacgaagagaccaaagaggaagugggcaagugggaacguauggucuuaauacauucacaaauauggaagcucaguugauaagacaaauggaaggagagggaauuuuuaaaucgauacaacaucucacuguuacggaggaaaucgcaguacaaaacuggcuggcccgaguaggacgugaacgguuaagucgaauggccauauccggugaugauuguguaguaaagccucuugacgaucguuuugcgagcgcucuaacggcccuuaaugauauggguaaagugagaaaggauauucaacaaugggagccauccagaggauggaaugauuggacccaaguuccuuuuuguucgcaccauuuucacgaauuagugaugaaggauggaaggguauuaguggugcccuguagaaaccaagaugaacuaaucggcagagcacgaauaucucagggugcaggauggucucugaaagaaacagccuguuuaggaaaaucauaugcgcagauguggacacuaauguauuuccaucgaagagauuuaaggcuugcggcuaacgcaauauguagcgcgguacccagucauuggguaccaacaaguaggacuacauggucaauucaugcuaaccacgaguggaugacaacagaggacauguuagcagucuggaauagaguauggauccaagaaaacccuuggauggaggacaaaacuccuguggagucaugggaagaagugccauaucuuggaaaaagagaagaccaauggugcgguagucuuauuggucuaacaucaagagcuacaugggcgaaaaauauacagaccgcgauaaaccaaguacguagcuuaauaggaaaugaagaauacaccgauuacaugccaaguaugaagagauuuaggagagaagaagaggaagccgguguucuaugguag

SEQ ID NO: 22923 - RNA, 9876 nt, Artificial Sequence
  derived and/or modified CDS sequence (opt6) from DENV-2__GQ398308__SS-prME
accgcuggaguaauaauuaugcuuauaccgaccgccauggccuuccaccucacaacacguaacggggaaccccauaugauagucggccgacaagaaaaagguaaaucgcuauuauucaaaacagaagaugguguaaacauguguacuuuaauggcuauagaucucggggaacuuugcgaagauacuauaacauauaaaugcccccuacugcgucaaaacgaaccagaagauauagacuguuggugcaauaguacuucgaccugggucacauacggaacguguacaacuacuggcgaacaccgaagagagaaacgaucgguagcucuuguuccgcacgucggaaugggcuuagaaaccaggacagaaaccuggaugaguucagaaggugccuggaaacauguacaacguauagaaacuuggauacuacgacacccuggguucacgauaauggcggcuauauuagcauauacaauugggacaacacauuuucaacgggccuugaucuuuauacuacuaacagcuguggcaccuucuaugacaaugagguguauugguauuucuaaccgagauuuuguagaaggagucaguggcgguucauggguggauauaguacuugagcacggaaguuguguaacaacgauggcgaaaaacaaaccuacguuagauuuugaacuaauaaaaacagaagcaaaacaacccgcgaccuuaaggaaauauugcaucgaagcgaaacugacaaauacgacaacggaaucaagguguccaacucaaggugagccuucauuaaaugaagaacaagacaaaagauuugucuguaaacauucuaugguggauaggggcugggggaauggaugugggcuauucggaaaaggaggaaucgucaccugugcaauguuuacguguaagaaaaacauggaggguaaaguuguacuacccgaaaauuuggaauacacgaucguuauaacuccgcacucaggcgaagaacacgcaguaggcaaugauacggguaaacauggaaaagaaaucaaaauaacuccacaaucgagcaucacagaagcagaauuaacgggauacgggacuguaacuauggaauguagucccagaacgggacuugauuuuaaugaaaugguuuuacuucagauggaagacaaagcgugguuaguacauagacaaugguuucuagacuuaccgcugccauggcuuccgggugcugauacucaaggaucaaauuggauucaaaaggaaacacucguaacauucaaaaacccacacgcgaagaaacaagaugucguaguacuuggaagucaagaaggugcaaugcauacugcacuaacaggggcuacagaaauccaaaugucaaguggaaauuuacuguuuacuggacaucuaaaguguagauuacggauggauaaguugcaauuaaagggaauguccuauaguauguguacaggaaaauucaaaaucguaaaggaaaucgcugaaacacaacacgguacaauuguuauaaggguacaauacgagggugacggaucuccaugcaagauaccauuugagauaauggaccuugaaaaacgacauguauuaggucgacuuauuacagugaauccaauaguagcagaaaaggacucaccagucaauauagaggccgagccaccauuuggagauucuuacauaauuauuggcguagagccugggcaguugaaacuuaauugguucaagaaagggagcucuauuggacaaauguucgaaacuaccaugcgaggcgcgaaaagaauggcaauucuaggugauacggcuugggacuuugguucauuagguggcgucuucaccagcauaggaaaagcucuacaucaaguuuucggugcaaucuauggggcagccuucucaggaguuagcuggaccaugaaaauucuaaucggaguuaucauaacuuggauagguaugaauagucguaguaccagcuuaucgguuagcuuaguauugguagguguagucaccuuauauuugggugccaugguucaagcugauucgggcuguguagucagcuggaaaaguaaagaauugaaauguggcucugguauauuuaucaccgauaauguacauacuuggacggaacaguacaaauuucaaccagaaaguccuuccaaguuagcaucggcaauacaaaaggcgcacgaagagggaauaugugguaucagaucaguuacgcgacuagaaaacuuaauguggaaacaaauaacaccagaauuaaaucacauccucagugaaaaugaagugaaauuaacuauaaugacaggagauauaaaagguaucaugcaagcuggaaaaaggagcuuaagaccccagccaacagaacucaaguauagcuggaaaacaugggguaaggcuaagaugcuuaguacggagagccacaaucaaacauuccuuauagaugggccagagacggccgaauguccaaacaccaauagagccuggaacucucuagaaguugaagauuauggauucggaguauucaguacgaauauauggcucaaauuacgcgaaaaacaagauguguuuugcgauaguaaauuaauguccgcggcaauuaaggacaaucgugcaguacaugcagauaugggguauuggaucgagagugcuuuaaacgauacauggaaaauggagaaagccucauucaucgaaguaaaaagcugucauuggccaaaaucccauacauuauggucuaacggagugcuugaaagcgaaaugauaauccccaagaauuuugcgggcccggucucacaacauaauuaucgaccaggauaucacacacaaacagcaggacccuggcaccuaggaaaacuugaaauggauuuugauuucugugaagggaccaccguagucguaaccgaagacugcggcaacagaggacccucauugcgaaccacaacagcuucagggaaacuaauaacagaaugguguuguagaaguuguaccuugccaccucuacgauacagaggcgaagauggaugcugguaugggauggaaauacgaccccuuaaagaaaaagaagaaaauuuaguaaauagcuuagucacagcugggcauggucaaauugacaacuucagcuuagguguucuaggaauggcguuauuuuuagaagaaauguuacgaacgagaguugguacuaaacacgcaauguuauuaguagcaguaucauucguaacuuuaauaacugguaacaugucauuccgagacuuagguagaguuaugguaauggucggagccacuaugaccgaugacauagggaugggaauaacauaccuagcauugcuagcugccuucaaaguacgaccuacauucgcagcagggcucuuacucagaaaacuaacaucaaaagaauugaugauggcaaccaucggaaucgcccuacuaagucaaucaacaauaccagaaacgauuuuagagcuuacugacgccuuagcauuagguaugaugguguuaaaaauagugagaaauauggaaaaguaucaacucgcagucaccauaauggcuauuucuuguguaccaaaugccguaauacuacagaaugcuuggaaaguaucuuguacuauccuagcugcuguaucagugucuccucuguuauuaaccucaucacaacagaaggccgacuggauaccacuagcacugacgauaaaagggcuaaauccgacugcaaucuuucuuacaacucugucccggacgaguaagaaaaggaguuggccucugaaugaagcuauaauggcagucgguaugguaucaauacuugcauccaguuugcucaaaaaugacauaccgaugaccgggccuuugguagcaggaggguuauuaacaguauguuacguacucaccgggcgaagugcagacuuggaacuugaaagggcagccgauguaaaaugggaagaucaagcagaaauuucaggcagcucgccgauauuaagcauuacaaucagugaagacgguucuaugucaauaaagaacgaagaagaggaacaaacauugacaaucuuaauuagaaccggacuauugguuauauccggggucuuuccaguuucgauaccaaucacggcggcagcgugguaucugugggagguuaaaaagcaacgugcaggaguacucugggauguuccgaguccaccuccugugggaaaagccgagcuggaggauggagcguauagaaucaaacaaaggggaauacuaggcuacucgcaaauaggcgcgggaguauacaaagaagguacauuucauacaauguggcacguaacaagaggagcaguacuuaugcauagagggaaaagaauugaaccgucuugggcugaugugaagaaagauuuaauuucauacggcggaggcuggaaacucgaaggggaguggaaggaaggcgaagaaguucaaguuuuagcccuagaacccgguaaaaaucccagagcaguucaaacuaaaccaggccuuuucaaaacaaauaccggaaccauaggcgcagugucacuagauuucucuccggggacaucagggaguccaauaguagauagaaaagguaagguuguaggucuauaugggaauggcguaguaacccguucuggagcguaugugucagcgauagcucaaaccgaaaaaucuaucgaagauaacccugaaauagaagacgauauuuuccguaagaagcgguuaacuauaauggaucuacauccaggcgcgggaaagacaaagcgcuaucuaccagcaauagugagggaagcuauuaagagagggcuaagaacguuaauacuagccccuacaagaguaguagcugcagaaauggaagaagcucuaagaggauugccuauccgauaccaaacuccagcaauccgggcugagcauacagguagagaaauaguagaucuaaugugccaugcaacauuuacuaugagacuucugucgccagucagaguacccaauuauaauuugaucauuauggaugaagcccauuucacugauccagcgagcauugccgcgcguggguauauuucuacacguguagagaugggcgaagcugccggaauauuuaugacagcuacaccaccaggaucucgcgauccguuuccacagucaaaugcgccuauuauggacgaagaaagagaaauuccugagcguaguuggaacucgggacacgaauggguuacugacuuuaaaggaaagacaguaugguuuguaccuagcaucaaggcagggaaugacauugcugcaugucuccguaaaaaugggaaaaagguaauacaacuaucuagaaaaaccuucgacuccgaauauguuaagacucgcgccaacgacugggacuucgucguaacaaccgauauaucugagaugggggcaaacuucaaagcggaaagaguaauagacccaagacgcuguaugaaaccuguaauacuuaccgacggagaggaaagagucauacuggcgggaccgaugccaguaacucauucuucugcagcacaaagaagagguagaauaggucgaaaucccaaaaacgagaaugaucaauacaucuacaugggagaaccucuagagaacgaugaggacugcgcacauuggaaagaagcaaagaugcucuuagauaauauaaauaccccugaaggaaucauuccuagcauguuugaaccagagcgcgagaagguugaugcuauugauggagaauauagguugagaggugaagcuaggaaaacuuucguggaccuuaugcgacguggcgaucuccccguaugguuagcuuaccgcguggccgcggaaggaauaaauuacgcggacagacgauggugcuuugacggaaucaaaaauaaucaaauauuggaagaaaauguagaaguagaaauauggacaaaagaaggcgaaagaaagaaacucaaaccgagaugguuggaugcuaggauauauagcgauccacuugcacuaaaagaauuuaaagaauuugcagccggccgaaagucuuuaacacucaaucuuaucacagaaaugggacgcuuaccaacguucaugacacaaaaagcgcgugacgcuuuagacaaucucgccguacuacauacugcagaggcuggcgggcgagcauauaaccacgcacugucagagcuuccggagacuuuggagacacuacuauuauuaacauuauuagcaaccguaaccggaggaauauuucuguucuuaaugagcggcaaaggaauugguaagaugaccuuaggaauguguugcauaaucacggcaucaauccuauuaugguacgcucagauacaaccacacuggaucgcggcaagcauaauccuagaguucuuuuuaauaguuuuacuaauaccagaacccgaaaagcaacguacuccgcaagauaaucagcuaacuuauguagucaucgcuauccuuacgguaguagcagcaaccauggcuaaugaaaugggcuuucuggagaaaacuaagaaagaucuggguuuaggaucaauugcaacacaggagagcgaaucuaauauccuugauauagauuuacgcccagcaucagcauggacccuauacgcaguagcuaccaccuuugucacacccauguugaggcacagcauagaaaauucaucuguaaauguaucgcuaaccgcuauagcaaaucaagcaacaguacuuaugggacuaggaaaaggauggccacuuucuaaaauggacauuggaguaccauuacuggccauaggcuguuacagccaaguaaauccuauaacauugacugcagcacucuuauuacucguagcacacuacgcaauuauuggaccuggucuucaggcaaaggcaacacgcgaagcucagaaacgugcagcggcuggcauaaugaaaaauccuacgguagacggcaucacggugauagauuuagaaccuauuccauaugaucccaaauucgaaaagcaacuaggacaaguuaugcuccucauuuuauguguuacacagguauuaaugaugcgcacaacuugggcuuuaugugaagcguugacauuggcaacugguccaauauccacguugugggagggaaacccagggagauuuuggaauacaacgauugcagucagcauggcuaacaucuuuagaggcucauauuuggccggugcggguuugcuauuuuccauuaugaagaauacuacaaauacacgaaggggaacagggaauauaggugagacgcucggagaaaaguggaaaagucgacuuaacgcgcucgguaaaucagaguuccagauuuauaagaaaucgggaauccaagaaguagauagaacacuagcuaaagaggguaucaagagaggcgagaccgaccaucaugcagucagccgcggcucggcaaaauuaagaugguucguagaaagaaauaugguaaccccggaagguaaagucguagauuugggaugcggucgagggggauggucguacuauuguggaggccugaaaaacgugcgagaaguuaaaggucuaacaaaagggggaccaggccacgaggaaccuauacccaugucaacauacggauggaaucucguuagguuacagucaggugucgauguauucuuuaccccaccagaaaaaugugacacacucuuaugcgauauuggagaaaguucgccuaacccuacaauagaggcaggacgcacuuugagaguauugaaucuaguggaaaacugguugaacaaugacacucaguuuuguauaaagguuuuaaauccguauaugccuucuguaauugagaaaauggagacacuccagagaaaauauggcggagcuauuguacguaauccgcuuucgagaaacucaacccaugaaauguauugggugaguaacgcaacuggaaauauuguaagcagcguaaacaugauuucucgaauguuaauuaauagguuuacaaugaaacacaaaaaggcuaccuacgaaccggacguggauuugggcagcggaacacgaaauauugguauagaaucagagauuccuaaucuagauauaauugguaagcgaauugaaaagauuaagcaggagcaugaaacaaguuggcacuaugaccaagaucauccauauaaaaccugggcguaucauggcucauacgaaacaaagcagaccggcucugcuucauccauggugaauggcguaguuagguuauugaccaaaccaugggauguaguccccaugguuacacagauggcgaugacagauacaacgccuuucggucagcaacgaguguuuaaagaaaaaguagacacccgcacucaagaaccuaaagaaggaacgaagaaacucaugaaaauaaccgcagaguggcuauggaaagagcugggcaaaaagaaaacuccacggauguguacaagagaagaguucacacguaaaguaagaucgaaugcagcguuaggagcaauauuuaccgacgaaaauaaauggaaaagugcuagagaagcagucgaggacucccgauuuugggaacuaaucgauagggaaaggaauuugcaccuagaagguaaaugugaaacaugcguauauaauaugauggguaaaagagagaagaaacuaggagaauuugguaaagcaaaagggagccgugcuauaugguauauguggcuaggcgcuagauucuuagaguuugaagcacuggguuuccugaaugaagaccauugguucucccgcggcaauucccuuucuggaguagaaggcgaaggacuacauaggcucgguuacauacuacgagauguaagcaagaaggaaggaggagcaauguacgcugaugauacugcgggaugggauacaaggauuacucucgaagaccucaaaaaugaggaaauggucacuaaccauaugaagggagaacacaagaaacucgcggaggcgauauucaaauuaaccuaucaaaauaaagucgucaggguucaacgaccaacuccaagaggaacagucauggauauuauaucgcgaagagaccagcgcggaucaggccaaguagguacauauggcuuaaauaccuuuaccaauauggaagcacaauuaauuaggcaaauggaaggugaaggaauauucaagagcauacagcauuugaccgugacggaagaaaucgcaguucagaacuggcuugccagagucggaagagaaagacuaucuaggauggcuauaaguggagaugacugcgucguuaaaccacuagacgauagauuugcuucugcauuaaccgcucuaaacgauauggguaaaguaaggaaagauauacaacaaugggaaccuucaagaggcuggaacgauuggacucagguaccuuucuguucccaccauuuucaugaauuaguuaugaaagacggcagaguuuuaguuguaccuugucguaaccaagacgaauuaaucggcagagcaagaauaucgcaaggagcuggcuggagccuaaaagaaacagccugucuaggaaagucuuaugcacaaauguggacauugauguacuuucacaggagagaucuuagauuagcagccaacgcaaucugcagugccgucccuucgcacuggguaccaacaagucguacuacguggucaauacaugccaagcaugaauggaugacaacagaagacaugcucaccgucuggaauagaguuuggauacaagagaacccuuggauggaggauaaaacgcccguugagucaugggaggagguuccauaucuagguaagcgagaagaccaguggugcggaucauuaauaggucuuaccagucgcgcaacaugggccaaaaacauccaaacagcuauaaaucaaguucguaguuuaauugguaacgaagaauacacugauuauaugccgaguaugaaacguuucagaagagaagaggaggaagcuggcguauuaugguag

SEQ ID NO: 22924 - RNA, 9876 nt, Artificial Sequence
  derived and/or modified CDS sequence (opt6) from DENV-2__GQ398287__SS-prME
acagcagguguaauaaucauguuaauaccaacugcaauggcuuuucaccuaacaacgcgcaauggagagccgcauaugauaguuggacgucaagagaagggaaaaagucuguuguucaaaacggaggacggaguuaacauguguaccuugauggcuauagaccugggggaacuuugugaagacaccaucacauauaaaugccccuugcuaagacaaaacgaaccggaagauauagauugcuggugcaacucuacaucuacuugggugacauacgggacauguacaacgacaggagaacaucgaagagaaaaacgaucgguggcccuagugccacauguugguaugggcuuagagacgcgaaccgaaacuuggaugucaagugaaggggccuggaaacacguucaaagaauagagacauggauauuaaggcauccagguuuugcaauaauggcggcuauucuagcauauacuauagguacuacacacuuccaacgagcccuuauauucauacuuuuaaccgcagucgccccaucaaugacgaugcguuguaucgggauuagcaaucgugacuuuguagaggguguaucuggugguuccuggguagacaucgugcuugaacacggcucaugcguaacaaccauggcaaagaacaaaccaacgcuggacuucgaauuaauuaagacggaagcuaaacagccggcaacucugaggaaauauugcauugaggcuaagcucacaaauaccacgacagagaguagauguccuacccaaggugaacccagccucaacgaagaacaagacaaaagauucgucuguaaacauaguaugguggaucguggauggggcaauggauguggauuauucggaaaaggaggcauuguuacuugcgcgauguuuacuugcaaaaaaaacauggaggguaaaguaguacucccagaaaaccuugaguauacgauaguuauaacaccccacucaggcgaagaacacgcgguuggaaaugacacugggaaacauggaaaagaaauaaaaaucacaccucaaucguccauuacugaggcugaacuaacuggauaugguacugugacgauggaaugcucaccaagaacaggauuggauuuuaaugaaaugguccuacuacaaauggaagacaaagcaugguuaguacaucgucagugguuuuuggaccuaccguuaccaugguuaccgggagcugauacccaaggaagcaauuggauacagaaagaaacacuugugacauuuaaaaauccccaugcgaaaaaacaagauguaguaguacucggcagucaagaaggugcaaugcauacagcuuuaacuggggcgacagagauucaaaugaguuccgguaaucuauuguucacaggacaucuaaagugccgacuucguauggauaaacuucaguuaaaaggaaugucuuauuccauguguacuggaaaauuuaaaauagucaaggaaauugcggaaacacaacauggaacuauugugauaagaguucaauacgagggagauggaucuccauguaagauccccuuugaaauaauggaucuggaaaaaagacauguuuuagggcgcuugaucacaguaaaucccauagucacggaaaaagauucaccuguuaauauugaggcagaaccccccuucggggauucauauauaaucauaggaguagaaccagggcaauuaaaacugaauugguucaaaaaagguaguagcaucgggcaaauguuugaaacgacgaugagaggagcgaagcggauggcaauucuuggggauacagcaugggacuuuggaaguuuaggaggaguauuuaccucaaucgguaaagcucuccaccagguauuuggcgcgauauauggugcagccuuuucuggagugaguuggacaaugaagauuuuaauuggcguaauaaucacguggauaggaaugaacagccggucaacaagccuaucaguuagcuuaguauuaguuggaguaguaacauuauaucuuggugcuaugguccaggccgauaguggauguguggugaguuggaaaagcaaagaguuaaaaugcggcucaggaauauucauaacagauaacguucacacuuggacugaacaauauaaauuucagcccgaaucuccuucgaaauuagcgucggcaauccagaaagcucaugaggagggaauaugcggcauacgcaguguaacaagacuggaaaauuuaauguggaaacagauaacucccgagcuaaaucacauacugagugaaaaugaaguuaaacucacgaucaugacuggagauaucaaaggcaucaugcaagcagggaaaagaagcuuacgaccacaaccgacagaacugaaauacucuuggaaaacaugggggaaagcaaaaauguuaucuaccgaaagccacaaccagacauuuuuaauugauggcccugaaacggcagaguguccaaauacuaacagagcauggaacucucucgaaguugaagauuaugguuuuggugucuuuaccacgaacauaugguuaaaauuacgcgagaaacaggauguauucugcgauaguaagcuaaugagugccgcgauuaaagauaacagggcaguccacgcugauaugggcuacuggauugagagcgcauugaaugacacguggaagauggaaaaggcauccuuuauugagguuaaaucaugccacuggccaaaaucucauaccuuauggucaaacgggguucuggaaagugaaaugaucauuccaaaaaaccucgcugggcccgucucacagcacaauuauagaccagguuaccauacacagaccgccgguccauggcauuuagguaaguuggaaauggacuuugauuucugugaggggacgacuguugucguuaccgaggauuguggcaauagaggaccaucucuuagaacaaccacagcaagcggaaaauuaaucacagaaugguguugucggucuuguacccucccuccacuccgauacaggggagaagauggcugcugguaugggauggagauacgacccuuaaaagaaaaagaggaaaaucuagucaacagucugguuacugcgggacacggccaaauugacaacuucuccuuaggcguacuuggaauggcacuauuucuugaagagauguuacgcacgagaguugguacaaaacacgcaauucuacucaucgcaguuaguuucguaacacuaauaacagggaacauguccuucagagacuuaggccgagugaugguuaugguaggcgcuacuaugaccgaugauauuggcaugggcgugacuuacuuggcccuacuggcugcauuuaagguaagaccuacauucgccgcuggacuuuuacuccgaaaauuaacaaguaaagaacuuaugauggccacgauagguauagcacuccuuucccaaucgacaauaccugaaacuauauuggaauuaaccgaugcuuuagccuuaggcaugaugguccugaaaauaguuagaaauauggaaaaauaucaacuagcagucacgauuauggccauaucuugcguacccaaugcaguuaucuuacaaaaugcuuggaaaguuucaugcaccauauuggcagcugucucgguaucaccacuuuuauuaacaucaucacagcaaaaagccgacuggauuccguuagcacucacaauaaaaggauuaaacccaaccgcaaucuuuuuaaccacuuugagcagaacuucuaaaaaaagaucguggccacucaacgaggcuauaauggcugucgguaugguauccauucucgcaaguagucuacucaagaaugauaucccaaugacuggaccuuuggucgcuggaggccugcugaccguauguuauguguugaccgggcgcuccgcagauuuagaguuggaaagagcggccgacguaaaaugggaggaucaagccgagauuucaggaaguucuccgauacucagcauuacgauauccgaagauggcaguaugaguauuaaaaaugaagaggaggaacaaacucuaacaauauuaauccgaacaggauuacuaguaaucucaggaguauucccaguuaguauuccuauuacugccgcggcgugguaucuuugggaaguuaaaaaacaaagggcaggaguauuaugggacguaccaucaccgccuccagucgagaaagcugagcuagaggauggagcuuauaggaucaaacagagaggcauacucggauauucacagauaggugcgggaguguauaaggaaggcaccuuccacacuauguggcauguaaccagaggggccguuuuaaugcacagagggaaacggauagagccuagcugggcagacguuaagaaagauuuaauaucauauggaggugguuggaaacucgaaggugaauggaaagaaggugaagaagugcaaguguuagcuuuagaaccaggaaaaaacccgcgugcaguacaaacaaaacccggauuauucaagacuaacacaggaaccauuggagcagugucguuagauuuuaguccagguaccucggguuccccuauaguagaucgcaaaggcaaaguaguuggauuauaugguaacgguguaguuacgcguucgggagcauacgugagcgccauugcacaaaccgaaaagaguauugaagauaauccggagaucgaagaugacauuuuucgaaagaagcguuuaacuauuauggaucuacacccaggagcuggaaagacaaaaagguaccuacccgcaauaguucgugaagcuauaaaaagaggacuaagaaccuugauuuuagcaccgacccgcguaguugcagccgaaauggaagaagcuuuacgaggauugcccauuagauaucaaacuccagcaauaagagcugagcauacgggacgggaaaucguagaccuaaugugucacgcaacguucacuaugagauuacuuagcccuguacggguacccaauuauaauuuaauuauaauggacgaagcacacuuuaccgaccccgcuaguauagcugcgaggggauacaucuccacacgaguagaaaugggcgaggccgcaggaaucuucaugacggcaacccccccagguucacgagacccuuucccacagaguaacgccccaauaauggacgaagaaagagaaauuccggagagaaguuggaacaguggacaugaguggguuacugauuuuaaaggaaaaacaguaugguuugugccuagcauuaaagcuggaaacgauauugccgcauguuuaagaaaaaacgguaagaaaguuauacaauuaucuaggaaaacuuucgauagugaauauguaaaaacgcgagcgaaugauugggacuucguaguaacaacagauaucucagaaaugggagccaauuuuaaagccgaaagggugauagacccucgcagguguaugaaaccaguaauccuaacagauggagaggaacgcgucaucuuagcaggaccgaugccaguaacccauucgagcgcagcacaacggcgaggaaggauaggaagaaauccgaaaaacgaaaaugaucaauacauauacaugggugagccucucgaaaacgacgaagacugcgcacacuggaaggaagcuaagaugcuuuuagauaacauaaacacuccugaaggaauaauacccucuuuauucgaacccgaaagagaaaaaguagaugccauugauggugaauacagauugcgaggggaagcuaggaagacuuucguugauuuaaugagaaggggcgauuuaccaguauggcuagcuuaccgaguagcagcagaaggcauaaauuacgcugacaggagaugguguuucgacgguaucaaaaauaaccaaauacucgaagaaaacguagaaguugaaaucuggacaaaagaaggagaaaggaaaaaauuaaaaccuagauggcuggaugcgagaauauauuccgauccacuugcguuaaaagaguuuaaagaauuugccgcugggaggaaaagucucacauuaaaucuaaucacugaaaugggacgacucccuacauuuaugacacaaaaagcccgggaugcgcuagacaaucuagcagucuuacauacugcagaagccgggggacgcgcguauaaucaugcgcuaucugaacuucccgaaacuuuagagacauuauuacucuuaacuuugcuugcaacagucaccggggguauauucuuguuccuaaugucaggucgaggcauugguaaaaugacauuagguaugugcuguauaauaacggcgucuauucuacuaugguaugcccaaauucaaccacacuggauugcugcuucgauaauacuagaauuuuucuuaauaguguuauuaauaccugagccagaaaaacagagaaccccccaggauaaccaauuaacguacguaguuauugcgauauuaacgguuguagcugcgacgauggcaaaugaaaugggauuuuuagaaaaaaccaaaaaagaucuugguuuaggauccauaaccacacaagagagugaaucaaauauuuuggacaucgaucuccgaccagccucagccuggacacuauacgcaguagcaacaacuuucgugacaccgauguuaaggcacagcaucgaaaacuccucagugaauguaucucuaacggcgauugcuaaucaagcuacaguguuaaugggucuaggaaaagguuggccauugucaaagauggauauaggugugccuuuguuggcaauagggugcuacagucaagugaaccccauuacccuaacagcagcguugcuacuccucguugcccauuaugcgauaauaggaccagggcuucaagcgaaagcuacuagggaggcacaaaagagagcagcagcggguauuaugaaaaauccaacaguagaugguauuacaguaauagaccuggaaccgauacccuaugauccaaaauucgaaaaacaauuagggcagguaauguuacugaucuuaugcgucacucagguguugaugaugagaacaacaugggcuuugugugaagcgcuuacuuuggcuacuggaccaauuucaacacuaugggaagguaaccccggcagguucuggaauacaacuauugcuguaucaauggcgaacauuuucagggguucuuaccuugcgggcgcaggauuguuauucucaauuaugaaaaauacuacaaacacgaggcgagggacuggcaacauuggugaaacguuaggagaaaaauggaaaucuaggcuuaacgcuuuaggcaaaucugaauuccaaauauacaaaaagucaggaauacaagagguagauagaacacuggcaaaagaaggaauaaaaagaggggaaacugaccaccacgcagugaguagaggaucggccaaacugagaugguucgucgagaggaacauggugacaccugaagggaagguaguagaccuaggaugcggaagaggaggaugguccuauuacuguggaggauuaaagaauguuagagaaguuaaaggacugacaaaaggcggccccggucacgaggaacccauuccgaugagcacauauggauggaaccuaguacgauugcaaagcgggguagauguauucuuuacucccccagaaaaaugcgauacaguucuaugugauauaggagagucaucacccaauccgacaauagaggcuggaagaacucuaagaguucuaaaccuggucgagaauugguuaaacaauaauacgcaauuuugcaucaaaguacuaaauccauauaugccuucagugauugaaaaaauggagacguugcaaagaaaauauggcggagcauugguuagaaacccauuauccagaaacaguacucacgaaauguauugggucaguaaugcuacaggcaauaucguuaguucaguuaauaugauaaguagaauguuaauuaauagauucacgaugaagcauaaaaaagcgacuuacgagcccgauguugaucuaggaucuggaacacgaaauauugguauugaaagcgaaauaccaaauuuagacauaaucggcaagagaauugaaaaaauaaaacaggagcacgaaacaaguuggcauuaugaucaggaucacccauauaaaacaugggcuuaccacggcucguaugaaacgaaacaaacaggaucagcgaguuccaugguaaauggaguaguaagauuauugacgaaaccaugggacgucguaccaaugguaacucaaauggcaaugacagauacaacacccuuuggacaacaaagaguauucaaagaaaaaguugacacgagaacccaggaaccaaaagaagguacaaaaaaacuaaugaaaauuacggcagaaugguuauggaaggaauuggguaaaaaaaaaacuccacggaugugcaccagagaagaauuuacuaggaagguucgaucaaaugcagcacuaggugcaauauucaccgaugagaauaaauggaaaucugcucgagaggcaguagaagauuccagguuuugggaacuaauagauagggaacguaaccuacauuuagaggggaagugugaaacgugugucuacaacaugaugggaaagcgcgagaaaaagcuaggugaauucggaaaggcaaaaggaucgagagccauaugguacauguggcuaggcgcacguuuuuuggaguuugaagcauuggguuuccucaacgaagaccauugguucucaaggagaaauucacuuucaggugucgagggggagggauuacauagauuaggauacauauuacgagauguaaguaagaaagaagggggcgcaauguaugcagacgacacggcaggaugggauacuagaauaacccuagaagauuuaaaaaaugaagaaaugguuacuaaucauaugaaaggggagcauaaaaaacuagcagaggcaauauuuaaguuaaccuaucaaaacaaaguggucaggguacagcggcccacucccaggggaacggugauggacauaauaucucgaagagaucaaagaggcaguggccaaguagggaccuacggacugaacacauuuacaaauauggaagcacaauuaauacgucaaauggagggagaaggaauauucaaaaguauacaacauuuaacagugacagaagagauagcaguacaaaacugguuagcuaggguaggucgugaacgguuaucaagaauggcaaucagcggugacgacugcguagugaaaccguuagacgaucguuuugcaagcgcacuaacagcgcugaaugauauggguaaaguuagaaaagacauacagcagugggagccaagccggggauggaaugauuggacgcaaguuccguucuguagucaccauuuccaugagcuaguuaugaaagauggucgcguauuagucgugccuuguagaaaucaagacgaauuaauugggagagcgcgcauaucccagggugcagguuggucauugaaagagacugcaugucuugguaagucauacgcgcagauguggacucuuauguacuuccacagacgagaucuacgucucgccgcgaacgcaaucuguagugcugugccuucacauuggguaccaacuaguaggacgacauggaguauucaugcaaaacaugaauggaugacgaccgaagacaugcuggcaguguggaaucgcguauggauucaggaaaacccauggauggaagauaaaacgccaguugaaaguugggaggagguuccuuauuuagguaagagagaggaccaaugguguggaucuuuaauuggacucacuagccgagcuacaugggcaaagaacauacaaacagcaauuaaucagguacgaucuuuaauuggaaacgaagaauauacggauuauaugccgucaaugaagagauuucgacgcgaagaagaagaagcaggcguuuuaugguga

SEQ ID NO: 22925 - RNA, 9876 nt, Artificial Sequence
  derived and/or modified CDS sequence (opt6) from DENV-2__GQ398302__SS-prME
acugcaggagucauaaucaugcucauaccaaccgcaauggcauuucauuuaaccacuagaaacggagaaccucacaugaucguaucaagacaggaaaaaggaaaaucuuuacucuucaaaacugaagaugguguuaauauguguacauugauggcuauagacuuaggagaauuaugcgaagacaccauaacguauaaaugcccacuauugcgacagaacgaaccagaagacauagauugcuggugcaauuccacuucaacaugggucacauaugguaccuguacaaccacgggagaacaucggcgagaaaaacggucuguggcucuaguuccacauguuggaaugggcuuggaaacacgcaccgagacuuggaugucgucagaaggggcguggaaacauguucaaagaaucgaaacguggauccuucgacauccaggauucacuauuauggcugcaauucuugcguauaccauaggaacuacacauuuucaacgagcacugaucuucauacuauuaacagcaguugcaccuucaaugacuaugagguguauaggaauuaguaauagagauuuuguggaaggggugaguggugguucauggguagacauaguauuagaacacgguagcuguguaacaacuauggcuaaaaauaaaccaacacuggauuuugaacuuauaaaaacugaggcaaaacaaccggcaacgcugcgaaaauacugcauagaggcgaaacuuaccaacacuaccacagaaaguagaugccccacacaaggugaaccuaguuuaaaugaagaacaagacaaaagauucguuuguaaacacucgaugguugauagagguugggggaauggguguggucuauuuggaaaaggaggaauaguuacaugugccauguucacguguaagaaaaauauggagggcaaagucguauuaccagagaaucuagaauauacaauagugauaacuccacauaguggagaagaacaugcgguaggcaacgauaccggaaaacacggaaaagaaaucaaaauaacaccgcaguccucuauaacggaggccgagcuuaccggguacgggacuguaacgauggaauguucuccgagaacgggucucgacuucaacgaaauggugcuuuuacaaauggaagauaaagcaugguuagugcacagacaaugguuuuuggauuuaccgcuuccgugguuacccggugcagacacccaagggagcaacuggauucaaaaagaaacucuaguaacauuuaaaaauccucacgcuaagaaacaggacguugugguguuaggaagccaagaaggcgcuaugcacacggcucucacgggcgcaacagaaauccaaaugucaucuggcaaccuacuauuuacuggacaucuaaaauguaggcugagaauggacaaauugcaauuaaaaggcaugucguacucuaugugcaccgguaaauucaaaauaguaaaagaaauagcggagacucagcauggaacaauagugauuagaguccaauaugaaggggacggaagcccauguaaaaucccguuugaaauaauggaucuugagaaaagacaugugcuaggucggcuuauaacaguaaauccaauaguagccgaaaaagauucaccuguuaauauugaagcggaaccgccauuuggggacagcuauauaauuauuggaguugagcccggucaacuuaaauuaaauugguuuaagaaagguucauccaucggacaaauguuugaaacaaccaugcgaggagcaaaacguauggccauuuuaggggauaccgcuugggauuuugggagcuugggugguguauuuacaucuauuggaaaagcauuacaccaaguguucggagccauauauggugcugcauuuucugguguuucauggaccaugaaaauauuaaucgguguaauuauaaccuggaucggaaugaacucaaggucgaccagcuuauccguuucccuaguauuagugggagucguaacguuauaucuaggagcgauggugcaagcagauucaggaugcguaguuucuuggaaaaguaaagagcucaaaugcggaucagguauuuucauaaccgauaacguucauacauggaccgaacaauauaaauuucaaccagagucuccuaguaaacuagcaucggcaauacaaaaagcucaugaagaggguauuugcggaauacggucaguuacaagacuagaaaaucuaauguggaaacaaaucacuccagaauugaaccauauacuaucugagaacgagguaaaauuaacgaucaugacgggugacauaaaagguauaaugcaagcuggcaagcguucacucagaccucagccaacagaacugaaauauaguuggaagaccuggggaaaagcaaaaaugcuaaguacagaaucccauaaccagacauucuuaauugacgggccugagacggcugagugcccuaacacaaaucgagccuggaacucccuagagguagaagacuacggguuuggagucuuuacaacaaacauauggcuaaaauuacgagaaaaacaggaugucuuuugugauucgaaauuaaugagugcagcuauuaaagacaaccgagcgguacaugccgacaugggauacuggauagagucugcacuuaacgauacuuggaagauggagaaagccagcuuuauagaagucaaaaguugucacuggccuaaaucacacacauuauggaguaauggaguacuagaaucagaaaugauaauacccaaaaauuuugcuggcccagucucacaacauaauuaccgacccggguaucacacccaaaccgccgguccguggcaucucgggaaacuugaaauggacuuugauuuuugcgaaggcacaacagucguaguaaccgaagauugcgguaaccggggaccuagcuuacgaacgacuacagcgucaggaaaacuaauaacggaauggugcugucguucauguacucuuccgccccuucgauauaggggagaagacgguugcugguacggaauggaaauuagaccccucaaagagaaggaagagaauuuaguuaauucccuagugacugcggggcauggccagauagauaauuuuagccuggguguauuagguauggcucuauuucuagaggagaugcuuagaacacguguaggaaccaaacaugcuauguugcugguagcagugucuuucgucacccuuauaacaggcaauaugaguuuccgugaccuuggucgaguaauggucaugguaggugcuacaaugacggaugacauagguauggggauuacauaccuagcauuacuugcagcauuuaaaguaagacccacauucgccgccggccucuuauugagaaaauuaacaucaaaagaauuaaugauggcaacaaucggaaucgcauuguuaucucaaaguacaauuccagaaaccauucuagaacuaacggacgcuuuagcccuugggaugaugguacugaaaauaguaaggaacauggaaaaauaccaauuggcaguuacaauaauggcaauaagcugcguacccaacgcugugauccuucaaaaugcguggaaaguuucauguacgauuuuagcggccguuucuguauccccuuuacucuuaacaucaucgcaacaaaaagcugauuggaucccucuggcucuaaccauaaaagggcuaaauccaacagccauauucuuaacaacacucuccagaacgaguaagaaacgaaguuggccuuuaaaugaagcgauuauggcuguggguaugguaaguauacuugcaucuaguuugcucaaaaaugacauacccaugacagggccucucguagccggaggauuacucacgguauguuacguguuaacuggaagaucugccgacuuagaacuugagagggcugcugacgugaaaugggaagaccaagcagagauaaguggcucaucuccaauucuuagcauuacuauaagugaagauggaucaaugagcauuaagaaugaggaagaggagcaaaccuugacaauacugauaagaacaggccuuuuaguaauaagugguguuuuuccuguuucaauucccauaacugcagccgcaugguacuugugggaagugaagaaacaaagggcuggaguccucugggauguuccuagucccccaccuguggguaaggccgaauuagaggauggugcauaucgaauaaaacaaagaggcauucucggauacagucaaauaggagcaggcguauauaaggaagguacauuccauacuauguggcacguuacgcgcggugcugugcucaugcaucguggaaagcgcaucgaaccaaguugggcagacguaaagaaagacuugaucucauacggaggaggguggaaguuagaaggggaauggaaagaaggagaagaaguccaaguacuagcccuugaaccuggcaaaaauccucgagcaguacaaacgaagccugggcucuuuaagaccaauacuggcacaauaggggccgugagucuugauuucagcccaggaacuucaggauccccuaucguagacagaaagggaaagguuguaggguuauaugguaaugguguugucaccagaucaggggcguacguaagcgcaaucgcgcaaacggagaaaaguauugaggauaacccugaaauagaagaugauauauuuagaaagaaacguuuaacgauuauggaucuacauccaggagcagggaagacaaaaagauaccuuccagcaauaguaagagaggccauuaagcgagguuuacggacucuuauccuagcaccaacacgagucgucgccgccgagauggaggaagcacuuaggggauuaccaauccgguaucaaacaccagcaaucagggcggagcauacggguagagaaauuguagaucuaaugugccaugcuacauuuacuaugaggcuucugucaccaguuaggguuccaaacuacaacuugaucauuauggaugaggcacauuucaccgaccccgcaagcauagcggcaagaggauacauaaguacucgcguagaaaugggugaagcggcugggauauuuaugacagcaacaccaccaggaucucgugauccguuuccacaaaguaacgcacccauuauggacgaagagagggaaauuccggaaagaucauggaauaguggacacgaauggguuacagauuuuaaaggaaagacagugugguuugugccaucaauuaaagcaggaaacgauauagcggcuugucuacggaagaacggaaagaaaguaauacaguuaaguagaaaaacuuuugacagcgaauaugucaagacacgugcgaacgacugggacuuuguuguaacgacggauauuagcgaaaugggugcaaauuucaaagcugagagagucauagauccgcgcagaugcaugaaaccaguaauauuaacagacggagaagaaagaguaauccuagccgguccaaugcccguaacacauucaagugcugcccaaaggagagggagaauaggacgaaaucccaaaaaugaaaaugaucaauauaucuacaugggcgaaccauuagagaaugaugaagacugcgcacauuggaaagaggcgaaaaugcucuuagauaacauaaauacaccggaaggaaucaucccgucuauguucgagccagaacgagaaaaagucgacgcgauagacggagaauacagacuccguggggaggcuagaaagacuuuuguggaucuaaugagaaggggcgaccuacccgucuggcuggcauaccguguugcggcagaaggcauaaacuaugcagauagacgaugguguuuugacggaauuaagaauaaccaaauucuggaagaaaacguagaaguugaaauauggacaaaagaaggagaaagaaagaaauugaaaccgagauggcuggacgcaagaauuuauucggauccauuagcauuaaaagaauuuaaagaguucgcagcugggcgaaaaucacuaacacucaauuugauaacggaaaugggacgacugccgacauuuaugacacaaaaggccagagaugcuuuagacaaucuagcaguacuucauacagcagaagcgggaggacgagcauacaaccaugcauuauccgaacugccagaaacucuagaaaccuugcuacuacuaacacuguuagcaacuguaacgggagguaucuuucuguuccuuaugucuggaaaaggcauaggaaaaaugacccugggaauguguuguauaauaacagcgucgauacuauuaugguacgcacaaauucaaccucauuggauagcagcauccauuauacuagaguucuuuuuaauagugcuuuugauaccagaacccgaaaaacagcgaacgccacaagacaaccaacucacuuacguuguaauugcaaucuuaacaguaguagcagcaacaauggcgaacgaaauggguuucuuagaaaagacuaagaaagaccuaggacuaggaucuauagcaacucaagaaagugaaucaaacauauuagauauagauuuaaggccagcuucugccuggacacuuuacgcuguggcuaccaccuucguuaccccuaugcuccgacacucuauagaaaacagcagcguaaauguaucccuaacggcaauagccaaccaggcaaccguacuuaugggacugggaaaaggauggccguuaaguaaaauggacauagguguuccacuccuugccauaggaugcuauucacagguaaauccuaucacguuaacugcggcauugcuucuuuuaguggcacacuacgcuauaauagguccaggacuucaagcaaaagcuacaagggaggcucaaaagcgggcugcagcagguauaaugaaaaauccaacaguugacggcauaacaguaauagauuuagaacccaucccauacgacccaaaauuugaaaaacaauugggucaaguaaugcuacugaucuuauguguuacucaaguucucaugaugagaacuacaugggcauuaugcgaagcauuaacacuugccaccggaccaauaucuacacuaugggaaggcaacccuggaagauucuggaacaccacaauagcgguuucgauggcaaauauuuucagagggucguacuuagccggugcgggauuauuguuuucaaucaugaagaauacuacaaacacacgcagaggaaccggcaacauuggugaaacacuaggcgaaaaauggaaaucgcgccuuaaugcacugggaaaaucugaguuccaaaucuacaagaaaagcgguauacaggagguagauagaacuuuggcuaaagaaggcauuaaacgcggagagaccgaccaccaugcuguaucgcgaggaagcgcuaaauuacggugguuuguggagaggaacauggucacaccagaggguaaagucguagaccuuggauguggacgaggcgguuggucauauuacugcggcggacuuaaaaauguaagagaagugaaaggucuaacuaaaggagggccuggucaugaagaaccgaucccgaugucaaccuaugguuggaauuugguuaggcuacagagcggaguggacguauucuuuacacccccugaaaaaugugauacgcuacuuugcgacauaggcgaaucauccccuaauccgacaauagaagccggucgaacucucaggguucuaaaccuaguugaaaauuggcucaauaauaacacccaauuuuguaucaaaguauuaaauccauauaugcccucagucauagagaaaauggaaacacuccaaaggaaauaugguggugcucuaguacgaaauccacugucaaggaauagcacgcaugaaauguacugggucaguaaugcaacaggaaauaucguaucaucuguaaauaugauaaguaggaugcucauuaauagauuuacgaugaagcauaagaaagcaacauacgaaccggauguugaucuaggaagugguacuagaaacauaggcauagaaagcgaaauuccaaaucuggauauuauagguaaacgcauugagaaaaucaaacaagaacaugagacaucauggcauuaugaccaagaucacccuuauaagaccugggccuaucauggaucauacgaaacaaaacagacgggcagugcuucauccaugguaaauggaguaguaagguuauugacuaaacccugggacgucguaccaaugguuacccaaauggcuaugaccgacacaacaccguuugggcaacaaagaguuuuuaaagaaaaaguagauacaaggacgcaggagccaaaggaaggcacgaagaaacuuaugaaaauaacggcugaguggcuguggaaagaguuagguaaaaagaaaacuccacguaugugcacucgcgaggaauuuacccgcaaaguuagaaguaacgcggcuuuaggagccauauuuacagaugagaacaaauggaaaucagcucgagaagcggucgaagacucacgauuuugggaacucauagaucgggaaaggaaccuccacuuagaaggcaagugugagacuuguguauacaauaugauggguaagagagagaagaaacuaggagaguucggaaaagcgaaagguucaagagcaaucugguauauguggcucggugcuagauuucuagaguucgaagcgcugggauucuuaaacgaagaucacugguucaguagggguaauucguuaucuggcguagaaggagaaggauuacacagauuaggauacauauuacgagauguaaguaagaaagagggaggugcuauguacgcugaugacaccgcgggaugggauacuagaauaaccuuagaagaccucaaaaaugaagaaaugguuaccaaccacaugaaaggagaacauaagaaacuagcugaagcaauuuucaaacuaacuuaucaaaauaagguaguucgggugcaaaggccaacuccacgagggacuguaauggacaucauaucccgacgagaccaacgagguuccggacaggucgguacuuauggcuuaaauaccuuuaccaauauggaagcgcaacugauucgacaaauggaaggggaaggaaucuucaaaucaauacaacacuuaacaguaacggaagaaaucgccguacaaaacuggcuagccagaguaggucgggaacgcuugucacguauggcuauuucuggggacgauuguguuguaaaacccuuagaugaccgguuugcaagcgcauuaacugcauugaaugacaugggaaaaguacgaaaggacauacaacaaugggaaccaagucguggguggaaugauuggacgcagguaccauucugcucgcaucauuuucacgaguuaguaaugaaagacggacggguauuagucguccccugucgaaaccaggaugaacugauaggccgcgcacgaaucagucaaggugcuggauggucacuaaaagaaacugcuugcuugggaaaguccuaugcacaaauguggacguugauguauuuucaccgaagagacuuaagauuagcagccaaugcaauauguucugccguaccaucacacuggguacccacaagucgcacgacaugguccauccacgcgaaacaugaauggaugacaacugaggacaugcuggcuguauggaauaggguuuggauucaagaaaauccuuggauggaagauaaaacaccuguagaaaguugggaagaaguuccauaucuagggaagagggaggaucaguggugcggcagcuuaaucggucucacaagucgcgcaacaugggccaaaaauauacaaacagcaauaaaucaagugagaucuuuaaucggcaaugaggaauauacagacuauaugccaaguaugaagagauucagaagagaagaggaagaagcgggaguauuaugguag

SEQ ID NO: 22926 - RNA, 9876 nt, Artificial Sequence
  derived and/or modified CDS sequence (opt6) from DENV-2__GQ398272__SS-prME
accgcagguguaauuaucauguugauaccuaccgcaauggccuuucauuuaacaacuagaaauggagaaccgcauaugauaguaggccgacaagaaaaaggaaaaagccuauuauuuaagacagaagacggcguuaacauguguacauuaauggcgauugaccucggagaguuaugugaagauacuauuacauauaaguguccacuuuuaagacagaaugagccugaggauauugacuguuggugcaacuccacaucuacaugggucacguaugggacuuguacuacuacaggggagcaccgccgagaaaaacgaagcgucgcuuuaguaccucacguagguauggggcucgaaacuagaacugaaacauggaugucgucagagggagccuggaagcacguucagagaauagagaccuggauacuaaggcauccaggauuuacaauaauggcggcaauauuggccuacacuauagguacaacucacuuucagcgcgcucuuauauuuauccucuuaacagccguugcgccaaguaugacaaugagauguauagguauaucaaauagagauuuuguugagggaguuaguggagguucuuggguagauauaguucuagaacauggaaguugugucacaacgauggcaaagaauaaaccuacauuagacuucgaauuaauaaaaacggaggcuaaacaacccgcgacacuacgaaaauauuguauagaagcaaaauuaaccaacacaacuaccgaaucucgcuguccuacucagggugaaccaucauugaaugaagagcaagacaaaagguuuauauguaaacacucuauggucgacagaggcuggggaaacgguugcggacuauucggaaaaggagguauaguuacuugcgcgauguuuacuuguaaaaagaacauggagggaaaaguaguauuacccgaaaaucuugaauacacuaucguuauaacuccacauucuggagaagagcaugccguagggaaugacacaggcaaacauggaaaagagaucaaaaucacaccacagucaaguaucacagaggcagagcuaaccgguuauggaacaguuacgauggaguguaguccaaggacaggauuagauuucaaugagaugguauuacuacagauggaagauaaagccugguuagugcaccggcaaugguucuuggacuugccacugccuuggcuaccaggcgcggauacucaaggaagcaacuggauacaaaaagaaacauuaguuacuuuuaaaaacccucaugcaaaaaagcaggacguaguaguacuagggucacaagagggugccaugcauacggcacuaaccggcgcaacggagauacagaugucaagcggaaauuuacuauuuacaggucaucuaaaaugcagauugaggauggacaagcuacaauuaaaagggaugucauauaguaugugcacgggaaaguucaaaauagucaaggaaauagcugaaacccaacacggaaccaucguaauucgcguacaauaugaaggugacggaagccccuguaaaauaccauucgaaauuauggauuuagagaaaagacacguacucgggcguuugauuacaguaaacccaauagucacggaaaaggauagcccagugaacaucgaagccgaaccucccuucggagauaguuauauaauaaucggaguggagccgggucaacuuaaacuaaauugguucaagaaagguaguaguaucggacaaauguuugaaacuaccaugcgaggagcaaaaaggauggcaauccucggggacacagcaugggacuuuggaucacuaggcggcguauuuaccucuauugguaaagcgcuccaccaaguauuuggcgccauuuauggugcggcguuuaguggaguaucauggacgaugaaaauacucauugggguuaucaucaccuggauaggaaugaacucaagaagcacuucguuaucgguuaguuuagugcuaguagggguuguaacucuuuaucucggcguaaugguacaggccgauagcgguugugugguaucauggaagaacaaagaauuaaaauguggaaguggcauuuucauaacugauaauguacacacauggacagaacaguauaaguuucaaccagaauccccaucaaaauuagccagcgcaauacaaaaagcucacgaggaggguauaugcggaauuaggaguguuaccagacuagaaaauuugauguggaagcagaucaccccagaacuaaaucauauauugucugaaaacgaaguuaaacuuacaauuaugacaggagacauuaaaggcauaaugcaagcagguaaacguagccuuagaccacagccuacagaauuaaaauacuccuggaaaacuuggggaaaagccaaaauguugagcacggaaucacauaaccagaccuucuugauugaugguccagaaaccgccgaauguccaaacacaaaucgcgcauggaacucucucgaaguagaggauuacggauucggaguauuuagcacaaacauaugguugaaacugagggaaaaacaagacguguucugugauucuaagcugaugucagcagcgauaaaagacaaccgagcaguccaugccgacaugggguacuggauugaaagugcauuaaaugauacauggaagauggaaaaagcgucuuuuauagaaguaaaaaguugucauuggccuaaaucccauacacuauggagcaacgguguguuggaaagcgaaaugauaauuccuaaaaauuucgcgggcccgguaagucaacacaauuauagacccggguaccacacccagacggccggcccuuggcauuugggcaaacuugagauggacuuugacuucugcgaaggaacgaccguuguggucacagaagauugcggcaaucgaggaccaucccuaagaacaacuacugcaucugggaaacuuaucacugaaugguguugucggagcuguacguuacccccuuuaagguauagaggggaagauggauguugguauggcauggaaauacgaccguuaaaggaaaaggaggaaaauuugguaaauucacuuguaacugcuggucacggucaaauagauaacuuuucacugggggucuuggguauggcauuauuuuuggaggaaauguuacggacacguguggggacgaaacaugccauccucuuaguagcaguaagcuucgugacguuaauaaccggcaacaugagcuucagggauuuaggaagagucaugguaaugguaggagcaaccaugacggaugacauagguaugggcguaacuuacuuagcauugcucgccgcuuuuaaaguacguccaacuuuugcagccgggcuacuucuaagaaaacuaaccaguaaagaacuuaugauggcaaccauuggaauagcgcuacugucacagaguaccauaccagagacgauauuggagcuaacugaugcacuugcucucggcaugaugguauuaaaaaucguccgaaacauggaaaaauaccaauuggcaguaacaauaauggcaauauccugcguuccgaaugcggugauccuacaaaacgcguggaaaguaucguguacuauuuuagcugccguuucuguaaguccucuauuauuaacuucuucacaacaaaaagcggacuggauuccccuagccuugacgauuaagggucuuaauccaacggcaauauuucugaccaccuuaucacgaaccucuaagaaaagaucuuggccauugaaugaagcaguaauggcuguagggaugguaagcauucuagcaucaagcuuacuaaaaaaugacauaccaaugacuggaccccugguggccgguggucuauugacaguauguuauguacucacuggaagaagcgccgaccuagaacuugagagggcggcugacguuaaaugggaagaccaagcugaaauaagcgguucuagcccaauccuauccauaacgauaucagaagauggaucaaugucgauuaagaaugaagaagaggagcagacucuaacgauucuaauuagaacaggccuuuuaguaaucucaggcgucuucccaguaagcauacccauaacugcagcagccugguaccucugggagguaaaaaaacagagggcaggagugcuuugggaugucccuagcccaccaccgguaggaaaagccgaacuagaagauggagcauaccgcauaaaacaaagaggaauauucggguauucccaaauaggagcaggaguauacaaggagggcacauuucauaccauguggcacguaacgcgcggagcaguauuaaugcacaggggaaaaagaauagagccaucuugggcggacgugaaaaaagaccucaucucauacggaggaggguggaaauuagagggugaauggaaggaaggagaagaaguucagguccuggcacuggaaccgggcaaaaacccccgagcgguacaaacuaaaccaggccuauucaaaacuaacacagguacaauuggggcagucucauuggacuuuucucccgggacuagugggucaccuauaguugaucgaaaaggaaaaguaguggggcuguacggaaauggagugguaacgaggucgggagcuuacguaucugcgaucgcgcaaacugaaaaaaguaucgaggauaauccggaaauagaagaugauauuuuucguaagaaaagacuaacuauaauggaucuacacccaggggcaggaaagacaaaaagguaccuuccugcgauaguacgagaagcaauuaaaagagguuugcgcacgcuuauauuggccccaacgaggguuguagcagcagaaauggaggaagcucuacguggauugcccaucagguaucaaacacccgccauaagagcagaacacacagguagagaaaucguugaucugaugugccacgccaccuuuacaaugcgccuguugaguccagugcgcgucccgaauuauaauuuaauaauuauggaugaagcucauuuuacugacccagcauccauagcagcacgaggcuacauaucuacacgcguagaaaugggugaagcugcaggaauauuuaugacagcaacuccgcccgguuccagagauccguuuccgcaaucuaaugcaccgaucauggacgaagaacgggaaauaccagaaaggucguggaauaguggacacgaauggguuacagauuucaaagggaaaacuguaugguucgucccuuccauaaaagcggguaacgauauagcugcguguuugcgaaaaaacgggaaaaagguuauacaauuaagucgaaaaacguucgauagugaauacgucaaaacaagagccaaugacugggacuuugucgugacuacagacauaagugaaaugggagcuaauuuuagagcagaaagaguaauagacccacgacgauguaugaagccaguuauccuuaccgacggcgaggaaagagugauacuugccggaccaaugccggugacacauaguucagcugcacaaagaagagguaggauugguaggaacccaaaaaaugagaaugaucaauauaucuauaugggagagccuuuagaaaacgaugaagauugugcucauuggaaggaagcaaaaaugcuauuggacaauaucaauacgccugaagguauaauaccuucaauguuugagccagaacgagaaaaggucgaugcuauagauggggaguaucgucuacgcggagaagcaaggaaaacauucguagaccuaaugagacgcggagauuuaccggucuggcuggcauacagaguagcugcugaagggauaaacuaugcagaccggaggugguguuuugauggaauuaaaaauaaucaaauccuagaagaaaaugucgaaguugaaaucuggacgaaggaaggugaaaggaaaaaacuaaaaccaagaugguuagaugccagaaucuauagcgaccccuuagcguuaaaagaauuuaaagaauucgcugcagguagaaaaagucuaacgcuaaaucuuauaacagaaaugggccguuuaccuacauucaugacacaaaaggcaagagaugcguuggauaaccuggcagugcuucacacugccgaagugggaggaagagcguacaaucaugcauuaagugagcuuccagaaacauuagaaacucucuuacuccuaacacugcuagcuaccguaacugggggcauauuuuuauuucuaaugaguggcaaggguauuggaaaaaugacccuagggauguguuguaucauaacagcuagcauccuacuaugguacgcucaaauacaaccgcauuggauagcagcuuccauaauuuuagaauucuuucuaauaguucuauugauuccagagcccgaaaagcaaaggacgccacaagauaaucagcuaacauacguaguuauagcaauucuuacaguuguagcagccacaauggcuaacgaaauggguuuuuuggaaaaaacuaaaaaagauuuaggccuaggaucgaucauaacgcaggagucagaaaguaauauacucgacauugaccucagaccggcuagugcauggacuuuauaugccguagcgacaacguuuguaacaccuaugcuaaggcacaguauugaaaauucuaguguaaauguaucccuaacagcuauugcaaaucaggcaacuguucugaugggacugggaagagguuggccgcuaucaaagauggauauaggugucccccuccuagcaauugguugcuauagccaaguaaauccuaucacauugauugcagcccuacugcugcuggucgcccacuaugcuauaauuggaccagguuuacaagccaaagcaacacgugaagcacaaaaacgagcugcagcagggauaaugaagaaccccacaguagauggaauaacaguaaucgaucuagagccaauucccuacgauccgaaguucgaaaaacaauugggccaaguaaugcugcuuguuuuaugcgucacccagguccuaaugaugaggacuacaugggcguuaugugaagcccugacccuugcuacuggaccuauauccacuuuaugggagggaaauccuggaagauuuuggaauaccacuaucgcaguaucaauggcuaacauauuccgagguagcuaccuggcaggugcuggcuuacuguucucaauuaugaaaaacaccaccaacacaaggcgaggaacgggcaacauaggagaaacguuaggagagaaauggaaaucaagacuuaacgccuuaggaaaaagcgaguuucagaucuauaaaaaaucagguauucaggaaguagaucgaaccuuagcaaaagagggaauaaaaagaggggagacagaccaccacgcagucuccagaggaucggcgaaauugaggugguuugucgaaagaaacaugguaacaccagaaggaaaagucguagaccuaggauguggaagagggggcuggaguuauuauugcgguggccuuaaaaaugucagagaaguaaaggguuuaaccaaagguggaccugggcacgaggaaccaaucccaaugaguacuuacggauggaauuuaguacguuuacaaaguggaguagacguauucuucaccccgccugaaaagugugacacacuccuaugugauauaggcgaaucgagccccaaucccacaaucgaagcgggucgcacgcuaaggguuuugaauuugguagaaaacugguuaaauaacaauacccaauucugcauaaaagucuuaaauccguauaugccuucuguaaucgaaaaaauggaaacccuacaaagaaaauauggaggagccuuagugaggaauccauuaaguaggaauaguacccaugaaauguauuggguuucgaacgcgacugguaacauaguuaguucaguuaauaugauaucgagaauguugauaaaucgguuuacuaugaaacauaaaaaggcuacguaugaaccugacguagaccuuggcucaggcacucguaauauagggaucgaaaaugaaaucccaaauuuggacaucauugguaaaagaaucgaaaaaauuaagcaagaacacgagacgaguuggcauuacgaccaagaccauccauacaaaacaugggcuuaucauggaucauaugagacuaaacaaacaggaucagcaucgucgaugguaaacggcgucguaaggcugcuaacgaaaccgugggacguggucccaauggugacucaaauggcgaugacagacaccacaccauuuggucaacaaagaguauuuaaagaaaagguagacacucgcacccaagaaccuaaggaagggacuaaaaaacuaaugagaaucacagcugaauggcuuuggaaagaacuaggaaagaaaaaaaccccucgcauguguacuagggaggaauucacacggaaaguuagaaguaaugcugcacuuggcgccauauucacggaugaaaauaaauggaaaucagcacgggaggcuguagaagacagcagauucugggaauuaguagaucgugaaaggaaccuccauuuagaaggcaaaugcgaaaccuguguauauaauaugaugggcaaacgugagaaaaaauuaggugaauucgguaaggcgaaaggaucuagggcgaucugguauauguggcugggagcgagguuuuuggaauucgaagcacuaggauuucuaaaugaagaucauugguuuagccgggguaauucguuaagcggcguugaaggugaaggucugcacaaauuaggauauauauuacgagacguuagcaaaaaagaagggggugcuauguacgcggaugauacugcaggaugggauaccagaauaacacuggaggaccuaaaaaacgaagagauggucaccaaucacaugaagggagaacauaagaaacuagccgaggccauuuucaaguugaccuaccaaaauaaagucguaagaguucaacguccuacuccgagagggacuguaauggauauaaucucaagaaaagaccagagggguagcggacaaguaggcaccuacggauugaauacauuuaccaacauggaggcacagcuuauccggcaaauggaaggagagggaauuuuuaagucaauccagcaccuaacgguaacugaagagauugccguccaaaauugguuagcaagaguaggaagagaaagacugagcaggauggcuauaaguggugaugauuguguuguaaaaccauuagacgacagauuugcaagcgcacuaacagcauugaaugacauggguaagguacgaaaagauauccaacagugggagccuucaagggguuggaacgauuggacacaaguaccauucuguucacaucauuuucacgaauuagugaugaaagacggccgaguacuaguuguacccugccgaaaucaagacgaauuaauagguagagccagaauuagccagggugcggguuggucacucaaagaaacggccugccuaggaaaaucuuaugcacaaauguggacguuaauguacuuccaccgaagggaucugagacuugcagccaacgcaauauguagcgcaguaccaucacauuggguuccuaccaguagaacaacuuggaguauacacgcgaaacacgaguggaugacaacagaagauaugcuugccgucuggaauagaguuuggauccaagaaaacccuuggauggaagacaaaacgccagucgaaucgugggaggaaguccccuacuuaggcaaacgagaagaucaauggugcggaagccucauuggucuaacaucuagagcaacaugggccaaaaauauacaaacagcaaucaaccaaguucgaucauuaauaggaaaugaagaguacaccgauuacaugccuaguaugaaacguuuccgaaaggaggaagaagaagcuggaguacuuugguga

SEQ ID NO: 22927 - RNA, 9876 nt, Artificial Sequence
  derived and/or modified CDS sequence (opt6) from DENV-2__GQ398292__SS-prME
acugccgggguuuuuaucauguuaauucccacugcgauggccuuucacuugacaacgcguaauggggaaccgcacaugauuguggggcggcaagaaaaagguaaaagucucuuguuuaaaacagaagauggggugaauaugugcacauuaauggcaauagauuuaggagaacugugcgaggacacgauuacguauaaauguccccuauuacgucagaacgaaccagaagauauagauuguugguguaauucaaccaguaccuggguaacauauggaacaugcacaacaacaggcgaacauagacgagagaaaaggagcguugcacuuguuccacaugucggaauggguuuagaaacucggacagagacguggaugaguucagaaggagcguggaaacauguucagagaaucgaaaccuggauuaugcggcacccugguuuuacaaucauggcagccauacucgcuuacacuauaggaacaacccauuuccaacgugccuuaaucuucauccuccuuacagcaguugcucccagcaugaccaugcgcuguauagggauaucaaauagagauuuuguagaagguguuagcggagggucguggguugacauaguuuuggagcaugggucguguguaacaacaauggcuaaaaacaaacccacgcuggauuucgaacucauaaaaacugaggcaaaacaaccugccacccuaagaaaauacugcauugaagcuaaauuaaccaauacaacgacggaaagucgcuguccaacucaaggggaaccuagcuuaaaugaagaacaggauaaaagguuugucuguaaacacucgaugguagaucgagguuggggaaauggaugcggccuguuugguaaaggggguaucguuacgugcgcaauguuuacaugcaagaaaaauauggaaggaaaaguaguacuuccugagaaccuggaauauacaauuguaauaaccccacauucaggagaagaacacgcaguggguaaugacacaggcaaacaugggaaagaaaucaaaauaaccccgcaauccucuauuacugaagcggaacuaaccgguuaugggacugugacaauggaaugcucgccaagaacuggucuggacuucaaugaaaugguauuauuacaaauggaagacaaagcauggcuagugcacagacaaugguuucuugauuuaccucuaccauggcuaccgggagccgacacgcaagguucuaauuggauacagaaagaaacacuuguaacauuuaaaaauccgcaugccaagaaacaggauguuguaguacuaggaagccaagagggagcaaugcauacugcucuuaccggagcuacagagauccaaaugucgagcgguaaucuacucuucacugggcaucuuaaaugucgucugagaauggauaaauuacaauuaaaaggaaugucauauaguaugugcacaggaaaauucaaaauuguaaaagaaauagcggagacacaacaugguacuauagugauuaggguacaguacgaaggggacgggaguccuugcaaaauaccuuuugaaauaauggaccuggagaaacgacauguccuagguagacuuauuacaguaaacccaauuguggcugaaaaagauucaccgguaaacauagaagcugaaccuccuuucggagacaguuauaucauuauuggaguagaacccggucaacuaaaacuuaacugguuuaagaaagggucaagcauaggccaaauguuugaaaccacuaugaggggagcuaaaaggauggcuaucuuaggcgauacugcaugggacuuuggaucauuaggagggguuuuuacaagcaucgguaaagcauugcaucaaguauuuggcgcaaucuacggugcugccuucagcggaguaaguuggaccaugaaaauucuaauuggaguaauuauaacauggaucggaaugaacucgagaaguacaaguuuauccguaagucucguuuuaguugggguaguaacccuguauuuaggcgcaaugguucaagcugauagcgguuguguaguuucauggaaaucuaaagaacuaaaaugcggcucuggaauuuuuaucacugacaacguucauacguggacggaacaauauaaauuucaacccgaaaguccauccaaauuagcuagugcaauucagaaagcacacgaagagggaauuugugguauuaggucgguaacacgucuagaaaauuuaauguggaaacaaaucacgccugaacuuaaucacauauuaagugaaaaugagguuaagcuaacgauuaugacgggugauauaaaaggaauaaugcaggcagggaagcguucacuuagaccgcagccuacggaacuaaaauauucauggaaaacguggggcaaagcuaagaugcugucgacggaaucacauaaccagacauuucucauagauggcccagaaacggccgaaugcccaaauacuaacagggcguggaacucccuagaaguagaagacuauggauuuggcguuuucacaacgaacauuuggcucaaguuaagagaaaaacaagauguguucugugauaguaaacucaugucugcagcaauaaaagacaauagggcaguacaugcugacauggguuauuggauagaaucggcucuuaaugacacauggaagauggaaaaggcaucauuuauagaaguuaaaucuugccauuggccaaaaucacacacuuuauggaguaauggcguauuagaaagugaaaugauaauacccaaaaacuucgccggcccaguuagucaacauaacuacagaccuggauaccauacacaaacggcaggacccuggcaccuuggaaaauuagaaauggacuucgauuuuugugaagggacuaccguaguugugacugaagacugcggaaaccgcggaccaucucuacgaacaacaacagcaucaggaaaauuaauuacggaauggugcuguagaaguuguacacuaccaccccuacgguauagaggugaagaugguuguugguacggaauggaaauaaggccacuuaaagagaaggaagaaaauuuggugaauagucuaguuacagcuggacauggucaaauagacaacuuuucgcuggguguauuggguauggcuuuauuuuuagaagaaauguuacguacacguguugguacuaaacaugcaaugcuacugguagcagucucuuuuguuacauugaucaccgggaacauguccuuuagagacuuaggaaggguaaugguaaugguaggggccacgaugacagacgauauugggaugggaauaaccuacuuggcucuauuggccgcauucaaaguacgacccacuuuugcagcuggguuguuacuacgcaagcucacuucgaaagaacuuaugauggcaacuauagguauugcauuauuaucccaaucuacaauucccgaaacuauucuugaauuaacagacgccuuagcacuugguaugaugguucuuaaaauuguccggaacauggaaaaguaucaacuagcaguaacgauaauggccauuucuugugugccaaacgcaguaauacuacaaaacgcauggaaagucaguuguacaauccuagcugcuguaaguguaucuccacuacucuugacuucuagccaacagaaagcagauuggauacccuuggcacugacaaucaaaggauugaacccgacggcaaucuucuuaacaaccuuaaguagaacuagcaaaaagagaucauggccuuuaaaugaagcaaucauggcuguaggaauggucagcauucuagcaucaucauuauuaaagaaugacauuccaaugacuggaccuuuggucgcuggcggauuacuaacaguuugcuauguguuaacugguaggucggcugaucuagaacuagaaagagcggcagacguuaaaugggaagaucaagcggaaauaucagguucuucaccaauccuaucuauuacaauaucugaagacggaucaaugucaauuaagaaugaagaagaggaacagacguuaaccauauuaauacgcacuggguugcuggucauaagcggaguguuuccagugagcauacccaucacugcagcugcaugguaccucugggaagucaagaaacagagagccgggguucugugggacguaccuagcccgcccccuguagggaaagcggaauuagaagauggugcauacagaauuaagcaacgugguauacucggguacucgcaaauaggagcaggaguuuacaaagaagguacuuuucacaccauguggcacguaacuagaggugcgguacuaaugcaccguggaaaacguauagaaccaaguugggcugauguuaagaaagacuuaauaaguuacggagggggauggaaguuagaaggugaauggaaagaaggagaagaggugcaagucuuggcuuuagaaccagguaagaauccacgagcaguacaaaccaagcccggacuauucaagacgaacacagguacgaucggagccgugucuuuggacuuuaguccuggcacuucgggaucuccgauaguagacaggaagggcaaaguaguuggucucuauggaaacgggguugucacgagaucgggggcuuauguuuccgcgauagcccaaacagaaaaaucuauugaagauaauccagaaauagaagaugacauuuuccgcaagaaaagauuaacgauaauggaucuacacccuggugcugggaaaacaaaaagguauuuaccagcaauagugcgggaagcgauaaaaaggggauuacgaacguuaauauuagcuccuacuagaguuguugcagcugagauggaagaggcauuaaggggguuacccauuagguaccaaacuccugcaauacgugcagaacacaccggaagagagauaguagaccuaaugugucacgccacauuuacgaugcgacuacuaagccccguucgcguacccaacuauaaucugaucauaauggaugaagcucacuucacagauccagccagcauagcagcaaggggauacauaucaaccagaguagaaaugggggaagcggcaggaauuuuuaugacagcuacaccuccagguagucgugauccuuuuccucaaucaaaugcaccuauaauggaugaagaaagggaaaucccagaacggagcuggaacuccggacacgaauggguaacagacuucaaaggaaagacagucugguuuguaccaucaauaaaggcugggaacgacaucgcugcaugcuugaggaaaaauggaaagaaagucauacagcuaucgagaaaaaccuuugauucagaauacguaaaaaccagggcuaaugauugggauuucgucguuacgacugacauaagcgaaaugggggcuaauuucaaggccgagagaguuauagacccgcgaagauguaugaaacccgugauauuaacugacggggaggaacgagugauucuagcugguccaaugccugugacccacucgagugcagcgcaacgaagaggcaggauuggacguaauccuaagaaugaaaacgaucaauacauuuacaugggggaaccuuuggagaacgaugaggacugcgcgcauuggaaagaagcuaaaauguuacucgacaacauaaacacaccugaaggaauuauaccuagcauguuugagccugagagagaaaaagucgaugccauugauggagaauaccgguuacggggcgaagcuagaaaaacauuuguugaccuuaugcgucgaggugaucuacccguguggcucgcauauagaguugccgcggagggcaucaauuaugcagaccgaagaugguguuuugauggaauaaagaauaaucaaauuuuagaagagaacguagaaguagagauauggacgaaagaaggugaacgaaagaaauuaaaaccaagaugguuagacgccaggauauauucagauccacuagccuuaaaagaauuuaaagaauuugcugcuggaagaaaauccuuaacacuaaauuugauaacugaaauggggcgauuaccgacguuuaugacgcaaaaggcaagagacgcauuagauaaccucgccguauuacauacggcagaagccgguggacgagcguauaaucaugccuuauccgaauuacccgaaacccuagaaacacuacuucuguuaacguuauuggcgacuguaacaggggguauauuccuguucuuaaugucaggcaagggaauuggcaagaugacccuuggaaugugcuguauaauaacagccucgauccugcuaugguacgcacaaauacagccucacuggauugcagcgaguauaaucuuggaauuuuuccuaaucguccuucuuaucccggaaccggagaaacagaggacgccacaagauaaucaauuaacauacguuguuauagcaaucuuaacaguuguggcggcaacaauggccaacgagaugggcuuucucgagaagaccaagaaagacuuaggccuaggaucaauagcgacacaagaaagcgagucuaauauccuggauauagaccuaagacccgccucugcauggacuuuauaugcaguugcuacaacauuuguuacuccuauguuaaggcauucuauagaaaauaguagcguaaauguaucauuaacagcuaucgccaaucaggcgacaguccuuaugggguuaggcaaaggguggccccuaagcaaaauggacauugguguaccacuucucgcaaucggaugcuacucccaaguaaaucccauuacuuuaacugcugcauuacuacuacucguugcacacuaugcuauaauuggaccugguuuacaagcaaaagcgacgagggaagcgcagaaaagggcugcggcaggaauuaugaagaaccccacaguagacggcauuacuguaauugauuuagaaccaauaccauaugaucccaaauucgagaaacaacuuggccaagucauguugcuaauacucuguguaacacaagucuuaaugaugcguacaacaugggcucuuugugaggcccucacuuuggccaccggaccuauuucaacauugugggaaggcaauccuggaagauucuggaacacaacuauagcgguaucuauggcaaauaucuuucgaggcaguuauuuggcgggugcgggccuauuauucaguauuaugaagaacacuacaaauacacgcagagguacuggaaacauuggcgagacucuuggcgaaaaauggaaaucaaggcucaaugcguuggguaaaucagaauuucaaauuuauaagaaaagcggaauacaagaaguggaucgaacguuggcuaaagagggcauuaaacguggagagacagaucaccaugcaguaaguagagguagugccaagcucaggugguuuguugaaaggaacaugguaacaccugaaggaaagguaguggaucuaggauguggacgggguggauggucuuacuauuguggaggccucaaaaauguccgagagguaaaaggucuaacaaagggaggaccuggccacgaagaaccaauacccaugagcacauauggguggaacuuaguaagauugcaaaguggaguagauguauucuuuacaccaccagaaaaaugugacacucuuuugugugacauaggugaaaguucaccaaacccaacaauagaagcaggaagaacauugagaguauuaaauuuggucgaaaauuggcuaaacaacaauacucaauucugcauaaaaguacucaaucccuauaugccaucaguaauagaaaagauggaaacacuacaacgcaaguauggcggagcguugguucgaaacccucugagucguaacucuacgcaugagauguauuggguaucuaacgcaacuggaaacaucguuucaagugugaauaugauuucgcguauguuaauaaaucgauuuacaaugaaacacaaaaaggcgacauaugaaccugacguugauuuaggcucagguacacgaaauaucgggauagaaucugaaauaccaaaucuagauauuauaggcaaacgcaucgagaaaauaaagcaagaacaugaaacaaguuggcauuaugaucaagaccacccauauaaaacgugggcauaccaugguucuuaugaaacaaaacaaaccggcucugcaaguaguauggucaacgguguuguuagguugcucacgaaacccugggacguuguaccaaugguaacccaaauggcuaugacugacacaacucccuucggccagcaaagaguauucaaggaaaaaguagauacuaggacucaggaaccaaaggaggguacgaagaaauuaaugaaaaucacggccgaguggcuauggaaagaacuuggcaagaagaaaacgccacgaauguguacucgagaagaauuuacacguaaaguacgaagcaacgcagcgcuuggagcaauauucacggaugaaaauaaauggaaaagcgcacgggaagcuguagaggacucgagauucugggaacuaaucgauagagaacggaauuuacacuuggaaggaaagugugagaccuguguguauaacaugaugggaaagagggagaagaaacuuggugaauuuggaaaggcaaaagggucuagagcaauaugguauaugugguuaggagcacgauuccuugaauuugaggcuuuaggguuucuaaaugaagaccauugguuuucucgcgguaauucauugucgggcguugaaggagaaggguugcauagauuagguuauauucuucgagaugugagcaagaaagaagguggagcaauguaugcagacgauacugcaggcugggacaccagaaucacacuggaagaucugaagaaugaagaaaugguuacuaaucacaugaaaggugaacauaagaaacuagcagaagccauauucaaauuaacauaccaaaauaaaguuguaaggguucaacgaccgacgccccgaggaaccgucauggauaucauuagcaggcgagaccaaagaggaaguggacaaguagguaccuauggcuuaaauacauuuacaaauauggaagcacaacuaauaagacagauggaaggagagggaauuuucaagucaauucaacauuuaacugucaccgaagaaauagcaguacaaaacugguuggccagggugggacgugaaagauuaucgcgcauggcaauaucaggagaugacugcguugucaaaccauuagaugauagguucgcgagcgcauuaacagcucuuaacgacauggggaaagugagaaaagauauacaacaaugggaaccuaguagagguuggaaugacuggacacaagucccguuuugcagucaccauuuccaugaacuuguuaugaaagauggacgaguucuagugguaccauguagaaaccaggacgaacuuauaggucgcgcuagaaucucucagggugcaggauggagcuuaaaggaaacugcauguuugggaaaaucuuacgcacaaauguggacauugauguacuuucacagaagagaucuuagacuagcugccaaugcuauuuguagcgcgguaccuucacacugggucccaacgucaaggacuacauggucgauucacgcuaaacacgaguggaugacaacagaggacauguuggcgguauggaaccggguguggauccaagaaaaucccuggauggaagacaaaacaccagucgagagcugggaggaaguaccauauuuagguaagagagaagaucaauggugugguucacuaauaggguugaccagucgugcuacaugggcgaagaauauacagaccgcaaucaaucagguaagaagccuaauuggaaaugaggaguauacagacuauaugccaagcaugaaacgauuccggagagaagaggaggaagcgggggucuugugguag

SEQ ID NO: 22928 - RNA, 9876 nt, Artificial Sequence
  derived and/or modified CDS sequence (opt6) from DENV-2__GQ398267__SS-prME
acugcuggaauaauaauaaugaugauuccuaccguaauggcauuccauuuaacuacuaggaauggagaaccccacaugauuguaagccgucaagaaaaagguaaaucucuacuauuuaaaacugaaaacggagugaacauguguacauugauggcuauggaucuuggagaauugugcgaagauacaaucacguacaauuguccauuauuacgccagaaugaaccagaagauauagauugcuggugcaauagcacaagcacgugggucacauacggaacguguacggcaacaggagaacauagaagagaaaaacggagcguugcauuaguaccacauguuggaaugggguuagaaacacgcacagaaacguggaugucaucugaaggggcauggaaacacgcacaacgcauugaaacauggauccuucgucauccuggauucacaauuauggcagcgauacuugcauauacuaucgggacgacguacuuucaaaggguucuaauauuuauuuugcuuaccgcgguaacuccuuccauggccaugagauguaucgguauuucuaaccgcgauuuuguugaagguguaucuggcggcaguugggucgauauagucuuagaacauggaagcuguguaaccaccauggccaaaaauaaaccgacccuagauuuugaauuaauaaaaacugaggcaaaacauccugcaacacuacggaaauacugcguugaagcuaaauuaacaaacacuacaacggcgucaagguguccaacucaaggagaaccuucacuaaacgaagaacaagauaaacgauucguauguaaacauuccaugguggaucgggggugggggaacgguuguggucuuuucggcaaaggagggaucgucacaugugcuauguuuacaugcaagaaaaauauggaggguaaagucguccagcccgaaaaccuugaguacacaauugugauaaccccacauucgggagaggaaaacgcaguuggaaaugacacuggaaaacaugguaaagaaauuaaaguuaccccucaaucaucaauuacugaggcggagcuaaccggcuacgggacaguaacaauggagugcagcccaagaaccggacuagauuucaaugaaaugguuuuacugcagauggagaacaaagccugguuagugcauaggcagugguuucuagaucuuccucuucccuggcuaccuggugcagauacacaaggcaguaauuggauacaaaaagaaacauugguaacauucaaaaauccccacgccaagaaacaggauguuguagucuuaggaucucaagaaggcgcuaugcauacggcacuaacuggugccacugaaauacaaaugucuagcggcaaccuucuauuuacuggccaucuaaaaugcagacuacgcauggauaaacuacaacuuaaagguaugucuuauuccauguguacggguaaauucaaaguuguuaaagaaauagcugaaacacagcauggaacaaucgugauacgcguacaauacgaaggagauggaucucccuguaaaauuccauucgagauaauggaccuugaaaaacgccauguucuagguagacucauuacaguuaauccaauugugacagaaaaagauucucccgugaauauugaagcagaaccgccguuuggcgauaguuauauaauaauagguguugaaccuggccagcuuaaacugucuugguucaagaaaggaucuucuauuggccaaauguuugaaacuacgaugagaggugcaaaacgaauggcaauucugggagauacagcgugggauuuugguucuuuggguggaguauuuacaucaauaggcaaagcacuacaccaaguuuuuggugcuauauauggagcugcauuuucaggaguaucuuggacaaugaaaauccugauaggcguaguuauaacguggauaggaaugaacaguagauccacaaguuugucaguaucuuuagucuuagugggugugguuacccuauaccuuggugucaugguacaggcugacaguggaugcguagucucguggaaaaauaaagagcugaaaugugggagcggcauauucauaacagauaauguacauacauggacugaacaauacaaauuucagccggaaucaccgucgaaauuagcgagugcaauucaaaaagcgcaugaagaaggaauaugcgguauacgcaguguaacgagacuagaaaacuuaauguggaaacaaauuacaccagaguuaaaucauauacuaacugagaaugaaguaaaacuaacaauaaugacaggagauauuaaagggaucaugcaggcaggaaaaagaucauuaagaccucaaccuacugaguuaaaauacucguggaaagcguggggaaaagcaaaaaugcuuagcacagagcuacauaaccacacguuucucauugaugguccugagaccgccgagugcccuaacacgaauagagcauggaauagucuugagguagaagauuacggguuugggguauuuacaacgaauauuuggcugaaauuaaaagaaagacaagacguauuuugugauucuaaauugaugucagcggcaaucaaagauaacagagccguccaugccgauauggguuauuggauagaaucugcacuuaaugacacguggaaaauugaaaaggcuucuuuuauagagguaaaaucgugccacuggcccaaaucacacaccuuauggucuaaugguguauuagaguccgaaaugauuauaccuaaaaauuucgcaggucccgucucccaacacaacuaccgacccgguuaccacacacaaacagcagggccauggcaucuuggucgacuggagauggauuucgauuuuugugaagggacaacuguagucgugacagaagauuguggaaauagagguccaucacuccgaacuaccaccgccagcgggaaacugaucacagaaugguguugccggucgugcacucuuccaccacugagguauagaggggaagacgguuguugguaugguauggaaauucguccucucaaagagaaagaagagaacuuagucaauucccuaguaaccgcugggcaugggcagaucgauaacuucucucucggaguguuagguauggcccuauuccuagaagaaaugcuacgcacaaggguaggaacaaagcaugcuauauugcuuguagccguguccuucguaacccuuauaacaggaaauaugucuuuucgagaccuagggagaguaauggucauggugggggcgacaaugacagaugauauaggcauggguguaacauacuuggcauuacuggcagcuuuuaaagugagaccaacguuugccgcaggguuguuacuaagaaaacuaaccucaaaggaauuaaugaugacaacaauagggauaguuuuauuaucucagucaacaauuccugaaucaauuuuggaacuaacagaugcacuagcccuuggcaugauggugcuuaaaauagugagaaacauggaaaaauaucaacucgcaguaacgauaauggcuauuuuaugcguaccuaacgcuguuauacuucaaaacgccuggaaaguaucauguacuacucuugcgguagugucuguuucgccccuucuacuuacgucaucacaacaaaaagccgauuggauaccuuuagcgcuaacaauuaaaggucuaaacccaacugcaauauuuuuaacuaccuuaagcagaaccuccaagaaaagaaguuggccucucaaugaagcaaucauggcuguuggaaugguaucuauucuagcuaguucccuccugaagaacgacauaccuaugaccggaccuuugguagccgggggauuauugaccguaugcuacguguuaacgggacgaucagcagaccuggagcuagaacgcgcugcagauguaagaugggaggaacaagcugaaauaagugguucuagccccauacucucaauaaccauaucagaagauggaucuauguccauuaaaaaugaagaagaagaacaaacuuuaacuaucuugaucagaacaggacuauuagucaucagcggauuauucccagucaguauacccaucaccgcugcggcgugguaccugugggaagucaagaaacaaagagcaggaguauugugggauguuccgaguccuccacccgucggaaaagcggaauuagaggacggagcuuacagaauuaaacaaaagggaauacuaggauauagccaaauuggagcuggcgucuauaaggaggguacauuucacacaauguggcauguuaccagaggagcuguacuuaugcacaaaggaaaaagaauugaaccguccugggcggacguaaagaaggaucucauaucauaugguggaggauggaaacuagaaggagaauggaaagaaggagaagaaguccaaguauuagcauuagagccaggcaaaaauccaagagcaguucaaacuaaacccgguuuauuuaaaacaaauaccgggacaauaggagcagugagucuagacuuuagcccagguacuucuggaagcccaauuguggauaagaaaggcaaagucgucgguuuauacggaaacggaguagucacuagaagcggaacauauguuucggccauugcucaaacagagaaaagcaucgaggauaaucccgagaucgaagacgauaucuuccguaagaaaagacugacaauaauggacuuacauccaggagcaggaaagacgaaaagauacuuaccagcaauaguaagggaagcgaucaaaaggggauugagaacguuaauacuugcacccacaagaguugucgcagccgaaauggaagaagcauugagaggacuuccaauaagauaucagacuccagcaauuagggcggaacacacugguagggaaauaguggacuuaaugugccaugcuacguuuacuaugagacugcugucgccuauucgcgugccgaauuauaauuuaauaaucauggacgaagcacacuucaccgauccugcuucuauagcggcaagaggauacauaaguacacgaguugaaaugggagaagcagcuggcauauuuaugacggcgacuccuccuggcucuagagaucccuuuccacaaaguaaugcaccgaucauggacgaggaaagagaaauccccgagagaaguuggaacaguggucaugaauggguuacagacuucaaaggaaaaaccguaugguuuguuccaucgauaaaggcugguaaugauaucgcagcauguuugcgcaaaaaugguaagaaagugauacaacuaucucgaaaaacauuugauuccgaauacauaaaaacacguacaaaugauugggacuucguagugacaacagacauaucagagaugggagcaaacuucaaagcggaaagaguuauugauccgagacgaugcaugaaaccagugauauuaacagauggggaagaaagaguuauauuagcuggcccaaugcccguuacccauaguagugcugcucagaggagagggcgggucggacguaauccuaagaaugaaaacgaucaauauaucuauaugggagaaccccucgaaaacgaugaagauugugcucacuggaaagaagcaaaaaugcuuuuagacaauaucaacacuccagaaggaauaauuccuucgauguuugagccggagcgagaaaagguagaugcuauagauggcgaauacagacuuagaggagaagcuagaaaaacuuucguagacuuaaugcgacguggcgauuuaccaguguggcuugcuuacagaguugcagccgaggguaucaauuaugcggacaggaggugguguuuugauggagugaaaaauaaucagauauuagaagaaaacguggagguugaaauauggacuaaggagggggagcggaaaaaguuaaaaccacgcugguuagaugcaaggaucuauucagauccacuagcccuaaaagaguuuaaggaguucgcagcagguagaaaaucauugacucuaaaucucauaacagaaaugggacgccuaccaacguuuaugacacaaaaagccaaaaaugcuuuggacaaccuugcaguauugcauacagcugaagcugguggacgggcuuauaaucaugcguuaagugagcuuccagagacauuagaaacacuccuccuauuaacauuacuagcuacuguaacaggcgguaucuuuuuguucuuaaugagcggaaagggcauaggaaagaugacccuggguauguguugcauuauaaccgcuucuauucuucuaugguacgcccagauacaaccacacuggaucgcugcaaguauaauuuuggaauuuuucuuaaucguauuauugauaccggaaccggagaaacaacgcacuccacaagacaaucagcuaaccuaugucguaauagcaauacuuacgguaguagcagcuacuauggcaaacgagaugggguuucuggagaaaacuaagaaagacuuuggacucgguucaauaacuacacaacagccagaaaguaauauacucgacauugauuuaagaccagcaagugcauggacguuauaugcuguagcuacaacauuuauuacgccuauguugaggcacaguauagaaaauucgucuguaaacgugucauuaacggcaaucgcuaaucaggcuacaguuuugaugggucuagguaaaggguggccauuaagcaaaauggacauuggcguaccucuauuagcgauagggugcuauagucaggugaauccaauaacucuuauagcggcauuacuacugcuaguugcucacuacgcgaucauagguccuggcuuacaggcgaaagcgacaagagaagcucagaaacgugcagcugcagguaucaugaaaaauccgacuguggauggaaugaccguaaucgaucuugaucccauuccuuaugauccuaaauuugagaagcaauuaggucaggugauguuacuuguacuauguguaacccaaguguuaaugaugcgaacaacaugggcacucugcgaagccuugacacuggcaacugggcccauuucgacccuaugggaagguaauccaggacguuuuuggaauacgaccauagcuguauccauggcaaacauauuuagagguucguaucuugccggagccggcuuacucuuuucgauaaugaagaauacggcaaacacucgaagaggcacugggaauauuggagaaacuuuaggagagaaauggaagaaucgucuaaacgcgcuuggaaaaagugaguuccaaauuuauaagaaaucaggaauacaagagguugaccgcacgcucgcuaaggagggaauuaaaagaggagagacggaucaccaugcaguaucgcgagguagcgcaaaacuucggugguucguagaaagaaacuuaguaaccccugaaggaaagguagucgauuuagguuguggaaggggaggcuggucauauuauugcggagguuuaaagaauguuaaggaaguaaagggcuugaccaaaggcggaccaggucacgaagaaccuauacccaugucgaccuacggcuggaaucuaguucgauugcagagugggguggauguauucuuuacaccuccagaaaagugugauacauuacuuugugauauaggugaaucaucgcccaauccaacgguugaagcugggaggacccuucgagugcuuaacuuaguggaaaauuggcuuaacaacaacacacaauuuuguaucaaagucuugaauccauacaugccuaguguaauagagaaaauggaggcacuucagaggaaauacgguggugcuuuagugagaaauccacuaucaagaaauuccacucacgagauguauugggucucaaacgcgucugguaauauaguaagcagugucaauaugauaucccggauguuaauuaacagauucacaaugagacacaagaaggcaacauacgaaccugauguggaucuaggaucaggaaccagaaauauaggcauagaaagugaaacaccgaaucuggauauaaucgggaaacguauagagaaaaucaaacaagaacacgagaccagcuggcacuacgaucaagaucauccuuacaagacaugggcguaccacggaaguuaugaaacgaagcaaaccggaagugcauccucaaugguaaaugggguaguaagacuucucacuaagccuugggacguaauaccgaugguaacgcagauggcgaugacagauacuaccccuuucgggcagcagagaguauuuaaagaaaaaguagauacaagaacucaagaacccaaggaaggcacuaagaaauuaaugaaaauaacagccgaauggcuguggaaagagcuugguaagaagaaaacuccaagaaugugcacaagagaagaguucacucgcaaaguacgcucuaacgcagccuuaggugccauuuuuacagaugagaauaaauggaagagugcuagagaggccguugaggacucaggguuuugggaguuaguagauaaagaacggaacuuacacuuagagggaaaaugcgaaacauguguauauaacaugauggguaaacgggagaagaaacuaggcgaguucgggaaagcuaaaggaagucgagcaauaugguacauguggcugggugcacgcuuuuuagaauuugaagcguuaggguuuuugaaugaagaccauugguucagcagagaaaacagcuuaucaggaguggaaggagaaggauuacauaaauuagguuacauucuaagggacguaucuaaaaaggaaggcggcgcuauguacgcagacgauacugccggaugggauacacguauuacacuugaagaucucaaaaaugaggaaaugguaaccaaucauauggaaggagagcacaagaaacucgcggaagccaucuuuaaauuaacauaccaaaacaaagugguccgaguucaaaggccaacuccaagagguacagucauggacauuauuucacgaagagaucagcggggcagcggccagguugucacauacggauuaaauacuuucacaaauauggaggcccaacuaaucaggcagauggaaggggaaggcguauucaagaguauacaacagcucacaguaaaagaggagauagcggucaaaaauuggcugauacgcgugggacgagaaagacuuucuagaauggcuauauccggagaugauugugucguaaaaccccucgaugaccgauucgcaucggcucuuauugcgcuaaacgauaugggcaaagucagaaaggacauucaacagugggaaccuagccguggcuggaacgacuggacacaaguacccuuuuguucucaccauuuucaugaguugauaaugaaagacgguaggguccuaguaguaccgugcagaaaccaagaugaacuuauaggucgagcucggauuagucaaggagcagguuggagucuucgggaaaccgcuugucucgguaaauccuaugcucagauguggucucuaauguacuuccaccgacgugacuuaagauuagcggcaaaugcaauauguagugcuguaccaucacacuggguuccgaccagccguacgacguggucgauucacgcaacucaugaauggaugacaacagaagauaugcuaacagucuggaauagaguauggauucaggaaaauccauggauggaagauaaaacaccaguagaaagcugggaggaaauacccuaucuaggaaagagggaagaucaauggugugguucucuaauaggcuuaacaagccgagcgacuugggcaaagaauauacaaacagcaaucaaccaaguaaggaguuugauaggaaaugaagaauacaccgauuauaugccaucaaugaaaagguucaggagagaagaagaggaagcaggaguguuaugguaa

SEQ ID NO: 22929 - RNA, 9876 nt, Artificial Sequence
  derived and/or modified CDS sequence (opt6) from DENV-2__GQ398266__SS-prME
accgcagguaucauuaucaugaugauuccgacaguaauggccuuucauuugacuaccaggaauggagagccccacaugaucguauccagacaagaaaaggguaaaucuuuauuguucaaaaccgaaaauggaguaaauaugugcacguuaauggcuauggaucugggagaacuuugugaagacacuauaacauacaauuguccuuuacucaggcaaaaugaaccggaggacauagauuguugguguaauucaaccuccacauggguaacguaugguacauguaccgccacaggugaacauaggcgagaaaaacgcucgguagcuuuagucccgcauguuggaauggggcuagagacacgaacugaaacguggaugucaagugaaggagccuggaaacacgcacaaagaauagagacguggauauuaaggcauccaggguucacgauaauggcugcuauauuagcauacacuauaggaacaacauacuuucaaagaguucuaaucuucauuuuauuaacagcaguaacuccauccauggccaugcgcuguaucggcauaucuaauagagacuucguggaagguguuaguggugggaguuggguagauauugugcuagaacacggaucauguguaacaacaauggccaaaaacaaaccaacguuggacuuugaauugauaaaaacugaagccaaacauccggcaacgcuaagaaaauacuguguggaggcaaaguuaacaaauacuacaacagcgaguagauguccuacacaaggugaaccguccuuaaacgaagaacaagacaaacguuucguuuguaaacauaguaugguugaucggggcuggggcaauggcuguggauuauucgguaaggggggaauagugacaugugcgauguucaccuguaaaaaaaauauggaagguaagguagugcagcccgagaacuuagaguauacaauuguaauaacaccccauaguggggaagagaaugcggugggcaaugauacagguaaacaugguaaagagauuaaaguaacuccacagucgucuauaacugaggcggaacucacaggcuacggcacaguuacuauggagugcuccccuagaacaggguuagacuucaaugagaugguacucuuacaaauggaaaauaaggccuggcuuguacaccgacaaugguuucuagaucucccauuaccguggcuaccaggagcagauacacagggcucaaauuggauacagaaagaaacacugguuacguucaaaaacccucacgcaaaaaaacaggauguaguuguccuggggucccaagaaggcgcaaugcauacagcguuaacgggggcuacagaaauucaaaugucaagcggcaauuuauuauucacuggccaucugaagugcagauuacgaauggauaaacuacaacuaaaagguaugucauauaguauguguacaggaaaauuuaagguaguuaaagagauugcugagacucaacauggaacaauagucauccguguucaguaugaaggggauggcucaccaugcaagauuccauuugagauaauggauuuggaaaaaagacacguauuaggacgauugaucacaguuaauccaauugugacugaaaaggacaguccaguuaauauagaggcugagccaccguuuggagauaguuacauaaucauagggguagaaccaggccaauuaaaauuauccugguuuaaaaaagguucaagcauaggucaaauguuugagacaacuaugagaggugcgaaaagaauggcaauacucggagauacggcuugggacuucggcagccuaggagguguauuuaccucaauaggaaaagcacugcaucagguuuucggagcuauauauggagcagcauucaguggaguuagcuggacgaugaaaauucuaauaggugugguaauaacguggauaggaaugaacagccguucaacaucccucucaguaucucuggugcugguaggcguaguaaccuuauaccucggcguaaugguacaagcugauucaggauguguugucucauggaaaaauaaagaacucaagugcggcucaggcauauuuauaaccgauaaugugcauacuuggacggagcaauauaaauuucaaccggagucuccaucaaaauuagcaucagcaauacaaaaagcucacgaagaggguaucugugguaucaggagcguaacgaggcuggagaaccuuauguggaaacaaauuacuccagaacuaaaucacauacuuaccgaaaaugaagucaaauuaacuauuaugacaggcgauauaaagggaauaaugcaagccggcaaacgaucucuacgaccacaaccaacugaguuaaaguacaguuggaaggccugggggaaagcaaaaauguugaguacagaacugcauaaccacacauuccuaaucgacgggcccgaaaccgcugaaugcccuaauaccaaccgcgccuggaauucguuggaaguagaagauuauggauuugguguauuuacuacaaauauaugguugaaacugaaagagcgccaagaugucuuuugugauaguaagcuuaugagcgcagccauaaaagacaauagggcaguucaugcugacauggguuacuggauagaaagugcucugaaugacaccuggaagaucgaaaaagcuaguuuuauagaaguaaagaguugucauuggccuaaaucucacacacuuuggucaaacgggguccuagaaucugaaaugauuauuccgaagaacuuugcagggccugucucacaacacaacuaucgaccuggcuaucauacacaaacugcaggcccauggcacuugggaagguuagaaauggauuuugacuucugcgaaggcaccaccguagugguaacugaggauugcggaaaccguggucccagcuuaagaacuacaacagcaucggguaaauugauuacugaaugguguugcaggaguugcacacuuccaccccuaagauaucgcggugaagaugguugcugguacggcauggaaauaagaccuuugaaggagaaagaagaaaauuugguaaauagucugguuaccgccggccauggacaaauagauaacuucuccuugggagucuugggaauggcacucuuuuuggaggagaugcuccgaaccagaguaggaacgaaacaugcuauacuacuuguagcagugaguuuugugacgcuuaucacuggaaauaugucauuuagggaucuuggaaggguaaugguuaugguaggggccaccaugacugacgauauaggaaugggagugacuuauuuggcccuuuuggcagcguucaagguucguccuacguucgccgccggauuguuauuaagaaaacuuacaucaaaagaauugaugaugaccacgaucggcauaguucuauuaucacaaaguaccauaccagaaucgauucuugaacugacagaugcuuuagcccuaggaaugaugguucuaaaaauuguuagaaauauggagaaauaccagcuagcgguaacaauaauggcuauacuaugcguuccaaaugcgguuauacuacaaaaugccuggaagguaucguguaccaccuuagccguuguuucggucucaccuuuacuauugacuaguucacaacaaaaggccgacuggaucccguuagcuuuaacaauaaagggcuuaaauccaacagcgauuuuucuaacuacacucucacgaacaaauaaaaaaagauccuggccauugaaugaggcgauaauggccguagguaugguaagcauauuagccuccucccuacuaaaaaacgauauuccaaugacgggcccauuggucgcgggaggucuacuaacagugugcuauguacucacgggaagaucggccgaucuggaacuggaaagagccgcagauguaaggugggaagaacaagcagaaauuucgggaucuagcccuauauuaucgauuacaauaagcgaagaugguuccauguccaucaaaaacgaagaggaagaacaaacccucacgauacucauccguacgggauuacuuguaauauccggacuuuucccuguaucuaucccgauuacugcugcugcaugguauuuaugggaagucaaaaaacaacgagcaggugugcucugggacgugcccucgccaccuccugucggaaaggcagaacucgaagacggugcauaccgcaucaaacaaaaagguauuuuaggauacucgcagauaggagcagguguauauaaagagggaacauuccauacaauguggcacguaacacgaggggcuguauuaaugcacaaagguaaacgaauagaaccaucgugggcggacguuaagaaggaccuaauaucauacggcggcggguggaaacuggaaggugaauggaaagaaggugaggaaguacaagucuuagcccuagagccuggaaaaaauccaagagcagugcaaaccaaaccaggauuauucaaaacaaauaccggaaccauaggugcuguuucucuagauuucucgccaggaacuucaggaucaccaauaguagauaaaaaagggaagguaguaggauuguauggaaauggaguugugacucgcaguggaaccuacgucucagcgauagcucaaacagaaaaaagcauugaagauaacccagagaucgaagaugacauauuuagaaaaaaacgguuaacuauuauggauuuacauccaggcgcaggcaagacgaagagguacuuaccugcaauaguaagggaagccauuaagcggggcuuaagaacacuaauacuagccccgaccagggucguagcugcagaaauggaagaggcccuuagggguuuaccuauuagguaccagacuccugcaauccgagcagaacauacuggcagagaaauugucgaucuaaugugucacgcuacuuuuacaaugcgauuacuuaguccuauacguguaccgaauuacaaucuuauaauaauggacgaagcacauuuuacagaucccgccucuaucgcagcccguggguauaucaguacacgaguugaaaugggcgaagcagcaggcaucuucaugacagccacuccuccaggaagcagagauccuuuuccacaaaguaaugcuccaauaauggaugaggaaagagaaauaccggaacguaguuggaacucaggccaugaguggguuacagauuuuaaagguaaaacaguuugguucguaccaucaauuaaggcugguaaugauauagcagccugccuacgaaaaaacgguaaaaaagucauacaauuaucuagaaaaaccuuugacucggaauacauaaaaacccgcacaaacgacugggauuuuguuguaacuaccgauauuucagaaaugggggcgaauuucaaggcugaaagaguaauagacccaagacguuguaugaaaccaguaauccuuacagacggagaggaaagaguuauucuggcagguccaaugccaguaacacacucgagugcagcccaacgccgaggcagaguaggucgcaaucccaagaaugaaaacgaccaguacauuuauaugggugaaccauuagaaaaugacgaagacugcgcacauuggaaggaagccaaaaugcuauuagacaacauuaacacaccggaaggcauaauaccgagcauguuugagccagaaagagaaaaaguugacgcuauagacggagaauaucguuuaaggggugaagcaaggaaaacguuuguagacuuaaugcgcagaggagaucuucccguaugguuagccuaccgcguagcggccgaagggauaaauuaugcagauaggagauggugcuuugauggaguuaaaaauaaucaaauacuggaagaaaauguugagguugaaauauggacuaaggaaggugagcguaaaaaacuaaaaccucgcugguuagaugcucgaaucuacuccgaucccuuagcuuuaaaagaauucaaagaauuugcggcagggagaaaaagucuuacgcuuaauuuaaucacagagaugggaaggcuaccaacauuuaugacucaaaaagcaaagaaugcuuuggacaauuuagcaguuuuacacacugcagaagcaggaggaagggcauacaaccaugcgcuuucugagcuacccgaaacuuuggaaacacuuuuacuguuaacuuugcuagcuacaguaacagggggcauuuuucuguuuuugaugucugguaagggcauaggaaaaaugacauuagggauguguuguauuauaacggcgaguauacuauuaugguaugcacaaauacaaccacacuggauagccgcaagcauaauccuagaguucuucuuaauagucuuauugauaccugaaccagaaaaacaacgaacuccccaagauaaccagcuuacuuaugucgugaucgcaauauugacuguuguugcugcaaccauggcuaacgaaaugggguuuuuagaaaaaacaaaaaaagacuuuggucuagggucaauaacaacacaacagccugaaucgaauauacuagauauugaucuucggccagcgagugcauggacauuguaugcuguggccacaaccuucauuacaccaaugcucagacauucuauagaaaauucaaguguuaacguuucacucaccgcaauugcuaaucaggcaaccguucugaugggacuuggcaaagguuggccacuaucuaagauggauaucgggguaccucuucuggcgaucgguuguuacagucaaguaaacccuauuacgcugauagcagcccuacuucugcuagucgcucauuaugcuauuauugggccuggacuccaagcuaaagccacgagagaagcacagaagcgcgcugcugcggggauaaugaagaauccuacaguagaugguaugacaguaaucgacuuagauccaauuccauaugauccaaaauuugaaaagcaacuuggacaagugauguuauuaguacuuugugucacacagguucuaaugaugagaacuacuugggcacuaugugaagcacuaacauuagcaacugguccuaucucaacgcucugggagggaaauccugggcgguuuuggaacacaacaauugcaguaaguauggcaaauauauuucgagguucguaccuagcaggagcuggacuccuauuuucuauaaugaaaaauacagcuaacacucgacgaggaacugguaauaccggcgagacucuuggugaaaaguggaaaaaucggcuaaaugcauuaggaaagucagaauuucaaauauauaagaagucagggauacaggaaguagauagaacauuagccaaagaaggaauaaaaaggggugagacggaucaccacgcuguaucgagaggaucagcaaagcuucgaugguuuguagaaagaaacuuaguaaccccagagggaaagguuguugaccuaggaugcggaagaggaggauggaguuacuauugcggcgggcugaaaaacguuaaagaaguaaaaggucuaacaaaagggggaccaggacaugaagagccaauuccaaugagcacuuauggauggaacuuaguucgauuacaaagcggcgucgaugucuucuucacaccaccugaaaaaugugauacacuacuaugcgauauaggagaaucaucaccaaacccuacaguugaagccggaagaacucugaggguacuaaaucuuguugaaaauugguugaacaacaauacacaauuuugcauaaaaguguuaaacccguacaugccaaguguaauugagaagauggaggcucuucaacguaaauacgguggggcauuaguuagaaacccucuaucgaggaauaguacgcaugaaauguauuggguuagcaaugcaucaggaaauauuguaucaucugugaacaugauaucuaggaugcuuauaaaucguuucacgaugagacauaaaaaagccacguacgaaccggauguugaucuuggauccggaacucggaacauuggaauugaauccgaaacaccuaaucuagacauaauagguaagaggaucgaaaagauuaaacaagagcacgagacgucauggcauuaugaucaagaucauccauacaaaaccugggcguaucacgggucguaugagacaaaacaaacuggaagugccucgucuaugguaaacgggguuguacgauugcuuacuaaaccaugggacguuauacccaugguaacucagauggcgaugacugacacuacaccauucggccaacagagaguauucaaagagaaaguggacacaagaacacaagagccaaaggaaggaacaaaaaagcucaugaaaauaacugcagaguggcuauggaaagaauuaggaaaaaaaaagacaccuaggaugugcacuagagaggaauuuacaagaaaagugcgcucaaacgcagcacuaggggcuauauuuacugaugaaaauaaauggaaaucagccagagaagcugucgaagauucaggcuuuugggaacuagucgacaaagaaagaaaucuacaucuugaagguaaaugugagacauguguauauaacaugaugggaaaaagagaaaaaaaauuaggagaauuuggaaaggcaaaaggaucaagggcaauuugguauauguggcucggggccagguucuuagaguuugaagcauuaggauuucuaaacgaagaccacugguuuucacgagaaaauucauugucuggaguugaaggagaaggacuacauaaacuuggcuauauucuaagggauguaucuaaaaaagaaggaggcgcaauguaugcugacgauacugccgguugggacaccaggauaacacuagaagauuuaaaaaaugaagaaaugguuacgaaucauauggaaggagaacauaaaaaauuagccgaggcuauauuuaaauuaaccuaucagaauaaaguuguuaggguccagcgaccaaccccaagggggacugugauggauauaauaucgaggcgggaucaacguggaucaggucaggucguuacuuacggauuaaacacguuuacuaauauggaagcccaauuaauaaggcaaauggaaggggaagggguauuuaaaagcauucagcaacuaacgguaaaagaagaaaucgcuguuaaaaauugguuaauccggguaggcagagaaagauuaucacguauggcaauaagcggcgaugauugugugguuaaaccacuugaugacagguuugcgagcgcgcucacugcuuugaaugauauggggaagguaagaaaagauauacaacagugggaaccaaguaggggcuggaaugauuggacccagguaccguuuugcucacaucacuuucacgaacucauaaugaaggacggcagaguccuaguugugccuugccguaaccaggacgagcuuaucgguagggcuagaauaucacaaggagcaggauggagccuccgugaaacggcauguuuagguaaaaguuacgcucaaauguggaguuuaauguauuuucaucgucgugaccugaggcuagcagcgaaugcgauauguagcgcggucccaucacauugggucccgacaucaagaacaacuuggucaauucacgcaacacaugaguggaugacaacggaagauaugcucacuguauggaacagaguuuggauucaagaaaauccauggauggaagacaaaacaccaguggaaucgugggaagaaauaccuuacuuaggcaaacgcgaagaucaauggugcggaucauuaaucggacuaacaagccgagccacaugggcaaagaauauccaaacagcgauaaaucaaguucguucguugauugguaacgaagaguauaccgauuauaugcccucuaugaaaagguuuaggcgcgaagaagaagaggcgggcguauugugguaa

SEQ ID NO: 22930 - RNA, 9876 nt, Artificial Sequence
  derived and/or modified CDS sequence (opt6) from DENV-2__GQ398265__SS-prME
acugcgggaauuauaauaaugaugaucccaacaguaauggcauuucacuuaacaacuaggaauggagaaccgcauaugaucguaucacgucaggaaaaagguaaaagucuucuguuuaaaacugaaaacggaguuaacaugugcacuuuaauggcgauggaucuaggagaauugugugaagacacgauuacauauaauugcccacuauuaagacaaaacgaacccgaagauauagauugcuggugcaauucuacgaguacuuggguaacauaugggacaugcacagcuaccggugagcacagaagagagaaacgaucaguagcuuuaguuccgcauguugggaugggauuagaaaccagaacagaaacuuggaugucgucagagggagcauggaaacaugcacaacguauagaaacauggauucugagacaccccggguucacaauaauggcagcuauacuagcauacacaauagguacaacuuauuuccaacgcguucuaauauuuauuuugcuaaccgccgugacgccuucaauggccaugagguguaucgguauuucaaaucgagacuuuguagaaggagucaguggggguucauggguugacauugucuuagagcauggaagcugcguuacgacgauggccaaaaacaaaccaacauuggacuuugaauugauaaaaacagaggcuaaacauccagcaacucuucgaaaauacuguguagaagcaaaauuaacuaauacgaccaccgcaagccguugcccaacacaaggagagccuaguuugaaugaagaacaggauaaaagauucgucuguaaacacucuaugguagaccguggguggggcaacggaugugggcuguuugggaaaggaggaauaguuaccugcgcgauguuuacuugcaagaaaaauauggagggaaaagugguucaaccugaaaacuuagaauacacuaucguuaucacaccacacucuggagaagaaaaugcugugggaaacgacacaggcaaacacgggaaagaaauaaaagugacaccccaaucaucaaucacugaagcugagcuaacugguuaugguacugugacaauggaauguucaccaagaacaggcuuagacuucaaugaaauggugcuacuacaaauggaaaacaaggcuuggcuugugcauagacaaugguuccuugacuuacccuuaccuuggcugccaggagcagauacccaagguuccaacuggauucaaaaagaaacauuagugacguucaaaaacccucaugcaaagaaacaagauguggugguacuuggaagccaggaaggagcgaugcauacagcgcugacgggagcgacugaaauacagaugagcuccggaaauuugcuauuuacaggucaccuaaaauguagacuccgaauggauaaauuacaauuaaaagggaugucauauucaauguguacaggcaaauucaaaguuguaaaagaaauagcugaaacacaacauggaacuauaguaauccgugugcaauaugagggugacggaucucccuguaaaauccccuuugaaauaauggaucuagaaaaacgacauguucuaggaaggcuaauuacuguuaacccuauagugacugaaaaagacagcccagucaauaucgaggcugaaccucccuuuggagauaguuauauaaucauuggggucgaaccugggcagcuaaaacuuucuugguucaagaaaggaucuucaauuggacaaauguucgaaacuacaaugaggggugcgaaacgaauggcgauacucggggauaccgcaugggacuucgguucauuaggcggagucuuuacaucaauagguaaggcuuuacaucaaguauucggugcaaucuacggugcagcauuuaguggagugagcuggacaaugaaaauauuaauaggcgucguaauuaccuggauagguaugaacucuagaucuacaagccuaucagucagccuugugcuuguugguguggucacucuuuaccuagguguuaugguccaagcggauucagggugugucguuuccuggaaaaacaaagaacucaaaugugguagugguauauuuauaacagacaacguucauacauggacagaacaauacaaauuccaaccugaaucuccgaguaaacuagccucagcuauacaaaaagcucacgaagaaggcauuuguggaauaaggaguguuacacgucucgaaaacuugauguggaaacaaauuacucccgaacuuaaucauauuuuaacugaaaacgaggucaaacuaacaauaaugacaggagauauuaagggcaucaugcaagcaggaaaacguagcuugagaccacaaccuacugaauuaaaauacagcuggaaagcaugggggaaggccaaaauguuaucgacggaauuacauaaccauacuuuucuaauugacggaccagaaacugcugaaugcccaaacaccaauagggcuuggaacuccuuagagguggaggauuaugguuucggugucuuuacaacgaacauaugguuaaaacuaaaagagaggcaagacgucuuuugugauuccaagcugaugagugcagccauaaaagauaacagagcgguacaugcugauaugggauauuggauugaaucagcuuuaaaugacacguggaaaauugagaaggcauccuucauagaagucaagagcugucauuggccuaaaagucacacacuuuggucaaauggugucuuagaaagugaaaugauaauaccaaagaauuucgcgggcccuguuucucaacacaauuaucgcccggguuaccauacgcaaacagccggaccguggcaucuuggucgacuagaaauggacuucgauuuuugcgaaggcacaacagucgugguuacggaggacuguggaaaccgggguccuucucuacgcacuacaacagccagugguaaauugauuacagaauggugcuguagaucaugcacgcuaccacccuuaagauauaggggugaggaugguuguugguacgguauggagauccggccuuuaaaagagaaggaagagaaccuugucaacaguuuaguaacugcaggacacgggcagauugauaacuucucccucgggguccuaggcauggcacuuuucuuagaagaaaugcuucguacaagaguugggacaaagcacgccauuuuauuaguagcgguaaguuuugugacauuaauuacaggcaacaugaguuuccgagauuuaggaagagugauggucaugguaggcgcuacaaugacagaugauauaggaaugggagucaccuaccuugcauuguuagcagcguucaaaguuaggcccacauuugcugcuggucuauuacuuagaaaauuaaccuccaaagaacuaaugaugaccacgauagguaucguccuguuaucgcagucuacuauuccagaauccauccuagaauuaacugacgcucucgcguugggcaugaugguacuaaaaaucgugaggaauauggaaaaauaucaacuagcugugacgaucauggcgauacucugcguaccaaacgcaguuauacuccaaaacgccuggaaaguaaguuguacaacacuagcugucgugucaguaucuccauuauuacugacuucuucgcaacaaaaagcagauuggauaccauuagcacuaacuaucaaagggcugaaccccacugcuauauuucuaacuacauuaucccggaccaauaaaaagcgaaguuggccgcuaaaugaggcaaucauggcuguagguaugguaaguauacuggcgaguucucuacuuaaaaaugauaucccaaugacaggcccccuaguagcaggaggauugcucacaguguguuacguacuaacugguagaagugcugauuuagaguuggaaagagcagcagauguuagaugggaagaacaagcugaaauaucgggaucgucaccaauacucucgauuacaauaucagaagaugggucuauguccaucaagaacgaggaggaagaacaaacuuuaacuauauuaauacgcacagguuuguuaguaauaucaggcuuauuuccaguuucgauaccuauaacugcagcugcgugguaccuuugggagguuaagaaacaaagagcaggagugcuaugggaugucccgagucccccaccugugggaaaagccgaauuagaagauggugcguauagaauuaaacaaaaagggaucuuagguuauucucaaauaggggcaggcguguauaaagagggaaccuuucauaccauguggcauguuacaaggggagcaguacuaaugcacaaaggaaaacgcauugaaccuucgugggccgaugucaagaaagaucugauuucauauggaggaggauggaaauuagaaggggaauggaaagaaggcgaagaaguccaaguguuagcacuagaaccagggaaaaauccaagggcagugcaaaccaagccaggacuuuucaaaacaaacacaggaaccauaggugcaguaucgcuagacuuuaguccaggcacaagugguagcccaauagucgacaaaaagggaaaaguagugggacuuuacggcaaugggguggugacaaggucuggaaccuacguaucagcaauagcccagacugagaaaaguaucgaggauaacccggaaauugaagaugacauuuuucguaagaaacgguuaacgauuauggaucugcacccgggcgcagguaagacuaagcgauaucuccccgcaaucguaagagaagcaauuaagagagggcuuagaacguuaauucuagcaccaaccagggucguagcagcugaaauggaagaagcacuucguggguugccuauuagauaucaaacgccagccauacgagcagaacacaccggaagggaaauugucgaucugaugugccaugcgaccuucacuaugcgacugcuaucaccaauacguguuccaaacuacaaccuaaucauuauggaugaagcacauuuuaccgacccugcaucgauagcugcaaggggauauauuucuacaagagucgaaaugggcgaggcagcagguauauuuaugacagccacgcccccagggaguagagauccauuuccccaaagcaacgcacccauuauggacgaggagagggagauuccagaacggucuuggaacucuggacacgaguggguuaccgacuucaaagggaaaacaguaugguucguaccaagcauaaaggcaggaaaugauauagcagcaugccuacguaaaaauggaaagaaggugauacaacuaagucgcaaaacauucgauagcgaguauauaaaaacucggacuaaugacugggauuuuguaguuaccaccgacauaucugaaaugggagcaaacuuuaaagcagaacgaguuauagauccacgaagguguaugaaacccgugauucugacagauggagaagaaagaguuauccuugcggggccaaugcccguuacccauucuagcgcagcacaaaggagaggaagaguaggacguaauccaaagaaugagaacgaccaguauauuuauaugggggaaccacuagagaaugacgaagauugugcacauuggaaagaagcaaaaauguuauuagauaauaucaacacaccugaagggauaauaccaagcauguucgaacccgaaagagagaaaguagacgcgaucgauggcgaauauagauuaagaggugaagccagaaaaacauuuguagaucugaugaggagaggggauuugccagucuggcuagcguauagaguagcugcugaaggaauuaauuacgcggaccggcgauggugcuuugacggaguuaaaaauaaucaaauacucgaggaaaacguagaaguagaaauauggacaaaagaaggggaacggaagaaguugaaaccgagguggcuugaugcacguauuuacagcgacccguuggcuuuaaaagaauuuaaagaauuugcugcugguagaaagaguuugacccugaaucugauaacagaaaugggaagauuaccaacauucaugacacagaaagccaaaaaugcacucgacaaccucgcaguccuucauaccgcagaagcaggcgggagagcauacaaucacgcgcuaucagaacuuccugaaaccuuagaaacccuuuugcuacuaacauuacuagcuacuguuacgggcgggauauuuuuauuccuaaugucugguaaaggcauagguaagaugacacuugggaugugcugcaucauaacagccagcauccuguuaugguaugcgcaaauacagccacacuggauugccgcaaguaucauuuuagaguucuuuuuaauagucuuacucauaccugaacccgaaaaacaaaggacaccgcaagacaaccaacuuacauacgucguaauagcuauucuaacaguagucgcagcaacaauggcuaaugaaaugggauuucucgaaaagacgaagaaagacuuuggguuaggaucuaucacaacccaacagccagaauccaauauauuagacauagacuuacguccugccagcgccuggacccuauacgcagucgcgacaacauucauaaccccaauguuaagacauaguauagagaauaguaguguuaacguuagucucacggcuauagccaaucaggcaacaguauugaugggacuugggaaggguuggccguuaucuaaaauggacauuggaguuccguuacuagcaauaggguguuauucucaaguaaauccgauaacuuuaacagcggcgcuucuacuauuaguagcacacuacgcuaucauagguccaggccuucaggcgaaagcuacaagggaagcacaaaaacgagccgcagcagguauuaugaagaacccaacaguagacggaaugacaguaauagaucuagauccgaucccauaugauccaaaauuugagaaacaacuuggacaagugauguuauuaguucuuuguguaacacaaguuuugaugaugcgaaccacaugggcucucugugaggcgcugacguuagccacugggcccauuagcacuuuaugggaggguaacccagguagauuuuggaauacaaccauugccguaucgauggccaauauuuuccgaggcucauaccuggcgggugcaggacugcuauuuucuauaaugaaaaauacagcaaacacuagaagagggacaggcaauacaggagaaacauuaggggaaaaauggaaaaacagauuaaaugccuuggguaagagugaguuccaaaucuacaagaaauccggcauacaagaaguggacagaacacuagcuaaagaaggaauuaaaaggggcgaaaccgaccaucacgcgguaaguaggggaucugcuaaauugcggugguuugucgagaggaauuuaguaacaccagaagguaaagucguagauuuagguugugggagaggcggcugguccuauuacuguggugggcuuaaaaacgucaaagaaguaaaaggauuaacaaaaggaggucccggacacgaagaacccauuccuaugucuacguaugguuggaaccugguaaggcuacaaucaggcgucgauguauucuucacucccccagaaaaaugugauacccuucuaugugacauaggugaaucgagcccaaaccccaccguagaagcuggaaggacuuuacgcguauuaaacuugguagaaaauuggcugaauaacaauacgcaguucugcauaaagguacuaaacccuuacaugccaagcgugauugagaaaauggaagcauugcaaaggaaauauggaggggcauuagucagaaaccccuugucaagaaauuccacccaugaaauguacuggguuucgaaugcuucugggaacaucguaaguucagucaauaugauaucgcgcaugcucauuaaucguuucaccaugagacauaagaaagcgaccuaugagccagacguggauuuaggauccggcacgaggaacauuggaauagagagugaaaccccgaaucuugauauaauugggaagaggauagagaagaucaagcaagagcaugaaacuucauggcacuaugaccaagaccacccauacaaaacaugggccuaccauggaaguuaugaaacaaaacaaacagggagcgcaaguuccaugguaaauggggucguucgguugcuaacaaaaccaugggauguaauaccaaugguuacucaaauggcuaugacagauaccacaccuuucgggcaacagcgaguauucaaagaaaaaguagauacucgaacucaagaaccaaaagagggcacuaagaaacuaaugaaaauaacagcagaguggcuguggaaggaacucgguaagaagaaaacaccucgcaugugcacacgcgaggaguuuaccaggaagguacgaucaaaugcagcuuuaggagcaauuuucacagacgaaaauaaauggaagucugccagagaagcagucgaagauucgggauucugggaacuuguugauaaagaacguaacuuacauuuagaaggcaagugugagacuuguguguauaauaugauggggaaacgcgagaagaaauuaggagaguucggcaaggccaaggguagucgagcuauuugguauaugugguuaggugcucgauucuuagaauuugaagccuuagguuuucuuaacgaagaucacugguuuagucgagaaaauagcuuaagugguguggaaggggaaggcuugcauaaacuaggcuauauauuaagagacgucagcaagaaagaagguggugcuauguacgcggacgauacggcaggaugggauacaaggaucacguuagaagaccucaaaaaugaagaaaugguaacuaaccacauggaaggagaacauaagaaauuagcagaagcuauauuuaaacuuacuuaucagaauaaaguugugcgagugcaacgcccuacacccagaggaacagucauggauaucauaagucguagggaucaaagaggcucaggucaagugguuacuuacggguuaaauacauucacuaacauggaagcucaacucauuaggcaaauggaaggcgaaggcgucuuuaagucaauccaacaacuuacaguaaaagaggaaaucgcgguuaaaaacugguuaauacgcguuggaagagaacgauuaucacgaauggcaauaucaggagacgauugcguuguuaaaccuuuagaugaccgauucgcaucagcgcuuacagccuugaacgacaugggaaaagugaggaaagauauccaacaaugggaaccaucaagaggcuggaacgauuggacgcaaguccccuucugcucacaucauuuucacgaguuaauaaugaaagaugguagaguucuuguagucccaugucgaaaccaagacgaacucauaggcagagcgaggaucucccaaggugcaggauggagucuacgcgaaacggcgugccuuggaaagucguacgcucaaauguggucauuaauguauuuccaccgaagagaccugcguuuggcagcuaacgcuauauguucagcagucccaucgcacuggguucccacaagccgaacgacauggagcauucacgcgacucacgaguggaugacaacagaggacaugcuaacuguauggaaucguguauggauucaagaaaauccuuggauggaggauaaaacaccuguugagagcugggaagaaauacccuaucuuggaaaacgcgaagaucaaugguguggcagucucauaggauugacgagcagagcgaccugggccaaaaacauccagacggcuauuaaucaggucagaucacuuauaggaaaugaagaauacacggacuauaugccauccaugaaaagauuccgaagggaggaagaagaagcaggaguacuuugguga

SEQ ID NO: 22931 - RNA, 9876 nt, Artificial Sequence
  derived and/or modified CDS sequence (opt6) from DENV-2__KX702403__SS-prME
acagcuggugugauaguaaugcuuauacccacugcaauggcauuccaccucacuacacgaaacggagaaccccauaugauaguuggacgacaggaaaaaggaaaaucauuacuauucaaaacagaagacggagucaacauguguaccuuaauggcuauagaucuuggggaauuaugugaagauacaauaacauacaaaugcccauuauuacgccaaaaugaaccugaggacauugacuguugguguaauucaacaaguacauggguaacguacggaaccuguaccacuacuggcgaacaucggagagaaaaacguucuguagcucucguuccacaugucggcauggggcuagaaacacguacagaaaccuggaugucgagcgaaggggcuuggaaacacguccaacgaauagaaacguggauacuuaggcacccagguuuuacaauuauggcugcgauacuggcguauacuauugggacaacucacuuucagagagcauugauacuuaucuuauugaccgcagucgcuccuucaaugacgaugcgauguaucggcauaagcaaccgagacuuuguagaaggaguuuccggggguucauggguugauauaguacuggaacacggcucgugcguaacuacgauggcuaaaaacaaaccuacucuagauuucgaacuuauaaaaacggaagccaaacaaccggcaacucuacguaaauacuguauugaggcaaaauuaacaaauacuacaacagaaaguaggugucccacacagggagagccgucucuaaaugaagaacaagacaaaagauucauuuguaaacauuccaugguagauaggggauggggcaaugguugcggucuauucggaaaaggagguauuguaacuugugcaauguuuacguguaagaaaaauauggagggcaaaauaguucagccagaaaaccuugaguauacuauuguuauaacaccacauagcggcgaagaacaugcgguggguaaugacacuggaaaacauggcaaagagauaaaaauuacaccucaaucaucuacuacagaggcugaacuaacaggauauggaacuguuacuauggaauguuccccaagaacgggauuagacuuuaacgagaugguauuauugcaaauggaagauaaagcauggcugguacacaggcaaugguuccuugaucuaccguugccauggcuaccaggugccgauacccagggaagcaacuggauacaaaaagaaacucucguaacuuuuaaaaacccccacgccaagaaacaggauguagucgucuugggcagucaggaaggugcuaugcauacagcgcugacaggagcgacugaaauacaaaugagcuccgguaauuuacuuuuuacgggacaucucaaauguagauugaggauggauaaauuacaacucaaagggauguccuauuccaugugcaccggaaaauuuaaaauaguuaaagaaauugcagaaacccaacaugguaccauuguaauuagaguacaauacgaaggggaugguagcccaugcaaaauuccuuucgagaucacugauuuagagaaacgacauguucuagguagguugauaacgguaaacccuauaguaacagaaaaagauucuccugugaauauagaagcagaaccucccuuuggugacuccuauauaauuguggguguugaaccuggacaguuaaaauuaaacugguucaagaaagggagcagcaucggacaaauguuugagaccacgaugagaggggcaaaacgcauggcgauccuuggcgacacagccugggacuuugggucucuagguggaguuuuuacaagcauaggaaaggcuuuacaucaaguauuuggcgccauauauggagccgcauuuucaggagugucguggaccaugaaaaucuuaauaggagugauaauuacguggaucggaaugaacucacgaucuacaagccuuagcguauccuuaguacugguugggguagugacuuuauaucuaggugcuauggugcaagccgauucggguugcauaguuagcuggaagaacaaggaguugaagugcgguagugggauuuucauaacagauaacguucacacauggacugaacaauauaaguuucaacccgaaagucccaguaaauuagcauccgcaauacaaaaggcccaugaagagggaaucugcggaauaagaucuguuacuagguuggaaaacuugauguggaagcaaauaaccccggaauuaaaccauauacucagugaaaaugagguaaagcuaacgauuaugacgggagauaucaagggaauaaugcaagcaggcaaaagaaguuuacggccacagccgacagaacucaaguauucuuggaagacaugggguaaagcuaagaugcugaguacagaaucucauaaucaaacuuucuugauagaugggccggaaaccgcagaauguccaaacacaaauagagcguggaacucucuugagguagaagauuauggcuucgggguauucacaacaaacaucuggcuuaaauuaagagagaagcaagacguauucugugauaguaaauuaaugagugccgcaauaaaggacaauagggcaguccaugcagacaugggauauuggauagagucagcccugaaugauacauggaaaauggagaaagcaucuuucauagaaguuaaaagcugccacuggccgaaaucacauacucuauggagcaauggaguauuagaaucggagaugauuauaccuaagaauuuugcagggccgguaucacaacacaauuaccguccgggauaucauacgcaaacugcaggccccuggcaccuaggcaaauuggaaauggauuucgauuuuugcgaagguacaacugucguaguaacggaggauugugaaaagcgugggccgucguuacgaacaacaacugcuucaggcaaguuaauaacagaaugguguuguaggagcuguacuuuaccuccauugagauacagaggcgaagacggguguugguacggaauggaaauacggccacuaaaagaaaaagaagagaacuuaguaaauagcuuaguaacugcugggcaugggcaaauagauaauuuuagucuaggcguacuuggaauggcacuauuucuggaggagaugcuuagaaccagagucgggacaaaacacgcgauacucuuaguugcauuaucauuuguaacauugauaacaggaaauaugagcuucagagaucuaggacgggugaugguaauggugggagccacuaugacagacgauauugggaugggagucacuuacuuagcauuacuagcugcuuucaaaguucgcccaacuuuugcagcaggcuuacuccuuagaaaacugacuucuaaggaauuaaugauggcaacuaucgguaucgccuuauuaagucaaagcacauuaccagaaaccauuuuagaauuaacugaugcgcucgcauuaggaaugauggcacucaaaauaguacgaaauauggagaaauaccaauuagcaguaaccauuauggcuauaucuugcgucccaaaugcuguaauauuacagaaugcauggaagguuagcuguacaauccuugccgcagucucgguaucuccuuuguuguuaacgagcucucaacaaaaagcagauuggauuccauuggcguugacuauaaaaggauuaaacccuacugccauauuucuaacuacguuaucucguacgagcaagaaacgaucauggccauuaaaugaggcgaucauggcgguuggaauggugaguauuuuggccaguagccuuuugaaaaaugauauacccaugacuggaccucuaguagcaggaggucuacuaacagugugcuauguacucacugggagaagcgcagaccuagaguuggagagggcggcagacguuaaaugggaagaucaggcagaaauuagcggcaguucaccuauacugagcauaaccauaucagaggacgguaguaugucaaucaaaaaugaagaagaggaacaaacguuaacaauucuuauuaggacagguuuauuaguaaucuccggaguuuuccccguauccauacccauaacagcagcagccugguaucuuugggaaguuaagaaacagcgagccgguguccuuugggauguaccaaguccaccgccaguaggcaaagcagaguuagaagacggggcauacagaauaaaacaaagagguauacuuggguacucacaaauaggcgcaggaguguacaaagaggggacauuccacacgauguggcacguuacucgaggagcgguacuuaugcaucgcggaaagcgcauugagccuagcugggcagacguaaagaaagauuuaauaucauauggcggagguuggaaacuugaaggugaauggaaagaaggcgaagaggugcaaguuuuagcucuagaaccuggcaaaaauccucgcgccguacaaacaaaaccaggaauauuuaaaacaaacacaggaacaauaggugcgguauccuuggauuuuucaccugggacaucagguuccccaauagucgauagaaaaggaaaagugguuggcuuguaugguaacggcguugugacucgauccggagccuacguaucugcaauagcgcagaccgaaaaaucaauugaagauaaucccgaaaucgaggaugauaucuuuagaaagaaaagacuuaccauuauggaucuccacccaggcgcuggcaaaaccaaaagauaccuucccgcaauuguaagggaagccauaaaaagaggacuccguacgcugauuuuagcuccuacgagaguuguggcugcugaaauggaggaagcacuuaggggacuaccaauuagauaccaaacgccggcaauacgugcagagcauacuggaagagaaauaguugauuuaaugugccaugcuaccuuuacaaugcgcuuacuauccccaguaagagucccgaauuauaauuuaauaaucauggaugaagcucauuuuacagacccagcuucaaucgcugcaaggggauacauuagcacaagggucgaaaugggagaagcagcaggaauauucaugacggcuaccccuccgggcuccagggacccguucccccaaucaaaugcaccaauuauggacgaagaaagagagauuccggaacgcucauggaacucaggucacgaauggguuacggauuuuaaaggaaagacuguaugguuuguaccgucaaucaaagcaggaaaugauauugccgcguguuuaaggaaaaauggcaaaaagguaauucaauuaagcagaaaaacauucgauucggaguaugucaaaacaagggcaaacgacugggacuucguaguaacaacugauauaagcgaaaugggagcuaauuucaaggcggaacgcgugaucgacccucgaagauguaugaagccaguaauucuaaccgauggugaagaacguguuauccuugcgggaccuaugccagugacucacucaagcgcugcucaacgacgugggcgaauagguaggaaucccaaaaaugaaaaugaucaauauauauacaugggcgagccgcuugaaaacgacgaagacugcgcccauuggaaagaagcgaaaaugcuauuagauaauauuaauacuccggaagguauaauuccaucgauguuugaaccggaaagggaaaaaguggacgccauagacggagaguaucgccuaagaggagaagcaaggaaaacauuugucgaucuaaugagaaggggcgauuuaccuguauggcuugcauauaagguugcugccgaaggcauaaacuacgcugauaggaaaugguguuucgacggcauuaaaaauaaucaaauacuugaagaaaacguagaaguagaaauauggacaaaggaaggagaaagaaagaaauuaaaaccccguugguuggaugcaagaauauauagcgacccucucgcauuaaaagaguucaaagaauuugcagccggccgaaagucguugacauuaaauuugauaacagagaugggaagacuaccgacuuuuaugacgcagaaagcaagaaaugcucuggauaaccucgccguacugcacacagcugaagugggaggcaaggcauacacgcacgcccuuucugaauugccagagacucuagaaacacuauuacuacuuacauuauuagcugcuguaacgggcgguaucuucuuauuucuuauguccggcaaggguauugggaaaaugacccuugguaugugcuguauuaucacagcaucgauucuuuuaugguacgcacaaauucaaccacauuggauagcagcuagcauaauucuagaguucuuucugauuguacuacuuauuccagaacccgaaaaacaaaggaccccgcaagauaaucagcuuaccuacgucguaauagcaauauuaacaguaguagccgcaacaauggcgaacgagauggguuuccucgagaagacaaagaaagaccuaggauuuggcagcauaacaacacaggaaagcgaaaguaauauucuagacauugacuuacguccggcauccgcauggacucuauaugccguagcaacaacuuucgugacgccuauguuacgccacaguauagaaaauucaagcgugaacgucucucucacagcaaucgcgaaccaagcaacaguacuuaugggauuggguaaaggauggcccuugucgaagauggacaucggcguaccgcuacuggccauagguugcuacagucagguaaacccaaucacgcuaacugcagcguuauuauuauuaguagcucauuacgccauuauagguccaggauugcaagcgaaggcaacaagagaagcacagaaaagagcugcagccggaauaaugaagaauccaacaguugaugggauaacuguaauagaccuagaaccuaucccgcaugauccgaaauucgaaaaacaacuaggccaaguaaugcucuuaauacuaugcguuacacaaguacuaaugaugcggacaacgugggcacuaugcgaggcucuaacacuagcaacugguccaauaucuacucugugggagggcaaccccggcagguucuggaacaccacuauagcaguaagcauggcuaauauauuucgagguucuuauuuagcaggagcaggucuacuauuuuccauaaugaagaacacaacaaauacaagacgaggcacuggaaacguuggugaaacauugggugaaaaauggaagucucguuuaaaugcauuagguaaauccgaguuccaaauauauaagaaaucagguauccaagaaguagaucgaacauuagcgaaagaagguauaaaacgaggagaaaccgaucaucacgcagugucucgcgggagcgcgaaauuaaggugguuugucgaacgaaacauggucacaccugaagguaaaguaguagaccucgguuguggaagaggaggauggagcuauuacuguggaggcuuaaagaauguccgagaagugaaaggucuuacaaaaggaggccccggucaugaagaacccauacccaugucgacguaugguuggaaucuaguucggcuacagucagguguagauguauucuuuacuccgccagaaaaaugcgauacauuauuaugugauaucggagaaucaaguccuaauccaaccaucgaagccggacgcacuuugaggguucugaaucuuguagaaaacuggcugaauaacaacacacaauuuuguauuaaaguuuuaaaccccuacaugccgucugugauugagaaaauggagacauugcaacgaaaauauggcggugcccuaguacggaacccuuuaucgcgaaauucaacacaugagauguacuggguaagcaacgcaacuggaaacaucguguccucaguaaauaugauaucgagaauguuaauaaacagguuuacgaugaaacacaagaaggcuacguaugaaccggacguagaucucggaucggguacacgaaauauaggcauugaaucggagacaccaaaucuugacauaaucggcaaacgaauagagaaaauaaaacaagagcaugaaacguccuggcauuaugaucaggaucacccguauaaaacaugggcauaucacggaucauaugaaacgaaacaaacagguagugcaucauccaugguaaaugguguaguucgacuauuaaccaaaccuugggacguuguacccaugguuacacagauggcuaugacugacacaacuccauucggacaacaaagaguguucaaagaaaaggucgacacgagaacccaagaaccaaaagagggcacaaagaaacuaaugaaaauaaccgcagagugguuauggaaagaauuaggcaaagagaagacaccucgaauguguacgagagaagaauuuacucgcaaaguaagaaguaaugcagcuuuaggagcgguauuuaccgaugaaaauaaguggaaaagugccagagaggccguagaagauggaagauucugggaacugguggaucgagagcgaaauuuacauuuagaagguaaaugcgaaaccugcguauauaauaugaugggcaagcgagaaaagaaacuuggcgaauuugguaaggcaaaagguagccgagcgauaugguacauguggcuaggugcuagauuccuagaauuugaagcacuagguuucuuaaacgaagaccacugguuuagcagggguaauucccugucaggaguagaaggagaaggucuccaccgucugggauauauucuacgugagguagggaagaaagaagguggugcaauguacgcugacgacaccgcagguugggauacaagaaucacucuagaagaccuuaaaaaugaagaaauggucacaaaccacaugaaaggugaacacaagaaacucgcggaggcaaucuucaaauuaacuuaucaaaacaaaguaguacgaguacaaagaccuacaccaagagguacuguaauggacauaaucuccagaaaggaucagcgggguucugggcaaguaggaacguauggguuaaacaccuucacuaauauggaagcacaauugauaaggcagauggaaggugagggaauauucaagaguauucagcaccuuacggcaacugaagaaacugcaguccaaaacugguuagcaagagugggucgagaacgguuaucaagaauggcaauaucuggugaugauuguguaguuaagccaauagaugauagauuugcauccgcgcuaacggcacucaacgacaugggaaaaguacgcaaagauauacaacaaugggaaccuuccagaggauggaacgauuggacgcaaguaccauuuuguucacaccauuuucacgagcuaguaaugaaagauggcaggguauuagucguaccauguagaaaucaagacgagcuaauaggacgagcgagaauuucccaaggagcaggguggucccuuaaggagaccgccugccuuggcaaaagcuacgcacaaauguggacguugauguauuuucaccgaagagauuuaaggcuagcugcaaaugcuauuugcucugcgguacccucccacuggguccccacaaguagaaccacauggucuauucacgccaaacaugaauggaugacaaccgaagauaugcuagcuguguggaaccgaguauggauucaagaaaacccauggauggaagauaaaacgccgguggaaucgugggaagaaguucccuaucuuggaaaaagggaggaccaaugguguggaagccucauaggacuaacaaguagggccaccugggcgaaaaacauccaaacagcaauaaaccaaguccgaagccugauaggcaaugaaggauauacagauuauaugccaucaaugaagagauucaggagagaggaagaagaagccggaguacugugguaa

SEQ ID NO: 22932 - RNA, 9876 nt, Artificial Sequence
  derived and/or modified CDS sequence (opt6) from DENV-2__KX702404__SS-prME
acugcaggaguuauaguuaugcugauaccaacagcuauggcauuucaucuaacaacucguaauggugaaccccauaugauagugggaaggcaggaaaaagguaaaaguuuauuauuuaaaacugaagauggaguaaauauguguacuuuaauggcaauugacuuaggugaacuuugcgaagacaccauaacauauaaaugcccuuuacuacgucaaaaugaaccagaagauauugacugcugguguaacaguacaagcaccuggguaacauacgggacuuguacuacaacuggagaacaucgcagggaaaaacggagcguagcuuuagucccacauguuggaaugggucuugaaaccaggacugaaacauggaugaguagugaaggagcauggaagcacguacaaaggauagaaaccuggauacugcgacauccaggauuuacgauaauggcugcaauacuugcuuauacuaucgguacaacucauuuucaacgcgcauuaaucuuuauuuuguuaacugccgucgcuccaucaaugaccaugagauguauaggaauaucaaauagagacuucguagaaggagucucgggagguaguuggguggauaucguacuagaacaugguaguugcgucacuacaauggcuaaaaauaaaccaacccuagauuucgaacuaaucaaaaccgaagccaaacaaccugcuacccuaagaaaauacuguauagaagcuaaguuaacuaauaccacuacagaaucccguugccccacacaaggagaaccuucucuaaacgaggaacaagauaaaagauucauuugcaagcauuccaugguugacagaggauggggaaauggaugcggauuauuugguaaaggaggaauaguaacuugugcgauguuuacauguaagaagaauauggagggaaaagucguccaaccggaaaauuuggaauauacaaucguaauuacuccacauaguggagaagaacacgccgugggaaacgauacgggaaaacacgggaaagaaaucaaaaucacaccucaaagcucuacgacggaggccgaacuaacugguuauggcacggugacaauggaguguagcccaagaacgggucuggacuuuaaugaaaugguauuacugcaaauggaagacaaggcaugguuggugcauagacaaugguuuuuggaccuuccuuuaccuuggcugccgggggcagauacgcagggaaguaacuggauucaaaaagaaacacuuguuacauuuaagaauccgcacgcaaagaagcaagacgucguugugcuagguucucaagaaggggccaugcacacggccuuaacgggagcaacugaaauacaaauguccagcggaaacuugcuauucacaggacacuuaaaaugucgguugagaauggacaaauuacaacugaaggggaugagcuauucaauguguacagguaaguuuaaagucguaaaagaaauagccgagacacaacaugggacaaucguaauacgagugcaauaugaaggugacgguagcccauguaagauuccauuugagauuacagaccucgaaaagcgacacguacuagggcgacuaauaacaguuaaucccauuguaacggaaaaagacucgccuguuaacauagaggcggaaccuccauuuggagauucauacauaauuguaggagucgaaccaggacaacucaaacuuaacugguuuaagaaaggaucuaguaucggacaaauguucgaaacaacuaugagaggcgccaaacgaauggcuauauugggagacacugcuugggacuucgggucacuuggcggagucuuuacaucuaucggaaaagcauuacaucagguauucggagcuauuuauggagcagcauuuucugguguaucauggaccaugaaaauucuaauugguguaauaauuacuuggauuggaaugaacucaagaagcaccucuuugaguguuucucuagucuugguaggcgugguaacgcuauauuugggagccaugguucaagccgauucuggguguguaguaucauggaaaaacaaagaauuaaaaugcggcucggggauauuuauaacggauaacguacacacuuggacagaacaguauaaauuucagccugaaucaccuaguaaauuagcuagugcaauacagaaagcacaugaggaagggaucugcggaauacgaucagucacaagacuagagaacuuaauguggaagcaaauuacgccagaacuaaaccacauauuaucggaaaaugagauaaaguuaacgaucaugacaggggauauaaaaggcauaaugcaagcaggaaaacgaucauuacgaccacaaccuacagaauugaaauacaguuggaaaaccugggguaaagcuaaaauguugagcacagaaucacauaaccagacuuucuuaauagaugguccagaaacagcagaguguccuaauacgaaccgugcuuggaauagucuagaagucgaggacuacggauucgggguauucacuacuaauauauggcugaaacugagggaaaaacaggauguauuuugcgauucaaaauuaaugucugccgcuauuaaagacaauagggcaguucaugcugauaugggauauuggauugaaucugcguuaaaugacacauggaaaauggaaaaagccagcuuuauagaggugaagaguugccacuggccaaagucccacacauuguggucaaauggcguccuagaaucugaaaugauaauucccaaaaauuuugcaggaccggucucgcagcauaauuauagacccggguaccacacacaaaccgcaggaccauggcaucucgguaaacucgaaauggacuuugauuuuugugagggcacaacaguaguugucacagaagauugugguaauagagguccgagccucagaacgacgacagcgucggguaaauugaucacagaauggugcuguaggucauguacguuaccaccuuuacgguacaggggagaagauggauguugguauggaauggaaaucagaccccuaaaagaaaaggaagagaaccuaguuaacucccucguuacagcaggucacggucaaaucgauaacuuuucuuuaggagucuuagguauggccuuguuucuugaggagaugcuaagaacccguguagguacuaaacaugcuaucuuacuuguagcauuguccuuuguaacuuuaauuacaggaaauauguccuucagagaucuugguagggucauggucaugguaggggcaacgaugacagaugauauugggaugggugucacauaucuggcccuauuagcagcauuuaaaguacguccaacuuucgcggcgggacuucugcuaagaaaacuaacaagcaaagaacuuaugauggcuacgaucggaauugcuuuauugucgcaaucgacacuuccagaaacgauuuuagaacuaacugaugcauuggcacuaggaaugauggcacuuaaaauuguccguaacauggagaaguaucaauuagcaguuacaaucauggcuauuucgugugucccaaaugcaguaauucuacaaaacgcguggaagguaucauguacgauucuagccgcgguuagcgugagcccauuauuacuuacgucuucacaacagaaagccgauuggauacccuuagcacuaaccaucaaagggcucaauccaacagcaauauuucucacaacacucucccguacaucaaagaagcgcagcuggccguuaaaugaagcaaucauggccgucggaauggugagcauuuuagcuagcagcuuacucaaaaaugacauacccaugaccgggccacuuguagccggcggauuacuaacaguuuguuacguucuaacaggaagaagcgcagauuuagaacuagaaagggccgcagaugucaaaugggaggaucaggccgaaauuagcggaucuuccccuauuuuguccaucacuauaucugaagacgggucaaugucaaucaaaaaugaagaagaggaacagacccuaacaauucuaauaagaaccggcuuguuagugauuucaggaguguuccccgucagcauaccaauuaccgccgccgcaugguacuuaugggaaguuaagaagcaaagagcuggaguguuaugggacguuccuucaccuccuccagucgaaaaagcugaauuagaagacggugcuuacagaauuaaacaacguggcauuuuaggauacagucaaauaggugcaggaguguauaaagaaggcacuuuccauacaauguggcauguaacacgaggugcaguacugaugcaucgcggaaaaagaauugaaccgucaugggccgauguuaaaaaggaccucaucagcuacggugguggcuggaaguuagagggggaauggaaagaaggggaagaagugcaaguguuagcccuugagccaggcaaaaacccuagagcaguacaaacaaaaccaggaauauucaaaacuaauacaggaacgauaggcgcggucucuuuggauuuuucucccggaacaaguggcagucccaucguagacagaaaaggcaaaguaguaggacuuuacggcaacggaguaguuacuagaaguggggcauacguaucugccaucgcucaaacggagaagucuauagaagacaauccugagauagaagacgacauuuuuaggaagaaacgauuaacuauuauggacuuacauccaggagcugggaaaaccaagcguuaccuaccagccauaguccgagaggcuauuaagagaggcuugcgaacauuaauacuagcuccuacaagggucguagcggcagaaauggaggaagcucucagaggauugccaauuagauaucaaacuccggccauaagagccgagcacacagggagagagauaguugaucuaaugugucaugcgacguuuaccaugagauuacucuccccagucaggguaccaaacuauaaccucaucaucauggacgaagcccacuuuacggacccagccucgauugccgcucgaggauacauaaguacccggguugaaaugggggaggcagcaggcauauucaugacagcaacaccgccaggaaguagagacccguucccgcaaagcaaugcucccauuauggaugaggaaagagaaauucccgaaagaucauggaacucugggcaugaauggguaacagauuucaaggguaaaacuguuugguuugugccuucgaucaaagcuggaaaugauauagcugcauguuuaaggaaaaacggcaagaaagucauccaacuaucaagaaagacauuugacucggaauauguaaaaacucgugcuaaugauugggauuuugugguaacgacugacaucucugaaaugggugcuaacuucaaggcagaaagaguuauagacccaagaagauguaugaaaccugugauuuuaacagauggagaagaacgaguaauauuagccgggccaaugccuguuacucauucgucugccgcgcaacggaggggaagaauaggucggaaucccaaaaaugaaaaugaccaauauauauauaugggugaaccucuggagaaugacgaagacugcgcgcacuggaaggaagcuaaaaugcuauuagauaauaucaauacaccugaaggcauaaucccgagcauguuugaaccugaacgagaaaaaguggaugccauagauggcgaauaucgccuucgaggugaggcuagaaaaacguuuguagacuugaugcgcagaggagauuugccagucuggcuugcauacaaaguugcugcugaagguaucaacuaugcugauagaaaaugguguuucgauggcauuaaaaauaaccagauacuggaggagaacguagaaguagaaauauggacgaaggaaggagaacgcaagaaguuaaaaccgcgguggcuggacgcacgaauauauagugauccauuggcccuaaaagaauuuaaagaguuugcugcgggaagaaagagcuuaacuuuaaacuuaauaaccgagaugggaagguugcccaccuucaugacucaaaaagcacgaaaugcacuggacaaucuagcaguauugcacaccgcugaaguugguggaaaggcauacacacacgccuuaucagaauuaccagaaacguuagaaacucuguuauuauuaaccuuauuggccgcaguuacagggggaauauuccuauuucuaaugucaggaaaaggaauagggaagaugacccucggcauguguugcauaauuacagcgucuaucuuacuuugguacgcucagauacaaccgcauuggauagcagcaagcauaauacuugaguucuuucuuaucguuuuauuaauaccagaaccagaaaaacaaaggacuccacaggauaaccaacucacauaugugguuauugcaauacugacaguaguagcagcaaccauggcaaaugaaauggguuuccuugagaaaacaaagaaagaucuugguuuuggcuccauaacaacucaagaaagugagaguaauauauuggacauagaucuuaggccagccucggcauggaccuuguacgcuguagcaacaacuuucgucaccccgaugcuacgccacucaauagaaaacagcagugugaacgucagcuuaaccgcgauugcuaaccaggcuacuguccuuaugggucucgggaaaggguggccccugucaaaaauggacauagggguaccacuauuggcaauuggcuguuauagccaagugaacccuauuaccuuaacggcugcucuacuauuacuuguugcacacuaugcgaucauugguccuggauuacaagcaaaagcaacaagagaggcccagaaaagagcagcugccggaauuaugaaaaauccaacaguugaugggaucacggugauagauuuggaaccuauuccauacgacccuaaauucgaaaaacaacuggggcaaguuauguuauugauucuaugcguaacucaaguuuuaaugaugcgaacaacuugggcauugugugaggcuuuaacccuugcaaccggaccuaucucaacacugugggaagguaacccaggucgauuuuggaauacgacuauagcugugucuauggcgaacaucuuccgaggaucguaccuagccggagcuggauuacuguuuaguauuaugaagaauacgacuaacacaagaagaggaacagggaacguuggagaaacacuaggcgaaaaauggaaaucgagauuaaaugcacuaggaaaaucggaguuccaaauuuacaaaaagaguggcauucaagaaguugacaggacucuagcaaaagaagggauaaaaagaggagaaacggaucaccaugcaguaaguaggggcucugcaaaauuacgaugguucguagaacguaauaugguuacuccggaagguaagguaguagaccuuggauguggaagagguggauggaguuacuacuguggaggcuugaaaaacguuagagaagucaaaggcuuaacuaaaggaggacccggccacgaagaaccgaucccaaugagcacuuauggcuggaacuugguuaggcuacaaucugguguggauguauucuucacaccacccgaaaaaugugauacacuauuaugcgacauaggugaaagcagcccaaauccaacuaucgaggccggaagaacacuuagagucuuaaacuuaguagaaaauugguuaaacaauaacacccaauuuugcauaaaagugcuuaauccauacaugccuucgguaauagagaaaauggagacccuucaacgaaaauauggaggcgcguuaguucgaaacccuuuaucaagaaacucgacacaugagauguacugggugagcaaugcaacaggcaacaucguaaguagcguuaacaugauuagccgaaugcuuauaaaucgcuuuacuaugaagcauaagaaggccaccuaugaaccagaugucgacuuaggguccgggaccagaaauaucgggauugaaucagaaauaccgaaccucgacauaguuggaaaacgaauagagaaaauuaaacaagaacaugaaaccagcuggcauuacgaccaagaucauccauauaaaacaugggcauaccauggcaguuacgaaacuaaacagacaggaucugccagcucaaugguuaauggaguuguaagacuacuaacuaaaccaugggaugucguuccaauggucacccagauggcgaugacugauacuacaccauucgggcaacaaagaguauucaaagaaaagguggacaccagaacacaggaaccaaaagaaggaacaaagaaacuuaugaaaauaacugcugaaugguuguggaaagagcuagguaaagaaaagacgccaagaauguguacaagagaagaguuuacacgaaaaguuagaaguaacgcagcacugggagccgucuuuaccaaugaaaauaaauggaaaucagcacgggaggcuguagaagacggacguuuuugggaauuaguugauagagagagaaaccuccacuuagaagguaaaugcgaaacauguguauacaauaugaugggaaaaagggagaagaaauuaggugaauuuggaaaagcgaaagguucacgcgccauaugguacaugugguuaggggcaagauuuuuagaauuugaggcacuuggauuucuuaaugaagaucacugguuuagcagaggaaauagcuugagcggaguggaaggggagggccuacacagacucggcuacauucuaagggaagucggcaaaaaggaaggcggcgcgauguacgcugaugacaccgcugguugggauaccagaauaacguuagaagaccucaaaaaugaagagauggucacaaaccauaugaaaggugagcacaagaaauuagccgaggccauauuuaaguugacuuaucaaaauaaggucguaagaguacagagaccaacaccuagaggaaccgucauggauauaauaucaagaaaggaucaacguggaaguggucagguaggaacguacggauugaauaccuuuacaaauauggaagcgcaacuaauucgacaaauggagggugaaggaauuuuuaaauccauacaacauuuaacagcaaccgaagaaauagccgugcaaaauugguuggcgagaguagguagagaaagguuaucaagaauggcuaucagcggagacgauugcguuguuaagcccauagaugacagguucgcgucugcuuuaacugccuuaaaugauauggguaagguacgcaaagauauacagcaaugggagccgucacgaggcuggaaugauuggacacaagucccauucugcucacaucauuuucaugagcuaguuaugaaggaugggcgcgucuuagucguuccauguagaaaccaggaugaauugauaggcagagcgagaauaagucaaggugcaggauggagucugaaagagacagcuugucuuggcaaaucguaugcacaaauguggacacuuauguacuuucaucguagggaucuucgacuagcugcaaaugcuauaugcagugcaguaccaagccauuggguaccgaccaguagaacaacguggucaauucacgccaaacacgaguggaugacgacugaagacauguuagcaguuuggaaucguguuuggauacaagaaaaccccuggauggaggauaaaacuccuguagagucuugggaagaaguuccauauuuggguaaaagagaagaccaauggugcggaucuuuaaucggacuaaccucccgagcgacgugggccaaaaauauucagacggcaauaaaucagguucguucguugauaggaaaugaagguuauaccgacuacaugccaaguaugaaacguuuuagaagagaggaggaagaagcuggaguacucugguaa

SEQ ID NO: 22933 - RNA, 9873 nt, Artificial Sequence
  derived and/or modified CDS sequence (opt6) from DENV-2__JQ686088__SS-prME
acuacugggaugauaauuaugcuaauaccgacggugauggccuuucaucuaacgacaagaaacggagagccucacaugauagucagucgccaggauaaaggaaagucacuuuuauuuaagacaaaagauggaacuaacauguguacccucauggcuauggaucugggagaacuaugugaagacacaauaacauacaaguguccauuuuuaaaacaaaaugaaccugaggacauagacugcugguguaauucuacaucaacguggguuacauauggcacauguacgacgacuggagaacauagaagagaaaagagauccguggcacuagucccacauguuggcaugggacucgaaacuaggacagaaacuuggaugucuucggaaggugcauggaaacaugcucaacgaauagaaacauggauacuacgacauccgggguuuacgauaauggcugcaauauuagcauauaccauagguacaacgcacuuccaacggguacuaaucuuuauuuuauuaacugcagucgcgccaucgaugacaaugagauguaucggaaucgcuaauagggacuuuguugaaggcguaagcggugggucauggguggauauaguucuggaacacggcagcugcgugaccacgauggcuaaaaauaaaccaacauuagauuuugaacuuaucaaaacagaggccaaacaaccggcaacgcugcguaaauacugcauugaagccaaacuaacuaauaccacuacugacucccgauguccaacacaaggcgagccaucacugaacgaagagcaagauaaaagauuuguauguaaacacaguaugguagauagaggcuggggaaacgggugugggcuuuuugguaaagggggaauugucacuugugcaauguuuacguguaagaaaaauaugaaagggaaaaucguucaaccugaaaacuuagaauauaccaucgucauaaccccacauucaggcgaagaacacgccgugggcaaugacaccgggaaacacggaaaagaggugaaaauuacaccacaaagcucgauaacugaagcugaacucacuggguacgguacaguuacgauggaaugcagcccgcguacaggcuuggacuuuaaugagaugguccuuuuacagauggaagauaaggcauggcuagugcauagacaaugguuuuuagaccuaccucuaccauggcugccaggugcagauacacaaggaucgaauuggauccaaaaagaaacuuuaguaacguucaagaauccucaugccaagaaacaggauguaguagugcuaggaagccaggaaggagcaaugcacacggcacuuacuggagcgacagagauacagaugaguuccgguaaucuucuauuuaccggacaccuaaaaugcagauuaagaauggauaaacugcaacuuaaaggcaugucuuauagcauguguacaggcaaauuuaaaguagugaaagagaucgccgaaacucaacaugguacaauaguuauacgaguccaauaugaaggagauggcucuccuugcaaaauacccuuugaaauuauggaucuagaaaaaagacacgugcugggacgcuuaauuacggugaacccaauuguuacagaaaaagaucgcccgguaaauauagaagcagaaccacccuuuggagacucguauauaaucauaggagucgaacccggacaauuaaaauugaauugguuuaaaaaaggaucuucaauaggacagauguuugaaacuacaaugaggggagcaaaacgcauggcgauacuaggagauacagcuugggauuuugguucacucggagguguuuucacuagcauagggaaagcacuacaccaaguguucggagcuaucuauggagccgccuucuccgguguaucauggacgaugaaaauacucauagguguaaucauaacauggauaggaaugaacaguaggagcacgagccugucaguuucacugguucuuguggguauaguaaccuuguaccugggagugauggugcaagcugauucaggcuguguuguaaguuggaaaaauaaggaacucaaauguggaaacggaaucuucguaaccgauaauguacauacauggaccgaacaauauaaauuccagccagaaagcccgagcaagcuugcaagugcaauccaaaaagcacacgaagaggguauaugugguauccguucaguuacaagguuagaaaaucugauguggaaacagauaacucccgaguuaaaucauauauuaucugagaaugagguuaaauuaacgauuaugacgggggacauaaaaggaauaaugcaggugggaaaacgaucccugcaaccucagccgacugaauuacgguauucauggaaaacauggggaaaggcaaagaugcucaguaccgagcuccacaaccagacauuuuuaauugacggaccagaaacagcagaauguccgaauacgaauagggccuggaacucccuagaaguagaggauuauggauuugguguuuuuacaacuaauauaugguuaaaacuucgagaaaagcaggaugucuuuugugauaguaaacuaaugagugccgcaauaaaagauaaccgugcuguacaugcugacaugggguauuggauagaaagcgcguugaaugacacauggaaaauugaaaaagccuccuucaucgaagugaaaaguugucacuggcccaaaagccauacccuuuggaguaacggaguucuggaaucugaaaugauaauaccuaaaaaucuugccggaccuguaucgcaacacaauaaucguccaggauauuauacgcaaacugcaggcccguggcaucugggaaaacuggaaauggacuucgacuuuuguaaaggaacuacagugguugugacggaggacugugggaaccgggguccaucucuaagaacuacuacugcaucgggaaagcuuauuacggaaugguguuguagaaguuguacguuaccaccgcuccguuacagaggugaggacgguugcugguaugguauggaaauaagaccgcugaaagaaaaagaagaaaacuuggugaacucucuuguaacagcagggcaugggcagauagacaacuucagcuuaggcauauuggguauggcucuauuccuugaggagaugcuaaggacaagaguagggacaaaacaugcaauauuacuuguagccguaaguuucguaacacuaauaacaggcaacaugagcuuuagggacuuagguaggguuauaguuaugguaggcgcaaccaugacagacgacauaggcauggguguaacauaucuugcucuacuagcggccuuuaaagugagaccaaccuuugcagcuggacuacugcucagaaaauuaacaaguaaggaacugaugaugacuacgauugggauuguacuauuaucgcagaguucuauaccugagacuauacucgaguuaacagaugcauuggcgcuaggaaugaugauacuaaaaaugguucgaaauauggaaaaauaccaacucgcgguaacgauuauggcaauuuuaugcguaccuaacgccguaauuuuacaaaaugcauggaaaguaagcuguacgauccuugcaguugucucuguaucuccauugcuucuaacuaguagccagcagaaggccgauuggaucccgaucgcauugacaauaaagggcuuaaauccaacagcuauauuucuuaccacuuuaagcaggacaaguaaaaaacgaaguuggcccuugaacgaagccauaauggcaguugguaugguaucaauauuggcgucaucgcuauuaaaaaaugauauuccaaugacggggccuuuaguugcggguggauuacuaacaguauguuauguauugacggggcgcagugccgaucuagaauuagagcgcgcugcggauguaaaaugggaggaccaggcggaaaucuccgguucaucaccaauauuauccauaacaauaucagaagacggcucuaugucaauaaaaaaugaagaagaggaacaaacucugacuauacucauccgaacuggcuuguugguuguaucuggauuguuuccggugucaguuccaauuacagcugcagcuugguaucugugggagguaaaaaaacaaagggcaggcguguuaugggacguuccuucaccuccaccagcgggaaaagcagaacuggaggauggagcuuacagaauaaaacaaaaaggaaucuuaggcuauucacaaauaggggcuggcgucuauaaagaaggaacuuuccauacuauguggcacguuacacguggugccguacugaugcauaaaggaaaaaggauagaaccgaguugggcugauguaaagaaagacuuaauauccuauggcggggguuggaaacuagagggugaauggaaagaaggagaagagguacagguuuuagcauuggaacccggaaaaaaccccagggcaguacaaacaaagccuggucuauuuaaaaccaauacaggaacgauuggagccguaucauuagauuucuccccgggaacuaguggcagcccgauuguugauaaaaaagguaaaguaguaggacucuauggaaacggcgucgucacgaggucaggagcauacgugagugcgauagcccagacggaaaagagcauugaagauaauccggaaauugaagaugacauauuucgaaaacgacguuugacuauuauggaucuacaucccggagcugguaaaacgaaaagauauuugccugcgauagugagagaagcaaucaaaagaggucucaggacauuaauuuuagcccccacaagaguuguugccgcugaaauggaggaggcgcuuagaggauugccugugagauaucaaacaccagccauaagagcggaacauacaggacgugaaaucguugauuuaaugugccaugcgaccuuuacgaugcgucuacuaucuccuauacgcguacccaauuauaauuuaaucaucauggaugaagcccacuuuacugauccagcaucgauugcugcacguggcuauauuagcacgcgaguagaaaugggugaagcugcuggcauauuuaugacggcgacaccacccgguucucgagauccauuuccccaaucuaacgcaccaauaauggaugaggaaagggaaauaccagaaaggagcuggaauagugggcacgaauggguaacugauuucaagggcaaaacaguuugguucgucccuucaauaaaaaccggcaacgauauugcagcguguuuacguaaaaacgggaagcgaguaauacaauuaagccguaaaacauuugauuccgaguauauuaagaccagaacgaacgacugggauuuuguagugaccaccgacauaucugagaugggagccaacuuuaaagcucaaagaguaauugauccacggagaugcaugaaaccaguaauucuuacugauggagaagaaagagucauauuggcagggccuaugcccguuacucacagcucagcagcacaacgcggcagaguaggucgaaacccaaaaaaugagaaugaccaauacauauauaugggugaaccacuugaaaacgaugaagauugugcacauuggaaagaagcuaaaauguuauuagacaauauuaauacaccagagggaauuauaccuuccauguuugagccagagagagaaaaaguagaugcuauugauggggaauacaggcugcgaggggaagcgagaaagacauucguggacuuaaugcgaagaggagauuugccuguauggcuggcuuacaaaguugcggcagaagggauaaacuacgcagauagacgguggugcuucgacggaacaagaaauaaucaaauauuagaggagaaugucgagguugaaauauggacgaaggaaggugagagaaagaaacuuaaacccaggugguuggaugcaaggaucuacgcggauccuuuagcguuaaaagaguucaaagaguuugcagcggguagaaaaucacuaacucugaacuugauaacagaaaugggaagacucccuacauuuaugacacaaaaagugcgggacgcauuagauaacuuagcuguauugcauaccgcugaagcaggugggaaagcauauaaccacgcauuaaacgaguuaccagaaacacuagagaccuuacuauuacuaacuuugcuugcgacaguaacuggcggcauauuccuuuucuuaaugucaggaagaggcauaggcaaaaugacguuaggcaugugcugcauuauuacagcaaguauccugcuaugguacgcacaaauacaaccacauuggauagcugcaucaauaauacuugaauucuuuuuaauaguacuuuuaauacccgagccggaaaagcagagaacaccucaggacaaccaguugacauacguaguuaucgccauucucacaguaguagcagcgacaauggcgaacgaaauggguuucuuggagaaaacuaagaaagauuuaggccuagggaguauuguaacccagcaaccugaaaguaauauacuugauauagaucuucgcccagcaucagcauggacucuuuaugcugucgcaacaacuuuuauaacuccgaugcuacggcauagcauagaaaacuccucgguaaauguaucauuaacagcaauagcuaaccaagcaaccguuuuaaugggauuaggaaaaggcuggccccugucuaaaauggacauaggagugccacuacuugcgauaggauguuauucgcaggugaacccaauuacauugacugcugcuuuauuccuuuugguagcgcauuacgcaauuauagguccaggcuuacaggcuaaggcgaccagagaagcucaaaaacgugccgcagcuggcauuaugaaaaauccuacaguugacgguauuacugugauagaucuugauccuauuccguaugaucccaaguuugaaaaacaauuagggcaaguaaugcuauuagucuuaugugugacacaaguauugaugaugagaacuacgugggcauugugugaagcgcucacauuagcgacaggacccguaucaacucuuugggaagggaauccuggaagauuuuggaacacuacuauagcuguaucaauggcaaauauauuccgaggaaguuaucuagcaggggcugggcuauuauuuuccauaaugaaaaacacuaccucugcuaggagagguacaggaaauauaggagaaacgcuaggugaaaaauggaagagucgacugaaugcacucgggaaaagugaguuccaaauauacaagaaaaguggcauucaagaaguugauagaacauuagcuaaagaaggcauaaagagaggggaaacagaucaccaugcaguaagccgagggucagcuaaauuaagaugguuugucgaacgaaauuuaguaaccccugaagguaaagucguagacuuaggaugcggacgaggaggcuggucuuacuauuguggcggccuaaagaauguucgagaagugaaaggacuaacuaaaggcggccccggccacgaagaaccaauuccaaugucaacguauggcuggaaccuaguucgucuucaaagugguguugacgucuuuuuuauaccuccggagagaugcgacacccuauugugugacauuggagaaaguaguccaaguccuacaguagaagcgggacgaacucuuagagugcucaaccuuguagaaaauugguugucaaauaauacacaauucugugucaaaguccucaauccauacaugcccucuguaauugaaaaaauggaagcuuugcaaagaaagcacggcggugcucucguuagaaauccacuuucgaggaauaguacacaugagauguacuggguuucuaacgcaucaggaaauaucgugucuucagucaacaugauaucaaggauguugaucaaucgauuuacaaugagacacaaaaaagccacguaugagccugaugucgaccucggauccgggacucgaaauauaggaaucgaaucugagaccccaaaucucgauauaauagguaaacgaauugaaaaaauaaaacaggaacacgaaacuucauggcacuacgaccaagaccaccccuacaaaacuugggcguaucauggaucuuaugaaacgaaacaaacagguucugcgucuucuauggugaacgguguaguccgacucuugacuaaaccaugggacguuguaccaaugguuacccaaauggccaugaccgacacaaccccuuucggucaacaacggguuuuuaaggaaaaaguggauacaaggacacaagagccaaaagaaggaacgaaaaaacuaaugcguauuacggcggaauggcuauggaaagaacuaggcaaaaaaaagacaccucggauguguacucgagaagaauucacgaaaaaaguuagaagcaaugcagcuuuaggcgcuaucuuuacagacgaaaacaaauggaaaucugcacgcgaagcgguuggggacggucgauucugggaacuaguggacaaagaacgaaaccugcacuuagaagguaagugcgagacuuguguauauaauaugauggggaaacgcgagaaaaagcuuggagaauuuggaaaagcaaaagguucccgagcaauaugguauauguggcuaggggcucguuuuuuagaguucgaggcacuaggcuuucuuaacgaagaucacugguuuucgagagaaaauucauuaagcggugucgaaggagaaggucuucauaagcugggauauauauugcgcgagguaucaaaaaaagaagggggugcgauguaugcagacgauacugcagggugggauaccagaauaacgauagaggacuugaaaaacgaagaaaugauuaccaaucauauggaaggugaacauaaaaaauuagccgaagcgauauuuagacuaacauaucaaaacaaagucguaagaguacaaagaccaacuccacggggcacuguaauggacauaauuucccgcagagaucaaagaggaaguggacaaguuggaaccuauggacuuaacacuuucacaaauauggaagcucaauuaauacgccaaauggaaggagaggggguuuucaaaaguauccaacaccuuacagccgcagaagaaauugcgguucaaaacugguuaguacgugugggccgcgaacgacuuagcagaauggcaauaucaggugacgauugcguaguuaagccucuagacgauagauuugcgagagcauuaaccgcguugaaugauauggggaaagugagaaaagauauucaacaaugggagccaaguagggguuggaaugacuggacccaaguaccauuuugcucacaucauuuccaugagcuuauaaugaaagauggacgaauucuagucguaccgugucgaaaucaggacgaacuuaucggaagagccaggauuucccagggagcaggaugguccuuaagagaaacugcuugucuaggaaaauccuacgcgcaaauguggucucuaauguauuuccacaggcgugaccuccgauuagcagcaaaugcuauuuguucagcuguaccaagucauugggucccaaccaguagaacuacuuggagcauccacgcgucccaugaauggaugacaacggaagauauguuaacuguuuggaaccgaguuuggauccaggaaaacccauggauggaggacaaaacuccuguggaaagcugggaagagauaccguacuuaggcaagagggaagaucaguggugugggucguuaauuggucucacaucaagagcaacuugggcaaagaacauacagacggcaauaaaucaaguaagauccuuaaucgggaacgaagaauacacugacuacaugccuucaaugaaaagauuucgucgagaggaagaagaagcgggagucuugugguaa

SEQ ID NO: 22934 - RNA, 9876 nt, Artificial Sequence
  derived and/or modified CDS sequence (opt6) from DENV-2__KF479233__SS-prME
acggcugggguuaucaucauguugauuccuacugcaauggcauuucacuugaccacacgaaauggugaaccacacaugauaguaaguaggcaagaaaaaggaaaaucuuuguuguuuaaaacggaagacgguguaaauaugugcacauuaauggcaauggaucuuggcgaauuaugcgaagacacaauaacuuacaauugcccauuacuaaggcagaaugaaccagaagacauagauugcugguguaauagcacaucaaccuggguuacguacggaaccuguacggcgacgggagaacacaggagagagaaacgaaguguagcguuggugccucauguaggaaugggcuuagaaaccagaacagaaacauggaugucaagugaaggagcauggaaacaugcucaacgaauugaaacuuggauuuuaagacacccaggauuuacaauaauggcagcgauacuagcuuacacgauugguaccaccuauuuucagagaguuuuaauuuuuauauuacuaacugcuguggcaccaucgaugacaaugcguugcauuggaauauccaauagggacuucguugaaggggugucaggaggaucuuggguagauauaguguuagaacacgguuccugugugacuacuauggcgaaaaacaaaccgacauuagauuuugaacuuauaaaaacagaagcgaaacaaccggcuaccuuaagaaaauacugcauugaagcuaaacuaacgaauaccacaacagccucucgauguccaacgcaaggggaacccucuuuaaaugaagaacaggauaaaagauuuguuugcaaacauucuaugguugaucggggauggggaaacggauguggucuauucggcaagggagggaucguuacaugugcgauguuuacauguaagaaaaacauggagggaaaaauuguacaacccgaaaauuuggaauauacuauaguuguaacgccccauaguggugaagaaaaugcgguaggaaacgauacgggaaaacacgggaaggagauuaaaguaacaccucaaaguuccauaacggaggcggaacuaacaggauaugguacaguuacgauggagugcucgccgcgaacuggccuagauuuuaaugagaugguauuguuacaaauggagaauaaagcaugguuaguacauagacagugguuucuagaucucccacuuccuuggcugccaggagcugauacacaagguucaaacuggauccagaaagaaacacucgucacguuuaaaaauccucaugccaagaaacaagacgugguaguuuuaggcucacaagaaggagcgaugcauaccgcuuuaacuggggcuacggaaauccaaaugucaaguggaaaucuguuauuuaccggucaucugaagugcagacuuagaauggauaaacuccaguuaaaaggcaugaguuauucgauguguacugggaaauuuaaaguagucaaagaaauagcagagacucagcacggaacaauuguaguaagagugcaauacgaaggagaugguagcccuuguaagauaccauucgaaauaauggacuuagagaaaagacauguacuaggucggcuaaucacagugaauccuauaguuaccgagaaggacagcccugugaacauugaagcugaaccacccuucggggauagcuauauuauaauugggguagagccgggacagcuaaaacuauccugguucaagaaaggcuccaguauaggacaaauguuugaaacgacaaugcgaggagcaaaaaggauggcgauacuaggugacacugcgugggauuuuggaucguuaggaggcguauucaccucaauagguaaggcguugcaucaaguauucggcgcaauuuauggagcugccuucagugggguaucauggacuaugaagauucuaauagguguaguuauuaccuggauaggaaugaacucuagauccacuucgcuaucaguuagucucguguuaguugguguagucacacuauaccucgggguaaugguucaggccgauagugguugugucguaucauggaaaaauaaggagcuuaaguguggaagcggcaucuucaucacagauaacguacauaccuggacagagcaauacaaauuucaaccugaaucaccuucaaaguuagcaagugcaauccaaaaagcucacgaggaaggaauauguggcauaagaucgguuacaagauuagaaaaucugauguggaagcaaauaacuccugagcucaaccauauauugagcgaaaaugaaguaaagcucacuauuaugacuggagacauuaaggguauuaugcaagcggggaaacgcucccuaagaccccaaccaacugaauugaaauauagcuggaaaacaugggguaaagcgaaaauguugucgacagagccccagaaucaaacauuucuaauagacggcccggagacagcugaaugcccaaauacgaauagagcguggaacagccuagaaguugaagacuacgguuuugguguauuuaccacuaauaucugguuaaaauuaaaagaaagacaagauguguuuugugacaguaaauugaugucagcagccauuaaagacaacagggcuguccaugcagauaugggauauuggauugaaagugcacuuaacgacacauggaaaauugaaaaggccaguuuuauagaaguaaaaaguugucauuggccaaaaagucauacgcucuggaguaauggggugcucgagagcgagaugauuauuccaaagaauuucgcaggaccugucucccagcauaauuauagaccuggcuaucauacgcaaacagcagguccguggcauuuagguaaacuagaaauggacuuugacuuuugugaaggaaccacaguggugguuacagaggauugcggaaacagagggccuucccuccguacuacuacagcaagcgguaaauuaaucacugaauggugcuguagaaguuguaccuuacccccguuaagauacaaaggagaagauggauguugguacgguauggaaauacggccacuuaaagagaaagaggagaacuuggucaauucucuuguaaccgcuggacacggucaaauagacaauuuuagccuuggcguguuaggaauggcucuauucuuagaagaaauguuacguacacgcguaggcacaaaacacgcuguauuacuuguugcuguuaguuucaugacauuaauuacuggaaauaugucauuucgcgaccucggcagagugaugguaauggugggagcagccaugacugaugauauagguaugggaguuacguaucucgccuuauuagcugcauuuaaaguaagacccacauucgcugcgggucuccugcugcgaaaacuaacaaguaaagaauuaaugaugacuacaauugguaucguuuugcuuucacaaaguacuauaccagaaaccauacucgaguugacagaugcauuggcucucgguaugaugauauugaaaauagugagaaauauggaaaaauaucagcuagccgugacgauaauggcuauauugugugucccaaaugccguaauauuacaaaacgcuuggaaaguauccuguacuauacuagcaguaguaucaguaucgccucuucuacucaccagcucacaacaaaaagcagauuggauuccacuugccuuaacaaucaaggguuugaaucccaccgcaauauuccuaaccacacuauccaggacaaauaaaaagagauccuggccauuaaaugaagcaauaauggcuguuggcaugguuucaaucuuagcaucuucacuucuuaagaaugacauacccaugaccggaccgcuaguugccgguggauuauuaacugugugcuauguucuaacaggaagaagcgcagaucuagaacuagaacgagcagcugauguacgaugggaagaccaagccgagaucucuggaucuucuccuauacucaguauuaccauaucagaagauggaucuaugucaaucaaaaaugaagaagaagaacaaacccuuacuauccuaauuaggacuggacuauuaguaauuagugguuuauuuccaguaaguauaccuauuacugcugcagcuugguaccuaugggagguaaagaaacaaagggcuggaguauugugggacgugcccucuccgccuccuguagguaaggcagagcuggaggauggagcauauagaauaaagcaaaaagguauauuaggguacucgcaaauuggggcaggaguauacaaagaaggcacguuccacacaauguggcacguaacccgaggagcaguguuaaugcauaaaggaaaacgaauagaaccgucgugggccgauguucgaaaagaccuuaucucguacggcggaggguggaaacuugaaggagaauggaaagaaggcgaggagguucaaguauuagcucuagaaccggguaagaaucccagagccguccaaacuaagccaggauuauucaaaacaaacacugguacaaucggagcagucagccuugauuuuaguccagggacaaguggcucaccgauaguagauaagaaaggcaaaguagucggacuuuacggaaauggugucguaacaagaucaggaaccuacguuagcgccauugcucaaacggagaagucaauugaagacaacccagagauugaggaugauauauuuaggaaaaagcguuugaccauuauggaucuacauccgggugcagggaaaacaaagagguacuuaccagcaauuguucgugaggcgauuaaacgaggacuccgaacuuuaauauuagcaccaacuagaguuguagcugcggaaauggaagaagcauugcgaggacuuccgauccgauaccaaacuccugcaauccgugccgaacauaccggaagagaaauaguagaccucaugugccaugcuacauucacaaugagauuacucaguccuguacguguuccuaacuauaacuuaauuauuauggaugaagcccacuuuaccgauccugccucuauagcugcaaggggauacauaucaacacgcgucgaaaugggagaagcggcaggaauauucaugacugcaacaccuccgggcucucgggacccguucccacaaucaaacgcaccaauuauggaugaggaacgggagauuccagaacguaguuggaacucaggccaugaauggguuaccgauuucaaagguaaaacaguaugguucgugccuucgauuaaagcagguaaugacaucgcugcaugccuacgcaaaaacgguaagaaagucauccaauuaagcagaaaaacuuucgauucugaguauauaaagacccggacaaaugacugggacuuuguaguuacaacagacaucagugaaaugggggcgaacuuuaaagcugaacgcguaauugauccaagaagaugcaugaaaccuguaauauuaacggauggagaagaaagaguaauauuggcaggacccaugccugucacacacaguuccgcagcccaaagaagaggcagaauuggaaggaaccccaagaaugagaacgaucaauacauuuacaugggugagccacuagagaacgacgaggauugcgcgcauuggaaagaagcaaaaaugcuacuggauaacauaaauacgcccgaaggcauaauaccuucaauguucgaaccugaaagggaaaagguugaugcaauagauggcgaauauaggcuuagaggggaagcuagaaagaccuuuguagaauuaaugcgcaggggagaccuaccuguuugguuagccuaucgcguggcagcagaagguaucaauuaugcagauagacgaugguguuucgaugguauaaagaauaaccagauauuggaagaaaaugucgaagucgaaaucuggacaaaggagggcgagaagaagaaacuuaaaccacgaugguuggaugcaagaauuuauucugacccgcucgcuuuaaaggaguucaaagaauuugccgcuggacguaagucacuuacaaugaaucuaauaacggaaaugggaagguugccuacauucaugacacaaaaagcucgaaaugcauuggauaauuuagcuguccugcauacggcagaagccggugguagagccuauaaucacgcguuaucugaauuaccggaaacauuggaaacucuacuauuacugacacuauuggcaacgguuacagguggaauauucuuauuccuaaugucagguaaaggaauagguaagaugacacuaggaauguguugcauuauaaccgcauccauacuauugugguacgcacaaauucaaccgcauuggauagcggcuucaauaauuuuagaauuuuucuugauaguacuauugauaccggaaccagaaaaacaacgcacaccacaagacaaucaacucaccuauguagucauugcgauauuaaccgucguggcagcuacaauggcaaaugaaaugggguucuuagagaaaacuaaaaaggauuucggucuaggaucgaucguuacacaacagccagaaaguaauauauuagacauugacuugcgaccggcuucagcguggacuuuauacgccgucgcuacaacuuuuaucacgccaaugcuccgucauuccauagaaaacucuucagucaauguaucucuaacugcaauagcaaaucaagcgacgguucucaugggcuuggggaagggauggccacuaucuaagauggauauuggcguaccacuacuggcaaucggcuguuauucacaaguaaauccaauaacucuaacugcagcgcugcuucuucugguagcacauuaugccauaauuggaccaggauugcaagcaaaggcaaccagggaagcacagaagagagccgcggcgggcauuaugaaaaaccccacaguagacggaauaacagucauagaccuugauccuaucccguaugaccccaaguuugaaaaacagcuaggacaaguaaugcucuuaguuuugugcguuacccaggucuuaaugaugcgaaccacaugggccuugugcgaggcucugacacuugcaacugggccaauuucuacacugugggaaggaaaccccggacgauuuuggaauacgaccauagcagugucgauggcaaauauauuucguggaucauaccuggcuggcgcuggacuauuauucucuauaaugaaaaacacggcaaauacucggagaggcaccgggaacaccggagaaacacuaggcgaaaaauggaagaacagacugaacagccuagggaagucagaguuucaaauauacaaacguagugguauucaggaaguugauagaacauuagcaaaggaaggaauuaagcgaggagagacagaccaccaugcgguaaguagaggaucggccaagcucagaugguucguagaaagaaacuugguaacgccggaggguaaagucauggaccuggguugugguagaggaggcuggagcuauuauuguggagggcucaaaaauguacgugaaguuaagggacuaaccaaaggaggcccuggucaugaagaacccauacccaugucuacguauggcuggaacuugguacgucuacaauccggaguagaugucuucuuuacaccaccugaaaagugcgauacacuauuaugugauauaggggaaucaagccccaaucccaccguggaggcugggcgaacauugagaguauugaauuuaguggagaacugguuaaacaacaacacucaauuuugcauaaaaguuuuaaauccuuauaugccuucugucauugagaaaauggaaacacuacaacgaaaauauggaggggcauuaguccgaaacccucugucgagaaauucaacgcaugaaauguauuggguaagcaaugcaagugguaacauaguaucaagcguuaacaugauuucgcguaugcugaucaauagauuuacgaugcgucauaagaaagcaacuuaugaaccugauguugauuuggggucgggaacacguaacaucggaauugaaucugaaauaccaaaucuugauauaauuggaaaaagaauugagaaaauaaaacaagaacaugaaacaaguuggcauuaugaucaagaccauccauacaaaacaugggcauaucacggcucuuacgaaacaaaacaaaccggaucugcaucaagcaugguaaaugguguagucagauuacuaacaaaaccgugggaugugauuccaaugguaacgcaaauggcuaugacugauacgacccccuuuggacaacaaagagucuuuaaagaaaaaguagauacacgaacccaagaaccaaaagaagguacuaaaaagcucaugaagaucacagcagaauggcucuggaaagagcuagguaagaagaaaacaccuagaaugugcacacgagaggaguuuacucguaaaguaagaagcaacgcggcacucggagcgauauuuaccgaugagaauaaauggaaaagugccagagaagcagucgaagacucgagguucugggagcuaguagacaaagaacgaaauuugcauuuagaagguaaaugcgaaacaugcguguauaauaugaugggaaaaagggagaagaaaauaggagaguuugggaaagcuaaaggaucaagggcuaucugguauauguggcuaggcgcgagauuucuagaauuugaggccuuaggcuuuuuaaacgaagaccauugguucuccagagaaaauagccuaucaggcguugaaggagaaggauuacacaaacuaggauacauacugagggaggugagcaagaaagagggcggagcgauguaugcggaugauacagcgggaugggacacucguauaacauuagaggaucuaaagaaugaagaaaugguaacuaaccauauggaaggggagcacaaaaagcucgcagaagcuauauuuaaacucacauaucagaacaaaguugugagagugcagagaccaacuccgcgaggcacaguuauggauaucauaucacgacgggaucaaagagguagcgggcaaguugggacuuauggucuaaacacuuuuacgaacaugggcgcucaguuaauucgacagauggagggagaagggguauuuaaaucaauucagcaucucacaacaacagaagaaguugcuguacaggauuggcuagcuagaguaggaagggaacgacugagcagaauggcuauaucuggugacgauugcguuguaaaaccacuugaugaucgauucgccuccgcacuaacagcuuugaacgauaugggcaaagugagaaaagauauucaacaaugggagcccagcaggggguggaaugauuggacacaaguaccguuuuguagucaucauuuccacgaacuaauaaugaaggauggcagagucuuaguaguucccugucgaaaccaggaugaauuaauaggaagggcuagaauaucacaaggcgcuggauggucauuaagggaaaccgcuugucucgggaaaaguuaugcccaaauguggucccuaauguacuuucacaggagagaccuacgauuggccgcgaacgccauuugcagcgcagugccgagucauuggguaccaacaaguagaacgaccuggucgauccacgcuagacaugaauggaugacuacugaagauaugcucaccguuuggaaccgagucuggauucaggaaaauccguggauggaagauaaaacaccgguggagucgugggaagaaaucccauaucucggaaaaagggaagaccaauggugcgggagccugauagggcuaaccaguagagccacuugggccaaaaacauucaaacugcaauuaaucaaguuaggucacugauaggaucagaagaguauacugauuauaugccaucaaugaagcgguucaggagagaagaagaagaagcuggcguacucugguaa

SEQ ID NO: 22935 - RNA, 9876 nt, Artificial Sequence
  derived and/or modified CDS sequence (opt6) from DENV-2__KX372564__SS-prME
accgcggggauaauuauaaugaugaucccuacagucauggcuuuucaucuaacaacacguaacggggaaccucauaugauugugucucgacaagaaaaagggaaaagccuacuguucaaaacugaaaacggaguaaauauguguacacugauggcaauggauuuaggugaguugugugaagacacaaucacauacaauuguccacuauuacgacaaaaugaaccagaagauauagacugcugguguaauaguacaaguacaugggucacguacgguacauguacugccacuggugaacauagacgagaaaaacggaguguagcucuaguaccacacguugggaugggacuugaaacaagaacugagacauggaugagcucagaaggugcuuggaaacaugcucaaagaauagaaacuuggguacuacgucacccuggauuuacgauuauggcggcgauucuagccuacacaauugguacaacauacuuccaacgaguacugauauuuauacuauuaacagcaguugcuccaaguaugacgaugagaugcauugguaucucuaauagagauuuuguugaagguguuagcgguggauccuggguggacauuguacuugagcauggaagcuguguuacaacuauggcuaaaaauaaaccgacuuuagauuuugaauuaaucaaaaccgaggcuaaacauccagccacacuccguaaauauuguauagaagcaaaacuaacuaauacuacuacugcuucacguugcccuacacaaggggagccuucacuaaaugaggaacaagacaaacgauuuguuugcaaacauucaaugguagauaggggguggggaaauggcugcgguuuauuuggaaaagguggcauaguaacgugugcaauguuuaccugcaagaaaaauauggaaggaaaaauuguccaaccugaaaaucucgaauacacaauaguaaucacuccgcauucaggagaagaaaaugcgguagguaacgauaccggaaaacacggaaaagaaauaaaaguuacuccacaaaguucaauaacagaagcugaacucacuggcuacggaacaguuaccauggaaugcaguccaaggaccggucuggauuucaacgagaugguccuucugcaaauggaaaauaaagcaugguuaguccaucgucagugguuucuagaucuaccacuaccaugguuaccgggagcagauacucagggcagcaauuggauccaaaaagaaacucuugugacauuuaaaaauccacaugcgaagaaacaagauguagucgucuuagguagccaggagggagcaaugcacaccgcucucacuggcgcaacagaaauacaaauguccucaggcaaucucuuauuuacgggacaccugaaaugccgacucagaauggauaaauuacagcucaaaggaaugucuuauucaauguguacaggaaaauuuaaagugguuaaggaaauagccgaaacccagcauggaacaaucguaauucgaguucaauaugaaggugaugggaguccgugcaagauccccuuugaaauaauggaucuagagaagcgucacguacuugguaggcuaaucacaguaaacccuauuguaacugaaaaagacucuccaguuaacauagaggcugaaccaccguuuggcgacucauacauaaucauuggaguagaaccaggucaauuaaaauuaaguugguuuaagaaagggucaucgauaggucagauguuugaaacaaccaugcguggggccaaacgaauggcuauucucggggauacagcgugggauuucgguagucucggcggaguauucacgaguauaggaaaagcauuacaucaggucuuuggggcaauauauggugcagcuuuuucaggugucucguggacaaugaaaaucuugauaggugucgugauaacauggaucgggaugaacucuagaucaaccucccucucagugucauugguacuugucggcgugguuacacucuauuuaggaguaaugguucaagcagacagcggauguguuguauccuggaaaaauaaagaauuaaagugugguucggguauuuucauaaccgacaacguacauacauggacagagcaauauaaguuccaaccugagaguccaucgaaacuagcaagcgcgauucagaaagcacaugaggaaggcauaugcggaauaagaagugucacgcgacucgaaaaucuuauguggaagcaaauuaccccggagcugaaucauauauuaacugaaaaugaagucaaacuaacuauuaugacaggugauauuaaaggaauuaugcaggcagguaaacgcaguuuacggccacaaccgacagaacuaaaguauaguuggaaagcaugggguaaggcuaaaguauuaaguacagaauuacacaaccacacuuuucuaauagauggaccggaaacagcagaaugcccaaacacuaauagggcauggaacagcuuggaagucgaagauuauggauucggcguuuuuacgacaaauauauggcucaaacuuaaagaaagacaagacguuucuugugauaguaagcucaugucagcagcuauuaaagauaaccgagcagugcaugcagacaugggguauuggauagaaucggcucuaaacgauacguggaaaaucgaaaaagcaucguuuauagaaguaaaaucaugucacuggccgaagucucauacgcuguggaguaacggugucuuagagucggagaugauaauaccuaaaaauuuugcagguccagugucacaacauaacuauagacccggauaucauacacaaacggcugggccauggcaccuaggaagauuagagauggauuuugacuuuugcgaagggacgacgguaguaguaacugaggacugugggaauagaggacccucacugcgaacgacuacugcaucgggaaagcucauuacugaauggugcugcagaaguugcacauugccaccauugagauaucggggcgaagacggaugcugguaugguauggagauuaggccauuaaaagagaaagaggaaaaccuuguuaauucccuagugacugcuggccacggacaaauagacaauuuuagucuagggguucucgggauggcgcuauuuuuagaagagauguugcguacgagaguuggaacaaaacacgcaauuuuacuggucgcgguaucuuucguaacacugauuacgggaaauaugucguuucgcgauuuaggccguguaauggucaugguaggggccacaaugacagacgacaucggaaugggggugacguaccuagcccuacuagcagcauuuaaagucagaccgacauuugcggcuggacuacugcugaggaaauuaacgaguaaagaguuaaugaugacuacaauagguauaguuuuauugucucaaaguacaaucccagagacaauauuggaguuaacggacgcucuagcgcugggaaugaugguacugaagauaguuaggaauauggaaaaauaccaguuggcaguuacaauuauggcuauacuuugugucccgaaugcuguaauucuacagaaugcuuggaaaguuucuuguacagcacuugcagugguuagcguuucuccuuuauuguuaacuucaucacagcaaaagacagacuggauacccuuagcucuaacaauuaaaggucuaaauccuacagcaauuuuucuaacuacauuaagccguacgagcaagaaaaggucuuggccucuaaacgaggcgauuauggcagucggcaugguaucaauacucgcaaguucauucuuaaagaacgacauuccaaugacuggaccauuaguggccggaggacuacuaacugucuguuacguguuaacuggaagauccgcagaucucgagcuagagcgggcagcagauauccggugggaggaacaagcugaaauuucuggauccucucccauuuuauccauuacaauuuccgaggaugggagcaugagcaucaaaaacgaagaagaagaacaaacuuuaacuauccuaauccguacuggauuauuaguaauuucuggacuauuuccagugagcauaccgaucacugccgcugcaugguacuuaugggaagucaagaaacaaagggcaggaguauuaugggacgugccgucaccuccacccguugguagagcggaacuugaagacggcgcuuauaggauaaaacaaaaaggcauauuaggauacucacaaaucggagcaggagucuauaaggaagguacauuucacacuauguggcauguaacuagaggcgccguccuaaugcauaaaggaaaacgcauagagccgucaugggccgauguaaagaaggacuuaauaucauauggaggagguuggaaguuagagggugaauggaaagaaggagaagagguacaggucuuagcacuagaaccagguaaaaauccacgagcaguacaaaccaaaccaggccuauuuaagacgaauacaggaacuaucggcgccgucucgcuggacuuuagcccggggacuucaggaaguccgauuguugauaagaaaggaaaagugguaggucuuuaugguaaugguguuguaacacgaucaggaacauacgucucagcaauagcgcaaacggaaaaaucgauagaggacaauccggagauagaagaugacauuuucaggaagaaaagauuaacgauaauggacuuacauccaggagcuggaaaaacuaagagauaucuacccgccauuguacgcgaagcaauuaaaagggguuuaaggacucucauucuggcacccacaagaguuguggcagcugaaauggaagaagcauuaagagguuuaccaauaagauaccaaacgcccgcuauaagagcagaacacacaggaagagaaauaguagauuuaaugugucaugcuacauuuacuaugcgacuccuaucaccaauacgaguuccgaacuauaaccucauaauaauggaugaagcgcauuuuacagauccagcauccauugcagccagaggauauauaucaacuagaguagaaaugggggaagcagcagguauauucaugaccgccaccccgccuggaaguagagauccguuuccgcaaucaaacgcaccaaucauggacgaagaacgagaaauucccgaaaggucuuggaauagcggucaugaguggguuaccgauuucaagggcaaaaccguuugguuuguaccgucgauaaaagcuggaaaugacauagcugcgugcuugaggaaaaacgggaagaaaguaauacaauuauccagaaaaaccuuugauuccgaguacauuaaaaccagaaccaaugauugggacuuuguagugacaacagacauaagcgaaaugggagcuaauuuuaaagcagagcguguaauagacccaagaagauguaugaaaccaguuauacugacugauggcgaagaaagagucauacuagcagguccaaugccugugacccacaguucagcagcucaaagacgaggucgcguuggaagaaaucccaaaaaugagaaugaucaauauaucuacaugggagaaccacucgaaaaugaugaagauugugcacauuggaaggaagcaaaaauguuacuggauaacauuaauacaccugaaggaauuauaccgucaauguucgagccugaaagagaaaagguugaugccauugauggggaauaucgccuaagaggcgaagcuaggaaaaccuucguagauuuaaugcgacgaggcgaucuuccuguauggcucgccuacagaguggcagcugaagggauuaauuacgcagacaggagguggugcuuugauggcgucaaaaacaaccagauauuagaggagaacguagaaguagagauauggaccaaagaaggcgaaaggaagaaacuaaaaccucgguggcuagacgcgagaaucuauucagacccauuagcgcugaaagaauuuaaagaauuugcugcaggucguaagucguuaacauuaaauuuaaucacagaaaugggacgucugccuacauucaugacacagaaggcucgaaacgcauuagacaaucucgcuguucugcauacugcugaagcggguggaagggccuacaaucaugccuugucggaauuacccgaaacguuagagaccuuguuauuguugacgcuucuagccaccgucacaggcggcauauuuuuguuccugaugucagggaaaggaauuggcaaaaugaccuuaggaauguguuguauugugacugcuucuauacuuuugugguaugcccaaauacagccacauuggauugcggcuagcauaauauuggaguucuuuuuaaucguacuauuaauaccugaaccagaaaaacagagaacgccacaagauaaccagcuaacauacguagugauugcaauauugacgguaguggcugcuacaauggcaaaugaaaugggcuuucuagagaaaacuaagaaagacuucggauuagggucaauaacgacacaacagccagaaucgaacaucuuagacauagauuuacgaccagcgucagcuuggacauuauaugcuguagcuaccacguucauaacucccaugcuccgucauagcauugaaaauucuucgguuaauguuucuuuaacugccauugcaaaccaagcgacgguuuugauggggcuagguaaaggauggccucucucaaaaauggacaucggagugccacuacuagcuauuggguguuacagucaaguuaauccgauuacucugacagcggcauugcuacuauuaguagcgcauuaugccauaauagguccaggacuccaagcuaaagccacaagggaagcgcaaaagagagcagcugcagggauaaugaaaaaccccaccguggacggaauaacagucauagaucucgacccuauacccuaugauccaaaguuugaaaaacaauuaggccaaguaaugcuauugguauuauguguaacgcagguacugaugaugagaacaaccugggcacuaugcgaagcucuuacccuggccacgggaccaauuagcacucuaugggaagguaacccggguagauucuggaacaccacaauugcagucaguauggcaaacaucuuucgggguucuuauuuagcgggggcaggcuuguuauuuagcauaaugaagaauacggcaaauacccgaaggggcacagggaacacgggagaaacguuaggggaaaaauggaagaaucguuuaaaugcauuaggaaaaucugaauuucaaauuuauaagaagucagguauucaagaaguagauaggacacuagcaaaagaaggaauaaaaagaggugaaacggaucaucacgcaguuagcagaggaagcgccaaacuuagaugguucguagaaagaaaccucguaacacccgaaggcaagguaguagaccucgguugcgggcgugggggcugguccuauuacuguggaggacucaaaaauguaaaggaggucaagggauugacaaagggagguccgggccaugaggagccgauaccaaugucgacauauggauggaauuuagucaggcuacaaaguggcguggauguguucuuuacgccgccagaaaaaugugacacuuuacuuugugacaucggagaaucauccccgaacccaacaguugaggccggaagaacauugcgcguguugaacuuagucgagaacuggcugaauaauaauacccaguucugcauaaaaguucuaaauccauauaugccaucaguuauugagaaaauggaagccuuacaacgacgguacgguggagcccucguacgaaauccuuuaaguagaaacagcacccaugaaauguauugggugucaaacgcaucaggaaacaucguuucaagugucaauaugauaucuagaaugcuuaucaacagguuuacaaugcgacacaagaaagccaccuaugagccagauguagaucuaggaucaggaacgagaaauauuggaauugaaucugaagugccaaaccuugacauuauaggaaaaagaaucgaaaagauaaaacaagaacacgagacaucauggcauuaugaccaagaccacccuuacaagacgugggcguaucauggcucuuaugaaacuaaacaaacaggauccgcaaguucaaugguaaacggaguaguuaggcuacuaacgaaacccugggacgugauccccauggucacucaaauggcuaugacagauacuaccccuuucgggcaacagcgugucuuuaaagaaaaaguggacacgaggacacaagaaccuaaggaagggacaaagaaauugaugaaaaucacagcagaguggcuuuggaaagaacuaggcaaaaagaaaacgccacgcaugugcacgagggaagaauuuacccggaaaguacguaguaacgccgcuuuaggagcaauauuuacugacgaaaauaaauggaaaucagcgcgugaggcaguagaagacucagguuucugggaauuaguugacaaagaaagaaaccuacaccuagaaggaaaaugugaaacgugcguauauaacaugauggguaaacgcgagaagaaauuaggagaauuugguaaagcaaaaggaucgagagcgauaugguacauguggcucggggcaagauuuuuggaguucgaagcucuaggauuucucaacgaagaucauugguucucgagagaaaauucauuaucaggaguugaaggugagggacuucauaaacugggauauauauuaagagacguguccaagaaagaagggggagccauguaugccgacgauacggcuggcugggacacgaggauaacgcuagaagaccugaaaaaugaagagaugguuaccaaucauauggaaggcgagcacaaaaagcuagcugaggcgauuuuccgccuaaccuaucagaacaagguuguaagggugcaaagaccuacaccgagagguacagugauggauauaauauccagaagggaucaaagagguuccgggcaaguaguuacauacgggcuaaacacauuuacuaauauggaggcucaacuuauccgucagauggaaggugaggggguuuucaaauccauacaacaucuuacagcuaccgaagaaauugcagugaaaaacugguuaguaaggguaggaagagaacgacucucucgcauggcaauuucaggugaugauuguguuguuaaacccuucgaugacagauuugccaacgcuuuaacugcacuuaacgauaugggaaaaguuagaaaagacauacagcagugggaaccgagcagaggauggaaugauuggacgcagguuccguucuguucucaucacuuucacgaacuuauuaugaaagacggaagaguucucguaguaccaugcaggaaucaggaugaacucaucgggagggcuagaauaucucagggagcaggguggaguuuacgugagacggcuuguuuggguaagaguuaugcacaaauguggucauuaauguacuuucaccgccgagaccuccgccuagcagcaaaugcaaucuguucagccguaccaagccauuggguaccgacaucacgaacgacuuggucgauacaugcaacccacgaauggaugacuaccgaggauaugcuuacaguauggaacagaguauggauccaagagaaucccuggauggaagacaaaacuccaguggaguccugggaagaaauuccuuauuuagggaagagagaagaccaguggugcgguucccuuauaggacuaacuucgagagcuacaugggcuaaaaacauacaaacagcaauaaaucaagugcgaagccuaaucggcaacgaagaauacaccgacuauaugccaaguaugaagagguuuagaagagaagaagaagaagcuggaguguuaugguaa

SEQ ID NO: 22936 - RNA, 9873 nt, Artificial Sequence
  derived and/or modified CDS sequence (opt6) from DENV-2__KX274130__SS-prME
ucagcggcaacauuauugcuucuuguaccaacuauuauggcuuuccacuuaacaacuagaaacggggaaccgcauaugaucguagcacgacaugaaaaaggcaaaucuuugauauuuaaaaccgaaaaugguguuaauauguguacacuuauggcaauggaucuaggagaacuaugcgaagaaacgguaacauauaaauguccguaucuaaaacagagugaaccagaagacauagacugcugguguaauacuacgagcacguggguaacuuauggaacauguucguccuccggcgaacaucgaagagagaaaagaagcguggcuuuggcuccacacguaggaaugggauuagaaacaaggacggaaacuuggaugucgagugaaggugcauggaaacaugcacaaaggauugaaaauuggauuuugcgacauccagguuacacgguaauggcagcagcaauagcaauggcaaucggaacuaacaacuuucagcgcgcacuaaucuuugugcuacuaacagcaguugcaccaucuaugacaaugagauguguaggaauugcaaacagagauuuuguagaagggguaucaggaggaucauggguagauauaguacucgaacacgguucaugugucacaaccauggccaaaaacaaaccaaccuuagauuuugaauuaacaaaaaccgaagcuaaacuuccugcaacauuaagaaaauacuguauagaagcaaaacucacgaauacaacaacggagucgagaugcccuacacagggugaaccuucucuaccugaagaacaggauaaaagauucauaugcagacacagucugguggauagaggaugggguaauggaugcgggcuuuuugguaaaggaggcauuguaacaugcgcaauguuuacuuguaagaaguacauggaagggaagauuguucaaccagaaaauuuggaauauacaguugcagucaccccgcacucaggcgaagaacacaguguaggaaaugauaccggaaaacauggacaagauguuaaaaucacaccacaaaguucaauuacggaaacggcccuagaaggauaugguaguauuaguauggaauguucaccacggacugggcuagauuucaacgaaaugguacuacuacaaauggaggauaaagcauggcuuguacaucggcaaugguuucuugaucuaccauugccguggcucccagguucggacacacaaggcaguaauugggugcaaaaagaaacacuggucacguucaaaaauccacaugcgaagaaacaggauguuguuguauuaggaagucaggaaggggcaaugcauagcgcuuugacaggugcgacggaaauucaaaugacaucggguaaucucuuauuuacgggccauuuaaaauguagacugcguauggauaaacuagaacuaaagggaaugucguacucgauguguacuggaaaauuuaaagucguuaaagagauagcagagacgcaacaugggaccaucgucauacgaguucaguacgaaggcgaagguucaccaugcaaaauucccuuugaaauaauggaucucgagaagaaacacguacucggaagauugauaacuguuaacccgauuauuacugaaaaagauaaaccuacaaauauagaagccgaaccacccuuuggagauaguuauauacuaauaggcguggaaccgggucaacuaaagaugaauugguucaagaaggguagcaguauaggacaaauguucgaaacaacaaugagaggggcaaagagaauggcaauauuaggugauacggcaugggauuuuggcucucuagguggcguauucaauucgaucggaaaagcacuucaucaaguauuuggggcaguauacaacgccgcuuucucuggagucucguggacgaugaaaauacuaauaggggucauaauaacauggaucggaaugaacucgcgcucaacaucgauguccauuacccugguuauggucgguuuagucacucuguacuuaggugugguugugcaagcagacucuggaugcguagucaguuggaaaacaaaagaacuaaagugcggcagcggaauauuugucacggacaauguucacguauggacugaacaauauaaauuucaacccgagucgccugcuaaguuggcugccgcaauaaagaaagcacaugaagaaggaguuugcggcauucgcucugucacaaggcucgaaaauauaauguggaaacaaauuacaccugaacuuaaucacauucucacugagaacgacguaaaaguuacuauuaugacgggggauauaaaaggaauacuacaacaagggagaagggcguugcgcccccaaccuacagaauuaaaauauucuuggaaaucuuggggaaaaucuaaaauaguaucaucggaaacacacaaccagacauuccuuauugacggaccagaaacaacagagugcccagacaccaauagagcauggaauagccucgaaguugaagacuauggauucggcuuauucagcacgaauauauggcuaagauuaagagaaaagcaagacacgcucugugauaguaaauuaaugagugcagccgucaaagacgaaagagccauacacgcagacaugggguacuggauagaaaguaaauuaaauggaaguuggaaaauagaaaaggccagcuucuuagagguaaaaucgugcacauggccaagaagccacacauuauggaguaauggcguauuggaaucugaaaugauaauuccuaagaaccuaggaggcccuguaucucagcauaacuaccgaccuggauacuauacgcaaacaacagggccguggcaucuuggaaagcuggaaauggacuucgacuauugugaaggaacaacggugauagucacagaagagugcaacaaucgcggaccuagccuccgaaccacaaccgcaucuggaaaauugauuacagaauggugcugccgaucguguacuaugcccccgcuucgauuuaagggugaggauggauguugguauggcauggaaauaagaccacuuaaagaaaaagaagaaaaucucguaaauucucucgugacagcggggcauggacaaauugauaauuuuucacuaggaauacuuggaauugcgcuauuccuagaagaaguaaugaaauccaggauagguauaaaacacacgauuggaaugaccauaaucacuuucuuacugcuagugacaggaaacgucucguauagagaucuagguagggugauuuuaaugguaggaagcacuauggcggacgagauggggaugggugugacuuauuuggcacuacuagcaacauuucgaauaagaccgacauuugcucuugcuuuaaugauaaggaaacugacaaguaaagaacuauugauggcuacgaucggaauaguguuaauagcccaaugcgauguaccugguacuauuuuagagauaacugacgcgugugcguuaggccucauguuauugaaaaugacucgcgagcuggaacgauaucaauuagcugucacacuacuuagcuugacuuguaucccaaaugcaacaauuauguggggagcuuggaaaguaacauguacuauccuaacauugguuaguauggcacccuuguucuugacgacuagcagacagaaaacagacuggguuccgguugcacuuucaaucuauggacuuaauccaacggcaauauacuuuacaacuuuagcaaaagccaagaaaauuagaagcuggccgcugaaugaagcaguaauggcuguaggaaugguaagcauuuuagcaucgagucuauugaggaacgauauuccuauggccggaccacuuguugcagggggccuguugacccucugcuauguacuaaccgggaggucagcagaccuugagcuagagaaaagugcagacauaaaguggaacgaugaugccgaaauauccggguccucaccaauaauaaaugucgcggucagcgaagacgguuccaugaguaucaaagacgaagaagaagagaauacacuaacuauccuaauacggacaggacuccuugccauaaguggaauguacccuauggcgauacccgcuacugcagcggucugguauuuuugggaagcacggaaacaaagggcggguguacuuugggaugugccuuccccuccuccaacaggcaaagcugaauuggaagaaggagcguauaggauaaagcaaagagguauauuuggguauagccaaauuggagccggcguuuacaaagaaggcacauuccauaccauguggcacguuaccagaggaucaguucuuauguguaaaggaaaacguuuagaaccaagcugggcugacguuaaaaaggauuuaauaagcuauggcggugguuggagauuagauggagaauggacagaaggcgaagagguucagguauuggcacuggagccuggaaagaacccuagggcaguucagacaaagccagggauguuuaagacagauacuggaaggauuggggcaguaucauuagacuuugcaccuggaacaagcggaaguccuauaauagauaagaaggguaaggucauugguuuauauggcaacggagugguaaugaaaucuggugcauauguuucgaguauagcacaaacugagaaaagagaagacgaaauccccgagauagaagacgacauauuuaggaaacgaagacucacaauuauggaucuacauccaggagcagguaaaacaaaacgauacuuaccugcaauaguacgcgaagccauaaaaagaggccuaagaacucuuauauuagcuccaaccaggguaguagcagcugagauggaggaagcacugagaggguugccaauacgguaucaaacuccugcaaucagagcggaacacacaggacgcgaaaucgucgaucuuaugugccacgcgacauucaccaugcgacuauuaagcccaguacggguaccgaacuacaauuuaauaauuauggacgaagcacacuucacagauccagcuucuauugcugcucgugguuauauagcuaccagaguagagaugggagaagcagccgguauauucaugaccgcgacgccaccaggaagcaaagauccguuuccccaaaguaacgccccuauuauggaugaggagcgagagauacccgagagauccuggaacucgggccaugaauggauaaccgacuucgaagguaaaacgguaugguuuguuccgucaauuagagcagguaaugauauagcuacgugccuaaggaaaaacgguaagaaaguaauccaauugagcagaaaaacauuugacacggaauacauuaagacucgaaauaacgauugggauuuuguagugacuacagauaucucagaaaugggcgcgaauuucaaagccgaaagaguaauagauccucgccgguguaugaaaccagucauccucacagacggagaagaacguguaauacuagccggaccgaugccaguuacuccaucaagugcugcucaaagaaggggacgaauaggaagaaaccccaaaaacgaaaaugaucaguauaucuauaugggggaaccacuugagaaugacgaagacugugcucauuggaaagaggcuaagaugcuauuggacaauaucaacacucccgagggaauaauacccgccauguucggaccagagagagagaaaacagaugcaauugacggcgaguacaggcuaaggggcgaaagucguaaaacuuuuguagaacuuaugagaaggggcgauuuaccuguaugguuagccuauaaaguagcuucggaagguuauaguuacgccgaccggagaugguguuuugaggguguuaaaaacaaccagauauuagaagaaaaucuggaaguugagauauggaccaaagaaggugagaggaagaaacuucggccaaaauggcuagacgcacgaacguauucagauccacaagcauugaaagacuuuaaagaauuugccgcaggacgaaaaagcacaacucuuaauuugauagcggaguuaggaagacuaccgacauacaugacucaaaagacaagagacgcacuugauaaucuugccgugcuucacacggccgaggaaggagggagagccuaucaacaugcaauaucggaacucccagaaaccuuggaaacauuacucuuguuauguuuacuagcgacgguaucaggcggugucuuccuauuuuuaauguccgguaaagguauaggaaagaugaguaugggacuaggauguauaauaacugcgucaggucuccucugguaugcgcagauacagccacacuggauagcugcaaguauaaucuuagaguuuuucuugauuguauuacuaaucccagaaccggaaaaacagagaacuccacaagauaaucaacuuacguauguggugauagcuauauuaacauuaguagcugcuaccauggcaaaugagaugggguaucucgagaaaacuaaaaaggacuuagguuuugggaacccauauguagcaucucaugaagccgcuauucuagacauugaucuacaccccgcgucagcauggacacuuuaugccguagcuacaacacugauuacaccuaugcuaaggcacaguaucgagaacucaagcaccaacguuagccuuaccgcaauagccaaucaagcuacaguauugauggggcuaggaaaagguuggccucugagucgaauggaucuugggguuccacugcucgcuuuaggcuguuauucacaaguaaauccucuaacgcuuacggcaagucuucuccuuuuaauaggacacuacgcaaucaucgguccgggauuacaagcaaaggcaacaagggaagcacagaaaagaacugcagcaggcauaaugaaaaaucccacuguagauggaauaacgguaaucgacauagaacccauaccauaugauccgaaguucgaaaaacaauugggacaaguaaugcuccuuguacuauguguugcacaaguccuaaugaugagaacuacgugggcaaugugcgaagcucuaacaauagcuacaggaccaauauccacacucugggaaggaaacccuggcaaguucuggaauacuacaauugcaguaucaauggcuaacauauucagaggaucauaccucgccggagcagggcuucucuuuucgauaaugaaaaauacugucacuggaaggagaggcacgggagucgcaggggagacgcuuggagaaaaguggaaaauaaaauuaaauggauuaggucguaccgacuuucaaacauauaaaaggucaggcauuaucgaaguugauagaacguuagccaaggaaggaauuaagcgaggagagacaaaucaucaugccguuucucgagguagcgcaaagcuacguugguucguagaaaggaaucugguuaaaccagaaggaaaaguaauagaccucggaugcgggagaggcggauggucauacuacugugguggauuaaagaauguaacagaaguaaagggauuaaccaagggagguccaggacaugaagaacccauaccaaugagcacuuauggauggaaccuuguaagacuccagagcgguguugacgucuucuucacacccccagaaaagugcgauacccuucucugugauauaggcgagucaucaccuaacccaacaauagaagcgggaagaacuuuaagaguacuuaauaugguugaaaauugguuaggcaacaaucaauucugcauaaagguuuugaauccuuauaugcccagcguuaucgagaaaauggagaaccuucagcguaaauuuggagggacuuugguacguaauccguugaguagaaauuccacacaugaaauguauuggguaucaaaugcuaguggaaauauaguauccucagugaauaugauuucaaggaugcuaauuaaucgauucacuaugaaacauaagaaaccaaccuaugaacaggauguagaucucgguucaggaacuagaaauguggguauagaaacggaaaaaccuaaucuggagauuauagguaaaagaauagagaaaauuaaagaugaacauaaacaaacauggcauuacgauuuggaucauccuuacaaaacgugggcuuaucauggcagcuaugaaacaaagcaaacugguagugccaguucaaugauaaacggaguuguuaaacuauugacaaagccaugggauguuauuccaaugguaacacaaauggcuaugacugauaccacaccuuuugggcaacaaagaguuuuuaaagaaaaaguagacacaaggacuccagaacccaaagaaggcacaaagaaguugaugaaacuaacggccaaaugguuaugggcggaacuagguagacacaaagucccgagaauguguacaagagaugaauuuacaaauaaaguaagaagcaaugcagcuaugggugcggucuuuaccgaagaaaacagauggucuagugcuaaggaggcuguagaggaugaggcuuucugggauuugguggacagagaaaggaaauuacauuuacaaggaaagugcgaaacuuguguguacaauaugauggguaagagggagaagaaauugggagaguucggccgcgcaaaagguagucgcgcgauaugguacauguggcuuggcgcgcgcuuucuagaauuugaagcgcucggguuuuuaaacgaagaucacugguuuucacgggaaaacucuuuauccgguguugaaggugaaggccuucacaaacugggcuacaucuugagggaaauaggugcaaaagauggagguaugauguaugcggaugauacggcagggugggauaccagaguaacagaagaagacuugaaaaacgaagaaaugauaagugagcagaugaaaggcgaacaccguacgcuagcagaggcuaucuuuaaacugacguaucaaaauaagguaguucgugugcaaagaccaacacccaagggaacggugauggauauaauaaguagaagagaccaacgugguucaggccagguggggacuuauggguugaauaccuuuacgaacauggaagcccaacuuauucgacaaauggaaggugagggacuguucagagauaucaguaaguugaccauacaagaagagaccgccauacucacguggcuaaaagaaaaaggacgagacagacuuucaagaauggcuauuagcggagaugauuguguaguaaaaccugucgaugaucgauuugcgcaugcuuugacggcgcucaacgauaugggaaaaguaagaaaagauauucaacagugggaggcauccaagggauggaaugauuggacacaaguacccuuuugcucgcaucacuuccacgaaauuauaaugaaagacgggaggaagcuaguggugccaugccgaaaccaagaugagcuaauuggucgggcuagaaucucacagggagccgggugggcauuaaaagaaacagcaugccuaggaaaagccuacgcacaaaugugguccuuaauguauuuucauaggcgggaucugcgccuagcagccaaugcgauuuguucagccguaccuucucauugggucccuacaagcagaacaacguggaguauucaugcucaccaccaauggaugacgaccgaggauaugcuagacguguggaacagaguuuggauauuagaaaauccuuggauggacgacaagacuuguguaaaaucaugggaagaaguaccauaccuugggaagagggaagaucaguggugcggaaguuuaauaggguuaaccuccagggcaacuugggccaaaaauaucaagguugcuaucgaacagguaagaucccuaauaggaaaggaagaauauaccgauuacaugccuucaaugaaacgguuuaaacaggagcaauccacugagggugccuugugguag

SEQ ID NO: 22937 - RNA, 9876 nt, Artificial Sequence
  derived and/or modified CDS sequence (opt6) from DENV-2__GU289914__SS-prME
ucagcaggaaugaucauuaugcuaaucccgaccguuauggcauuccacuuaacaacucgcaauggugaaccgcacaugauuguuucacgucaagaaaaaggaaaaagucuacuuuuuaaaacagaagauggagucaacaugugcacucuuauggcuauggaucuuggggaacugugcgaagacaccauaacguauaauugucccuuauuacgacaaaacgaacccgaagauauugauugcugguguaauagcacaaguacaugggucacuuacggaacauguaccaccacaggugaacacaggagagaaaaacgaucaguagcacuuguuccucauguugguaugggauuagaaacgaggacagaaacguggaugucuucugaaggagcauggaaacacgcacaaagaauugaaacauggauacuuaggcacccugguuuuaccauuauggcagcaauucuagcauauacuauagguacaacacauuuccagagagcauuaauauuuauauuacugaccgcaguggcgccuaguaugacuaugagguguauaggaaucagcaauagggauuucgucgaagggguuucuggaggaucuuggguugauaucguuuuagagcacggguccugcgucacgaccauggccaaaaauaaaccgacucuugauuuugaguuaauaaaaaccgaggccaaacaacccgcaacguuaagaaaauauuguauagaagccaaauuaacuaauaccacgacugaaagccguugccccacccaaggagagccgucauugaacgaagaacaagauaaaagguucguguguaaacauucgaugguagaucgcggaugggguaauggguguggacuauucggaaaagguggaauuguaacgugugcuauguuuacguguaagaaaaacauggaaggaaagguaguccaaccagaaaaucucgaauacacaauugucguaacuccacacuccggcgaagaacaugcgguaggaaaugauacagguaagcacgguaaagagauaaaaguaacuccccaaaguucaauaaccgaggcagaauuaacaggcuaugggaccguuacaauggaauguagucccagaacuggguuagauuuuaacgaaaugguacuacuacagauggaaaacaaggcuugguuaguacaucgucagugguucuuagaucuuccacuaccauggcucccgggugccgauacucaaggaaguaacuggauacagaaggaaacccuagugacauucaagaacccgcacgcuaagaaacaagacguugucgucuuaggaucucaagaaggagcuaugcauacagcguuaacaggagcuacagaaauacaaaugucuagcggaaauuuacuuuuuacaggccacuugaaauguagguuacguauggacaaacuucaacuaaaagguaugaguuauaguaugugcaccggaaaauuuaaaguugugaaagaaauagcggagacacaacauggaacgauagucauuaggguucaauacgaaggggaugggucaccuuguaaaauaccguuugagauuauggaccuagaaaaacgucaugugcuaggaagguuaauaacugugaauccaauaguaacugaaaaggacaguccuguaaauauugaagcagagccacccuucggugacucguacauaauaauugguguagacccaggucaauuaaagcuaaacugguuuaagaaagguucuucuauaggacaaauguuugaaaccacaaugagaggcgcaaaacggauggcaauauuaggagauacugcuugggacuuuggaagucuuggcgggguauucacaucaauagguaaagcauuacaucagguguucggagccaucuauggagccgcauuuucaggcgucucauggacgaugaaaauccuaauuggagucauaauaacauggauaggcaugaacucucguucuacuagcuuaucuguuagccuaguauuaguugggauaguaacauuauaucuaggcgugaugguacaagcagauucagguugcgucguaucauggaaaaauaaagaauuaaaaugcggaucagggauuuucauaacugauaacguccacacguggacagaacaguacaaguuucaacccgaaucgcccucgaaauuggcaucggcaauacaaaaggcacaagaggaagguaucugugguauacgaaguguuaccagacucgagaaccuuauguggaaacaaauaacgccagaacuuaaccacauacuggcggaaaacgaggugaagcugacuaucaugacaggcgacauaaagggaauuaugcaagccgguaagagauccuuaaggccacaaccgacugaacucaaguauuccuggaagacauggggcaaggcuaaaaugcugucaaccgaaucacacaaccaaacguuuuuaaucgacggucccgagacagcggaauguccaaacaccaauagagcuuggaauagucuagaaguggaggacuacgguuuuggaguguuuacaaccaacauaugguuaaaguuaaaagaaaaacaggaugcuuuuugugauucaaaacuaaugucugcggcuaucaaggauaauagggccguucacgcugacaugggcuauuggaucgagucagcauuaaacgauacuuggaaaaucgagaaagcgucauucauagaagucaaaaacugucacuggccgaaaagccacacuuuauggucuaacgguguacuagaaucagaaaugauaaucccgaagaaccuagccgggccagucucacagcacaauuacagaccaggguaccacacgcagaucgcgggaccguggcaucucggaaaauuggaaauggacuuugauuuuugcgauggaacgacaguaguaguuacggaagauugcgguaaccgugggccgagucuaagaacaacuacagcgucaggaaaguuaauaacugaauggugcugcagguccugcacucuaccuccccuaagauauaggggagaagaugguuguugguacggaauggagauacgaccuuugaaagaaaaggaagaaaauuuggucaauagccugguaacugcagggcacggacaagucgacaauuucucucucggggucuuaggaauggcacuguuucuagaggaaauguuacggacacgaguuggaacaaaacaugcaauccuauugguggcagucucauuuguaacuuuaauuacaggcaauaugucauuucgagaucuaggccguguaguaguaaugguuggggcaacaaugacagaugacauaggaaugggagucacauauuuagcucuauuggcugcuuuuaaagugagaccuacuuucgccgcgggacugcuauugcggaaacugacaucgaaagaacuaaugaugaccacgauugguauaguuuugcuaagccaaucaacaauaccugagaccauuuuagaauuaacagacgcccuagcgcucgggaugaugguacuaaagaugguuaggaauauggaaaaauaucaacuggcaguaacaauaauggcaauauuguguguaccaaaugccguuauuuugcagaacgcauggaaaguuucuuguacuauuuuagcggugguuucaguaucgccuuuacuauuaacuucgagucaacagaaaaccgacuggauaccucuugcacuaacaauaaaagggcuaaacccuacugcuauuuuccuaacaacuuuaucacguacgagcaagaaaaggucuuggccauugaaugaagcgauuauggcuguagguaugguuucaauauuagcauccucgcucuuaaagaaugacaucccaaugacugguccucuagucgcuggggguuuacuaacuguaugcuauguacuuacaggaaggucagcugauuuagaacuugaaagagcagcggaugucaaaugggaagaccaagcugagauaucaggcaguaguccaauacuaucaauaacgauuucagaagacggcucaaugagcaucaaaaaugaagaggaagaacaaacguuaacaauuuuaauacgcacgggccucuuagugauaaguggauuauucccaguuagcauuccaaucaccgccgcggcaugguaucuuugggaggucaagaagcaaagagccgguguguugugggacgucccuagucccccaccaaugggaaaggcugaacucgaagacggagcuuaccguaucaaacaaaaaggaauacuggguuauucccagauaggagcuggcguguacaaggagggaacuuuucauaccauguggcacguaacacgcggagcaguguuaaugcauaaaggaaagcggauagaaccuucaugggccgaugucaaaaaggaucuaauaaguuacggaggaggguggaaguuagaaggugaauggaaagaaggcgaagaaguucaaguccuggcuuuagagcccgggaaaaauccaagggcuguacaaacuaaaccagggcuguuuagaacuaacgcagguacuaucggugcaguuagcuuagauuucucaccgggaacaagugggaguccgauaauagacaagaaaggcaaggucguuggauuguaugggaacgggguugugacgcguaguggugcuuauguuucugcuauagcccaaacagaaaaaucaauugaagacaacccggaaauagaggaugauauauucaggaaaaggagauuaacaauuauggauuuacacccaggcgcagggaaaaccaaacgcuaucucccugccaucguacgagaagcuauaaaacgugggcucagaaccuuaauauuagccccuacccgugucguagcggcagagauggaggaagcucuaagaggucuucccauuagauaccaaacuccugcgaucagggccgaacauacuggaagagagauaguagacuuaaugugucaugcuacuuucacuaugagacuucugucaccggucaggguacccaauuauaaccuaauuaucauggaugaagcccauuuuacagauccggcuagcauugcagcgagaggauacauaagcacccguguagaaaugggugaagcggcagggauauuuaugacagccacgccacccggaucaagggaucccuuuccccaaucuaacgcccccauuauagaugaagaaagggaaauucccgaaaggucauggaacucaggacaugaauggguaacggacuuuaaaggcaaaacgguuugguuuguaccuaguauuaaagcaggcaacgauauugcggcaugcuugcgaaagaauggaaagaaggucauucaacuaagcagaaaaacauucgacagcgaauauguuaagacacguaccaaugauugggauuuuguugucacuacggacauuuccgaaaugggggcaaacuucaaagccgaacgcguaaucgacccgagaagauguaugaaaccaguuauauuaaccgacggggaggaacgcguaauacucgcugguccgaugccggucacgcauucgucugcagcccagcguagaggucgaauagggcggaaucccaagaacgaaaacgaucaauacauauacaugggcgagccgcuagaaaaugacgaagauugugcacacuggaaagaagcaaaaaugcuccuugacaacaucaauacaccugagggaauaauaccuucaauguuugaaccagaacgugaaaaaguagacgcaauugauggagaauauagacuuagaggggaagcucgaaaaacauuugucgauuuaaugaggcguggagaccucccuguguggcuugcauauaagguagcugcugaagggauuaauuaugcagacagacgauggugcuucgaugguauaaagaauaaccaaauucuagaggaaaacguugaaguagaaauuuggacuaaagaaggcgaaagaaagaaacuuaaaccgcgaugguuggacgcgagaauuuauucggacccuuuagcacucaaggaguuuaaggaauuugcagcugggaggaaaaguuuaacauugaaccugauuacagaaauggguagacucccgacuuuuaugacgcaaaaagcccgcgacgcuuuagauaauuuagcuguauugcauacagcagaagcuggagguagggcauauaaucacgcacucucagagcuaccggagaccuuggaaacauugcugcuauuaacacuuuuagccacaguuacaggcggcauauucuuauuucuaaugaguggaagaggaauaggaaaaaugacauuaggaauguguuguauuaucacagcgucgauuuuacuuugguaugcucaaauucaaccgcacuggauagcagcgagcauaauuuuggaauuuuuccuaauuguguuguuaauaccagagccagagaagcaacguacgccucaagauaaucaguuaacauacgugguaaucgcaaucuuaacuguaguagcugccacaauggcuaaugaaaugggauuucuugagaaaacaaagaaagaucucggacuugguucaauugcgacccaacagccugaaagcaacauacuagacauugaucugagaccugcaagugcguggacccuauacgcgguggcuacaacauucguaacaccgaugcuccgccauagcauagagaacuccucagucaacguaucguugacagccauugcuaaucaagcuaccguacuaaugggacuagguaaaggauggccuuugucuaaaauggacaucgggguaccauuacuagccauagguugcuauucgcaaguaaauccuauaacucugaccgcagcgcuucugcuccucguggcccacuacgccauaauugguccugggcugcaagcaaaagcaacgcgcgaggcccaaaagagggcugccgcgggaauaaugaaaaaucccacaguagauggaauuacaguuauagaccuugauccaauuccguacgacccaaaauuugaaaaacaauuaggucaaguaaugcuacugguauuguguguuacacagguauugaugaugcgaacuaccugggcguuaugcgaagcucuuacucuugccacagguccaaucuccacucucugggagggcaauccugggcguuucuggaauacaaccauugcgguuucaauggcuaacauauuucgagguucguauuuagcuggugcaggauuacucuuuagcauuaugaaaaauacaacgaauacucgucgagguacaggaaacauaggagaaacucuuggcgaaaaauggaaaagcagacuuaacgcguuggggaaaucagaauuucagauuuauaagaaaucgggcauucaagagguagaccgaacacucgcgaaagaaggaauuaagcgaggcgagaccgaucaccacgcugucucccgugggucagcuaaauuacgaugguucguagaaagaaauaugguaacaccagagggcaaaguuguagauuuaggaugugguaggggagguuggucuuauuacugcggcggccuaaagaauguuagggaagucaagggcuuaacaaaaggcggaccggggcacgaggaaccaaucccaaugucaacuuauggcuggaaucucguucgguuacaaucgggagucgauguauucuuuauaccuccagagaaaugcgauacacuacugugcgacauuggcgaaucaaguccaaauccuaccguugaagccggcagaacacuacgaguuuuaaaccucguugaaaacuggcugaauaauaacacccaauucugcauuaaaguccugaauccauauaugccuuccguaauugagaaaauggaaacauuacaacguaaguauggcggcgcgcucguuagaaacccucuaucuagaaacaguacccaugaaauguauuggguaucuaaugcguccggaaacauaguuucaagugugaacaugauaucaaggauguuaaucaauagauucacaaugagacauaagaaagcgacauaugaaccugacgucgaccuaggcucaggcacccgaaacauaggaauagaaagugagauuccuaacuuagacauaauagguaagagaauugagaaaauaaagcaagaacaugaaacuucguggcauuacgaucaagaucacccauauaagacaugggcguaccauggaucauacgaaacuaaacaaaccgggagcgcuucaucuauggucaacggggugguccgcuugcugacgaaaccaugggaugugguaccuaugguuacacaaauggcaaugacagacacgacaccauucggccaacagcgcguguuuaaagaaaaaguagauacucggacccaagaaccuaaagaggggacaaagaaauugaugaaaauaaccgcagagugguuauggaaagaauuaggcaaaaagaaaacaccaagaauguguacccgggaagaguucacaagaaaaguaaggaguaaugcagcgcuaggagcuaucuuuaccgaugaaaauaaauggaaaagugccagggaagcaguagaagacucccgauucugggagcuaguggauaaagaaaggaauuugcauuuagaagguaaaugugagacuugugucuauaacaugaugggaaaaagggaaaagaaacuuggcgaauuuggaaaagcaaaagguucgagggcgauuugguauaugugguuaggcgccagauuccuagaguuugaagcgcuagguuuucuaaaugaagaccauugguucucuagagaaaauagccuuucaggcguggaaggggaaggcuugcauaaacuaggguacauacuaagagacgucagcaagaaagaaggaggagcuauguacgcagaugacaccgccggaugggauacaagaauuacgcuggaagaucugaaaaacgaagagaugguuacaaaccauauggaaggugaacauaagaaguuagccgaagcaauuuucaaacuaacguaccaaaacaaaguaguuagggugcagaggccgacuccuagaggcacuguaauggauauaauuagucguagggaucaaagaggauccggacaaguaggaacauauggacuaaauacuuucacgaauauggaagcgcagcuaauucgucaaauggaaggagaagggguuuucaaaaauauccagcaccuuacggugacugaagagauugcgguccaaaauuggcucgcgaggguggggagagaaagauuaaguagaauggcgauaucaggagacgauugugucguaaaaccacucgaugaucguuucgcaucggcacucacagcguuaaaugacaugggaaagauuaggaaagauauacaacaaugggaacccaguaggggcuggaacgacuggacccaaguaccauuuuguagucaucauuuucaugaacucauuaugaaagacgggcgcgucuuaguaguuccguguagaaaccaggaugaauuaaucggcagagcaagaauaagucagggcgcugguuggucguugagagagacagcaugccuugggaaaucauaugcacaaauguggagcuuaauguauuuucauaggcgugaccuuagacuagcagccaaugcaauauguucagcggucccaucccacugggucccaacuucucgaacaacuuggaguauacacgcuaaacacgaauggaugacaacagaagauaugcuaaccgucuggaauagaguuuggauacaggaaaauccauggauggaggauaagacuccaguagaaucaugggaagagaucccauacuuaggcaagagagaagaucaguggugcgggucuuuaauuggcuuaacuucaagagcaaccugggccaaaaauauccaagcugcaaucaaucaaguaaggucguuaauaggcaaugaggaauacaccgacuacaugccaagcaugaaacguuuccgcagagaagaggaggaggccggaguauugugguaa

SEQ ID NO: 22938 - RNA, 9876 nt, Artificial Sequence
  derived and/or modified CDS sequence (opt6) from DENV-2__AY858036__SS-prME
acugcaggaauaauuauaaugaugauaccaaccguaauggcauuccauuuaaccacuagaaauggggaaccacacaugauugugucacgacaagaaaaaggaaaaagccuacuauuuaaaacggaaaaugguguaaauauguguacacuaauggcaauggaucuuggcgaauuaugugaagacacgauaacuuauaauugucccuuacuacgacaaaaugaacccgaagauaucgauuguuggugcaauucaaccaguacauggguuacuuaugggacguguacagcuaccggugaacaucguagagagaaaagaucgguggcucuaguuccacacguagggaugggacuagaaaccagaacggaaacauggaugucaucagaaggcgccuggaaacaugcccaacggauugagacguggguauuacgccaccccggcuuuacgauaauggcggcuauacuagcauacaccaucgguacuacauauuuccaacgaguacuuaucuuuauucuauuaacggccguagcuccauccaugacaaugcguuguaucgguaucucgaacagagacuucguagaagguguaucuggaggcagcuggguggauauugucuuagaacacggaaguugugucacgaccauggccaaaaauaaaccaacgcucgacuuugaacuaauaaaaacggaagcuaaacacccugcgaccuuacgaaaauauuguauagaagcuaaauugacgaauacaacaacagccagucgaugccccacgcagggagaacccagcuuaaacgaagaacaagauaaaagauuuguguguaaacauucuaugguagauagaggaugggggaaugguugcggacuauuuggcaaaggaggaauagugacuugcgcuauguuuacuuguaaaaagaauauggaagguaaaauagugcagccagaaaaucuggaauacacaauugucauuacgccacacaguggcgaggaaaacgccgucggaaaugauacagggaaacaugggaaagaaauaaaagucaccccacaaucgucgauaacagaggcugaacuaacaggauacgguacgguuacaauggagugcuccccacgaacgggacuagauuucaacgaaaugguucuauuacaaauggagaauaaagcguggcugguacaccgacaaugguuucuugaucuuccgcucccuuggcuuccaggugcagacacacaagguucaaacuggauucaaaaagaaacucuuguaacuuucaaaaauccucaugccaagaaacaggacguuguaguccuagggucacaagaaggagcuaugcacacggcgcuaacuggagcaacagaaauccagaugaguucggguaaccucuuauuuaccggccacuuaaaauguagacuacgcauggacaaauuacaacuaaaaggaaugucuuauucaauguguacagguaaauucaaaguaguaaaagaaauagcagaaacucaacaugggacaauagucauacgaguucaauacgaaggagauggcaguccuuguaaaauaccuuucgaaauaauggaucuugagaaaagacauguauuaggacgucuaauaacggugaacccgaucgucaccgaaaaagacagucccguaaauaucgaggccgagccacccuucggagauagcuauauuauaauuggcguagaaccaggucaacucaaacuaagcugguucaagaaaggaucuucaaucgggcagauguuugaaacuacaaugcggggugccaaacguauggcuauacuaggcgauacagcuugggauuuuggcucauuggguggagucuuuacauccaucgguaaggcuuugcaucaaguguucggugcaaucuacggugcagcauucucugggguuaguuggacuaugaaaauacuaauaggaguuguuauaacauggauagguaugaacaguagaucuacaagucuaucagugagcuugguucuggugggagucguaacacuauacuuaggaguaaugguacaagcagauagcggaugugucguaucguggaaaaacaaagaacuaaaauguggaucugguaucuucguaaccgauaacgugcauacuuggaccgaacaauauaaauuccaaccagaaucaccaucuaaacuagccuccgcaauacagaaagcucaugaggaagguauaugcggaauacgaaguguuacuagacuagaaaaucuaauguggaaacagaucacaccugaacuaaaucacaucuugucugaaaaugaagucaaacugacaauaaugacaggcgauaucaaagggaucaugcaagcaggaaaacgcucccuaagaccccaaccuacggaguugaaauauucguggaaaacauggggcaaagccaaaaugcucucuacagagcuucauaaucacacauucuuaauagauggcccggaaacggcggaauguccaaacaccaaucgcgcauggaacucucuugaaguggaagacuacggauuuggcguuuucacuacgaauauuugguuaaaacuaaaagaaagacaagacguauuuugcgacaguaaacuuaugucugcagcaauaaaagauaacagggccguacaugcugauaugggguacuggauagaaucagcccuaaaugauacauggaagaucgaaaaggcaucauucauugaaguuaaaucaugccacuggccgaaaagccauacacuauggagcaauggaguuuuagaaucagagaugauaauccccaaaaauuucgcaggaccggugagucaacauaauuaucgaccuggguaucauacacaaaccgcggguccauggcaccuagguagauuagaaauggacuuugacuuuugcgaagguacaacaguaguggucacugaggauugcgguaaccggggacccucucucaggacuacgacagcuucaggcaaacuaauuacagaauggugcugcagaagcuguacacugccaccacugcgcuacagaggagaagauggguguugguaugguauggaaauaagaccucuuaaagaaaaggaagaaaaccuuguuaacagucugguuaccgcaggccaugggcaaauagacaacuuuucgcucggaguauuagggauggcguuauuucucgaagaaaugcucaggaccagaguuggaaccaagcaugcaauauuacucguugcggucucauuuguaacgcuaauaaccgggaacaugucuuuuagagaucuaggacgugucauggucaugguaggugcaacaaugacagaugauauuggaauggguguuacauacuuagccuuguuagccgcauuuaaagugaggccuacguuugcugcaggcuuacuuuuacguaagcuaacuagcaaagagcucaugaugacuacaauagguauuguacuguugucacagucaaccauuccagaaacgauuuuagaacuuacugacgcacuagcuuuagggaugaugguucugaaaaucgugaggaacauggaaaaauaucaguuggcaguaacuaucauggcuaucuuaugugucccaaacgccguaaucuuacaaaaugcuuggaaaguuucuuguacaacauuggcagucgugucugucuccccacuacuauuaacuuccucucaacagaaagcugauuggauucccuuagcacugacuaucaaaggucuuaaccccaccgcuauuuuucucacuacccuagcacgcacaagcaagaaaagaaguuggccucucaacgaagcaauaauggcuguggggauggugucuauauuagcaucaucuuuacucaaaaaugauauaccgaugacugguccguuaguugccggaggucuuuuaacaguuugcuacguucuaacuggucgaucagcugauuuagaauuagaaagggcugcagauguaagaugggaggagcaggcugaaauauccggcucuagucccauccucaguaucacgaucuccgaggacgguucaaugaguaucaaaaacgaagaggaagaacaaacauugaccauauuaauaagaacaggccuccuaguuauauccggacuuuuucccgugaguauuccaauuacagcagcagcaugguauuugugggaggugaagaaacaaagagcaggaguauuaugggacguacccucaccuccgccaguaggaaaagcagaauuagaagacggugcuuacagaauuaaacaaaaaggcauacucggcuauucucaaauuggggcaggcguauauaaagaggguacuuuucauacaauguggcauguuaccagaggagcaguauuaaugcacaaaggaaaacgaaucgagcccucaugggcagauguuaaaaaggaucuaauuaguuacggcggaggauggaaauuagagggagaauggaaagaaggugaggagguacaaguacuagcucuagagccuggaaagaaucccagagcgguccaaacgaagccuggguuguucaaaacuaacacuggaacuauuggagccguguccuuagacuucagucccgggacaucugguaguccuauaguagauaaaaaggguaaaguggugggacuauauggcaacggagugguaaccagaagcggaacuuacguaagugccauagcccagaccgaaaaaucaaucgaagacaauccugaaauagaagacgacauauucaggaagaaacgccuaaccauaauggauuuacaucccggugcaggaaagaccaaaagauaccugccugccauaguaagagaagccauaaaaaggggacugagaacgcuuauacuugcaccaaccagaguaguugccgcggagauggaagaagcgcuacgaggucuuccaauacguuaccaaacgccugcaauuagagcagaacauacaggaagagaaaucguugauuugaugugccaugcgacauuuacaaugcgauuauuaagcccaauaaggguaccaaacuauaaccucauaauaauggaugaggcccauuucacagauccugcgaguauagcagcacgagguuauauaucuacacguguggaaaugggagaggccgcgggaaucuucaugacugcaaccccgccgggguccagagauccauuuccucaaucuaacgcaccuauaauggaugaagaaagagaaauaccggagaggucuuggaacucuggucacgaauggguaaccgauuuuaaaggaaaaacugugugguuuguuccaagcauaaaagcggggaaugacauugcagcaugucugagaaagaaugguaagaaaguuauccaauuaucgcggaaaacguucgauucugaauauaucaaaacaaggacaaaugauugggauuuuguugugacaacagauauaucagaaaugggcgccaauuucaaagcagaacgcguaaucgauccaagaaggugcaugaaaccuguaauccugacugauggagaagagagggugauccuggccggaccaaugccagugacacauucauccgcugcacagaggcggggcaggguaggucgcaauccuaaaaaugaaaaugaucaguacauuuauaugggcgagccacucgagaacgaugaagauugugcacacuggaaagaagccaaaauguuauuagacaauauuaauacuccugaagggaucauaccaucaauguuugaaccggaaagagaaaaaguagaugcaauugauggcgaauauagguugagaggagaagcaaggaaaacauuuguggaucugaugagacguggagaccuaccaguauggcuggcguacagggucgcagcagaagggauaaacuaugcagauagaagguggugcuuugauggcguuaagaacaaccagauauuagaggagaacguugaaguggaaauuuggacaaaagaaggugaaaggaaaaagcuaaagccgagaugguuagacgcccggauauacucggacccauuagccuuaaaggaauuuaaagaauuugcggcuggaagaaaaucauugacucuaaacuuaauuaccgaaauggguaggcugccaaccuuuaugacccaaaaagcgcguaaugcacuugacaaucucgcaguacuacauacagcggaaacgggaggucgggcauacaaccaugcccuuagcgaacuuccagaaacauuagagacacuauuauuauugacucuguuagcgacaguaaccgggggaauauucuuguuccucaugucuggcaaagggaucgguaagaugaccuuagguauguguuguaucaucacagcuagcauacuacuaugguacgcccaaauacaaccucauuggauagcagcuagcauuauacuagaguucuucuugauugucuuguuaauaccagaaccggaaaaacaacguacuccacaagacaaucaauuaacguacgugguaauagcgauacucacugucguagcugccacaauggcaaaugaaauggguuuccuggagaaaacaaagaaagacuuuggacuuggaucaauaacaacacaacaaccugaaucaaacauuuuagauauagaucuaaggccagcauccgcauggacauuauaugcgguugcgaccaccuuuauaaccccaaugcugagacauucuauagaaaacucaagcgugaaugugucauuaaccgcaaucgcuaaccaggcgaccguauuaauggguuuggguaaaggcuggccucuuuccaaaauggacauugggguuccuuuacuagcaauuggcuguuauagucaggugaauccaauuaccuugacagcggcacuacugcuacucguugcgcauuaugccauuauagguccaggacuccaagcuaaagcaacgagagaagcgcagaaaagagcugcggcaggaauaaugaaaaauccgacgguggauggaauaacagucauugacuuagacccaauucccuaugauccaaaauuugaaaaacaacuuggacaaguaaugcuucucguuuugugcgucacccaaguccuaaugaugcgaacgaccugggcccuaugugaagcccuuacucuugcuaccgggcccauaaguacauuaugggaagguaaucccggaagguuuuggaauacaacuauagcagucucuauggcaaauaucuuccgcgguucguauuuagcaggggcaggacuacuauucaguauuaugaaaaacacggcaaauacgagacgugguacagggaacacaggcgaaacauuaggugagaaauggaagaauagacuaaaugcuuuagguaaaucugaauuucaaauauauaagaaaagcggcauacaagagguugauagaacgcuugcaaaggaaggcauaaaacguggcgaaacagaucaccaugccguuucgcguggaagcgcgaaauugagaugguucguugaaagaaaccuggugacaccagaaggcaaaguaguagauuuaggcugugggcgaggaggcuggagcuacuacugcggaggucuaaagaaugucaaggaggucaaaggauuaacgaaaggaggaccaggucacgaagaaccaaucccaaugucaacauauggauggaacuuaguuagacuacaaucuggaguggacguauucuuuacaccaccagaaaaaugcgauacgcucuuaugugauaucggcgagucaaguccgaacccuacuguagaggcgggcagaacguugagagugcuuaaccucgucgagaauuggcuaaauaauaauacacaauuuuguauaaaagugcucaauccauauaugcccucuguaauagaaaagauggaagcguuacaaagaaaguaugguggagcgcuaguaagaaauccccuaucacgaaauucgacccacgaaauguauuggguuucaaacgcuagcgguaauauaguaucuuccguaaauaugauaagcaggaugcugauaaacagauuuacuaugaggcauaaaaaggccacuuacgaaccagacgucgaucuagguucgggaacgcgaaauauagggauagaaucagaaacuccuaaccuagauauaaucggaaaaagaaucgagaaaauuaaacaagaacaugaaacuucguggcauuaugaccaggaucacccauauaaaacuugggcauaucacggaaguuacgaaacuaaacaaaccggcucugcaagcucaaugguuaaugggguaguuagauuacuaacaaaaccaugggacguuauaccuauggucacacagauggcuaugacagauacuacuccauuuggccaacaacguguauuuaaggaaaaaguggacaccagaacccaagaaccuaaagaagguacuaaaaaguuaaugaaaauaaccgccgaauggcucuggaaagagcuagguaagaagaaaacgccacguauguguacucgagaggaguucacgaggaaaguccgguccaaugcagcacuuggggcaaucuuuaccgacgaaaacaaguggaaaucagcuagagaagcugucgaagauagugaguucugggaauuaguagacaaagaacguaacuuacaccuggaaggaaaaugugaaacaugugucuacaauaugaugggaaaacgcgagaaaaaguugggagaguucgggaaagccaaagguucaagagcgauaugguauauguggcuuggggcaagguuccuugaguuugaagcucuaggauucuugaaugaagaucacugguuuucccgagaaaacagccugucagguguggagggugagggcuuacacaaacuuggguacauacuaagggauguuaguaagaaagaagguggcgcaauguacgcagaugacaccgcaggaugggacacacguauuacacuagaagaccucaagaaugaagaaauggucacuaaccacauggagggcgaacacaagaaauuagccgaagcuaucuuccgacuaacauaucagaacaagguaguaagagugcaacggccuacaccuagagguacaguuauggacauaaucucaaggagggaucagagagggucaggucaggucguuacauacggacuaaauaccuuuacuaacauggaagcucaauugauacgacaaauggaaggagagggaguauuuaagucaauccaacauuuaacuguaaccgaggagauagcagugaaaaauuggcuaguccgaguugggcgggagagacuuagccguauggcgauaucuggagacgauuguguugugaaaccucucgaugacagauuugcuagcgcauuaacagcucugaacgacauggggaagguucgaaaggacauccaacagugggagccaucgagagguuggaacgauuggacacaaguccccuucuguucucaucauuuucacgaacuaauaaugaaggaugguagaguccuaguaguuccuugucggaaucaagaugaauuaaucggcagagccagaauaagucaaggagcugguuggucgcuucgugaaacugccugucuugggaaaaguuacgcacagauguggagccuaauguauuuucaucgacgagauuuaaggcuagcugcuaacgcaauauguagugcaguaccaagucauugggugccaacaagccguacuacauggucaauccacgcaacgcaugaauggaugacaacagaagauauguugacggucuggaauaggguauggauucaggaaaauccuuggauggaagacaaaaccccaguagaaucuugggaggagauaccuuauuuagggaaaagagaggaucaauggugugggucuuugauuggucuaacaucucgugcaacuugggcgaaaaacauacaaacugcuauaaaucagguacggucucucauuggaaaugaagaauacacugacuauaugccuagcaugaagcgguucagacgcgaggaagaagaagcgggaguccuuugguga

SEQ ID NO: 22939 - RNA, 9876 nt, Artificial Sequence
  derived and/or modified CDS sequence (opt6) from DENV-2__HQ332184__SS-prME
acagcggguguaaucauuauguuaaucccaacagcaauggcuuuccauuuaacgacacgaaacggggaaccacacaugauagugggccggcaagaaaaagguaaaucccuucuuuucaaaaccgaagacggcguuaacaugugcaccuugauggccauugauuuaggagaacucugugaagacacuauaacuuauaaaugccccuuauuaagacaaaacgaaccggaagacaucgauuguugguguaacaguacaucuacaugggugacauacgggacgugcacaaccacaggugaacaccgaagagagaaacgaagcguugcauuaguaccacacguagguaugggacuagagacuagaacugaaacauggaugaguagcgaaggagcauggaaacaugugcaaagaauagaaacauggauccuacgucauccugguuuuacaauaauggccgccauauuagcauacacuauaggaaccacucacuuccaacgcgccuugauuuuuauauuauuaacagccguggcaccuaguaugaccaugagauguaucgggauaucaaaucgggacuuuguagaagggguuucugggggcagcuggguugauauaguucuagaacauggcucauguguuacuacuauggcgaaaaacaaaccuacucuugacuuugaguugauaaaaacagaagccaaacagccagcaacucugagaaaauacuguaucgaagcuaaauugaccaauacgacuacugagaguaggugcccgacccagggagagcccucacugaaugaagaacaagauaaacgauuuauaugcaaacacaguauggucgacagaggguggggcaacggaugcgguuuauuugguaaaggcgguauagugacaugugccauguuuacuuguaagaaaaauauggaagguaaaguaguacaaccagagaaucuagaauacacgauaguaauaacaccgcacuccggagaagaacacgcagucggaaaugauacaggaaaacaugggaaagaaauaaaaauaaccccgcaaaguucaaucacggaagcagaguugacuggauacggaacuguuacgauggagugcuccccgagaacgggauuagauuucaaugaaaugguccucuuacagauggaagacaaagcguggcuuguucauagacagugguuucuggaccucccacuaccaugguugcccggcgcagacacucaaggcucuaauuggauacaaaaagaaacacuggucacauucaaaaauccgcaugcaaagaaacaagacgucguaguacuuggaucacaagaaggcgcuaugcauacggcgcuaaccggcgcaacagagauucaaaugagcucugggaaccuacuauuuaccggacauuuaaaaugucgauugcguauggauaagcugcagcuaaaaggcaugaguuacagcaugugcacaggcaaguuuaaaauagucaaagaaauagccgaaacacaacacggaacaauaguaauaagaauccaauaugaaggagacggcucgccuugcaaaauuccauuugagauaacggaccuugagaaaaggcauguauuaggaagauuaaucacagucaauccaauuguuauagaaaaagacuccccagucaauauugaagcagaacccccuuuuggugacucauacauaauaauugggguugaaccaggacaauugaagcucaauugguuuaagaaagguaguaguauagggcaaauguuugaaacgacgaugcgcggugcuaaaaggauggcaauacuaggagauacugguugggauuuuggaucccuuggcggaguauucacuucaauaggaaaagcucuacaccagguuuucggggcuauauacggugccgcguuuucuggaguaaguuggacuaugaaaauacucauuggcguggucauuaccuggauaggcaugaacucucggucuacaucuuuaaguguaucgcuagugcuaguagggguaguuacacuuuauuuaggagcaaugguacaagccgauucuggcuguguuguaucauggaagaauaaagaauugaagugcggguccggcaucuuuauaaccgauaauguacacaccuggacagagcaauauaaauuucagccugaaagcccuucaaaacuagcaucagcaauacaaaaagcccaugaagaagguauauguggaauacgcaguguaaccagauuagaaaacuuaauguggaagcagaucacaccagaauuaaaucacauccuuuccgaaaaugaagucaaauuaacuauaaugacaggagauacuaaagguauaaugcaagcugggaaaagaagucuucguccacagccgacagaguuaaaguauuccuggaaaacaugggguaaggcuaaaauguuaaguaccgaaucacacaaccaaaccuuucuaauugauggaccagaaacagcugaaugucccaacaccaaucgagcauggaauagucucgaggucgaagauuacggguuuggaguuuuuacgaccaacauuuggcuuaaacuaagagagaaacaggacguauucugugauucuaagcuaaugucugcagcuauaaaagauaauagagcgguacacgcagacaugggguauuggaucgagagugcgcugaaugauacuuggaaaauggaaaaagcgaguuuuauugaagucaaaucaugccauuggccgaaaucgcauacauuguggaguaauggggucuuggagucugaaaugauaauuccuaaaaacuuugcuggacccguaucacaacauaauuauaggccagguuaucauacucaaaccgcaggucccuggcacuuggggaagcuagaaauggauuuugauuuuugugaagguacuacaguuguugugaccgaagacugcgggaacagagggcccucacuacgaacaaccacagccucagggaaauuaauuacagaaugguguugucgguccugcacguuaccacccuuaagauaccgaggcgaagacgguugcugguaugggauggaaauuaggccacuaaaagaaaaagaagaaaacuuaguaaauucauuaguaacggcuggucauggccagauugauaacuucucauuaggaguauuaggaauggcauuguuucuugaagaaauguuacguacucggguaggaacaaagcacgcgacacuauuagucgcugcgaguuuuguaacgcucaucacuggaaacaugaguuuccgugauuuagguagagucauggucauggucggcgccacaaugacugacgacaucggaauggggguaacauaucuugcucuuuuagcagcguuuaaagugagaccuacauucgcggcuggacuauuguuaagaaaacuuacguccaaggaacuuaugauggccacaauagguauaacacuucuuucgcaaaguacaauccccgaaacaauuuuagaacugacggaugcacuagcguuagggaugauggucuuaaagauaguuagaaauauggagaaauaucaacuagcuguuacaauuauggcaaucagcugcguuccgaaugccgucauucuuaggaaugcauggaagguuagcugcacuauacucgcggcagugagugucaguccccuucucuuaacaagcucucagcaaaaagccgacuggauuccucuugcauuaacaauaaaagguuugaauccuacugcaauuuuucuaaccacacuaucuagaacuagcaagaaacgaagcuggccgcuaaaugaggcaauaauggcaguaggaaugguuucuauccuggcaagcucacuacuaaagaaugauauaccgaugacuggcccauuagucgcaggaggacuucuaacagugugcuauguauuaacaggaagaagcgccgaucuggaacuagaacgugcugcggauguaaaaugggaagaucaggcagaaauaucugggagcuccccaauauuaucaaucacuauaagcgaggacggaagcaugucaaucaaaaacgaagaagaagaacagaccuuaacaauuuuaauaagaacgggacuccucguaauaucaggagucuucccaguuaguauaccgauuacagcggccgcaugguaccucugggaagucaagaaacaaagagcagggguucuaugggacguaccaaguccuccaccagugggaaaagcagaacuugaagauggcgcauaucguauaaaacaacgaggaauacucgguuacucacaaauuggcgcuggaguguauaaagaggguacauuucacaccauguggcaugucacucgcggggcaguacucaugcaccgaggaaaacggauagaaccuucgugggcagauguaaagaaagauuuaauuagcuacgguggcggguggaaacucgaaggagaauggaaagaaggugaagaaguacaagucuuagcacuagagcccgguaaaaacccaagggcaguccagacaaaaccagguauuuucaaaacaaacacaggaacuaucggugcuguaucacuggacuuuucgccagguacaagcggcagcccaaucguggacagaaaaggaaaaguaguaggacuauauggcaauggaguggugacccgcucaggggcauacgucagcgcuauugcucaaacagagaaaagcaucgaagacaacccggagauugaagacgauauauuucguaagaaacggcuuacgauaauggacuugcacccaggggcaggaaaaacuaagcgcuaucuuccagcaauagucagggaagcaauuaaaaggggucuccgaacauuaauuuuagcgccaacaagagugguagccgcagaaauggaagaagcacugcgcgguuugcccauaagauaccaaacaccagcaauuaaagcagagcacacugguagggagaucguagauuuaaugugucaugcgacuuuuacgaugagauuacucucuccgguccgaguuccaaauuacaaucugauaauuauggaugaggcacauuuuacagauccagcaucgauagccgcccgagguuauauaucaacucgaguagaaaugggcgaagcagcuggaauauuuaugacugcaacgccuccuggaagucgagacccguuuccacaaucgaaugcgccuauaauggaugaagagagagaaauuccagaaaggaguuggaacuccggacaugaaugggucacugacuuuaaagggaaaaccgucugguuuguuccaaguauuaaagcagguaaugauauagcagcauguuugcgcaagaauggaaagaaagucauacagcugagcaggaagaccuuugauagugaauauguaaaaacacgcgcaaaugacugggacuucgugguaacaacggauaucucagagaugggugcuaauuucaaggcagaaagaguaauugacccucgacgauguaugaaaccuguuauauuaacagauggagaagaacgaguaauucucgccggaccaaugcccguuacccauaguuccgcagcacaacguagaggcagaaucggaagaaaccccaaaaaugagaacgaucaguauauuuacaugggcgaaccguuggaaaaugaugaagacugcgcccauuggaaagaagcuaaaaugcugcuggauaauauaaauacacccgaaggaauaauaccaucaauguucgagccagaaagagaaaaaguagaugcaauugauggggaauauagauuaaggggugaggcgaggaaaacuuuuguggauuuaaugcgacguggggaucuaccggucuggcuagccuauaagguugcugcagaggggauaaauuaugccgauagaaaaugguguuucgaugguaucaaaaauaaucaaauuuuggaagaaaauguggaaguagaaaucuggacuaaagaaggcgaaagaaagaaacuaaaacccagguggcuggaugccagaauuuacucagauccacucgcgcuaaaggaauuuaaggaauuugcggcugggagaaaaucauuaacauugaacuugauaacagagaugggacgguugccuacauucaugacacaaaaagcuagaaacgcguuagacaauuuagcaguauuacauacagcagaagcaggagggagagcguacaaucacgcucuaucugaacuaccggagacacuagaaacacucuuacuauuaacacuacuugcaacuguaaccggagguauuuuccuuuuccuaaugucagggaaaggaauugggaaaaugacauuagguauguguugcaucaucacagcuaguguuuuacuaugguacgcacagauacaaccccauuggaucgccgcgucgauaauuuuagaauuuuuccucaucguucuguugauacccgagccugaaaaacagcgaacaccgcaagacaaccagcucacguauguaguaauagccauuuuaacagugguggcugcaacaauggcgaaugaaaugggcuuucuugagaaaacuaagaaagauuuagguuuaggaucgauuacgacacaagaaucagaaucgaacauccuagauauagacuuacgaccggccucagccuggacauuauacgcuguagccacgacauuugugacuccuaugcugagacauuccauagagaacaguucgguaaaugucagucuaacagcaaucgcuaaccaagcgacuguccuaaugggccuaggcaaaggauggccccuaucaaaaauggacauaggaguaccauuauuggccauuggaugcuauucccaggucaauccaauuacuuuaacagcagcucuccuauuauugguggcacacuacgcuauaaucggaccaggauuacaagcuaaagccacccgagaagcacaaaaacgcgcagcagcggguauaaugaaaaauccaacaguugacggaauaacgguaauagacuuggaaccaauaccauaugauccaaaguuugaaaaacaguugggacagguaauguuacugauauuguguguaacacaaguacuaaugaugcgaaccacaugggcauuaugugaagcacuaacguuagcgacaggucccauaagcacauuaugggaagguaacccaggaagauuuuggaacacaacaauagcaguaucaauggccaauauuuuuaggggaucauacuuggccggugccggcuuauuauucucuaucaugaaaaacaccacuaauacacgaaggggaaccggcaauauaggagaaacuuugggagaaaaauggaaaagccguuuaaaugcucuaggaaaaagcgaguuucaaauauacaagaaaucaggcauccaagaaguagaucgaacucuagcaaaagaagguaucaaacgcggagaaacugaucaucaugcaguaucacgcggaagcgcuaaacuucggugguucguggaaagaaacauggucacaccugaaggaaaagucguagaucuaggaugcggacguggcggcuggucguacuacugugguggacuuaaaaacguacgagagguaaaaggucuuacuaagggaggcccaggacacgaagaaccgauaccaaugaguacguacgguuggaaucuuguacgucuacaaagcgguguugacguauucuuuacuccaccugaaaaaugcgacacacuguuaugcgauaucggagaaucuaguccaaacccgacuauagaagcuggaaggacucuaaggguacugaaucugguugagaacugguugaacaacaauacacaguuuugcauuaaaguacuaaauccguauaugccgagcguaauugagaaaauggaaacauuacaacggaaauacgguggggcuuuaguacgaaacccacuaagccggaacucuacucaugagauguacugggucaguaaugcgacaggcaacauaguuaguaguguaaacaugaucucucguaugcuuauaaaccguuuuaccaugaaacauaaaaaggcgacguaugagccagauguagaucuagguagugguacccggaauauuggaaucgaaagugaaauacccaauuuagauauuauaggaaagcgaauagaaaagauuaagcaagaacaugaaaccucuuggcauuaugaccaagaucauccauacaagaccugggcauaccaugguucuuacgaaacuaagcagacaggaucugcaagcucuaugguuaacggcgucguaagauuauuaacuaagccaugggacguggugccuaugguaacgcagauggcuaugaccgacacgacucccuuuggccaacaaagaguuuucaaagaaaaaguggacacccguacgcaagaaccgaaagaagguacgaagaaauugaugcgcauuacagcugaaugguuauggaaggaacuggggaagaagaaaacgccacguauguguacgagggaagaauuuacacguaaaguaagaagcaaugcagcguugggugcuauauucacagacgaaaacaaauggaagucugcccgggaggcgguagaagauggccgguucugggaacuuguggacaaagaaagaaaucuacauuuagagggaaagugcgaaacaugcguuuauaacaugaugggaaagcgagagaagaaauugggggaauuuggaaaggccaagggaucaagagcgauuugguauauguggcuaggggcgagauuucuagaguucgaagcacuuggguuucucaaugaagaccacugguuuaguagaggaaauucauuauccggaguugaaggagaaggacuccaccgauuaggcuauauucugcgagauguaggcaaaaaggagggaggagcaauguaugcugaugauacagcaggaugggauaccaggauuacacuagaagaccuaaagaaugaagaaaugguuacaaaccacaugaaaggggaacauaagaaauuagcagaagcaaucuuuaaauuaacuuaucaaaauaaaguagugcggguacaacgaccaaccccacggggaacaguuauggauauaaucagucgaagggaccaaagaggaaguggacaagucggaacauauggauuaaauacauuuaccaacauggaagcacaacucaucaggcaaauggaaggagaaggaauuuucaaaagcauacaacauuuaaccgcaacagaagaaauagccgugcaaaauuggcuagcgagaguuggaagagaacguuugucuaggauggcuauuucgggagacgauuguguugugaaaccaauugacgauagauuugcaucugcuuugacagcauugaaugauauggguaaaguaaggaaggauauacagcaaugggaaccaucacgaggauggaaugauuggacucaagucccuuucugcagccaucacuuccaugaacuuguuaugaaggauggcagaguucuuguaguucccugccgaaaucaagaugagcuuauugggagagcacggauaagccaaggggcuggcuggucgcugaaagaaacagccuguuuaggcaaaucuuacgcccaaauguggacauuaauguauuuccacagaagagaucuuagacucgcagcaaaugcuauauguagcgcaguucccucucauugggucccaaccucucgaaccacuuggucaauacacgcaaaacaugaauggaugacaaccgaagauaugcuagccguguggaauagaguguggauacaagaaaauccauggauggaggacaaaacuccuguggaaucgugggaagaaguuccauaccuuggcaaacgagaagaccaaugguguggaagccuuaucggucucacuagccgagcaacgugggcuaaaaauauacaaaccgcaaucaaccagguccguagccuaauagggaaugaggaauacacagauuauaugccuaguaugaagagguuucgaagagaagaggaggaagccggagugcugugguaa

SEQ ID NO: 22940 - RNA, 9876 nt, Artificial Sequence
  derived and/or modified CDS sequence (opt6) from DENV-2__HQ332185__SS-prME
acugcugguguuauaaucauguuaauacccacagcuauggcauuccaccugacaacgcgaaauggugaaccucauaugaucgucggacgacaagagaagggaaaauccuugcuauucaaaacagaggacgggguaaauaugugcacuuuaauggcuauagauuuaggugaacuaugugaggacaccauaacuuacaaauguccuuuguugagacagaacgaaccggaagauauagacuguugguguaauucaaccucaacguggguuacuuaugggacgugcacuacgacuggagaacacagaagggaaaaacgaucaguagcauuggucccgcacgugggaaugggucuggagacaagaaccgaaacauggauguccucugaaggugccuggaaacauguucaaagaaucgaaacguggaucuuacgacacccuggcuuuaccaucauggcggcaauacuagccuauaccaucgggacuacgcauuuucaacgagccuugaucuucauucuucuaacugcaguagccccaucuaugacuaugagaugcauuggcauuucgaacagggacuucgucgagggagugucuggugggaguuggguugauaucguauuagaacacgguucauguguaacuaccauggccaagaauaagccgacucuggauuuugagcuaauaaaaacugaagcaaagcaaccugccacccuuaggaaauauuguauugaagcaaaauuaacaaacacaaccacugaaagcagaugcccaacacagggagagccaagucuaaaugaggaacaggacaaacgcuuuaucuguaagcauagcauggucgauagagguugggggaauggcuguggacuauuuggaaaagguggaauaguaacuugugcuauguucacuugcaaaaaaaauauggaagguaagguagugcaaccggaaaauuuagaauauacgauaguuauaacgccgcauucaggggaagaacaugccguugguaacgauacaggaaaacacggaaaagagauaaagaucaccccucaaucuaguauaacagaagcggaacuaacuggauauggaaccguaaccauggaaugcaguccacgcacaggcuuagacuuuaacgaaaugguauuacuucaaauggaggacaaggcauggcuugugcaccgccagugguucuuggaucuaccguuaccuuggcucccaggcgcagacacucaaggcuccaauuggauacaaaaggaaacccuuguuacuuucaaaaauccacacgcaaagaagcaggauguagucguuuuaggaucgcaggagggcgcaaugcauacugcuuuaacaggugcuaccgaaauucaaaugaguucugggaaucuacuuuuuacuggacacuuaaaaugucgauugagaauggacaaguuacagcugaagggaaugagcuacagcauguguacgggcaaauuuaagauugucaaagagauagcagagacucaacacggaacuauaguaauacgaauacaguacgagggagacgguucuccauguaaaauuccuuucgaaauaaccgaucuugaaaaaaggcaugucuuaggucgguuaauuacaguaaauccuauuguaauugaaaaagacagcccggucaauauagaagcggaaccaccuuuuggugacucauacauuauuauaggaguugagcccggccaauuaaagcuaaauugguuuaaaaaaggaucuucaaucgggcagauguucgaaacaacaaugagaggugcuaaaagaauggcaauauugggggacacggcuugggauuuuggaagucuaggaggcguauuuacuucaaucgguaaagcguuacaucaaguauuuggagcaauauauggggcugcauuuucuggcguauccuggaccaugaaaauuuuaauugguguaguaauuaccuggauagguaugaauucucggucaacaucuuugucagucagccucguuuuggucggaguagugacauuauauuuaggcgcgauggugcaggccgauucuggauguguggucuccuggaaaauaaaagagcuaaaaugcggcuccggcaucuucauaaccgacaacgugcauaccuggacagaacaauacaaguuucaacccgaaucuccuucaaaacuggcaucagcaauucaaaaggcccaugaagaaggcauuugugggauaaggucgguaacuagacucgagaaccuaauguggaaacagauaaccccugaacugaaucauauacugucugaaaacgaaguuaaguuaacgauuaugacaggagacacgaaaggaauaaugcaagcggggaaacgaagccuaagaccacaaccaacagaguuaaaauauucauggaaaacaugggguaaggcaaaaaugcuaucaacagagucccauaaccagacauuucucauagauggaccugaaacagcagaauguccuaauacgaaucgagcauggaauucauuggagguagaagauuacggcuucggaguuuucacaacgaauaucuggcucaaacuaagagaaaaacaagacguauucugcgauaguaagcuuaugucagcggcaaucaaaaauaaccgagcaguccacgcugacaugggauacuggauagaaagcgcauuaaaugacacauggaaaauggaaaaagccagcuuuauugaaguaaaaaguugccacuggcccaaaagucacacauuauggucaaacgguguccuugagucugaaaugauaaucccaaagaauuucgccggccccguaucccaacauaacuauaggcccggauaucacacacagaccgcggggccuuggcaucuagggaaauuggaaauggauuuugauuuuugugaagguacuacugucgucguaacugaagauuguggaaaucgugguccaucucuuagaacuaccacagcaagcggcaaacuuauuacagaauggugcugucgcucauguacacugccaccguuacgauauagaggagaagacggauguugguauggaauggagauuagaccucuaaaagagaaagaagaaaauuuaguaaacucguugguuaccgcaggacauggucaaauagauaauuucagcuuaggcgugcucggaauggcacuuuuccuugaggaaaugcuuagaacuagaguaggaaccaaacaugcgauucuucuaguagcugucucauuuguaacauuaauaacaggaaauaugucguuucgagaucuagguagaguuaugguaauggucggagcuacaaugaccgaugacauuggcauggguguuacuuauuuagcacuauuggcugcauucaaggucaggccuacuuucgcagcugguuuacuucuaagaaaauuaaccaguaaggaauuaaugauggcaacaauuggaauaacguuacuuagucaaucuacaauaccagaaacuauuuuagaacuaacagacgcacuggcucuaggaaugauggugcuaaaaauuguacguaacauggagaaauaccaacuagccguaacaauuauggccaucucaugcgucccaaaugcgguaauccuacggaaugcauggaaaguaucgugcacgauauuagcggcaguaagcguaaguccccucuuauuaacuaguucacaacaaaaggcagacuggauuccgcuagcauuaacaauaaaaggccucaauccaacugccauauuucuaacuacccucucacgcacauccaaaaagcgaagcuggccauugaaugaagcaaucauggcaguuggaaugguaucgauccucgcaucaaguuuauuaaaaaaugauaucccaaugacaggaccuuuaguggccgguggacuacuuaccguauguuauguucuaacgggacgguccgcagauuuggaacuagaaagagcagccgacguuaaaugggaagaccaagcugaaauaagcgguaguucgcccauccuuagcauaacuauuagugaggaugguuccaugucaauuaaaaaugaggaagaagaacagacccuuacaaucuuaauucguacaggauugcuuguaaucucgggaguuuuuccaguaucuauuccuauuacggcggcagcuugguacuuaugggaaguaaaaaaacaacgugcagggguacucugggacgugccaagcccaccaccaguugggaaggccgaacucgaagacggcgccuacagaauaaaacaaagaggcauauuggguuauucacagauaggugcagggguauauaaagagggaacguuccauaccauguggcaugugacacgcggagcugucuuaaugcaucgaggaaaaagaauugagcccagcugggcagacgucaagaaagacuuaauuuccuacggaggcggauggaaacuagaaggugaauggaaggaaggugaggaaguacaaguacuagcacuagagcccggaaaaaauccacgcgccguacaaacgaagcccggaauuuucaaaaccaauacuggaacaauaggcgccgugucccuggacuucuccccaggaacuaguggaaguccaauaguggaucgaaaaggcaaaguaguuggucuauacggaaauggaguaguuacacgauccggcgcauauguaucagcaauugcccaaacagagaagucaauugaagauaauccagaaauagaagaugauaucuuccgaaagaaaagguuaacgauuauggacuuacaucccggggccggcaagaccaaacguuauuuaccggcuauaguaagggaagcgaucaaaagaggacuuaggacguuaauacuagccccaacaagagucguggcugcagagauggaagaggcauuacguggucucccuauacgguaccagacuccugcaauuaaagcugaacauaccggaagagaaauuguugaucuuaugugucaugcaacguucacaaugcgauugcugucaccugucagggugccuaacuauaauuuaaucauaauggacgaagcacauuucacggauccagcgucaaucgcagcacgaggguacaucuccacgaggguugagaugggcgaagcggccggaauauucaugacugccacuccgccaggaucgagagacccuuucccccagucaaaugcaccaaucauggaugaggagagagaaaucccagaaagaaguuggaauuccggacacgaauggguaacagauuucaaaggcaaaacgguuugguuuguaccaucuaucaaagcugggaaugacauugcagcauguuugagaaagaauggaaaaaaggucauucaguuaagccggaaaacauucgacucggaauacguaaaaacacgagcuaaugacugggacuuugucguaacuacggauauaagugaaaugggagcuaacuucaaagcagaaagaguuauagauccgcggagauguaugaaaccgguaauccuaacagauggagaggaacggguaauccuagcagggccuaugccaguaacgcauaguagugcagcucaaaggcguggucggauagguagaaacccuaaaaaugaaaaugaccaguacauauacaugggugaaccauuagaaaacgaugaagacugugcgcauuggaaagaggccaaaauguuacuugacaacauuaauacuccagaaggaauaauuccuucaauguuugaacccgaaagagaaaaaguagacgcaauagauggcgaauaccguuuacgaggggaggcaaggaaaacguuuguggauuuaaugaggcguggagaucucccuguuuggcuagcauauaaaguagcugcggaaggcauaaauuacgccgacaggaaguggugcuuugauggaauaaagaauaaccaaauacuagaagaaaacguagaaguagaaauauggaccaaagaaggugaaagaaagaaauuaaaaccuagguggcuagacgcaaggauuuauagugauccucucgcacugaaagaguucaaagaauuugcagcuggccgaaaaaguuuaacacuaaaccuaauaaccgagaugggacguuuaccuacguucaugacccaaaaagcaagaaaugcacuagauaaucucgcgguacuucauaccgccgaggcuggagggagggcguauaaccaugcacuauccgaacuuccggagacacucgaaacauuacuuuuauuaaccuuacuggcgaccguuacuggugguauuuucuuguuccuaaugucgggcaagggaauagguaagaugacccuuggaauguguugcauaauaacugcuucugugcuguuaugguacgcgcaaauucaaccgcauuggaucgcugcaagcauuauacuagaauuuuuuuuaauaguauuacuuauaccugaaccagaaaaacaacguaccccacaagauaaccaauuaacguaugucgucauugcuauauugacaguagucgcugccacuauggcgaacgaaauggguuuucuggaaaaaacuaagaaggaucuugguuugggaagcaucaccacacaggagucagagaguaauauuuuagacaucgauuuacggccagcauccgcauggacguuguaugcuguugccacuacuuucguuacuccaauguuaagacacaguauugaaaauaguaguguaaauguuagcuugacagcuauugcuaaucaagcaacaguacuaaugggucugggaaaaggcuggccacuaucaaaaauggauauaggugugccauuacucgcuauaggguguuauucccaaguaaauccuauuacacuaacugcugccuugcuauugcuaguagcacauuaugccauuauaggaccaggacugcaagccaaagcuaccagagaggcccaaaaaagagccgcagccggcauuaugaagaaccccacaguggaugguauuaccguaauugaucuugaaccaauuccuuaugauccaaaauucgagaaacaacugggacaggucauguugcucauccugugcguuacgcaaguacuaaugaugcggaccacaugggcucucugugaagcacuuacacuagcgacuggacccaucagcacauugugggaaggcaacccggggagguucuggaacacuacuauugcagucucuauggcaaacauuuuuagaggcucauaucuggcuggagcgggacuucuauuuagcauuaugaaaaauacgacgaacacaagacgagguacuggaaauaucggugaaacucuaggagaaaaauggaaaucaagguugaaugcacucggaaagagcgaauuccaaauauauaagaaaagcgguauacaagaaguugacaggacccuagcuaaagaagguauaaaacggggagaaacugaccaccaugcagugucgagagguucagcgaaguuacgcugguuuguggaacgaaauaugguuacaccagaaggcaaaguagucgaccuggguugugguagagguggguggucauacuauugcggaggucugaagaauguuagagaagucaaaggacuuacgaaggggggucccggccacgaagaacccauaccaaugaguacauacggguggaaccucguucgucuccagucagguguggacguuuuuuuuacaccgccugaaaaaugcgauacuuuguuaugugauauuggggaaaguucaccaaauccuacaauagaggcagguaggacuuuaagaguucuaaacuuagucgaaaauuggcuaaacaacaauacacaguuuuguauuaaagucuuaaauccguacaugccaucggucauagaaaaaauggaaacucuacaaagaaaauaugguggggccuuaguucgcaauccacuaagcaggaauuccacacacgagauguauuggguaaguaacgcuacggguaacauaguuucgucagucaauaugaucagcaggaugcugauaaaccgauuuacuaugaaacauaaaaaagcaaccuacgaaccagauguugauuuaggaagcggaacacggaauauagguaucgaaucggaaauaccuaacuuagacauuauuggaaaaagaauugaaaagauaaaacaagagcacgaaacgucauggcacuaugaucaggaccauccuuauaaaaccugggcauaccacggaagcuaugaaaccaagcagacaggaucugcgucuaguaugguuaaugggguuguaagacucuuaacgaaaccuugggauguagucccgaugguuacgcaaauggcuaugacugauacaacuccauuugggcagcagcgaguguucaaggaaaaagucgacacgcgcacacaggaaccuaaagaggggacuaaaaaacuaaugagaauuacggccgagugguuguggaaagagcucggaaaaaagaaaacgccgagaaugugcaccagagaagaauuuacccgcaaaguucguucuaacgcagcgcuaggugcuauuuuuaccgaugaaaauaaauggaagagcgcaagggaggcaguagaggacggaagguuuugggaacuaguggauaaagaacgaaacuuacauuuagaaggaaaaugugaaacauguguuuacaacaugaugggcaaacgggaaaaaaaacuuggagaauucggaaaggcuaaagggagucgagccauaugguauauguggcugggcgcuagauuucuugaauuugaagcauuagguuuuuuaaaugaagaucauugguucucaagaggaaauucguuaucagggguagagggagaaggccuucaucgauuagguuauauucuaagagacguaggaaagaaagaagggggagcuauguacgcagaugauacagccggcugggacacaagaauaacacuagaagaucugaaaaacgaagaaaugguaaccaaucauaugaaaggugaacauaagaaguuagcagaagcaauuuuuaaauugacauaucaaaauaaagugguaagaguucagagaccgaccccuagagggacaguaauggacauaauuucaaggcgagaccagagagguucaggacaaguuggaacguauggccugaauacauucacaaauauggaagcacaacuuauaagacaaauggaaggugaggguauauuuaagagcauucaacauuugacagcgacagaagaaauagcuguucagaauugguuagcaagagucggcagagaacgcuugucuagaauggcaauuaguggagaugacugugugguaaagcccauagaugacagguuugcuucugccuugacagccuugaacgauaugggaaaaguacgaaaggacauucaacagugggaaccgucaagaggauggaacgacuggacccaagugccauuuugcagucaucacuuccaugaauuggucaugaaagauggccgaguauuaguaguaccuuguagaaaccaagacgaauuaaucgguagagcuagaauaagucaaggagcuggcuggucacuaaaagaaacagcgugucugggaaaaucauaugcacagauguggacguugauguauuuucaccgcagagaccugcgauuagcagcaaaugcgauuugcagugccgugccgagucacuggguaccaacaagccggacaacuuggucuauacacgccaaacaugaauggaugacuaccgaagacauguuagcuguguggaauagaguuuggauacaggaaaauccauggauggaagacaagaccccaguggaaaguugggaggaaguuccauacuuggggaaacgugaagaucaaugguguggaucacuaauaggauugacaucuagagccaccugggcaaagaauauacaaacggccauuaaccaaguaagaagccuuauaggaaaugaagaauauacagacuauaugcccucaaugaagcgguucaggagagaagaggaagaagcuggagugcuaugguaa

SEQ ID NO: 22941 - RNA, 9876 nt, Artificial Sequence
  derived and/or modified CDS sequence (opt6) from DENV-2__HQ332186__SS-prME
acggcuggaguaauaguaaugcuaauuccgaccgcaauggcauuucauuugacuacgcgaaacggagaaccucacaugauagucggacggcaggaaaaaggaaaaucucuuuuauuuaaaacugaagacggaguaaacaugugcacgcuaauggcaauugauuugggggaauuaugcgaagacacuauaacguauaaaugcccguuguuacgccaaaaugaaccagaagauauagauuguugguguaacucaaccuccacauggguaacguacgguacuuguacaacaacuggugaacauagacgagaaaaacggucaguugcuuuagucccucacguaggaaugggauuagaaacuaggacagaaacuuggaugucuagcgaaggagcauggaaacacguacaacgaauagaaacguggauacuaagacauccagguuucacaaucauggcagcgauacuagcauauacgauugguacaacucauuuucaacgggcauuaauauuuauauuauuaacugcuguagcuccaucgaugacaaugcgcuguauaggaauuucaaacagagacuucgucgaaggugugucuggugguagcuggguugacauaguuuuagaacacggaucauguguuacuacgauggcgaaaaauaaaccaacauuagauuuugaauuaaucaaaacagaagcaaaacagccugcgacguuaagaaaauacugcaucgaagcaaaacugacgaauacgacaacugaaucgcgcugcccgacacaaggcgaacccucuuuaaaugaagaacaggauaaaagauuuauuuguaaacauagcaugguugacagaggguggggaaauggcuguggauuauuugggaaaggaggaauaguaacaugugcuauguucacuugcaagaaaaacauggaaggaaaagugguacagccugaaaauuuagaauauacaauagucaucacuccgcauucuggugaagaacaugcuguaggaaaugauacaggcaaacacgguaaagaaauuaaaauaacaccucaaaguucuauuacggaagccgaauugacuggauacggaacuguaacgauggagugcaguccaagaacaggucuagauuucaaugaaaugguucugcuacaaauggaagauaaagcauggcuaguacaccgccaaugguucuuggaucuaccucuuccuuggcuaccuggugcugauacccaagguucaaauuggauucagaaagaaacauuaguuacauucaaaaacccgcacgcuaagaaacaggauguuguuguacuuggaagucaagaaggugcuaugcauacagcccugacuggggccacggaaauucaaaugucgagcggcaauuuacuauuuacaggucacuuaaaaugucgucuuagaauggacaaacuacaacuaaaggggaugucauacagcaugugcacaggaaaguucaaaauaguuaaggaaauagcugagacacagcacgggacuauaguaauucgcguacaauaugaaggagaugguaguccgugcaaaauaccguuugagauaacagaccuagaaaaacgacauguacuggguagacuaauaacaguuaacccaaucguuauugaaaaagauagucccguaaauauagaagcugaaccuccguucggugauucuuauauaauuaucgggguugagccaggccaauuaaaauuaaauugguucaaaaagggguccaguauuggucaaauguuugaaacgacaaugagaggcgcaaaaagaauggcuauacuaggugauacugcaugggauuuuggcagucuaggagggguauuuacguccauugguaaagcauugcaucaaguauuuggagcuauauacggagccgcauuuucagguguuucguggacaaugaaaauauuaauaggggugguaauaacuuggaucggcaugaacuccagaaguacaaguuugaguguaucucuugugcuaguuggaguaguaacacucuaccuaggagcuaugguucaagcggauucagggugcguagucucauggaaaaacaaggaauuaaaaugcgguucaggaauuuucauuacugacaauguacauacauggacagaacaauauaaguuucagccggagucuccgucuaaacuggcguccgcaauacagaaagcacaugaagaggggauaugugggauaagaucuguaaccagacucgagaauuuaauguggaaacaaauaacgccagagcuaaaccauauucuaucagagaaugagguaaaauuaaccaucaugacuggagauacaaaggggaucaugcaggccgguaagcgaucauuacgaccacagccuacagagcuaaaauacaguuggaaaacguggggaaaagcgaagauguuaaguaccgagucucauaaucagacauucuuaaucgacggaccugaaacugcugaguguccgaauacuaaccgggcuuggaacaguuuagaaguagaagacuauggauucggaguuuucacuacgaauaucugguugaaacuaagggaaaaacaagacguauuuugugacaguaaauugaugucagccgcgauaaaagacaauagggcuguacacgcagacauggguuauuggauagaaucugcccuaaaugauacuuggaaaauggaaaaggcuaguuucauagaaguuaaaaguugucacuggcccaagagccauacauuuuggucaaauggggucuuggagucugaaaugauuauacccaaaaauuuugcugggccgguuagucagcauaauuacagacccgguuaucauacacaaauugccggccccuggcaucuugguaaauuagagauggacuuugauuucugugaggggacgacaguuguaguuacggaagacuguggcaacagagggccaucucuuagaacgacaacggcuuccggcaaacugauuaccgaaugguguugcagauccugcacacugccgccucuaagauaccggggugaagacggauguugguauggcauggaaauaagaccuuuaaaagagaaagaggaaaaccuugugaauagccuaguaaccgcaggccacggacaaauagauaauuucuccuuagguguguuaggaauggcccuuuuucuagaagagauguuaagaacgcgcguaggaacaaaacacgcuauucuauuaguugccguaucguucgugacccuuauaacugguaauaugagcuuucgagaucuaggucgugucauggucaugguaggugcgacaaugacagaugauaucgggaugggagugacauaccuugcauuguuagcagccuucaaagugagaccuacauucgccgccgguuuauuauuacguaaacuaacaucuaaagaauuaaugauggcgacaauuggaauaacauuauugagucagaguacgaucccagaaacuauauuagaacugacggaugcguuagcacuagggaugaugguauuaaaaauuguacgcaacauggagaaauaucaacuagcaguaacuauaauggcuaucagcuguguuccuaaugcagucauacucagaaaugcguggaagguuaguuguacgauacucgcggcuguaucuguuagcccauugcuacuaacauccagccaacagaaagcagacuggauaccacuggcuuuaacgaucaaaggacuuaauccaacugccauauuuuuaacuacgcugucacguacaaguaagaaaaggagcuggccacuaaaugaagcaauuauggcuguaggaauggugucuauauuagcauccucauuauuaaagaacgauauaccgaugacagguccuuuaguagcgggagguuuacuuacagucugcuauguauuaacaggaagaagugcagauuuagaauuggaaagagcagcugaugucaaaugggaggaccaagcugagaucucuggcucuagcccuauacuaucaauaaccaucucagaagacggaucaauguccaucaaaaaugaggaagaggaacagacauugaccauucuaauaagaacaggacuauuaguaauuucuggcguuuuucccguauccauaccgauuaccgcagcagcuugguaccugugggaaguuaaaaagcagcgugccggagucuugugggaugucccuucaccuccuccaguggguaaagcagaguuagaagauggugccuaucgaauaaaacagcgagguauccuaggcuauagccaaauaggagcaggaguguauaaagaaggaacuuuucauaccauguggcacguaaccagaggcgcggucuugaugcauagaggaaagagaauagaaccuaguugggccgacguaaagaaagauuugauuucuuauggcgggggauggaagcuagaaggugaauggaaagagggagaagaagugcaaguacuagcucuggagccuggcaaaaauccgagagcgguacaaacuaaaccugggauauucaagacuaauacagguacgauuggagcaguuagucucgauuuuaguccaggaacauccggcucaccaaucguagauagaaaaggaaaaguaguuggauuauacgggaauggaguggugacuaggucaggugccuacguaagcgcgauagcgcaaacagaaaaaucgauagaagauaaccccgaaauugaagaugacauauucaggaagaagagguugacaauaauggauuuacauccaggcgcaggaaaaaccaagcguuaucuaccagcgaucguucgagaagcuauaaaacguggauuacgaacuuugauauuagcaccuacuaggguuguagcagcugaaauggaagaagcacugcgaggauuaccgauacguuaucaaacuccugcaaucaaggcagagcauacuggaagagaaauaguagaccuaaugugucacgcuacauuuacuaugagguuauuaucucccguacgaguucccaacuauaaucuaauuaucauggacgaagcacauuucacggauccagcuucaauagcagcucgagguuacauuucgacuagaguagagaugggugaagcugcaggaaucuucaugaccgccacaccucccggaucacgugacccauuuccucagucaaaugcaccuauaauggacgaagaacgagaaaucccagaacgaagcuggaacucuggucaugaauggguaaccgacuuuaaagguaaaacaguuugguucguaccgaguauuaaagccggaaaugauauagcggcaugcuuacgcaaaaacggaaagaaagugauucaauuaaguagaaaaacauucgauucagaauaugugaaaacuagagcuaacgauugggauuuuguugucaccacagauauaucugagaugggagcuaacuuuaaagcagaacguguuauagauccacguagaugcaugaagccaguuauacucacagacggggaggaacgcguuauacuagcaggaccaaugccagugacacauaguagcgcagcgcaacguagaggacgaaucggaagaaaucccaaaaaugagaaugaucaauauauuuauaugggagagccacuagaaaaugaugaagacugugcgcauuggaaagaagccaaaauguuauuggacaauauuaauacaccugaagguauaauuccaaguauguuugaaccagagcgagaaaaagucgaugcuauugauggcgaauaucguuuacgcggagaggcccgcaaaaccuuuguugaucuuaugaggagaggugacuugccaguauggcuagcuuauaaagucgcagcagaaggaauaaacuacgcagacaggaaauggugcuuugauggaauuaaaaacaaccaaauuuuggaggaaaacguggaagucgaaauauggacaaaggaaggggaacgaaagaaacuuaaaccccgguggcuagacgcacggauauauagugauccgcuagcacuaaaagaguucaaagaguucgcggcgggaagaaaaagucucacacucaaucuaauuacugagaugggaagauuaccaaccuucaugacucaaaaagccagaaaugcauuagauaacuuagcaguucuucacacagcagaggcgggagguagagccuacaaucaugcauuaagcgaauuacccgaaacacucgaaacauuacuacugcuuacauugcucgcaaccgucacagggggaauauuucuguuuuugaugagcggcaaaggaauuggcaaaaugacacuuggcauguguugcauuauuacagcuucuguucuucuaugguacgcacaaauucagccgcauuggauagccgccucuaucauauuagaauuuuuccuaauuguauuacucauuccugaaccagagaaacaaaggacgccccaagauaaucaauuaacauaugucgucauagcaauauugacggucguugcagccacaauggcaaacgaaauggguuuucucgagaaaacgaagaaagauuuaggauuaggaucuauaaccacucaggaacccgagucgaacauacuagauauagaucuuagacccgcuuccgcauggacgcuauaugcugucgcaacuacuuucguuacgccgaugcuacgucauaguauagaaaauucaucaguaaacgucucauuaacagcgauagcuaaccaggcgacugugcuaaugggucuggguaaagguuggccauuaagcaagauggauauaggcguaccuuuacucgcuauaggaugcuacucccaggucaacccuauaacacuuaccgcagcacugcuacuccuaguugcucacuaugcgaucauagguccaggccuacaagcgaaagcuacaagagaggcacaaaaacgggcagccgcagguaucaugaaaaauccuaccguagacggaauaacaguaauagaucucgaacccauaccauaugaccccaaauuugaaaaacaauuagggcaaguaaugcuccugauauuaugcguaacccaaguacuaaugaugcgaacgacuugggcuuuaugugaagcguuaaccuuggcuaccgguccaauauccacucuaugggaagggaauccuggaagauuuuggaacacaacaauagcugucucaauggcuaacauauuucgcggcaguuacuuagcgggugcagguuuacuguuuagcaucaugaaaaauacaaccaacaccagacgagguacagggaauauuggagaaacacuaggagaaaaguggaagucacguuuaaaugcccuagguaaaucagaguuccaaauuuacaaaaagucaggaauacaggaaguagaucgcacacuagcuaaagaaggaauuaaaagaggugaaacugaucaccacgcagugucgcgcggaagugccaaguuacguugguucguugaaaggaauauggucacaccugaaggcaaaguaguugaucuaggaugcgggagagguggauggucauauuacugcggcgggcuuaaaaauguccgugaagucaaaggacuaacuaaaggugggccaggccaugaagaaccgauaccuauguccacauauggguggaaucuaguuagacugcaauccggaguugacguauuuuucaccccaccagaaaaaugugauacgcuucuaugugauauuggagaaucaaguccgaacccuacgauugaagcaggaagaacccuacgaguauuaaacuuagucgaaaauuggcugaauaauaacacccaauuuuguaucaagguuuuaaaucccuauaugccgagcguuauugaaaagauggaaacucugcagagaaaauacggcggugcccuaguucggaauccuuugucaagaaacaguacccacgaaauguauuggguaagcaaugcgacaggaaauauagugaguucuguaaauaugauaucccgaauguugauaaaucgauuuacaaugaaacauaagaaagcuacauacgaaccggauguagaccuggguagugguacacguaauauugguauagagucugagauaccgaaccuggauauuauagggaagcgaauagagaaaauaaagcaggaacacgagacaucauggcauuaugaccaagaucacacauacaaaacuugggcauaucaugguagcuaugagacaaaacaaacaggaucagcuucaucaauggugaacggggugguacgucucuuaaccaagccgugggacguaguaccuauggucacccaaauggcaaugacagauaccacgccauuuggucaacagaggguguuuaaagagaagguggauacgagaacucaggaacccaaggaagguacaaagaaacuaaugaggauuacggcugaaugguuauggaaagaauuagggaaaaagaaaacaccaaggauguguacgcgagaagaauuuacucgaaagguacgaaguaacgccgccuuaggggcuauuuucaccgacgaaaacaaguggaaaagugcacgugaagccgucgaagacggacgauuuugggagcuaguugaccgcgaaagaaaucuacaucuugaagguaaaugcgaaacgugugucuacaauaugaugggcaaaagggaaaagaagcugggagaauuugguaaagccaaggggagucgugcgauaugguacauguggcuaggugccagguuccuagaguucgaagcauuaggguuucuaaaugaagaucacugguucucuaggggaaacucccucuccggaguugaaggagaaggauuacacaggcuaggauauauacugagagacgugggcaagaaagagggcggugcuauguacgcugacgacacggccgguugggacacacgaauuacauuagaagauuuaaagaaugaagagaugguuacuaaucauaugaagggagagcacaagaaacuagcagaagccaucuuuaaauugacguaccaaaauaagguaguccgagugcaacguccaacaccgagaggcacgguaauggacauaaucagccgaagagaucaacgagguaguggacaaguaggcacuuauggacuuaacacauuuacgaauauggaagcacaacuaauucgucagauggaaggugaagggauauucaaguccauacagcauuuaacaguuacggaggaaauugcgguacaaaacuggcuugcaagaguaggaagggaaaggcucucgaggauggcuauuucuggagaugacuguguuguaaaaccaauugaugauagauuugcauccgcccuuacggcucucaacgauaugggaaagguacgaaaagacauacaacagugggagccaucgagagguuggaacgacuggacacaaguuccauuuugcucacaccacuuucaugaacuuguaaugaaggauggaagagugcuagucguccccuguaggaaucaagaugaacucauagggcgagcacguauaagucaaggagccggauggagccuaaaagaaacagcaugucuaggaaaaaguuacgcacagauguggacuuuaauguauuuucacagacgagauuuaagacuagcagcuaaugcuaucuguucggcagugcccagccacugggugccuacaaguagaacuacguggucaauccaugcaaaacaugaguggaugacaacugaggauaugcucgcuguauggaauaggguuuggauucaagagaacccuuggauggaagauaaaaccccggucgagaguugggaggaggucccauaucuuggaaaacgcgaagaccaaugguguggauccuugauugggcuuacaucccgggcaacuugggcuaaaaauauucaaacugcuauuaaucaaguucggagccugauaggaaaugaagaauauacagauuauaugccaagcaugaagagauuuagacgagaagaagaagaagcuggaguuuugugguaa

SEQ ID NO: 22942 - RNA, 9876 nt, Artificial Sequence
  derived and/or modified CDS sequence (opt6) from DENV-2__HQ332187__SS-prME
acagcaggaguaauaaucauguuaauuccgacagcgauggcguuucaccuaacaacgagaaauggagaaccucacaugauaguagguagacaagaaaaagguaaaagccuuuuguuuaaaacagaagacggaguuaauauguguacccuaauggcaauagaccucggcgaacugugcgaagauacuauaacauacaaauguccacuccuacgucaaaacgaaccagaagacauugauuguuggugcaacucgacguccacauggguuacguacgguacauguacuacaacgggggaacaucguagagaaaaacgaucuguugcauuagugccacacguaggaauggguuuagaaacaagaacagaaacauggaugucuucugaaggugcuuggaaacacguacaaagaaucgaaaccuggauucuccgucauccaggauuuaccauuauggccgcuauauuagcauacacaauagguacaacucauuuucaaagagcuuuaaucuuuauauuauuaacagcaguagcaccaagcaugaccaugcguugcaucggaaucaguaaucgagacuucguagaagguguauccggugggucuuggguggauauagucuuagaacacggaaguuguguuacgacaauggccaaaaauaaaccgacacuagacuucgaauuaauuaaaacugaagcgaaacaaccagcaacauugcgcaaauauuguauagaagcaaaacucaccaacacuacaacugaaagcagaugcccaacucagggugaaccuucuuuaaacgaagaacaagauaaaagauucaucugcaaacacucaaugguggaucgaggguggggaaaugggugcgggcuauucggaaaaggagguauugugacaugcgcuauguucacuugcaagaaaaacauggaagguaaagugguucaaccagaaaaucuggaauauacgauaguaaucacgccacauagcggagaagaacacgcuguaggaaaugauacagguaaacacgguaaagaaauaaaaaucacaccucaaucaaguauaacugaagcagaacuaacagguuacgguacugucaccauggaaugcuccccuagaacaggucuagacuucaaugaaauggucuuguugcagauggaagacaaggcuugguuggugcacaggcaaugguuucuagaucugccucuaccauggcuaccgggcgcggauacgcaagguucaaauuggauucaaaaagaaacauuagucacauuuaagaacccucaugccaagaaacaagauguagugguucucgguagucaagaaggggcaaugcacacagcgcuuacgggcgccacggagauccagaugucgagcggaaauuuguuauuuacagggcauuuaaagugcagacuaagaauggauaaauuacaacuaaaaggaaugaguuacucaauguguacugguaaauuuaagauuguaaaagagauugcagagacacaacaugguacuauagucauacguauacaauaugagggagaugguagcccauguaaaauaccauucgaaauuaccgaucuggagaaaaggcauguguuagggagacuaauuacuguaaacccaauuguuauagagaaggacaguccaguuaauauagaagcagaaccaccauuuggugacucuuacauaauuaucgggguagaaccaggacaauuaaaauuaaauugguucaaaaagggaucuuccauuggccagauguuugaaaccacgaugcgaggugcaaaacgaauggcgauucuuggagacaccgcaugggacuuuggcucucugggagguguuuucacgaguaucggaaaagcauuacaucagguguucggggcaauauacggagcagcauucagcggugucagcuggacuaugaaaauauuaauuggaguaguuaucacguggauagguaugaacucaagaucaacaucacuuaguguaucccuaguccuaguuggcguagugacacucuaccuuggugccauggugcaagccgauucuggaugugucgugaguuggaaaaacaaggagcucaaguguggcucaggaauuuucauaacagacaauguacauacauggacggagcaauauaaguuccaacccgaaagcccuaguaaacucgcaagcgcgauccaaaaagcgcacgaggaaggaauuugcgggauaaggucuguuacuagacuagagaaucuuauguggaaacaaauuacuccggaacugaaccauauacuaucagagaacgaagugaagcuaacuauaaugacuggagacacaaaaggcauaaugcaagcaggaaagcguaguuugaggccccaacccacagaauuaaaguacucauggaaaacauggggaaaggcuaaaauguuaucgacggaaucucauaaccaaacauuuuuaaucgaugggccugaaacagcugagugcccgaauacaaauagagcauggaauagccuagaagucgaagauuacgguuuugguguguuuacaacuaauauauggcuaaaauuaagagagaaacaagauguuuucugcgauuccaagcuaaugagcgcggcgauaaaagacaauagagcgguucacgcggauaugggauauuggauugaaucagcacuuaaugacacuuggaaaauggagaaagcuaguuucauugaggucaaaucaugucauuggccaaaaucgcauaccuuguggucaaauggcgucuuagagagcgaaaugauaauacccaaaaauuuugccggaccgguaagucaacacaacuaucggccaggauaccacacacaaacugcaggacccuggcauuugggcaaguuggaaauggauuucgacuucugugaagguacaacuguaguuguuaccgaggacuguggaaacagaggacccagucuacgaacaacaacagcguccggaaaguuaauuacugaaugguguugucgaagcuguacguuaccaccauuacgauacagaggagaagacgguugcugguacggaauggaaauaagaccgcuaaaagaaaaagaagaaaauuuaguuaacucccucguuacugccggucacggacaaauagacaacuuuagucuagguguauugggcauggcacuauuuuuggaggaaauguugaggacccgagugggcacaaaacacgcgauucuacucgucgcagucuccuucguuacgcuaauaacugggaauaugagcuuccgagacuuaggacgagucaugguuauggugggagcaaccaugacugaugauauagggaugggcgugacuuauuuagccuuauuagcggcauucaagguaaggccaacuuucgcagcaggccuuuuauuaaggaagcuaaccucuaaagaacuaaugauggcuacaauagguauaacucuacuuucucaaaguaccauaccagagacaauauuagaauugacagaugccuuagcguuagguaugaugauuuuaaaaaucguucgaaauauggaaaaauaucagcuagcagugacuauuauggccauauccuguguuccaaacgcaguuauccugagaaaugccuggaaaguaucuuguacaauccuagcugccgugagcgugucaccacuucugcuaacuucgucacaacaaaaagcggacuggauaccgcuagcuuuaaccauaaaaggauuaaaucccacagccauuuuucugacgacacuuucucgaacgaguaaaaagcgcucauggccacuaaaugaggcaauuauggcgguuggcaugguuaguauucuagcaaguucacucuuaaagaaugacauccccaugacggggccacuuguggcaggaggucuauuaacgguauguuacguauuaacaggaaggagugcagauuuagagcuugagagagcugcagacguaaaaugggaagaucaagcggaaauaucaggaucaucacccauacuuaguaucacaaucucagaggaugguucaaugucuauuaagaacgaggaagaagaacaaacacuaaccauuuugauacgaacgggacugcugguaauuucuggggucuuuccaguaagcauaccaauaaccgcugcagcaugguaucucugggaagugaagaaacaaagagcuggcgucuuaugggacguuccgagcccaccaccggugggcaaagccgaacuggaggacggcgcauauaggauaaagcaacgagguauucucggauacucacaaauaggcgcagggguguauaaggaaggaacauuccauacaauguggcacgugacccgcggcgccguccucaugcaucgggggaaaagaauugaaccguccugggcugacguaaagaaagauuuaauuucguacgguggugguuggaaacuagaaggugaauggaaagagggugaagaaguacaaguccuagcccuagaacccggaaagaacccgcgcgcaguccagaccaaaccugguaucuuuaaaacuaauacaggcacgauaggugcagucagcuuagauuucucaccuggcacgucugguucacccauuguagacaggaaaggaaaaguagucggucuauaugguaauggggucguuacaagaucaggcgccuaugugagugccauugcacaaacugagaaaagcauugaagauaaucccgaaauugaagaugacauauuuagaaagaaaagauuaaccauaauggacuuacacccaggugcuggcaaaacgaaaagguauuuaccuguuauagugagggaagcgauuaaacgcggguuaagaacgcugauacucgcuccgacucgggucguagcugcagagauggaagaggcacuccguggauugccaauuagguaccaaacaccagcgauuaaagcagaacauaccgggcgcgaaauagucgacuuaaugugucaugcuacauuuacaaugcgguuacuauccccuguccggguaccaaacuauaaucuaauuauaauggacgaagcacauuuuacagaccccgccagcauagccgcccggggauauauuucuacacgaguggagaugggagaggcugcaggaauauuuaugacagccacgccacccggaucacgagauccguuuccacaaucuaaugcaccaauuauggacgaagaacgagaaauaccggaacgcagcuggaauaguggccacgaauggguuacggacuucaaagggaagacaguaugguuuguuccaagcauaaaagcaggcaaugauauagcugccugcuuaagaaagaacggcaagaagguaauccaauuaaguagaaaaacguuugauagugaauacgucaaaacaagggccaaugauugggauuuuguugucaccaccgauaucucagagaugggugcgaacuuuaaagccgagcgcguuauagauccuagacgcuguaugaaaccuguuauacuuacagauggcgaagaacgugucaucuuagcaggucccaugccuguaacacacuccagcgccgcacaacgucgaggacgaauaggaaggaaccccaaaaaugagaaugaucaauauauuuauaugggggaaccccucgaaaaugaugaagauugugcacauuggaaggaagcuaaaaugcuacuagacaauauuaauacgccugaaggaauuauacccucaauguuugaaccggaacgugagaaaguggaugccauagauggagaauaccgucuccgaggcgaagcaagaaagacauucguugaucugaugcgucgaggagaucucccugugugguuggcauauaagguggcugcagaagguauaaauuacgcggauagaaaaugguguuucgacgggauuaaaaacaaccaaauucucgaagaaaauguugagguagaaauuuggaccaaagagggagaaaggaagaaacucaaaccucgauggcuagacgcacguauauauagcgacccccuggcucucaaagaguucaaagaguucgcagccggacgcaaaucucuaacacucaacuuaauuacagagaugggaagauugcccacuuuuaugacccagaaggcgagaaaugcgcuagacaauuuagccguacugcauacggcagaagccgguggucgagcauacaaucacgccuugucggaauuaccugaaacguuagagacguuguuguuguuaaccuuacuggcgacgguaacaggagguauuuuccuauucuugaugucaggaaaagggauuggaaaaaugacucuugguauguguugcaucauuacagcuucgguauuauuaugguacgcacagauucagccacauuggaucgcagcaucaauuauauuagaauuuuuccuaauagugcucuugaucccugaaccggaaaaacagagaacuccacaagauaaccaacuaacauacgugguuauugcuauccuaaccgucguagcggccacuauggccaacgagaugggcuuuuuagagaaaaccaagaaagaccugggacuaggaucaauaacaacccaggagucagaaucaaauauauuagacauagacuuaaggccggcuucagcauggacucuauacgccgucgcaaccacuuucguaaccccaauguugaggcacaguauagaaaacucuagugugaauguaaguuugacagcaauagccaaccaggcuacugugcugaugggguuagguaaagguuggccauuauccaagauggacauaggagugccuuuauuagcaauagguugcuauagucaagucaauccaauuacacuaacagcagccuuguuacuauuaguagcgcacuaugcgaucauugguccaggacuacaagcaaaagcuacacgcgaagcacaaaagagagccgcagcgggaauaaugaaaaauccuacgguugaugguauaacaguuauugauuuggaaccaauuccauaugacccaaaauuugaaaaacaacuaggacagguaauguuguuaauacuaugcguaacucaaguucucaugaugaggacuacuugggcacuuugugaggcacuaacauuagcuaccggaccgauaagcaccuuaugggagggcaauccagggcguuuuuggaacacgacuauagcuguuuccauggcuaacauauucagagggagcuaucuagcuggagcaggauugcuauucucaauaaugaagaauacuacaaauacacgaagagguacaggaaauauuggugaaacauuaggcgaaaaauggaaaagccgacuaaacgcacuaggaaagucagaguuucaaauauacaagaagagugggauacaagaaguugauaggacguuagcgaaggagggaauaaaaagaggggaaacagaucaucacgccgucucgcgaggaagugcaaaacuuagaugguuuguagagcggaacauggugaccccggaggguaaaguaguagacuuaggcugcggaagagggggcuggucauauuauuguggcggccuuaaaaacgucagagaggugaagggucuaacaaaaggcgggccaggucaugaggagccaauuccuaugagcacauauggauggaacuuagugagauuacaauccggaguggauguuuucuuuacgccaccagagaaaugcgacacuuuacuaugcgauauaggugagucauccccuaacccgacaauagaagcuggaagaacacugcgaguucuaaacuuaguugagaacuggcuaaauaauaauacucaauuuugcauaaaaguauugaauccauauaugccuucaguuauagagaaaauggagacacuacagagaaaauaugguggagcacucguaaggaacccacuaucacguaacaguacacacgaaauguauugggucagcaaugcaacgggcaacauuguaaguagugugaacaugauuucccgaauguuaauuaauagguuuaccaugaaacauaagaaagcuacguaugagccggauguagaucugggaucagguacacgaaacauugguauagaaucagaaauaccuaaccuggauauaaucggcaagaggaucgagaaaauaaagcaggaacaugaaacuucguggcauuacgaucaagaucaucccuauaagacuugggccuaucaugggucauaugaaacuaaacaaaccggaucagcauccaguauggugaauggaguaguaagguuauuaacaaaacccugggauguuguaccaauggugacacaaauggccaugacugauaccacuccauuuggucaacaaagaguguucaaagaaaaaguagacacuagaacccaggagcccaaggaagguacaaagaaacuuaugcgaauuacggcagaauggcuauggaaagaacuagguaaaaagaaaacacccaggaugugcacgagagaagaguucacacgaaaaguacgaaguaaugccgcgcuaggugcuauuuuuacggaugaaaauaaguggaaaucugcacgagaagcaguagaagacgggagguucggcgaauuagucgauaaggagagaaacuugcaucuggaaggcaagugcgaaacaugcguauauaacaugaugggcaagcgagagaaaaaguuaggugaguucgguaaagcaaaaggaagucgugcuauuugguacauguggcuaggagcaagauuucuagaguucgaggcauuaggauuuuuaaaugaagaccacugguucucacggggaaacagucuauccggcgucgaaggcgaagguuuacauagacuaggguacauuuugagagacgugggcaagaaagaaggaggagcaauguaugcugaugauacugcagguugggacacaaggauuacacuagaggaccucaaaaacgaagaaaugguuacaaaucacaugaaaggagaacauaagaaacuugcggaagcaaucuuuaaacuuacauaucagaacaaaguaguacgaguacagagacccacaccacgaggaaccguuauggauauuauuucacggcgugaucagagagggaguggacaaguugggacauacgguuuaaauacauucaccaacauggaggcucaacuaauaaggcagauggaaggagaaggaaucuuuaaaucuauccaacaucuaacugcuacggaggaaauugcaguucaaaacuggcuagcacgggucggaagagagcgccugagcaggauggcaaucaguggugaugacugugugguuaaaccaauugaugacagguucgcaucagcccuaacggcauuaaaugauaugggaaaggucagaaaagacauacaacagugggaaccuagccgaggguggaacgauuggacucaaguuccuuucuguagccaucauuuccaugagcugguuaugaaagacgguagaguacuggugguaccauguaggaaucaggaugaauuaauaggccgggccagaaucucacaaggcgcaggauggagucucaaagaaacugcauguuuagggaagucuuaugcucaaauguggacucuaauguauuuucaucgcagagacuugcgauuagccgcaaaugcaauauguucagccguaccuagucauuggguacccacaucacguacaacauggaguauacaugcaaagcacgaauggaugacuacggaagauaugcucgcagucuggaaucguguauggauacaagaaaauccauggauggaagauaagacuccuguugaaaguugggaggaaguaccauacuugggaaaaagagaagaucaauggugugggagucucauaggauuaaccucuagggccacaugggccaaaaauauacaaaccgcgauaaaccaggugcguaguuuaauuggaaacgaagaauauaccgauuacaugccuagcaugaaaagguuucgaagagaagaagaggaggcuggaguucuuugguaa

SEQ ID NO: 22943 - RNA, 9876 nt, Artificial Sequence
  derived and/or modified CDS sequence (opt6) from DENV-2__HQ332188__SS-prME
acugcaggcgucauuguuaugcuuauaccuacagcgauggcauuucacuugacaacuagaaauggugaaccgcauaugauaguugggagacaagaaaaagguaaaucacugcuguuuaaaaccgaagaugguguaaacauguguacguuaauggcuauagauuugggggaauuaugugaagauacgauuacauauaaaugcccccuauuaagacaaaaugaaccagaagauauugauuguugguguaacaguaccucuacauggguuaccuacggcacuuguacaacuacuggugaacauagacgagagaaaagaagcguagcacugguaccacacguggguauggguuuggaaacucggacugaaacuuggaugucaagcgaaggggcuuggaaacacgugcaaagaauugaaacguggauauuaaggcaucccggguuuacaauaauggcagcaauauuagcauacacaauuggaaccacacauuuucagagggcucuaauauuuaucuuacuuacugcuguugcgccgucuaugacgaugagguguauagggauaaguaaccgggacuuuguugaagggguuucuggagguucauggguagauauuguccuugaacauggcaguugcguaacaacuauggccaaaaacaaaccaacauuggauuucgaacuaauaaaaacagaagcaaaacagccugcuacauuaaggaaauauugcauagaagcuaaauugacuaacacuaccacagaauccagguguccgacccaaggggaaccuucauuaaacgaagaacaagacaaaagauuuauauguaaacauagcaugguggauagaggaugggggaacgguuguggacuauuugggaaagguggcauagucacuugugcgauguuuacauguaagaaaaauauggagggaaaggugguacagcccgaaaacuuggaauacacaauagugaucacaccacacaguggcgaagaacaugcaguaggaaaugacacgggaaaacacggaaaagaaauuaaaauaacaccacaaucuucaauaacugaagcggaacucacagguuauggaacggugaccauggaauguagcccccgaacaggauuagacuuuaaugaaaugguacuucugcagauggaagauaaagccuggcuaguacauagacaaugguuccucgaucugccgcugccgugguuaccgggagcagauacacaaggaucgaacuggauccaaaaagaaacccuagucacguuuaaaaacccccaugcgaagaaacaagaugucguaguuuugggcagucaagaaggugcuaugcacacugcguuaacuggagcaacggaaauccaaaugucguccgguaaucuguuauuuacgggacauuuaaaaugccgauuaagaauggauaaauuacaauugaaaggcaugucguacucuaugugcacagggaaauucaaaauaguuaaagaaauugcugaaacucaacauggcacuauaguaaucagaguccaauaugaaggggacggcucaccauguaaaauaccuuuugaaauuacggaccuugaaaaacgacauguucuuggaagacuaauaacuguaaacccuaucgugauagaaaaagacucucccguaaacauagaagcagaaccaccguucggcgacagcuauaucauaauugggguugaaccuggucaguuaaaauuaaacugguucaagaaagguuccaguauuggccaaauguucgaaaccacaaugcgaggcgcuaaaagaauggcaauauugggagauacggcaugggauuuuggaagucuaggagggguuuuuacgucgauagguaaagcucuacaucaaguauuuggugcuauuuauggggcugccuuuucugggguauccuggacgaugaaaauucucauaggaguuguaauuacauggauagguaugaacucacgaaguacgucguuaucgguaucguuaguauuagugggugugguuacgcuuuaucucggugccauggugcaagccgacucaggcuguguggugucuuggaagaauaaagaacuaaaauguggauccgguauuuuuauuaccgacaacguacacacguggacagaacaauacaaguuccaaccagaaagcccuagcaaauuagccucagcaauacaaaaagcucaugaagaaggaauuugugguauaagauccguuaccagacuugagaaccugauguggaaacaaauuacuccagaacugaaucauauacuuagugaaaaugagguaaaauuaaccauaaugacuggugauacaaagggagucaugcaagcuggaaaacgaagccuccgaccccaaccaacggaauuaaaauacucauggaaaaccugggggaaagcuaaaaugcucucgacggaaucacauaaucagacguuucuuauagauggcccagaaacgacggaaugucccaacacgaauagagcuuggaacaguuuagagguagaggauuauggauuuggagucuuuacaacgaacauuugguuaaagcuccgcgagaaacaagauguauucugugacucaaaguuaaugucugcggcaauaaaggauaauagagcuguucaugcagacaugggcuauuggauagaaucagcauuaaaugacacguggaagauggaaaaagcgaguuuuauugagguaaaaagcugucacuggccaaagucacacacucucuggucaaauggaguacuagaaucugagaugauaauacccaaaaacuuugcugguccaguuagccaacauaauuauaggccaggguaccauacacaaauagcugguccauggcauuuaggaaaauuggaaauggacuucgauuucugugagggaacgacaguugucguaacagaagauugugguaaucguggaccaucacuucguacaacaacagccagugggaaauugauaacggaauggugcugcaggagcugcacguuaccgccucuaagauaccguggugaggacggaugcugguacgguauggaaauaagaccuuugaaagaaaaagaagaaaaucucguaaacucucuuguaaccgccggacacggacaaauagauaacuucucauuagguguuuuagguauggcccuuuucuuagaagaaauguuacgcacuaggguaggaaccaagcacgcaauacuacucguagcaguauccuucgugacauuaauaacaggaaacaugucauucagggaucuagguagaguuaugguuaugguuggugcaacuaugaccgaugauauagguaugggcgcuacauacuuagcauuacuagcggcauuuaaaguuaggccaacauuugcggcuggucuacuucuacgcaaauugaccuccaaggaacucaugauggcaacaauaggaauaacauuguuaagucagaguacaauucccgaaacaauauuagaacuuacugacgcuuuggcucucggaaugaugguccucaaaaucguacgaaauauggagaaguaccaauuagcgguaacaauaauggcuauaaguuguguucccaacgcugugauauugagaaacgccuggaaaguuaguuguaccauauuggcugcuguaagcguaucaccauuacuucuaacaagcagccagcagaaagcggauuggauuccauuggccuuaacaauaaaaggguuaaauccaacugccauauuccucacgacgcugaguaggacauccaagaagagaucauggccucuuaacgaagcaaucauggcgguugggaugguguccauucuggcuaguucucuccuuaaaaacgacauaccgaugacgggaccgcuaguugcaggcggucuguugacuguauguuauguuuuaacaggucgaucugcugacuuagaacuagagagagccgcugauguuaaaugggaggaucaggcugagauuucaggaucgucuccaauuuuaucgauaacaauuucugaggacggaucuaugaguaucaaaaaugaggaagaggaacaaacgcuaacuauauuaauccguacaggguugcucguuaucagcggaguauucccaguaucaauucccauuacggcagccgcuugguaucucugggagguuaagaaacaacgagcggguguacucugggauguacccaguccgccgccuguaggaaaagcagaacuggaagacggagccuaucgaauaaaacaacggggaauauuaggguacagccagauuggugcggguguauauaaggaagguacuuuucacacuauguggcaugugacuagaggggcagugcuaaugcaccgagguaaaagaauugaaccaucaugggcagaugugaaaaaggaucuaauuucuuauggagguggauggaaacucgaaggggaauggaaggaaggagaagagauucagguucuggccuuggaaccugguaaaaacccccgggccguucagacuaaaccuggaauauucaaaacgaauacgggaacaauuggcgccguaagucuggauuucucaccaggaacauccgggucuccuauugucgauagaaagggcaaaguagucggacuauacggcaauggaguaguaacacgaaguggagccuacguaagugcaauagcucagacugagaagucaaucgaagacaauccagaaauagaagaugauauuuuucgaaagaagcgacuuacaaucauggaucuccauccuggugccggcaaaacaaagagauacuuacccgcaaucguuagagaagcuauuaaacgaggacuaagaacccugauuuuagcaccaacgcgagugguagcggcagaaauggaagaagcucuacgaggguugccaauuagguaucaaaccccugcgauaaaggcggaacacacgggaagagaaauaguugaucucaugugucaugcaacguuuacgaugagauuacuaaguccuguaaggguacccaauuacaaucuuauuauaauggaugaagcacacuuuacggacccugcaucuauugcugccaggggauauauuagcacgagaguagaaaugggagaagcugcaggcaucuucaugacugcuacuccucccggauccagagaucccuuuccccagaguaaugcucccauaauggacgaagaaagagaaauaccugaacgcuccuggaauaguggacacgagugggucacagacuucaaaggcaagacagucugguucguuccaagcauuaaagccgggaaugauaucgcagccugucuucguaaaaacgguaagaaaguaauucaacuuucgcgaaaaacauuugauuccgaauauguaaagacucgagcaaacgauugggauuuuguugugaccacggauauuagugaaaugggugcaaacuuuaaagcugaacgcguaauugacccccgaagguguaugaaaccugucauucuaaccgauggagaagagagagucauccuggcagggccgaugccugugacccauagcagcgccgcgcaaagaagaggucguaucggaagaaauccuaaaaaugaaaaugaucaauauauuuauaugggugaaccucuugagaaugacgaagauugcgcgcauuggaaagaagcaaagauguuacuagacaacauaaauacgccagaggguauaauaccgucaauguuugaaccagaaagagaaaaaguagaugcuauagauggagaauacagacuacgcggagaggccagaaaaacauuuguagaucuaaugagaaggggcgaccuaccaguaugguuggcauacaaaguagcagccgaaggcauuaauuaugccgaucgaaaguggugcuucgacgggauuaaaaacaaucaaauacuagaagaaaacguagaaguggaaauauggacuaaagagggugaacgaaagaaauuaaaaccacgauggcucgacgcaaggauauauagcgacccuuuggcacucaaagaauuuaaagaauuugcagccgggcgcaaaucucucacacucaauuugauaacugaaaugggucgauuaccgacuuucaugacacaaaaagcgaggaacgcucuugacaaucuugcuguauugcauacagccgaagcugggggccgcgcauacaaucaugccuuaagugagcuaccggaaacacuagaaacucuauuacuuuuaacacuauuagcuacagugacaggugguauauucuuguuuuuaaugucagguaaagggauuggcaaaaugaccuuggggauguguuguauaauaacagcuaguguauuacucugguaugcucaaauccaaccucacuggaucgcagcgagcaucauacuagaguucuuucuaauuguacuacuuauuccugaaccagaaaaacaaagaacaccucaagauaaccagcuuacuuacguuguuaucgcaauacucacagugguugcagcaacgauggcaaacgaaaugggcuuucuagaaaagaccaaaaaggaccucgggcucgggucaauaacaacccaagaaccagaauccaauauucuugauauagaccuuagaccagcuagugcuuggacacuuuacgccguggccacgacauucgucacaccaaugcuaaggcauuccauugaaaacagcuccguaaacgucaguuuaacagcaauagcuaaccaggcuaccgugcucauggguuuagggaaaggguggccccuaagcaagauggacauaggugugccgcucuuagcaauuggauguuacagccaaguuaaucccauuaccuuaacagcggcauuacucuuauuaguagcccacuaugcaauaauuggaccuggauugcaagccaaagcgacaagagaagcacagaaacgugcagcggccggaaucaugaaaaacccuacagucgauggaauaacaguuauagauuuagaaccaauuccauacgauccaaaauucgaaaaacagcuuggacaaguaaugcuauuaauacuaugcguaacucagguccuaaugaugcggaccacaugggcauuaugcgaagcauuaacucucgccaccggacccauaaguacguuaugggaagguaauccagggagauuuuggaauacgacaaucgcaguaucuauggccaauauuuuccgaggaaguuaucuugcuggcgcaggacuacuauuuaguauaaugaaaaacacuacaaacacaagaaggggcacagggaacaucggggaaacauuaggcgaaaaguggaaaucaagauuaaaugcauuaggaaaguccgaguuccagauauauaagaaaagugguauucaagaggucgacaggacucuggcaaaagagggaauuaaaagaggagaaacagaucaucacgcagugagccgcggaagcgccaaacuacguugguuuguagaaagaaacaugguaacgccagaaggaaagguuguagaucucgguugugguagagguggauggagcuacuacugcggagggcuuaagaauguacgggaaguaaagggauuaacuaaggguggaccgggccacgaggaaccaauacccaugucaacguacggcuggaaccuugugagauugcaaucugggguagauguauuuuucaccccgcccgaaaaaugcgacacacuauuaugcgauauuggagagaguagcccaaaucccacuauagaagcaggacgaacguugagaguacuaaaucuaguugaaaauuggcuaaauaauaacacacaguucuguauuaaaguacuaaaccccuauaugccaucuguaaucgagaaaauggaaacacuacaacguaaguauggaggugcauuaguuagaaauccacuaucgcgaaauucgacacaugaaauguacuggguuuccaacgcaacggggaauauuguaucaucuguuaauaugauaucaagaaugcuuaucaaccgguucacaaugaaacauaagaaagcaaccuaugagccggacguggacuuaggaucaggaacccgaaacaucggaauagagucggagaucccaaauuuagacaucauaggaaaaaggauugaaaagauaaaacaagaacacgagaccagcuggcauuacgaccaagaccacccuuacaaaaccugggcauaccaugguagcuaugaaacgaaacaaacuggauccgcuaguaguaugguaaaugguguuguaagguuacuaacaaagccgugggacguagugcccaugguaacacaaauggcuaugaccgacacaacuccauuuggccaacaacggguauuuaaggaaaaagucgauacucgaacacaagaaccuaaagagggaacuaaaaagcuaaugaggaucacggcggaaugguuauggaaggaguuaggcaagaagaaaacaccuaggauguguacuagagaagaauuuacacgaaaaguucgaucuaacgcagcauugggagccaucuucacagaugaaaauaaauggaagucggcgcgugaagcagucgaagauggacguuuuugggaauuaguggaccgagaacgaaaucuccacuuggagggaaagugugaaacaugcguauauaacaugaugggaaaaagagagaagaaacuuggggaguuuggcaaagcuaaagguucacgugcaaucugguauauguggcucggagccagauuucuagaauuugaagcguugggauuuuugaaugaagaucauugguuuucaagaggcaacaguuuaucaggaguugaaggugaggguuuacauagguuggguuauauuuugcgagacgugggcaagaaagaagguggagcaauguaugcagaugacacagcuggaugggacacgcgcaucacacuggaagacuugaaaaacgaagaaaugguaaccaaucauaugaaaggugaacauaagaaacucgcugaagcuauauuuaaacucacauaccaaaacaaaguagugcguguacaaagaccaacuccacgaggcacaguaauggacaucauaucacguagggaucagagaggaaguggccagguuggaacauauggacuaaauacauuuacaaacauggaagcgcaauuaauaaggcaaauggagggugaaggaauauuuaaaagcauccagcaucugacaguaacugaagaaauagcaguucaaaacugguuggcccgaguuggacgugaacguuugucgagaauggccauauccggugacgacugcgucguuaaacccauagaugauagauuugcgucggcacugacggcacugaacgauauggguaaaguccgcaaggauauacaacaaugggaacccucccguggcuggaaugacuggacccagguaccauuuuguagucaucauuuccacgaguuaguuaugaaagauggucgaguauuaguaguuccuuguagaaaucaagacgaacuuauaggccgagcaaggauaagucaaggagcuggauggucauuaaaagaaacugcaugucucggcaagucauacgcacagauguggacguugauguauuuucaucgaagagaccucagacucgcagcaaaugcaaucuguuccgcagucccgagucacuggguuccgacaaguagaacuaccugguccauucaugcaaaacaugaguggaugaccacggaggauauguuagcagucuggaacagagucuggauacaagaaaaucccuggauggaagauaagacaccaguugagucaugggaggaaguaccauaucuagguaaacgagaggaucagugguguggcucacuuauugguuuaacuucacgagcaacuugggccaaaaauauacaaacagcuauuaaucaagugaggucacuuaucggaaaugaagaauauacugauuauaugccaucuaugaaaagauuuaggcgugaagaagaagaagcaggaguucuaugguaa

SEQ ID NO: 22944 - RNA, 9876 nt, Artificial Sequence
  derived and/or modified CDS sequence (opt6) from DENV-2__HQ332189__SS-prME
acugcaggaguuauagugauguugauucccacggcaauggccuuccaccuuacgacucggaauggagaaccucacaugaucguaggcaggcaagaaaaagguaaaagucuauuauuuaaaacugaagaugguguuaacauguguacacuaauggcaauagaccuuggagaacugugcgaagauacgauuacauacaaaugcccgcuccuacgacaaaaugaaccagaagauauugacugcuggugcaauucaacaucaacauggguaacuuauggaacauguacaacuacaggugaacaucggagagaaaaacguucgguagcccugguaccgcauguugguauggggcuagagacucgaacagaaacguggaugucuuccgaaggugcguggaaacacguacaacgaaucgaaaauuggauccucagacauccaggguuuacaauaauggcagcuauacuggcguacaccauugggacaacacauuuccaaagagcucugauuuuuauccuacuaacggcaguagcgcccaguaugacuaugcgguguauaggaauaucuaauagagauuuuguagaaggagucuccgggggcucguggguugauauaguauuagagcauggaucaugcgucacuacaauggcgaaaaauaaacccacacuagauuuugaauuaauaaaaacagaggcgaaacaacccgcaacguuacgcaaguauuguauagaggcaaaacuuaccaauacgacaacagaaucaagaugcccgacccaaggcgaacccagcuuaaacgaagaacaagacaaacgguuuauauguaaacauagcaugguggauagggguugggguaauggcugcggccuauuugguaaaggugggauaguaacaugugcaauguuuacauguaagaaaaauauggaaggaaaaguaguacagccugagaaucuugaauacacaauuguaauaaccccacacaguggagaagaacaugcaguggggaacgauacaggcaaacauggaaaggagauaaaaaucaccccacaaucgucuauaacugaagccgaacuuacagguuauggaacaguuacuauggaaugcucgccccguacaggucuagacuucaacgaaaugguauuacuacaaauggaagauaaagcauggcuuguacaccgacaaugguuucucgacuuaccucuuccaugguuaccgggagcugauacgcagggaucaaacuggauacagaaagaaaccuuagugacuuuuaaaaauccgcacgcuaagaaacaagauguaguuguacuagggucacaggaaggagcgaugcacacagcucucaccggcgcaacugaaauccaaaugucuagcggcaacuuauuauucacagggcauuugaaaugcagauugcguauggacaaacuacaauugaaggguaugucauauucgauguguacagguaaguucaaaauagucaaagaaauugcagaaacacagcauggcacuauaguaauucgcgugcaauacgagggugauggaucuccuuguaagauaccguucgagauuaccgaccuagaaaaacggcauguccuaggucgccuaauaacagugaacccaaucguaauugaaaaagauagcccggugaauauagaggcagaaccgccguucggagauucauacgugauuauugguguugagccuggccaguugaagcugaauugguuuaagaaggguucgaguaucggucaaauguuugaaaccacuaugaggggcgccaagcgcauggccauacuaggggauacagccugggauuuuggaucauugggugguguauucacaucgauagggaaagccuuacaucaaguuuucggugcgaucuauggcgcagcguuuucgggcguuucguggacgaugaaaauacuuauaggagucguaauaacguggauaggaaugaauagccgaucaacaaguuuaucugucucacugguacuggucggggugguaacacuauacuuaggcgcgauggugcaggcugauucggggugcguggugagcuggaaaaacaaggaauuaaagugugggagcgguauauuuaucacagacaacguucauacauggacagagcaauacaaauuucagccggaaucaccaagcaaauuagcgagcgcuauacaaaaggcucacgaagaaggaauauguggaauacggaguguaacaagacuagagaauuuaauguggaagcaaauaacaccggaacuaaaucauauauuaagcgagaaugaagucaaacuuacaaucaugacaggagacacaaaaggcaucaugcaagcuggaaagcguagccuaagaccacaaccaacugaacuaaaauacucauggaagacauggggcaaagcgaaaaugcucucgacagagucucauaaccaaacauuccuaaucgacgggccggaaacagcagagugucccaauacgaauagagcuuggaacagucuugagguugaagacuaugguuucggcguuuucaccacaaacauauggcuuaaacuacgugaaaaacaggacgucuuuugcgauaguaaacuuaugagugcggccauuaaagauaacagagcugugcacgcugauaugggauacuggauugaaucagcucuaaaugacacauggaaaauggaaaaggcuucauucauagaaguaaaaucaugccauuggccuaaaagccacacccuauggaguaacgguguauuagaaagugaaaugauuaucccuaaaaacuuugcaggaccggugagucaacauaauuaucgaccaggguaccacacacaaaccgcagguccuuggcauuugggaaaacucgagauggauuucgacuucugcgaagggacuacaguaguagucacugaagauugugguaaucgaggcccaucguugaggacaacuaccgcaucuggaaaguuaaucaccgaauggugcugcagaucuuguaccuugcccccacuaagauaccgaggagaggauggaugcugguaugguauggaaauucgaccgcuaaaagaaaaagaagaaaaucuaguaaauuccuuggucacagcaggucauggccaaauagauaauuuuucacuugggguuuuaggaauggcacuauuccuggaagaaaugcuaagaaccaggguggggacgaaacacgccauacuccuaguugcaguaaguuuuguuacauuaaucacagguaauaugucauuccgugaucucggucgaguaauggugauggucggugcuacuaugacagacgauauaggcauggguguuacuuaccuggccuuacuagcggcuuuuaaaguuagaccaacauucgcagcuggucuauuacucagaaaacuaacgucuaaagagcuuaugauggcaacuauuggaauaacacugcuaagccaaaguacaauaccggaaaccauauuagaacugacggacgcauuagcauuaggaaugaugguccuuaaaauagucagaaauauggagaaguaccagcucgcaguaacaauuauggcgauaaguugugucccaaaugcgguaauauuaagaaaugccuggaagguuucuugcaccauucucgcagcaguuuccguaagucccuuacuuuuaacauccucacagcagaaagcagacuggauaccacuagcacuaacaauaaagggucuuaauccgacugcaaucuuuuuaacuacgcuuucacgcacgucgaagaaaagguccuggccacugaaugaagcaaucauggcaguggggaugguuagcauucuggcaucgucucuauugaaaaaugacauaccuaugacaggaccucuaguggcugguggccuacuuacgguguguuauguucucacgggaagaagcgcagacuuagagcuugagagagcagcagauguuaaaugggaagaucaagcugaaaucagcggaagcagcccaaucuugucaauaaccauaucugaagacgguucuaugucaauuaaaaaugaagaagaggaacaaacacuuacaauucuaauuaggacaggucuacugguuauaucagguguguuuccaguaagcauacccauuacagcggcugcaugguaucuaugggaaguaaagaaacaacgugcgggaguauuaugggacguacccucacccccuccaguugguaaagcagagcuggaagauggugccuaccguauuaaacaacgaggaauccugggguacucccaaaucggagcaggcguguacaaagaaggaacuuuucauacgauguggcaugucacacgaggugcugugcuuaugcaucggggaaagcgaauagagccuuccugggcugaugucaagaaagaucuuauaucuuacgggggcggauggaagcuagaaggagaguggaaagaaggggaagaagugcaaguacuugcauuagaaccaggcaagaauccuagagcaguacagaccaaaccagggauauuuaaaacgaauaccggcaccauaggcgccgucagcuuagauuucagcccuggaacaagugggucuccuauuguagacagaaaagguaaaguaguaggacuauacgggaaugguguuguuacaagaucgggugcauauguuucggcaauugcucaaaccgaaaagucuauugaagauaauccagaaauugaagaugauauuuuuagaaagaaaagacuuacaauuauggauuugcauccgggagcuggaaagacaaaaagauacuuaccugcuauuguaagagaagcaauuaaacgaggcuuacguacucuuauacuggcuccaacgaggguuguagcggcggaaauggaagaagcucuacgaggucucccgauacgauaccaaacacccgcaauuaaggcagaacauacuggucgagagauaguagauuugaugugucacgcuacauuuacaaugcgccuauuaucgccaguuagaguaccgaauuacaaccugauaaucauggaugaagcccacuuuacagacccggcuucaauagcagcacguggauacauaagcacccgagucgaaaugggagaagcagcggggauauuuaugacugccacgccuccggggaguagagaucccuucccgcagaguaacgcaccaaucauggaugaagagagagaaauccccgaaagaucauggaacucgggucaugaauggguaacagacuuuaaagguaaaacagucugguuuguuccgaguauaaaggcugguaaugacauagcagcaugccuaagaaagaaugggaagaaagugauccaauuaagccgaaaaacuuuugauucagaauaugugaaaacaagagcaaaugauugggauuucguugugacaacugauauuagcgaaaugggagcaaauuuuaaagcggagagagugauagacccaagaagaugcaugaaacccgucauacuuacagacggugaagaacgcguaauucuagcagguccaaugccaguuacucacucgucagcagcacaaagacgaggucguauuggucgaaauccuaaaaaugagaacgaccaauauauuuacaugggagaaccucuugagaacgaugaagauugugcacacuggaaagaggcaaaaaugcuccuagacaauauaaacaccccagaaggaauaaucccuagcauguucgagccggaaagggaaaaaguugaugccauugauggugaauaucgacuaagaggcgaagcccgcaaaacuuuuguggaucuuaugcguagaggugaucuacccgucuggcuagcauacaagguagcugcggaggguaucaauuacgcggaccgcaaaugguguuucgacgggauuaaaaauaaucaaauuuuggaagagaauguugaagucgaaaucuggacaaaggaaggugagagaaagaaacuuaaaccacgcuggcuggaugcacguaucuauagugacccccuugcauugaaagaguuuaaggaauuugccgcaggucguaagucgcugacacuaaaucuuauuacugagauggguagacuuccaacauucaugacacagaaagcaagaaacgcauuagauaaccuggcuguauuacauacggcugaggccgguggacgagcauauaaucacgcauuaucggaguuacccgaaacccuagaaacgcuauuacuucuaacguuacuagcaacuguaacaggaggaauuuuccuauucuuaaugucaggaaaaggcauagguaagaugacccuggguaugugcugcauuauaacagcgucaguauugcuaugguacgcacaaauacaaccacacuggauagcagccagcauuauauuagaauuuuucuuaauuguucuauugauccccgaaccagaaaagcagagaacuccacaagacaaccaguuaacuuauguggucauagcuauacugacaguaguagcagcuacuauggccaaugaaaugggauucuuagagaagacuaagaaagaccuggguuugggaaguauaacaacacaagaguccgaauccaacauauuagauauagacuugagaccagcaucagcauggacuuuguacgcuguagcuacaaccuucguaacgcccauguuaagacauaguauagaaaauucaagcguaaacguuaguuuaacugcuauagcaaaccaggcuacuguauuaaugggauuaggaaaaggcuggccucuaucaaagauggauauuggcgugccauuauuggcgauugguugcuauucacaaguaaacccaauaacacuaaccgcugccuuauuauuauuggucgcacauuacgcaauaauaggaccgggauuacaagcaaaggcuacaagagaggcacaaaagcgugccgcggcagguauaaugaaaaacccuaccguggauggcauaacuguaauagauuuagaaccaauuccauaugauccaaaauucgagaaacagcuuggacaagucauguugcuaauauuauguguuacacagguguuaaugaugcguacaacaugggcgcuaugugaagcacucaccuuagcuaccggaccgauaucaaccuuaugggaaggaaaucccggaagauuuuggaauaccacaaucgccgucucaauggccaauauauuccgaggauccuaccuggcaggggcuggauuguuauucaguauuaugaagaacaccacaaauacucguagaggcacaggaaauauaggagagaccuuaggugagaaauggaaaucuagauuaaacgcacuggguaaaagcgaguuccaaauuuacaagaaaucgggaauacaagagguggaucgaaccuuagccaaagaagggauaaagagaggggaaacggaucaucaugcaguuucaagagggagcgccaagcucagaugguuuguagagagaaacaugguuacgcccgaaggaaagguaguggauuuaggaugcggcagaggaggguggaguuauuacuguggcggacucaagaauguacgcgaggucaagggauuaacaaaagguggaccgggucacgaagaaccaauaccgaugaguacauauggauggaacuugguacgauuacaaucaggaguugauguauucuuuacaccacccgaaaagugcgauacacucuuaugcgauauaggggaaucaaguccgucaccaacuauagaggcaggacgcacacucagaguccucaacuuaguagaagauuggcuuaacaacaauacucaauucuguauaaaaguacuaaauccuuauaugcccucggucauagagaaaauggaaacauuacaaaggaaauauggcggagccuuaguaagaaauccacuuagucgaaauuccacacacgaaauguacuggguaagcaacgcgacgggaaacauugugagcagugugaacaugauuagcagaaugcuuauaaaucgauuuaccaugaaacacaagaaagcgacauacgaacccgauguagacuuagguagugguacacggaauauuggcauagagucagaaauaccaaauuuagauauuauagggaaaagaauagagaaaauaaaacaagaacaugagacaucguggcauuacgaucaggaccauacguauaaaacaugggccuaucaugggagcuacgaaacgaaacaaaccgguucggcaaguucaaugguuaauggugugguaagacugcuaacuaagccgugggacguaguaccaauggucacacaaauggcaaugacagauacaacccccuuuggucaacaacgaguauuuaaagaaaaaguugacacaagaacacaagaaccuaaggaaggcacgaagaaacucaugcggauuacagcugaaugguuguggaaagaacuggguaagaagaaaacacccagaauguguacuagagaagaguuuacaaggaaaguuaggucgaacgcagcacuaggagcgauuuuuaccgaugagaacaaauggaaaagcgcuagagaggcuguugaagaugggcgauuuugggagcuaguagauagggaacggaacuugcaucuagaaggcaaaugugaaacuugcguguauaacaugaugggaaagcgugaaaagaaauugggugaguucggaaaagcaaaagggagucgugccauaugguauauguggcuuggagcaagguucuuggaguucgaagcacuaggguuucucaaugaagaucauugguucucacggggaaauagcuugagcggaguagaaggugagggauuacauagacuggguuauauacuaagagacguuggcaaaaaggagggcggugcuauguaugcggacgacacugcagggugggauacccgaauaacucuugaagaucuuaagaaugaagaaaugguaacaaaccacaugaaaggggaacauaagaaauuagcugaagcaaucuuuaaacucacauaucaaaauaaaguuguacgggugcagagaccaacuccgcgaggaacugugauggauaucauaucaaggagagaccagagagguaguggacagguaggaacuuauggacuaaauacuuucacaaauauggaggcacaguugauuagacagauggagggagaagggauauucaaaucuauacagcauuuaacugcgacagaagagauugcuguccaaaacugguuagccagaguagguagggaaaggcuuucaagaauggcaauaaguggagaugauuguguuguaaagccaauagaugauagauucgccucagcauuaacugcucugaacgauauggguaaaguuaggaaggacauacaacaaugggagccuucaaggggcuggaacgauuggacgcaagucccauuuuguucacaucauuuccaugaacucgucaugaaggacggacgugugcugguuguuccaugccguaaccaagacgaacugauagggcgagcacggauaucccaaggcgcagguuggucgcuaaaagaaacugcauguuuagggaaaagcuaugcucaaauguggacacuaauguauuuccaucggagggauuuacgucuggcagcaaaugcaauuuguucagcagugccgucacauugggugccaaccucacgaaccacauggagcauacacgcgaaacacgaguggaugacaacugaagauaugcuggccguguggaaccgagucuggauacaagaaaaucccuggauggaagacaaaacaccaguagagaguugggaagaagucccuuaucuaggaaaaagagaagaucaauggugcgguucgcugauaggguuaaccagcagagcaaccugggcgaaaaacauacaaaccgcaauuaaccaaguacgcagucuaauaggcaacgaagaauauacagauuacaugccaaguaugaaacgguuccgaagggaagaggaagaagcuggugugcuaugguag

SEQ ID NO: 22945 - RNA, 9876 nt, Artificial Sequence
  derived and/or modified CDS sequence (opt6) from DENV-2__JN368476__SS-prME
agugcugguaugauaauaauguuaauaccgacaguuauggcuuuccauuuaacaacccguaauggugaaccacauaugauaguggguauucaagaaaaaggaaaaaguuuguuauuuaaaaccgaagauggagugaauauguguacguuaauggcaauggauuugggagaacuaugcgaagacacaauaacauacaaaugcccauuacugagacaaaaugaaccagaagacauagacugcugguguaacucaacgucaacuuggguuacauacggaacguguacgacgacaggugaacauaggagagagaaaagauccguagcucugguuccucauguaggaaugggauuagaaacaagaacggaaacuuggaugucuagugaaggggccuggaaacacgcgcaaagaauugaaacauggauacucaggcauccggguuuuacgauuauggccgcuauucuugcuuauacaauugggacuacgcacuuccaaagagcucuaauuuuuaucuugcucacagcaguugcgccuucgaugacaaugagguguauuggaauaaguaacagagauuuuguugaagguguuucaggagguaguugggucgauauugugcuggaacacgguaguuguguaacaacaauggccaaaaauaaacccaccuuagacuuugaacugauuaaaacugaagcgaaacaaccagcaaccuugcguaaauauuguauagaagcaaaauuaacaaacacaacuacagaaucaagauguccaacacaaggugaaccuucgcuuaaagaagaacaagacaaaagauucguauguaaacauagcauggucgaccgugguugggggaacggaugcggauuauucggaaaaggugguauugugacaugugcaauguuuacaugcaagaaaaacauggaaggaaaaaucguacaaccagagaauuuagaauauacgauaguaguaacuccacauagcggggaagaacaugcaguuggaaacgacacuggaaaacacggaaaagaaauaaaagugacaccacaauccucuauaaccgaagccgaacugacaggauauggcacaguaacuauggaauguucaccccgaacaggacuagacuuuaaugaaauggucuuacuccaaauggaaucuaaagcguggcuuguucacagacagugguuuuuagaccugccauugccgugguugccaggcgccgauaaacaggguucaaauuggauacaaaaagaaacgcuagucacauuuaaaaacccacaugcuaagaaacaagaugugguuguuuuaggaagucaggagggugcaaugcauacugcacucacgggugcgacagagauacaaaugagcucugguaaccucuuauuuacuggccaucuaaaaugcagauuacguauggauaaauugcaauuaaaaggaaugaguuauaguauguguacaggaaaauuuaaaguaguaaaagagauugcagaaacacaacaugggacaauaguuauuaggguacaguaugaaggagacggaucuccguguaaaauaccauucgaaaucauggauuuagagaaaagguacguccuuggcaggcuaauaacagucaauccuaucguaacagaaaaagauaguccagugaacaucgaagccgaaccucccuucggagauucauacauuauaauagguguggaaccuggccaauugaaauuaaauugguuuaagaaagggucgaguaucggccaaauguucgaaacaacuaugcguggagcgaaaagaauggcuauucuuggagauacggcuugggauuucggcagcuuaggcggaguauuuacaaguaucgguaaagcacuucaccaaguauuuggagcuauauacggugcagcauucuccgguguaaguuggacuaugaaaauucuuauagguguaaucauuacauggauaggaaugaacucccggucuacaagucuuucaguauccuugguauuagucggaauaguaacauuauaucugggaguaaugguccaagcagacucaggaugugucguaucguggaaaaacaaagaauuaaaaugugguucuggcauuuucauaacggauaauguucauacauggacugagcaguauaaauuucaaccggagucaccuucaaaacuggcaucggcgauucagaaggcucaagaggagggaauauguggaauaagauccguuacaagacucgaaaaucuaauguggaaacagauuacgccagaguuaaaccauauuuuggcagagaacgaggucaaguuaacaauuaugacaggcgauauaaaagguauaaugcaagcagggaagagaucguuacgcccacaaccuacugaacugaaguacagcuggaaaacguggggcaaggcuaagaugcucucaacagaaucacauaaucaaacauuucuaaucgaugguccagaaacggcagaauguccuaauacaaacagggccuggaauagcuuagagguagaagauuauggcuuugguguauucacaacaaacauaugguuaaaauuaaaagaaaagcaagaugcuuuuugugacucaaaacuaaugucugccgccauuaaggauaauagagcaguccaugccgauaugggauacuggaucgaaagcgcacuaaaugacacuuggaaaauugaaaaggcuucguuuauagaaguuaagaauugucacuggccaaaaagccauacuuuauggagcaauggcguacuagaaucugaaaugauaauuccaaagaaucuagcuggaccuguaagucaacauaauuaccgcccagguuaccauacgcagaccgcggggcccuggcacuuagguaaauuagaaauggacuucgacuuuugugauggaacgaccguaauagugacagaggauugugguaacagagggccaucgcuaagaaccacgacugcuucagguaaauuaauaacagaauggugcuguagaucuuguaccuuaccgccguuacgauaucgaggagaagacggauguugguauggcauggagauacgaccacuuaaggaaaaagaagaaaacuuaguaaauucguuggugacugcuggucacggucagguugacaacuucagcuuagggguacuagguauggcucucuuuuuggaggaaauguuaagaacaagaguaggaacaaagcaugcaauucugcuuguggcaguauccuucguaacauugauaacuggaaauaugucuuucaaagaucuaggacgugucguuguuauggucgguacuacuaugacugaugacaucgguaugggugucaccuacuuagcuuuacuagccgccuucaaagugcgucccaccuucgcagcaggccuucuuuuaaggaaacuaaccaguaaagaacucaugaugacaacaauagggauuguauuauuaagucaaagcacaaucccugaaacaauauuggaauuaacugaugcauuagcacuagguaugaugguucucaaaaucguucgagacauggaaaaguaucaacuagccgugaccaucauggcaauacuuugcgucccaaacgcaguuauucuucaaaacgcauggaaaguaaguuguaccauacuggcaguaguuucgguaaguccccuauuacuaaccagcucccagcagaaaacagauuggauaccucuugcacuuaccauaaagggauuaaauccaaccgccauauuccuaacuacucuaucgagaacaaacaagaaaagguccuggccucuaaaugaggcaauaauggcagucggcaugguaucgauccuugcaucuucucugcuuaaaaaugauaucccaaugacuggaccucuuguagcugguggauuauuaacuguuugcuacguauugacggguaggucugcagauuuagaacuugaacgcgcuaccgauguaaaaugggaagaccaggcagaaauaucuggaagcaguccaauacuaagcauaacuaucagcgaggacggaucaaugucaaucaaaaaugaagaagaggaacaaaccuuaacuauccuaauuagaacaggucuuuuaguaauaaguggauuauucccaguaucaaucccaauaacagcagcagcaugguacuuaugggaagucaagaaacagagagcggggguguuaugggauguuccuagcccgccaccaaugggaaaagcugaauuggaagauggugcauauagaauaaaacaaaaaggaauacuaggcuauucucaaauuggugcuggcguguacaaagaaggaacauuucacaccauguggcauguaacuaggggagcgguauugaugcauaaaggaaaaagaauagagccgucuugggcugauguuaagaaagacuuaauuucguauggaggaggauggaaacuagaaggugaguggaaagagggagaagaaguucaaguauuagcauuagagccgggcaaaaauccacgagcaguacaaaccaaaccaggacuauucaaaacgaacacagggacuaucggcgcaguaagccuagauuucucucccgguacgagcggcuccccgauaaucgauaagaaaggaaaaguaguaggguuauauggaaacgguguagucacuagaucaggggcuuauguaucagcgauagcgcagaccgaaaaaucuauagaagauaauccugagauugaggaugauauuuuuagaaaaagacgcuuaacgauuauggaucuacacccaggugcgggcaagacuaaaagauaucuuccagccauagugcgcgaagcuauaaaacgaggacuaagaacguuaauucuagcgccuacgagaguaguagcagcagaaauggaagaggcacuacgagggcuuccaauacgguaucagacgccggccauacgagcugagcacaccggacgggagauaguagaccuuaugugccaugccaccuuuacgaugagacugcuaucaccagucagaguaccuaauuauaacuuaauuauuauggacgaagcucauuuuacggauccggcaucuauagcugcaaggggauauauuaguaccaggguggagaugggugaagccgcggguauauucaugacagccacgccuccaggaucgagagauccguuuccacaaucaaacgcgccaauaauagaugaagaaagggaaauaccggaaaggucguggaacaccgggcacgagugggucaccgauuuuaaaggaaagacagugugguuugugccaagcauaaaagcuggcaaugacauugcagccugucugaggaaaaauggaaagaaagucauccaacuaagucguaaaaccuucgauucagaguacgucaaaacacguacaaaugacugggacuucguuguaaccaccgacauaucagaaaugggagcgaauuuuaaggcagaaagaguaauagauccuagaagaugcaugaagcccguaauuuugacagauggugaggaaagaguaauccuagccggaccgaugccuguuacacauaguuccgcugcucagcggaggggaagaaucggacgaaaccccaaaaaugaaaaugaccaauauauauacaugggugaaccguuagaaaacgaugaagauugugcacauuggaaagaagccaaaaugcuacuagauaacaucaacacgccagagggaaucauuccaucaauguuugagccagaaagagagaaaguagaugcuauagacggcgaguaccgauuacguggagaagcucgaaaaaccuuuguugauuugaugcgacggggagaucucccgguuugguuggcguauaaggucgcagcugaaggcauaaacuacgcagauagacguugguguuucgauggaaucaaaaauaaucaaauucuagaggaaaacguagagguugaaauauggacuaaagaaggugaacgcaagaagcucaagccuagaugguuagaugcgcgaaucuacucugauccacuagcuuuaaaagaguuuaaagaauuugccgccggccgaaaaagccugacacuaaacuuaauaacagaaaugggaagacuaccaacuuuuaugacgcagaagacccgggaugcauuagacaaccuggcuguacugcauacagcagaggcagggggcagagcuuauaaccacgcccuuucagaacuaccagaaacacuugagacgcuccuguuauugacgcuacuugcaaccgugacaggagggauauuucucuuccuaaugaguggaaggggaaucggaaaaaugacgcuagguauguguuguauaauaacugcuaguguccuuuuaugguaugcgcaaauacaaccucacuggaucgcugcaagcauaauacuggaauuuuuccugauuguacuacuaauaccggaaccggaaaaacaacgaacaccacaggauaaccaauugacauacguaguaauagccauucuaacugucguagcugcuacaauggcaaacgaaaugggauucuuagagaagaccaagaaagaccucggacuuggaagcaucgcaacacaacaacccgagucaaacauauuagacauagaucugagaccagccucagcauggacacuauaugcaguagcaaccacguucguaacgccuauguuaaggcacucuauugaaaacaguucuguaaacguaucgcugacagcuauugccaaccaggcaacaguacuuaugggcuuaggaaagggcuggccacucaguaagauggauauuggaguaccguuacuagcaaucggauguuacucccaagucaacccuauuacacuaacagcugcuuuacuccucuugguugcgcauuaugcaauaauuggaccaggccuacaggcuaaagccacucgagaagcacagaaacgugcagcagcugggauaaugaagaauccuaccguagauggcauuacaguaauagauuuagaccccauuccauacgaucccaaauucgaaaagcaacucggacagguaauguuauugauuuuaugugugacacaaguccuuaugaugagaacaacaugggcauuaugcgaggcacuaacucuggcgacggggcccauaaguacacuaugggaagguaacccugggcguuuuuggaauacuacuauagcugugucaauggcaaauauauuccgcgggaguuacuuggcaggggcaggccuauuauucucgauuaugaaaaacacaacgaacacgagacgugguacaggcaacaucggcgagacguuaggugaaaaauggaagucccgguuaaaugcccucggcaaaucagaguuccagacauauaaaaagagcggaauacaagaaguugaccggaccuuagcaaaagaaggaauuaagcgcggggagacagaucaucaugcugugaguaggggcagcgcgaaauugagaugguuuguagagagaaauaugguaacuccagagggcaaggugguagaucuagggugcgggagaggugguuggucauacuacugugguggauugaaaaauguaagggaaguaaaaggacuaaccaaagggggcccaggacacgaggaacccauaccgaugaguacauauggauggaaucuaguacgacuacagucaggugucgacguauucuuuaucccaccugagaaaugugacacguuauugugcgauaucggagagucaaguccaaauccuacuguagaggccggaagaacgcuccgaguguuaaaucuaguagaaaacuggcuuaacaauaacacgcaauucugcaucaagguacuuaacccauauaugcccaguguuauugagaaaauggaagcacuacaacgcaaguauggaggugcccuaguaagaaauccauuaagcagaaauuccacgcaugagauguauuggguaaguaaugcaagcggaaauauuguauccagcgucaauaugauuucgaggaugcugauuaacagauuuacaaugagacacaagaaagcaacauaugaaccagauguagaucuaggcucggggacuagaaacauaggaauagaaucugagauaccgaaucuugauauaauuggaaaacgaauugaaaagauuaaagaggaacacgagacuucauggcauuacgaccaagaucaucccuacaaaacaugggcauaccauggcucuuaugaaaccaaacaaacggggucagcaucuaguaugguaaacggagucgugcgacuucugaccaaaccuugggacguacuaccaacuguaacucaaauggcaaugaccgauacgacccccuucggacaacaacgaguuuuuaaggaaaaaguggauacucgcacucaagagcccaaagaaggcaccaagaaacucaugaaaaucaccgcugaauggcuguggaaggagcucggcaagaagaaaacaccacguauguguacaagggaggaguucacuagaaaggucagaucaaacgcggcauuaggggcgauauuuacugaugaaaauaaguggaaaucagcucgugaggcaguggaagacaguagauucugggaguuaguggacaaagaaaggaaucugcaccuugaagguaaaugugagacaugcguguauaauaugauggguaaaagagaaaagaaacuaggggaguuuggaaaagccaaagguagccgggcgaucugguauaugugguuaggagcaagauuucuagaguucgaggcauuaggauuucuuaacgaagaucauugguucagucgggaaaauagcuuaucuggaguagaaggcgaagguuuacauaagcuaggcuauauucuuagagaugucagcaagaaagagggaggggcuauguaugcugaugauaccgcaggaugggauacccgaauuacacuugaagaucucaaaaaugaggaaaugguaacaaaucauauggagggagaacauaagaagcuagcagaagcaaucuuuaaacuaacauaucagaacaaagucguaagagugcaaaggccgacuccacggggaacugugauggacauuauuagucgccgagaucagagagguucuggccaggucgggacauauggucugaauacguucaccaauauggaggcgcaauuaauucgacaaauggagggugaagguguguucaaaaacauacaacauuugacaguuacugaggaggccgcaguucaaaauuggcuugcaagaguuggaagggaacgucuaagcagaauggcaauaucuggcgaugauuguguggugaaaccacuggaugaccgauuugcaaaugcuuuaacugcacuaaaugacaugggcaaaauucguaaagacauacagcaaugggaaccgaguaaggguuggaaugacuggacacaaguaccauucugcagccaccauuuccaugaacugauaaugaaggacggucguguguuaguuguaccuugcagaaaucaagaugaauugauaggaagggcacgaauuucucaaggagcuggauggucuuuacgagagaccgcauguuuagguaaaagcuacgcccaaauguggucacuuauguauuuucauagaagagaucuaagacuggcugcuaaugcuaucugcucugcaguaccuucacauuggguacccacaucacggacgacauggucaauucacgcuaaacaugaguggaugaccacggaagauaugcuuacugucuggaauaggguauggaucagggagaauccauggauggaagacaagacccccguugagucgugggaagaaauaccauaucucggcaaaagagaagaccaauggugcggaucacuuauaggacucacaucgagggcgacaugggcuaagaauauacaagccgcuaucaaccaaguuagaucccuaaucgguaacgaagaguauacagacuacaugccgucgaugaaacgcuuucgucgagaagaagaagaagcuggaguacuaugguaa

SEQ ID NO: 22946 - RNA, 9876 nt, Artificial Sequence
  derived and/or modified CDS sequence (opt6) from DENV-2__JF260983__SS-prME
acugcuggauucuugauaaugguuauucccaccguaauggcuuuucaucucacuaccaggaauggggaaccgcauaugauaguaaguaaaaacgaaaaggggaaaggauuacucuucaaaacugaaaauggaaucaauaugugcacauugauggcaauggaucuaggugaacugugugaggacacagugacauacaaauguccguuuuuaaaacaaaaugaaccugaagacauagauuguuggugcaauagcacaucuacaugggucacguauggcacguguucgagcacuggagaacacagaagagaaaaaaggucgguagcacuaguuccacauguaggaaugggucuugaaaccagaacugaaacauggaugucaucagaaggagcuuggaaacaagcucaacgaauagagacuuggaucuuacgacacccuggauuuacgcugauggccgccguacuugcauacacgauaggcacaacacauuuccagcgggcacucauuuucauauugcuuacagcaguagcgccaucuaugacuaugagaugcaucggaauuucaaaucgcgacuuuguggagggcgucucgggcgggucuuggguggauauagugcuagaacauggcuccugcguaacuacaauggcgaaaaauaaaccuacuuuagacuuugaacuuauaaaaacagaagcuaaacaaccagccacucugagaaaauuuugcaucgaggcaaaauugacaaacacuacaaccgaaucacgaugcccgacucaaggagaacccagcuugguggaagaacaagauaaaagauucguuugccgucacaguaugguagacagaggguggggcaacgguugcggauuauucgguaagggggguauaguaacuugugcgauguuuacuuguuuaaaaaagauggaaggaaaagucguacaaccugagaaucuugaauauacaauuguuauaaccccacauucaggugaggagcaugcaguggggaaugacacagggaaacacggcaaagagguaaaaauuacaccucagagcaguaucagugagaccgaacuuacggacuauggaacaaucacaauggaauguaguccaagaacuggauuggauuuuaaugaaaugguauuacuccaaauggaguccaaagcaugguuaguccaccgacagugguuuuuagauuuaccauuacccuggcuaccaggugcagauacucaaggcaguaauuggauacaaaaagaaaugcuggugacuuucaaaaauccucacgcuaagagacaagauguaguuguuuuagguagucaggaaggagcaaugcauacugcacuaacaggcgcaacggaaauacagaugucucuaggaaauauccucuuuaugggccauuuaaaguguagauuaagaauggacaaauugcaacuaaaagguaugaguuacucaauguguacaggaaaguuuaaaguuguaaaagaaauugccgaaacacaacaugguacuauaguuauaagaguucaguacgagggcgaugacagcccauguaagauaccauuugagauaauggaccuagagaaaaaacaugucuuaggacgucugauaaccgucaauccgauagucacggaaaaagauaguccaauaaauauagaagcugaaccaccuuuuggcgacaguuauaucguuauagggguagagccuggucagcuaaaauugaauugguucaaaaaaggaagcuccauaggucaaauguucgagacaacaaugcguggcgcaaagagaauggcuaucuuaggugacacggcuugggacuuuggaaguauuggaggagucuuuacgucggugggcaaagcucuacaccagguuuucggugcaauauauggagcagcauuuucaggagucucuuggacaaugaaaauucuuauaggcguggugauaacauggauugguaugaauucaagaucuaccucacugagcgucacuuugguacuugucgguaucgugacuuuguaccuuggcguaaugguacaagcggauucgggcugugucgucaguuggaagaacaaggaauuaaaaugcggaucuggaaucuucgucacggacaauguacacacuuggaccgaacaauauaaguuccaaccugacucucccuccaaauuggcaagugcaauucaaaaagcgcaugaagaaggcauaugcggcauuaggucuguaacaagauuggaaaaucugauguggaaacagauuacccccgaguuaaaccacaucuuaucugagaacgaggugaaacuaacaauuaugaccggggaaauaaagggcaucaugcaggccggacgucgaagucuaaagccccagccuacugagcuacgguauucauggaaaacaugggguaaagcuaaaguacuaucuaccgagcuacagaaucaaaccuuucuaauagacggaccagaaacuacggaauguccuaauucaaauagggcuuggaacucacucgaaguggaggauuacggauucggaauuuuuacaaccaacauaugguugaagcugagggagaaacaagauaugauaugugauucaaaauuaaugagugcugcugugaaagaugauagggcuguccaugccgauauggguuauuggaucgagagcagauuaaaugacacauggaaaauggagaaagcuaguuucauugagguaaaaucauguuacuggccgagaagucauaccuuguggucaaauggaguuuuggaaucugaaaugauuauaccuaaaaaccucgccggaccaguaucacaacacaacuacagaccagguuacuauacucaaacggcagggccauggcauuugggcaaacuagaaauggauuucgaauucugugaagggacaacagucgucgucacagaagacugcggcaaucgaggaccuucuuuaagaacaacgaccgcaaguggaaaacuuauaaccgaauggugcuguagaagcuguacacuaccuccuuuaagauauaggggagaagaugguuguugguauggcauggaaauucguccuuugaaagaacgagaagagaaucucguaaauucguugguuaccgcgggucauggacagauagacaauuuuagucuuggaauauuagguauggcacuucuccuugaagaaauguuacgaaccagggucggcacaaaacacgcuuuauugcucguagcgauuuccuucgugacguuaauaacaggaaacaugaguuucaaagaccuagggagaguuauaauuaugguaggcgcagcuaugacagacgagaugggaauggguguaacuuauuuagcucuucuugcugccuuccgaguccguccaaccuucgcugucgguuugcuuuuaagaaagcucaccagcaaagaauuauuaauggcaaccauuggcguuguucuucuaucacaaaguaauaucccagggacuguauuggagcuaacugacgcgauugcucucggcauuaugguccuaaaaauaaugaggaguauggaaaaauaccaauuagcggugacaguuauggcaaugcuauguaucccgaacguaaugaucuuacaacacgcauggaaagugggguguacaauccuggccgcuguaucgguaaguccgcuccuucuuaccagcagccagcaaaaaaccgacuggauaccacuggcgcuaaccauuaagggacuaaauccgacagcgaucuuucucaccacguuaucaagacccaguaaaauuagaagcuggccacuaaaugaagcaauaauggcaguaggaaugguaaguauacuugcaaguucuuuacucaaaaaugacaucccaaugacaggaccgcuagucgcaggaggauuacuaacuguuuguuauguacuaacuggacguucggcagaccuugaacuugaaaaagcggcagaaguaaaaugggaagaccaggcugaaaucaguggaagcaguccuauauuguccaucacuaucucagaagaugggucaaugaguauuaagaaugaagaggaagaacagacacucacuauacucaucagaacaggauuauuagucauuucaggauuauucccaguuaguaucccgauuaccgcugcggcuugguauuuaugggagaccaaaaaacaaagagccggugugcuaugggacguaccuucaccaccaccaauggguaaggcagagcuagaagauggagcauaucgaauaaagcaacgaggaaucuuuggguauucacaaauaggagcaggaguauauaaagaaggaacguuucauacuauguggcaugucacaagaggcgcaguuuuaguacauaaagguaagcguuuagaacccucaugggccgaugugaaaaaggaucuaaucuccuacggaggaggauggaaacuagagggcgaauggaaggacggagaagagguucaaguccucgcucuugagccugguaaaaaccccagagcaguccaaacuaaaccaggucuguucaaaacaaacacagguacgauaggugcuguuucucuagauuuuucaccggggacaucggggagccccauaaucgaucgaaagggcaaaguuguaggacuauacggaaacggcguagugacacguucuggaacuuauguaucgucgauugcacaaacugaaaaauccguugaggauaacccggaaaucgaggaugauauauuccgaaaaaaaagauuaacuauaauggacuuacauccaggagcaggaaaaacuaaaagauaucugccagcgauaguuagggaggcaauuagaagaggauugcgcacacucauacuagcgccuacgagaguaguggcugcggagauggaagaagccuuacgaggacuuccuauucgauaccagacaccugcuauuaaggcugaacacacaggccgagaaauuguagaccuuaugugccaugcaacauuuaccaugagguuacuuaguccuauccguguaccgaauuacaaccugauuauuauggaugaggcacacuuuacagauccagcuucuauugcggcacguggauauauaagcacucgcguugagaugggagaagcagcaggaauuuucaugacugcaacaccuccagggucaagagauccuuucccacaaucaaaugccccaaucauggaugaagaaagagaaauaccugaaagaucuuggaauucuggucaugaauggauuacuaacuucaaagggaagacggucugguucguuccuaguauuagagcgggcaaugacauugcagcaugccucaggaaaaaugggaagagagucauucaguuaucacguaaaaccuuugauacagaauauacaaaaacucgaacgaaugacugggacuuuguaguaacaacugauaucucugagaugggagcgaacuucaaagcagaaaggguaauagacccaagacgaugcaugaaaccuguaauauuaacagacggagaagaacguguuguacucgcaggucccaugccagucacgcauaguucagcggcacaaagacggggaagaauagggagaaauccgaagaaugaaaaugaucaauauaucuacaugggcgagccacucgaaaacgaugaagacugcgcacacuggaaagaggcuaagaugcuucuagacaauauaaauacaccugaagguauuauacccucaauguucgagcccgaaagggagaaagucgaugcuauugacggggaguaucguuuaagaggcgaagcaaggaaaacuuucguagauuuaaugaaacguggcgauuuaccuguauggcuugcauauaaaguagcaucagaagguaucaacuaugccgacagaaaauggugcuucgauggaauacguaauaaccaaauuuuagaagaaaacauagaaguagagguguggaccaaagaaggggaaaggaagaaauugaaaccaagaugguuagaugcgagaacuuacuccgauccuuuagcuuugaaagaauuuaaagaauucgcggcagguagaaaaucuuuaacacucucauugauaacagaaaugggaagguugccuacguuuaugacacaaaaaacgcgggacgcuuuagauaacuuagcaguauugcacucagccgaaauggguggacgagcuuacaaucaugcacuaucggaauuaccugaaacuuuggaaacacuacuucuuuuaggauuacuugcaaccguaacugggggcaucuuccuuuuccuuaugagugggagagggguagggaaaaugacccuuggaauguguuguauuauaaccgcaagcggccucuuaugguacgcucaaauucaaccgcacuggauagcagcauccaucauucucgaguuuuuuuuaauaguuuuauugauuccugaaccggaaaaacaacgaaccccucaagauaaccaauuaacauacguaguaauugcaaucuuaacuuugguagcagcgaccauggcgaaugaaaugggauuccuagagaagacaaaaaaggauuuaggacucgggggauuuacgaugcaacaaccagaaauaaacauacuggauauagaccuacguccagcuagcgcauggacuuuauaugcuguagcaacgacuuuugugacgcccauguuacgucauaguauugagaauuccucaguaaauguuagccugacggcaauagcuaaucaagcaacuguuuuaauggguuuagggaaaggguggccgcuaucgaaaauggauauagggguuccgcuccuugccauagguuguuauucucaggugaauccaaucacgcuaacagcagcucuucuacucuuaguagcucauuacgcaauaauuggucccggcuuacaagcgaaggcgacucgagaagcacagaaaagagcugcagccggaauuaugaaaaaucccaccguagacggaauuacuguaauugaucuagaaccaauaccuuaugacccaaaguuugaaaaacaacugggucaagucauguuauuaguacugugcgucacacaaguacuuaugaugagaacaaccugggcuuuaugcgaggcuuugacuuuagcgacaggaccuaucucgacucuuugggaagguaaucccgggaaauucuggaacacaaccauugcagucucaauggccaauauuuuuagagggucguacuuagcgggagcaggacuauuguucagcauuaugcggaacacaacaagcgcacggaggggaacugguacgauuggagaaacccuuggugaaaaauggaaaucacguuuaaacgcgcuaggaagauccgaguuccaaauauacaagaaaucuggcauacaagagguugaccgaacgcuggccaaggaaggaaucaagcgaggggaaacagaucaucaugcugugucgagaggaagugcuaaacuuaggugguuuguagaaagaaauaugguagcgccagaaggaaaaguaguugaccuuggauguggaagaggagguugguccuauuacugcgggggcuuaaaaaaugugagggaaguuaaagguuuaaccaaaggagggcccggacaugaagaaccaauucccaugucaacauauggguggaauuuaguccgauugcaauccggaguagauguuuuuuucaccccaccggaaagaugcgauacauugcuaugugauauuggugaaucgucuccuaacccgaccgucgaagcggggaggacauuaaggguguuaaaucugguagagaauugguuaggauccaauacacaguucuguauaaaaguccuuaauccauacaugccaucaguaauugaacguauggaaacguuacaaagaaaauucggcggagcucuaguccgcaauccacucucuaggaauucaacacaugaaauguacugggucucaaaugcaucaggaaacauuguaaguagcgucaacaugauaucaagaaugcuuauaaacagguucacuaugagacacaaaaaggcaacauaugaacccgauguggacuuaggguccgggacacgaaauauaggaauagagugcgagaccccuaauauggacaucauaggaaaacggauagaaaaaauaaaacaagaacacgaagcuucauggcauuaugaucaagaccauccuuacaaaacgugggccuaccacggaaguuaugaaaccaaacaaacagggucagcgucaaguaugguaaacgguguggucagacucuuaacgaaaccaugggaugucauuccgaugguaacccaaauggcgaugacagauacuacaccauuugggcaacagaggguguuuaaagaaaagguggauacgcgcacacaggaaccaaaagaagguacgaaaaaguugaugagaaucacggcugaauggcuauggggugagcuggguagacgcaaaaaaccgagaauauguacaagagcagaguuuuguaacaaggugcgaucaaacgcagcucuaggugcaguguucacagacgaaaauaaguggaaaagugcacgugaggccguagaagacgagcgcuuuugggaacuuguagaaaaagaaagaaauuuacaccucgauggaaagugcgaaacaugcguuuauaacaugauggguaagagagaaaaaaaacuuggugaauuugguaaagcaaaaggauccagggcaauaugguauauguggcugggugcaagauuucuggaguucgaagcauuaggauuucugaacgaagaucauugguuuuccagggaaaacagcuugagcggaguugaaggggaaggauugcacaaauuaggcuacauucucagagacaucagcaggaaagcuggcggcgcaauguacgcggacgauacggcggggugggacacuagaaucacuagugaagaccuuaagaacgaggagaugauuacagaccaaauggaaggaagacauaaaaaauuagcugaagccaucuuucgguugacuuaccagaacaagguuguaaggguacaacgaccaacaccucgagggaccguaauggauauaauaucacguagagaucaacgagggagcggacaaguaggaacguaugggcugaacaccuuuacaaauauggaagcucaacuaauacgucaaauggaaggagaggggcuauuuaaaucuauauuacaccuaacuccucaagaagaaacugcaguccacgccuggcuggugcgugaaggucgagagcgacuagcucgaauggcgauuucaggcgaugauugcguagugaaaccauuagacgaccgauucgcaagagcacuaacggcucuaaaugacaugggaaaaguaagaaaagauauacaacagugggaaccaucuaaggguuggagugauuggacacaaguacccuuuuguucucaucauuuucacgaacuaauuaugaaagacggaaggaaacuaguaguaccauguagaaaccaggacgaacuaauuggcagggcuaggauuagucaaggagccggcuggagucuuagagaaacggcauguuugggaaagucauacgcacagauguggucccuaauguauuuucauagacgugauuuacgacuugcagcgaacgcaauaugcagugcggugccgucacacugggugcccacaagucgaaccacguggucaauucacgcaucacaugaauggaugacuacagaggauauguuagcuguuuggaaccgugucuggauacaagacaacccauggauggaggacaagacccccguagaaucaugggaagacauaccauaccuaggaaaaagagaagaucaauggugcggcucauuaauaggauuaacaucucgagcaacaugggcuaaaaauauacagacagcuauaaaccaagugagagcacuuauaggugaagaagaauacauggacuacaugccuucuaugaaaagguuucgaagcgaagaagaggaaagcggaguuuuaugguga

SEQ ID NO: 22947 - RNA, 9876 nt, Artificial Sequence
  derived and/or modified CDS sequence (opt6) from DENV-2__AF119661__SS-prME
acagugggcgugauuaucaugcuuauacccacagcgauggcauuucaucuaacuacacggaauggggaaccccacaugauagucggacgacaagaaaaaggaaaaucucuacuauuuaaaacugaagacggagucaacaugugcacacuaauggcuauugacuuaggagaacugugugaagauaccauaacguauaaauguccgcuacuacgucaaaacgaaccggaagauauagacuguuggugcaauaguacgaguacauggguuacguacggaacaugcacuacaaccggugaacaucggcgagaaaaacgaaguguggcucuuguuccucacguugguaugggacuagagacacggacagagacuuggaugaguagcgaaggggccuggaaacacgcacaacgaauugaaaccuggauucuuagacauccuggcuucauuaucauggcagcaauucuagcauacacaauugguacuacucacuuucaaagggcucugauauuuauacuacuuaccgccguggcuccuucaaugaccaugcguuguauaggggugagcaaccgugauuucguagaaggaguaagcgggggauccuggguugauauuguccuagaacauggcucaugugugacaacaauggcuaaaaacaaacccacacuagacuucgaauuaaucaaaacggaagcaaaacaaccggugacucuucgcaaauacugcauuaaagcaaaauugacaaacaccacuacagaaagccgaugcccaacccaaggagaaccgucgcucaaugaagaacaggacaaaagauuugucugcaaacacagcaugguugauagaggauggggcaaugguugcggccuuuuuggaaaagguggaauaguaacaugugcaacauuuacguguaagaaaaauauggagggaaaaauaguacagccggaaaaucuggaauacacaaucgucauuacaccacacucuggggaagaacaugcgguggguaaugacacagguaaacaugguaaagaaaucaaaauaacaccccagucaagcaucaccgaggcagaauuaaccggguauggcacuguaacaauggagugcaguccuagaacaggauuagacuuuaaugagaugguucuucuucaaauggaagauaaggcuugguugguccauaggcaaugguuucuagaccucccacuuccguggcugccaggggcugauacucagggguccaacuggauacaaaaggaaacccuagucacauucaaaaacccccaugcaaagaaacaagacguagucguuuugggaagucaagaaggggcgaugcauacugcauugacgggcgcuacagaaauccaaaugucgucaggaaaccuccuuuucacgggucaucuaaaaugccgucucagaauggauaaauugcaguugaagggaaugucuuauagcauguguacugggaaauuuaaaaucgugaaggaaauugcagaaacacagcauggaacaaucguaauccgcguccaauacgagggugaugguucucccuguaagauuccguuugaaauaauggauuuagagaaaagacacguccuagggagacugaucacgguaaaucccaucgugacugaaaaagauagcccuguuaauauugaggcagagccaccguucggagacaguuauauaaucaucggcgucgaacccggccagcuaaaauuaaauugggucaagaaagguagcucaaucggucaaauguuugaaacuacaaugcgaggagcaaaacgaauggcuauucugggggauacagcaugggauuuuggaagccuaggcggaguuuucacuucgauagggaaagcacuccaucaaguauuuggagcaauauauggugccgcguucaguggcguaucauggaccaugaaaauacugaucggagugaucauuacauggauagguaugaacagcagauccacgaguuuaucaguuucucucgugcuagucggcguaauaacuuuguaucuuggggcuaugguucaggccgacucuggcugcguaguaaguuggaaaaauaaagagcucaaauguggaagcgggaucuucaucacugacaacguucauacauggacugaacaauauaaguuccaaccggaaucgccgagcaaauuagcuuccgcaauacaaaaggcacaugaagaaggcauuuguggaauacgaagcguuacacgcuuagaaaaucuaauguggaaacaaauaaccccagagcucaaccauauacucucugaaaaugaggugaaacucacaauaaugacaggcgauauaaaaggaauuaugcaagcuggaaaacgaucauugcgaccccagccgacagaauuaaaguacucauggaaaaccuggggaaaagcuaaaaugcugucaacagagucccauaaccagacuuuucucauagauggaccugagacagcagaaugcccuaacacaaaucgagcauggaacucacuugaaguugaggacuauggcuucggaguauucacgacaaacauuuggcucaaacuuagggaaaaacaggauguauucugugacuccaaacuaaugagugccgccaucaaagauaaccgcgcuguacaugcagacaugggauacuggaucgaaucagcccucaacgauaccuggaaaauggaaaaagcaucauucauugaagugaaaucaugccauuggccaaaaucucauacauuauggucgaacggaguccucgaaagcgaaaugauaauuccuaaaucuuucgcuggcccagucucacaacacaacuauagaccggguuauuauacacaaacugcugggccauggcaccuagguaaauuggaaauggauuuugauuuuugugagggaacuacugucguaguuacagaggauugugguaauagagguccaucacugaggaccacaacagcaucaggaaaacuaauuacagaauggugcugcaggagcuguacuuuaccuccacugagauauagaggggaagauggguguugguauggaauggagauaagaccauuaaaggaaaaagaagaaagucuugucgauagucuaguaaccgcaggacauggacagaucgauaauuuuaguuuaggagucuuagguauggcucucuuuuuggaagaaaugcugagaacucguguggggacaaaacaugcuauacucuuaguagcuguuaguuuuguaacucugauaacaggcaauaugucguugagagaucugggcagagugaugguaaugguuggugcuacaaugacugacgacauaggaauggguguaaccuaucuggcccuuuuagcggccuucaaaguucgacccacuuuugccgcaggucuucuauugagaaagcuaacgaguaaagaacugaugauggcaacaaucggcauagcauuacuaagucagucuacaaucccagagaccauacuugaacuuacugaugcucuagcguuggggaugaugguuuugaagauaguaagaaauauggaaaaauaucaguuagcggugacgauuauggccauauccugcgugccuaacgcaguuauacuccaaaaugcuuggaaaguuaguuguacaauccuugcggcuguaagcguuaguccacuacuuuugacaagcagucaacaaaaagcagacuggauccccuuggcacuaacgaucaaaggucuaaaucccacugcaauuuuccuaacaacucuagcgcgcacaucuaaaaagcgaaguuggccauuaaaugaggcuauaauggcgguugggauggugagcauauuagcaaguucacucuuaaagaacgacauacccaugacuggaccucuaguugcgggagggcuacuaaccgugugcuauguauuaacaggcagaagugcagaccuagagcuggagcgugcuacugacguaaagugggaagaucaagccgaaauuaguggaucuaguccaauucuaucuauuaccauauccgaagacggaaguaugucgauaaagaaugaagaggaagaacaaacucuuaccauccugauacgaacaggcuuacuuguaauaaguggcuuauuuccugucaguauuccgauaaccgcagcugccugguacuuaugggaagucaagaaacaaagggcaggaguacucugggacguaccgucuccaccaccaguagaaaaagcugaauuagaagauggagccuauagaauuaaacaaaaagguauacuagguuauucacagauagggacuggaguguauaaagaggguacauuccauacaauguggcauguaacgagaggggcuguacugaugcaccgagggaaaagaaucgaaccauccugggcagacgugaagaaagaucuuauaucuuaugguggggguuggaaguuagaaggugaauggaaagaaggcgaagaaguccaaguacuugcauuagaaccggguaagaacccaagggcaguucaaacuaaaccuggguuauucaaaacuaacacgggaacaauaggcgcagugagucuagacuuuaguccuggcacgucggggucgccuauugucgaucggaaaggcaaaguuguaggacuguaugguaaugguguaguaacaagaagcggggcuuauguaucagcaauagcucaaacagagaaauccauagaagauaauccagaaauugaagacgauauuuuuaggaagaaacgauugacaauaauggauuugcaccccggugccgggaaaacaaaaagauauuuaccagccauugugcgcgaagcaauaaaacgcggauugagaacuuugauauuggcuccaacccgcguagucgcagcagaaauggaagaagcauuacguggacuuccaauuagauaucaaacgccagcaauuagagcagaacauaccgggcgagagauaguggaucuuaugugucaugcaacauuuacaaugaggcucuuaucacccguccgagugcccaauuauaauuuaaucauaauggaugaagcucauuuuacagacccugcgaauauagcagcacgaggauacaucucuacacgcguugaaaugggagaagcagccggaauauuuaugacugcaacgccgccuggaucacgugauccuuuuccccagucuaacgcgccaauaauggaugaagaaagggagauacccgaacgauccuggaacucgggccacgagugggucacagauuucaaagguaaaaccguuugguucguaccuaguauaaaagcuggaaaugacauagcagcauguuuaaggaagaaugggaaaaaggucauccaguuaaguaggaaaacguucgacucagaauacguaaaaacacgaacuaaugacugggacuuuguaguaacaacagauauuagugaaaugggagccaauuucaaggcagaaagaguuaucgacccaagaagguguaugaaaccagucauauuaaccgauggagaagaacguguuauucuugccggaccaaugccuguaacacauagcucagcagcacaacggagaggucguaucgggagaaauccuaagaaugaaaaugaccaauauauauauaugggcgaaccauuagagaacgacgaagauugcgcgcacuggaaggaagcaaaaaugcuucuagacaauauaaauacaccagaagguauuauuccaagcauguucgaaccugaaagagagaaggucgacgccauugacggugaguauaggcuaagaggagaggccagaaagacuuucguugauuuaaugaggcgaggcgaccuucccguauggcuugcauauagagucgccgccgaaggaauaaacuacgcagaccgacgaugguguuuugacggagucaagaacaaucaaauauuagaagagaacguggaaguagaaauuuggaccaaagagggagaaagaaagaaacuaaaaccuaggugguuggacgcuaggauauauucugauccacuagcucuaaaggaauuuaaagaauuugcugccgggcgcaagucauugacuuugaacuuaauaacagaaauggggagacucccaacauuuaugacccaaaaagcuagagaugcacuugauaauuuagcaguacuucacacugcugaagccggagguagagcuuacaaccaugcuuuaagcgaauuacccgaaacgcucgagacauugcuacuucuaacauugcuugccacaguuaccggcggcauauuccuauucuuaauguccggaaaggguguugguaagaugacauuagguaugugcuguaucauaacagcuucuauucuacucugguaugcccagauucaaccccacuggauugcggcguccauaauccuagaguucuuuuuaaugguacuacuuauacccgaaccggaaaaacaacgcacaccucaagacaaucaguuaacuuauguaguaauagcuauuuuaacuguaguugcagcaacaauggcaaaugaaaugggcuuuuuagagaagacuaagaaagauuuaggucuuggaaguauugccacacaagaaccagaaucaaacauuuuagacauagacuuacgacccgcgucugcauggaccuuauaugcaguagcuacgacuuuuguaacaccuauguugcgacauucgauugaaaauucaagugugaauguuucauuaaccgcaauagcaaaccaagccacaguucuaaugggacuaggaaagggguggccguuaagcaaaauggacaucggcgugccguuacuagcuauagguuguuauucgcaaguaaacccuauaacccuuacagcagcccuauuacuucuaguugcacauuaugccauaauaggaccgggacuacaggcgaaagccacucgugaagcacagaaaagagcugcagcggguauaaugaaaaauccaacgguggauggaauaacugucauagauuuagauccaaucccauaugauccaaaauuugaaaaacaacuuggacaaguaaugcugcuaauacucugcguaacgcaaguuuuaaugaugcgaacaacaugggcauuaugugaagcgcugacucuagcaacugguccaauuucaacuuuaugggaagguaacccgggcagguuuuggaacaccacuaucgccguaucaauggcaaauauuuuucgagguucauaccuugcgggugcaggucuacuuuucuucauaaugaaaaauacgacuaacacuagaagaggcaccggaaacauuggugaaacauuaggugagaaguggaagucaaggcuaaacgcacuaggcaaaucagaguuccaaauauacaagaaaagcggcauucaggaaguugaucgaaccuuagcaaaagaagggauaaaaagaggagaaacagaccaccacgccguuucacguggcucugcgaaacuacgaugguucguagaaaggaauauggugacaccugaaggcaaaguaguagaccuugguuguggacgaggcggcuggucauauuauuguggaggauugaaaaacguccgagaagugaaaggacuaacgaaaggagggccaggucacgaggagccuauaccaaugaguacuuacggguggaacuugguuagacugcagucgggggucgacguguucuucacucccccggaaaaaugcgacacauugcugugugauauuggagaaaguuccccaaacccuacaauugaagcaggacguaccuuacguguauuaaguuuagucgaaaauuggcuuaauaaugacacccaauuuuguauuaaaguucuuaacccauacaugccaucaguuauagagaaaauggaaacguuacaacgaaaauacgguggugccuugguacguaauccacuaagucgaaauaguacucaugaaauguauuggguaagcaaugcuacgggaaauauuguaaguucaguaaauaugauuagucggaugcugauaaauagauucacaaugaagcauaaaaaggcaacuuacgaaccagacguagaccuuggaaguggcacccggaauauaggcauagagagcgaaauuccaaacuuagacaucauagguaaaagaauagagaaaaucaagcaggagcacgaaacaucuuggcacuacgaccaagaccauccauauaaaacaugggccuaccacgguucauacgaaacaaagcaaacuggcucagccucuucgaugguaaauggagucguacgccugcugacuaaaccuugggauguaguuccaaugguuacgcagauggcaaugacugauacuacgccauuuggacaacaaagaguuuucaaggaaaagguggauacaagaacccaagagccaaaagaagguaccaaaaaguuaaugaaaauaacggcggaguggcuauggaaagaguuaggaaagaagaaaacuccaaggaugugcaccagggaagaguucacuaggaaaguaagaucgaacgcagcauuaggggcaauauuuacagaugagaauaaauggaaauccgcacgugaagccguagaagauaaucgcuucugggagcuuguggacaaagagcggaaucuacaucucgaaggaaaaugcgagaccuguguauauaacaugaugggaaaacgagagaagaaauuaggcgaguuuggaaaagccaaagggucccgggcaauuugguacaugugguuaggggccagauuccuagaauuugaggcacucggauucuuaaaugaagaccacugguuuagcagagaaaacucacuuagugguguugaaggagagggauuacacaaauuagguuauauacuuagggacguaagcaagaaagagggaggcgcuauguaugcugaugauaccgcagggugggauacaagaauaacauuagaggaucuuaaaaaugaagagaugguaacaaaucacauggaaggugaacauaagaaacuagcagaagccauuuucaaacuuacauaucaaaauaaagccguacgaguccagagacccacucccagaggaacggucauggauauaauaaguaggcgggaucaacguggaucaggacagguaggaaccuacggacuuaacacuuuuaccaauauggaggcucaguuaauaagacaaauggaaggggaagggauauucaaauccauacaacauuugacgguuacagaagaaauagcaguccaaaauugguuagcgaggguaggacgcgaaaggcugucaagaauggcaauuucuggggaugauugugugguaaaaccauuagacgaucgauuugcaagugcauuaacagcccuuaaugauaugggaaaaguacgcaaggacauacaacagugggaaccaucucgaggguggaaugauuggacucaggugccuuuuuguagucaucacuuucacgaacugauaaugaaagacgggaggguuuuaguaguacccugucgaaaccaagaugaauuaauaggucgggccaggauuucacaaggcgcaggguggucuuugaaagaaacagcaugucuuggcaaaucauaugcacagauguggaguuuaauguauuuucauagaagagacuuaagacuagcggcgaaugcaaucugcagugcaguucccucccauugggugccgacaagucguacaaccuggagcauacaugcaaagcacgaauggaugacuacugaggauauguugacaguauggaacagaguauggauacaagaaaaucccuggauggaagacaaaacaccgguugaaucgugggaggaaguaccuuauuuaggaaagagagaagaucaaugguguggaucacugaucggacuaacaucuagagcuacaugggcuaagaacauacagacagcgauuaaucaaguuagaucacugaucgguaaugaagaauacacugauuauaugcccagcaugaaaagauuucgucgggaagaagaggaagcuggaguucuuugguaa

SEQ ID NO: 22948 - RNA, 9876 nt, Artificial Sequence
  derived and/or modified CDS sequence (opt6) from DENV-2__EU056810__SS-prME
acugcugguauaauaauaaugcuuauuccaacaguaauggcuuuucaucuuacgacacgaaacggugaaccacacaugaucguaaguagacaggaaaaagguaaauccuuauuguuuaaaacagaagaugguguaaacaugugcacccugauggcuauggacuugggugaacugugugaagauacgauaacauauaacuguccucuauuacgacaaaacgaaccggaagauauagacugcugguguaauuccacgucaacaugggucacauacgguacaugcacggcaacaggagaacaucgucgagaaaaacggaguguagcccuagugccccauguugguauggggcuagaaacccggacugaaacauggaugaguucagaaggagcuuggaaacaugcacagagaauagaaacauggaucuugagacacccuggauuuaccauaauggcugcaauccuagcauacacaaucgguacuaccuacuuucaacguguauuaauuuucauccuucuaacagcgguagcuccgaguaugacuaugagaugcauaggaauuagcaaccgugacuucgucgaagggguauccgguggcucauggguagauauuguuuuagaacacggaucuugcguuacaacuauggcuaaaaacaaaccaacccuagacuuugaacuuauaaaaacggaagcaaaacagccagcaacccuaagaaaauauuguauagaagcuaaauuaacaaauacuacaacagcaagcagauguccaacacaaggagaaccaagccuaaaugaagaacaagauaaaagauucguuuguaaacauaguaugguagaccgaggauggggcaauggguguggacuuuuugggaaagggggaauagucacuugcgcgauguuuacauguaagaaaaauauggaagggaaagugguacagcccgaaaaccuggaauauacuauaguuauaaccccgcauucaggugaagaaaaugccgucgggaaugauacaggaaaacaugguaaagagauaaaaauaaccccacagucaucuaucacagaggcagaauuaaccggcuacgguacagucacuauggaauguaguccgcgaacagggcuugacuucaaugagaugguccuacuucaaauggaaaauaaagcauggcuaguccaucgacagugguuucuggauuuaccacuaccauggcuuccgggcgcagauacacaagggucaaauuggauacaaaaagagacucuagugacuuuuaaaaauccacacgcuaagaaacaagaugucguuguacuaggaagccaggaaggagcuaugcauacugcccuaacgggggccaccgaaauacaaaugagcagcggcaaucuacuuuucaccgggcauuuaaaaugcaggcuuagaauggacaaguuacaauugaaagggaugucguauuccauguguacuggcaaauuuaaaguagugaaagaaauugcagaaacucaacacggaaccaucgucguaaggguucaauacgaaggugacggaucgccauguaaaauuccauuugaaauuauggacuuagagaaaagacaugugcucggacgauuaauaacaguaaacccaauuguaacagagaaagauaguccggugaacaucgaagccgagccgccauuuggggacucguauauaauaauagggguagaaccuggccagcuuaaacuaaauugguucaagaaaggaucaucgaucggacaaauguuugagaccacaaugagaggagcaaaaagaauggcaauauuaggcgacacugcaugggacuucgguucacuagguggcguauuuaccagcauagguaaggcacuucaucaaguuuucggcgcgauuuacggagcagcauuuucgggcgugucuuggacaaugaagauauuaauugggguugugauuacauggaucggaaugaacucacgaaguacaucguugucgguaagccucguccucgugggggucguaacguuauaucuuggaguaaugguacaagcugacucgggaugcguggucucauggaaaaacaaagaacugaaguguggaagugguauuuuuguuaccgauaaugugcauaccuggacagaacaauauaaauuccagccagagucaccauccaaacuugcgucugcuauucaaaaagcacacgaagaggggauaugcggcauccgaagcguuacccgacuagagaaccuaauguggaagcagauuaccccugaauuaaaccauauccuaucagagaaugagguaaaguuaacaauaaugacaggugacauaaagggaauaaugcaggcaggaaaaaggucauuacgaccacaaccgacugaacuuaaauacucauggaaaacauggggaaaggccaaaauguugucgacugaacugcacaaucaaacauuucuaaucgauggaccagaaacggcugaauguccuaacacuaaccgagcauggaauagccucgagguagaagauuaugguuuugguguauucacaacuaauauaugguuaaaacuaaaagagaggcaagauguguuuugcgacaguaaacuaaugucggcagccauaaaagauaauagagcuguucacgcagacaugggcuauuggauagagagugcuuuaaacgauacuuggaaaauugagaaagcuaguuucaucgaaguuaaaaguugucauuggccaaaaucccauacucuguggagcaacggaguuuuagagucggaaaugauuauccccaaaaauuuugcgggaccaguaagccagcauaacuauagaccuggguaucacacacagacugccgguccauggcauuugggaaaauuagagguagauuuuaauuucugcgaagguacuacaguaguaguaaccggagauuguggcaaucgggggccaagucuacgaacgacaacugcaagugggaaacuaauuacagaauggugcugucgaaguuguacacuuccgccacuaagguaucgcggugaagacggcuguugguacgguauggagauaagaccucuuaaagaaaaagaggaaaacuuaguaaauucccuuguuacagcaggucacggucaaaucgauaauuucuccuuagguguauuaggaauggcgcuauuuuuagaagaaauguuaagaacaaggguuggaacuaaacaugcuauauuauuaguagccgugaguuucgucacacuuauuacaggaaacaugucauucagagaccugggaagagucauggugaugguuggcgcaacuaugacagaugacaucggaauggggguaaccuaucucgcauuauuggcugccuuuaaaguuaggccgaccuucgcagcaggacuauuauugcgaaaauugaccaguaaggaguuaaugaugacaacaaucggaauuguacugcuaucacaaaguacaauuccugaaacuguuuuagaacuaacagaugcgcuagcguuggguaugauggucuuaaagauugugagaaauauggaaaaguaucaauuagcuguaacuauaauggcgauucuaugcguuccaaaugcuguaauuuugcagaaugcguggaaaguaucuuguacaauuuuggcagucguaucaguaucgccauugcuuuugaccagcucacaacagaaagcagauuggauaccauuagcccuaaccaucaaagguuuaaacccaacggcgauauuuuuaacgacauugagucgaacuucgaagaaacgcucauggccguugaacgaagcuauuauggcuguaggaauggucaguauacuagcaaguucacuccucaaaaacgauauaccaaugacugguccccuaguggcuggaggucuguuaacggucuguuacguucuuacaggccggagcgcugacuuagaacucgaaagagcggcagacgucagaugggaagaucaagcggaaauaaguggaagcucccccauauuauccauaacaauaucggaagacgguucaauguccaucaaaaacgaagaggaagaacaaacgcuaacaaucuugauccggacaggacuguuggugauaagcggacuauuuccagucucaauuccuauaacagcugcugcuugguauuuaugggaaguuaagaaacagagagccgggguuuuaugggacguaccaagcccuccgccaguaggaaaagcggaauuagaggauggagcauaucguauaaaacagaaaggcauucuuggauauagucaaauuggggcagggguauauaaggaagggacauuucauacuauguggcacguaacuagaggggccguacuuaugcacaaagggaaaaggauugaaccaagcugggcagacgugaaaaaggaccugaucaguuauggaggcggguggaaauuggaaggagaauggaaagaaggagaagaaguucagguucuagcucuagagccaggcaaaaacccaagggccguacagaccaaaccgggacuauuuaagaccaauacagguacaaucggagccguuucucuagacuucucaccaggcaccaguggaucaccgauaguugauaagaaagggaagguuguagguuuauauggaaacggcgugguaacccgaucggguacuuauguaucggccauagcacaaaccgagaaaaguauagaagauaauccagaaauagaagaugauauuuucaggaagaaaagacuaacaauuauggaucugcacccaggagcgggaaaaacgaaacgauaucugccugcaauaguuagagaagcaauaaaaaggggacuaagaacauuaauuuuagcaccuacaaggguaguugccgcugaaauggaggaggcccuacggggacuucccauaagauaccagaccccugcuauaagggcagaacauacaggacgagaaaucguggauuuaaugugccacgccacauuuacaaugagauuauugucuccgguuaggguaccuaauuacaacuugaucauaauggacgaagcgcauuuuacagacccagcgucuauagcggcaagaggcuacauuucuacccgagucgaaaugggagaagcugcgggaaucuucaugacagccacaccaccggguagccgugauccuuuuccgcaaucaaacgcaccaaucauggaugaagaacgugaaauaccggaaagaucauggaacucaggucaugaauggguaacugauuucaaagguaaaaccguaugguucgucccaagcauaaaggccggaaaugauauagcagccugcuugaggaaaaauggcaagaaaguaauacagcuaucgcgaaaaaccuuugacucugaauauauaaaaacucgaacaaacgauugggauuucguaguaacuacugacauaagcgagaugggagccaacuucaaagcagaaagaguaauugauccucguagguguaugaaaccugugauacucacugacggagaagaaagagucauacuagcagggccaaugccaguaacacacagcagcgcggcgcaaagaagggguagaauuggacgaaaucccaagaacgaaaacgaucaauauauauauaugggugagccccuugaaaaugaugaggacugcgcccacuggaaggaagcaaagaugcuauuagauaauauaaauacaccggagggaaucaucccaaguauguucgagccggaaagagagaaaguagaugcaauagauggggaauaccgauugcgcggggaagcacgaaaaacauuuguugacuuaaugagaagaggagauuugccuguuugguuagcuuaucguguagcggccgaagggauaaacuaugcagaucgccguuggugcuuugauggcauaaagaacaaccaaauauuagaagaaaacguggaggucgaaauuuggacaaaagaaggggaacggaagaaacuuaagccucgauggcuggaugcccguauauauucggauccacuggcguuaaaagaauuuaaggaauuugcagcuggucggaaaucacuaacccugaauuugauaacugaaaugggaagauugcccacuuucaugacgcaaaaagcucggaaugcauuagacaaucucgcuguacugcacacugcggaagcuggaggacgagcauacaaccaugcucuuucggaguuacccgaaacucucgagacucuguuacuauuaacacuacuugcuacggugacaggaggaauuuuucuguuucuuaugagugguaaagguauagggaagaugacacugggaauguguugcaucauaacggcaucuauuuuacuaugguaugcucagauucaaccacauuggauagcugcuucgauaauuuuggaguucuuucuuauagucuuacucauacccgaacccgaaaaacaaagaacaccacaagacaaccaguuaacuuauguugugaucgcgauuuugacagucguagcagcgacuauggcuaacgaaaugggauuucuugagaagaccaagaaagacuucggucuagguucgauagcuacccaacaacccgaaaguaauauauuagacauagauuuacgacccgcuucugcauggacgcuuuaugcagucgcaacaacauucauaacaccaauguuaagacauucuauagaaaauucuaguguaaaugugagucuaaccgcaaucgcaaaccaagcaaccgugcuuaugggacuaggaaaaggcuggccguugucgaagauggauauuggcguaccguuacuugcaauugggugcuauucacaagucaacccuauuacuuuaacugcugcccuauuauuauuagucgcgcauuacgcgauuauagguccugguuuacaagcaaaagcaaccagggaagcucaaaaacgcgcugcagcagguaucaugaagaauccgacgguugauggaauaacgguuauagaccuagacccaauaccauacgauccuaaauucgaaaaacaacuaggucagguuaugcuccuuguacuaugcgugacacaaguacuuaugaugaggacgacuugggccuuaugcgaagcacucacacuagcuacuggccccauaucaacucuaugggaaggaaacccagggagauuuuggaauacgacgauagcagucuccauggcaaauaucuuccgaggaucauaucuagcgggggcaggucuauuauuuucaauuaugaaaaacacagcaaauacccgacgggguaccggaaauacuggagaaaccuuaggugaaaaauggaaaaauagauugaaugcauuaggaaaaagugaguuucaaaucuauaagaaaucuggaauacaagagguggauagaaccuuagccaaagagggcauaaagcguggugaaacugaucaucaugcuguguccagaggcuccgccaaauugaggugguucguggaacgcaauuuagucacuccagaaggaaaaguaguugaccuaggcugugggcgagguggguggucauauuacuguggcggacugaaaaacguuagagaaguaaaaggucucacaaaaggagguccuggucacgaagaaccaaucccuaugucaacuuacggguggaauuuaguccgguugcagucuggagucgacgucuucuuuacaccuccggagaagugcgauacacuucuaugcgauauaggagaaaguucuccuaauccuacaauagaagcggguagaacauuacgaguauugaauuuaguggaaaacugguuaaauaauaacacgcaauucugcauaaaaguccucaacccauauaugccgagcgugauagagaaaauggaagcgcuacaacguaaauauggaggggcacucguacggaacccauuaucaagaaacucaacccacgaaauguauugggucucaaacgcuaguggcaauauugugagcucgguaaacaugauuagccguauguuaauaaacagguucacuaugagacauaagaaagccaccuaugaaccggauguugaucugggcagugguacacguaauauuggaauagagucugaaacaccaaacuuagauauaauaggcaaacguaucgagaaaauuaaacaagagcaugaaacaaguuggcauuacgaccaagaucauccauacaaaacgugggcuuaucaugggucauaugaaacgaaacaaacaggaucagcaagcaguauggugaacggaguaguaagguuauuaacuaaaccuugggauguaauaccaaccgugacgcaaauggcaaugaccgauacgacucccuuuggccaacaacgagucuucaaggaaaaaguugacacacgaacccaagaacccaaggaaggaaccaagaaacuaaugaaaauaacagccgagugguuauggaaagaguugggcaagaagaaaacaccacggauguguacacgagaagaauuuacacguaagguacgaucgaaugcagccuuaggagcuaucuucacggaugaaaacaaguggaagucagcgagagaagcaguagaagauucacgcuuuugggaauugguagacaaagagaggaaucuucauuuagagggcaaaugcgaaacguguguuuacaacaugauggggaagagagagaagaaauuaggugaauuugguaaagcaaaagguucgcgugccauuugguauaugugguuaggagcaagauuuuuagaguucgaggcuuuaggauucuuaaaugaagaucauugguuuucccgggaaaacucacuaucagggguagaaggagaggguuuacacaaauugggcuauaucuuaagggauguguccaagaaagaagguggggcaauguaugcagacgacacagcggggugggauacacguauaacgcuagaggacuugaaaaaugaagagaugguaacuaaucacauggaaggagaacacaagaaacuagcggaagcaauuuucaaacuaacauaccaaaauaaaguagugcguguucaacgucccacacccagaggaacaguaauggauauaauaucaagacgugaucaaagaggaucaggucaaguagguacuuauggacuaaauacuuucacuaacauggaagcucaauugauucgccagauggaaggugaaggaguguucaaaaguauacaacaucuuacaguaacugaggagauaacagugaagaacugguuggcccgaguagguagagagagauugaguagaauggcaauuucuggagaugacuguguagugaagccuuuagacgacagauuugccagcgcucuaacggcccuuaaugacaugggcaaaguaagaaaagauauacagcaaugggagccaagccgcggauggaacgacuggacacaagucccuuuuugcucucaccauuuucaugaguugauaaugaaagacggucguguauuaguaguuccauguaggaaccaagacgaacuuauagggagagcuagaaucagucagggggcugguuggaguuuacgagaaaccgcuuguuuaggaaaaucauacgcacaaauguggaguuugauguauuuucaccggcgagauuugagguuagcagcaaacgcuauaugcucagcagugccaucgcacugggucccgacaagcaggacgaccuggucaauucacgccagacacgaauggaugacaaccgaagauaugcuuacaguguggaauagaguuuggauacaagaaaaccccuggauggaggacaaaacgcccgucgaaaguugggaagaaaucccauauuuggggaaaagagaagaccaauggugugggaguuuaauugggcugacaucgagagcaacgugggccaaaaacauucaaacugcaauaaaucaaguucgauccuuaauagggaaugaggaauauacagacuacaugccaucgaugaaaagauuccgaagagaagaagaagaagccggaguucugugguga

SEQ ID NO: 22949 - RNA, 9876 nt, Artificial Sequence
  derived and/or modified CDS sequence (opt6) from DENV-2__EU056811__SS-prME
acagcaggaaugauaauuaugcucaucccuacaguaauggcuuuucaucuuaccacucguaauggugaaccgcacaugauaguaucuagacaagaaaaaggaaaaucacuguuauuuaaaacaaaagaugguacaaauaugugcacucugauggcaauggaucucggcgaauugugugaagacacuauaacauauaaaugcccauuuuuaaaacagaaugaaccugaagacauagacuguuggugcaacaguacuucuacgugggugacauauggaaccuguacgacgacaggagaacauaggcgagagaaaagaucagucgcacugguuccccacguagguaugggauuagaaacaagaaccgaaacuuggaugucaucggaaggagcauggaaacaugcucaaagaauugaaacuuggauacuaagacacccuggcuuuacuauaauggcugcgauacucgcauauacaauagggacgacacacuuucaaaggguuuuaauauuuauacuuuuaaccgcaauugcaccaagcaugacuaugcgcugcauagggauaucuaaccgggauuucgucgaaggcguuucugguggaucgugggucgauaucguuuuggaacauggaucgugcguaaccaccauggccaaaaauaaaccuacccuagauuucgaauuaauaaaaacggaagcuaaacaaccugcaacguugcggaaauacugcaucgaagcaaaauugacuaauacgacgacagacucacguugcccaacacaaggggaaccgacuuuaaaugaagaacaggauaaacgauuuguuuguaaacacucaaugguagauaggggauggggcaacgguugugguuuguuuggaaaaggaggaauaguaaccugcgcaauguuuacuuguaagaaaaacauggaaggaaaaauaguacaaccagaaaauuuagaauacaccguggucaucacuccucacucaggcgaagaacacgcgguagggaaugauaccgggaaacauggcaaagaaguuaaaauuacaccacaaucuaguaucacugaagcggaguugacaggcuaugggacggucacgauggagugcucacccagaacugggcuagauuuuaaugagauggugcuacuccaaauggaagacaaagcaugguugguacauaggcaaugguuccuagauuuaccacucccgugguuaccgggcgcugauacacagggaucgaacuggauucagaaagagacauuaguaacguuuaaaaacccacaugcaaagaaacaggacgugguaguccuaggcucacaagaaggggccaugcacaccgcgcuaacaggcgcgacagaaauucaaaugucaucagguaaccuacuuuuuacuggucauuugaaaugcagacuucggauggauaaauugcaauuaaaaggaaugucguauagcauguguacuggaaaauuuaaaauaguaaaagagaucgcagagacacagcaugguacaauagucauacgaguucaauaugaaggagauggaaguccaugcaaaauacccuucgagauaauggaucuugaaaaacgacauguacugggucguuugauaacaguuaacccaaucgucacugaaaaagauucaccgguuaacauagaagccgaacccccauucggggauagcuacauaaucauagguguagaaccaggucaacuaaaacuugacugguucaagaaaggguccuccauuggucaaauguucgaaacaacaaugagaggugcuaaacgaauggcaauacuaggugauaccgcaugggacuucggcucuuugggaggggucuuuacgucgauaggaaaagcucuccaccaaguauucggcgccauuuacggugcugcauucagugguguuucauggacuaugaaaauucuaauagguguaauaaucaccuggauagggaugaacaguagaucuacaucucucuccgugucucuaguacucguuggaauagugacccuguaucucggagucaugguucaagcagacucugguuguguugugaguuggaaaaacaaagagcuaaaauguggaucaggcauauuuguuacagauaaugugcacacauggacagaacaauauaaauuucaaccagaaaguccauccaaacuugcgagugcuauucaaaaagcucaugaagaagguauuugcggaaucaggagugugacucggcuagagaauuuaauguggaaacagauuacaagugaacuaaaccauaucuuaucggaaaaugaaguaaaacucacuaucaugacgggagacauaaaaggaauuaugcaagucgggaaaagguccuuaagaccgcagccuacagaacuuagguacucuuggaagaccuggggaaaagcuaagauguuaucgaccgaacuacauaaucaaacauuccucaucgacgggccugaaacugcagaguguccaaauacuaauagggcguggaauagucuugaaguugaagauuacggguuuggaguuuuuaccacgaauauaugguuaagauuaagagagaaacaagaugcguucugcgacucaaaauuaaugucagcggcgauaaaggauaacagagcuguacaugcagauaugggcuacuggauagaaucagcacuuaacgauacuuggaagauugagaaagcaaguuucauugaggugaagaguugucauuggccaaagagccauacguuaugguccaacggggugcuagagagcgagaugguaauccccaaaaauauagcaggcccaguaucccaacacaacaauagaccaggcuaucauacacagacagcgggacccuggcaucucggaaaauuggagauggauuuugauuucugcgaaggaacuacagucguaguaacagaagaguguggaaauagagggccgucauugagaacaacuacggccagcgguaaacucaucacugaauggugcugccgaucaugcacauuaccgccgcuuagauauagaggugaagauggaugcugguauggaauggaaauuagaccccuuaaggaaaaagaagagaaccuuguuucaagccuaguaacagcaggucauggacaaauugauaacuuuaguuuaggaauauuaggcauggcacuguuucuagaagagaugcuaagaacacgugugggaacaaaacaugcuauccuguuaguagccgugaguuuccucacguuaaucacaggaaauaugucauuucgugaucuagggcgaguuaugguaaugguuggugccacaaugacagacgauaucggaaugggcgugacguauuuagcuuuacuagcagcauuuaaaguuagaccaacauucgcggcugggcugcuguuaaggaaacuaaccaguaaagaauuaaugaugacuacuauaggaauagucuuacuaagucagaguucaauuccggagacuauauuagaauuaaccgaugcuuuagcuuuagggaugaugguguuaaaaauggugagaaauauggaaaaauaccaauuagcuguaaccaucauggcgauacuauguguaccgaacgcgguuauucugcaaaacgcauggaaggugagcugcaccacuuuggcagugguaucuguaucaccccuuuuguugacaucgucacaacaaaaggcggacuggauaccucuggcauuaacaauuaaaggauuaaacccgaccgcuauauuuuuaacuacguuaacuagaacuucuaagaaaagaucuuggccacuaaaugaagcuauuauggcuguaggaaugguaaguauccucgcaaguagucugcuuaaaaacgauauccccaugaccggaccacucguugcaggcggguuacuaacaguguguuaugugcucacuggaagaucagcagacuuagaauuagaaagggcuacagaugucaaaugggaugaucaagcggaaauuagcgggucuagcccaauucucucaauaaccaucucugaagauggaucaaugucaauuaaaaaugaagaagaggagcaaacacuaacgaucuugauaagaacugggcuauuaguuauaucaggccuguuuccuguaucaaucccaauuacagcugcugcgugguaucuaugggaaguuaagaaacaacgugcaggaguucuaugggacguucccucacccccgccugucggcagagcagaacuagaagauggcgcauauagaauaaagcagaaagguauucuaggguauagucaaaucggcgccggugucuacaaagagggaacuuuucauaccauguggcaugugacccgaggagcaguacuuaugcacaaagguaaaagaaucgagccuuccugggcagacguuaagaaagauuuaauuaguuacggcgggggauggaaauuagaaggcgaguggaaagagggugaagaaguacagguacuagcuuuagagcccggcaaaaacccuagagcaguucagacuaaaccaggcuuauuucguacgaauacgggcacuauaggugcuguuucccucgauuuuagucccggaacaucuggaaguccaauagucgauaagaaagguaaagucgugggacuuuacgguaaugggguaguaacaagaggaggggcauauguuagugcuauagcacaaacagaaaaagguauagaagauaauccggagaucgaagaugacauuuuuagaaagaggagacuaaccauuauggaucuccauccgggugcgggaaagacgaagcgauacuuaccagcgauaguuagggaagcaaucaaaagaggucuuagaacacugauccucgcgccuaccagagucguugcggcagaaauggaggaggcgcuccgugguuuaccuaucagauaucaaaccccugcaauuagagcagaacauacaggacgagaaauaguagaucugaugugccacgcuacuuuuaccaugagguuguugagucccauucgcgugccuaauuauaaccucauuauaauggaugaagcucauuucacagauccugccucaauagcugcaagagguuacauaucaacacgugucgaaaugggugaagcagcaggaauauucaugaccgcaacaccuccagguaguagagaccccuuuccccagucuaacgccccgauaauggacgaagaacgugaaauuccggagaggucuuggaauaguggucaugaauggguuacagacuucaaaggaaagacugucugguuuguaccauccauuaaaacaggcaaugacauugcagcuugucuaaggaaaaacggaaaaagggucauacaguuaucucgcaaaacuuucgauagugaauacguaaagacgcgaacaaaugauugggacuucgucguaaccacagacauaagcgaaaugggagcuaacuuuaaagcagagcgagugaucgaccccagaagaugcaugaaaccugucauacuuacugauggugaggagaggguaauacuagcgggaccaaugccuguaacacacuccucugcggcacaaagaagaggaagaauaggcagaaauccuagaaacgaaaaugaccaguacauauauaugggagagccauuggaaaacgacgaggacugugcacauuggaaagaagccaaaaugcuucuagauaacauuaauacaccagaaggaauaauaccaucuauguucgaaccagaacgagaaaaagucgacgcaaucgacggugaauacaggcucagaggggaagcacgaaagaccuucguagaccuaaugaggaggggugauuuaccugucuggcuugcuuacaagguugcagcugaagguauuaauuacgcagaucgaagauggugcuucgacgggacaagaaauaaucagauacuagaagaaaauguagaaguagaaauauggacuaaggaaggcgaacgaaagaaauuaaaaccgagaugguuagaugccaggauuuauuccgauccauuagcacugaaagaauuuaaggaguucgcagcaggccgaaagagcuuaacucucaacuuaauuaccgaaaugggccguuuaccaacguuuaugacacaaaaagcccgagacgcgcucgacaaccucgcaguacuucacaccgcagaagcgggaggcaaggcuuacaaccaugcauuaucagaguuaccagaaacguuggaaacacucuuauuauuaacuuuauuagcuacaguuacagggggaaucuuucuguuucugauguccggucgcggaauagguaagaugacccucggaauguguugcauuauaacagcuagcauucuacuuugguacgcccagauucaaccccauuggauugcagcuucgauaauauuggaauuuuucuugaucguauuauuaauaccugaaccagaaaaacagagaacaccccaagacaaucaacugacauaugugaucauugcaauucugacugucguggccgcaacaauggccaaugagauggguuuccucgagaaaacuaagaaagacuuaggauuaggacauauagcaacacaacaaccagagucaaacauucuagauauugaucuuagaccagcaucagccuggacacuuuaugcaguggccacaacuuuuauaacaccaaugcucagacauucaauagaaaauucaagcgugaacguaucauuaacagcuaucgcuaaucaagcgacaguguuaauggguuugggcaagggauggccccuaucaaagauggauaucggcgugccuuugcucgcgauuggaugcuauucacaaguaaacccuauaacacuaacugcagccuuacuuaugcuuguggcacauuaugcaauaauaggaccagggcuacaggccaaagcuacacgugaagcccagaaacgagcugcugcaggcauuaugaaaaaccccaccguugacgggauaacgguaauugauuuagaccccauaccauacgacccgaaauucgaaaaacagcuuggacaaguaaugcugcugguacucugcgugacacaaguauugaugaugagaaccacuugggcucucugugaggccuuaacauuagccacgggaccuguaucuacccuuugggagggcaauccuggaagguucuggaauaccacgaucgcagugagcauggcaaacauauucagaggaucguaucuugcaggagcgggucuacuauuuagcauaaugaaaaacacgacuuccacacgaagagggacagggaacaugggagaaacccuaggagaaaaauggaaaaacaggcuaaaugcauuaggcaagucugaguuccaaauauauaagaaaucugguauccaagaaguagauagaacacuugcgaaggaaggaauuaaaagaggggagacggaccaccacgcagucagucgugguucagcaaaacuaagaugguuugucgaacgaaaccucguaacaccagaagguaaaguuguagauuuaggauguggucgaggugguuggaguuacuauuguggcggccuuaaaaauguaagagaaguaaaaggguugacuaaagggggaccgggccaugaagaaccaaucccaaugucaaccuauggauggaacuuaguccgacuucaaucgggaguggauguauuuuucguaccuccggaaaaaugugauaccuuacuuugugauauaggggaaucaagcccaaacccaaccguagaagcuggaaggacucuucgagugcuaaauuuaguugagaacuggcucaauaacaacacacaauuuuguguaaaaguuuuaaauccauauaugccaucuguaauugaaagaauggagacccuucagagaaaauaugggggcgcccuaguucgaaauccacuaucgcgaaacucaacccaugaaauguacuggguaaguaaugcgucuggaaauauaguuuccaguguaaacaugauaucaagaaugcuuauaaacagguucacuaugaggcauaagaaagcuacuuaugaaccagauguagaucuuggauccggaacucgaaacauagggauugaaucagaaacaccaaacuuagauaucauuggaaaacggaucgagaaaauaaagcaagagcacgaaacgagcuggcauuaugaucaagaccacccauacaaaacaugggcuuaucauggguccuaugaaacaaaacaaacgggcagcgcuagcucuaugguaaauggaguagucagauuauuaaccaaaccuugggacgugauacccaugguuacgcaaauggcgaugacggauacaacuccguucggacaacaaaggguauucaaagaaaaaguugacacaagaacucaggagccaaaggagggcaccaagaaacuuaugaagauaacugccgaauggcuauggaaagaacuaggaaagaagaaaacgcccagaauguguacaagggaagaguucacaaagaaagucaggucaaaugcugcacuuggugcgauauuuacugacgagaacaaauggaaaucggcgagggaagcuguagaggauaaccgguucugggaacuuguagauaaagaaagaaaccugcacuuagaagguaaaugugaaacaugcguauauaauaugauggguaaaagggagaagaaacuaggagaauuugguaaagcuaaagguucucgggcuauuugguauauguggcucggugcgcgauucuuggaguucgaagcacucggauuccuaaaugaagaccauugguucucaagggaaaauucacuuucgggagucgaaggagaggggcuacauaaacucggguauauacugagagaagucaguaaaaaggaagguggcgcaauguaugcugacgauacagcaggaugggauaccagaaucacaauugaggaccucaaaaacgaagaaaugauaacaaaccauauggcuggcgaacauaagaaauuagcagaagcaaucuuuaaacuuacauaucaaaauaaagucgugagaguccaacgacccacaccucgaggaacuguuauggauauuauuucucgaagagaucaaagaggaucgggacaaguuguaacuuauggucuaaacaccuuuacaaauauggaagcacaacuaauacggcaaauggaaggcgaagguguauuuaaaaguauucaacaucuaacagcaucagaagaaaucgccguucaggauugguugguaagagucggcagagaaaggcuuagcagaauggcaauaagcggagacgacugcguuguuaaaccacuugacgaucguuucgcuaaagcgcuuacagcacuaaaugacauggguaagguucguaaggauauacaacagugggaaccaucacgcggauggaaugauuggacucaggucccauuuugcucccaucauuuucaugagcuaaucaugaaggacggacgaacacuugucguuccaugucgcaaucaagaugaguuaauaggaagggcacgaauuagccaaggcgccggauggucacuacgagaaacggcaugucuagggaaaagcuaugcccaaauguggucacucauguauuuccaucguagagaucuccgauuggcagcgaaugcaaucugcucggcgguuccgucacauuggguuccuaccucuaggaccaccuggucaauucaugccagucaugaauggaugacaacagaagacauguuaaccgucuggaaucgaguuuggauacucgagaauccauggauggaagacaaaacgccaguugaauccugggaagagauaccauaucuaggaaagagagaagaccaaugguguggcaguuuaauugguuuaaccucaagagcuacuugggccaaaaauauacaaaccgcgauaaaucagguacggagucuaauagguaaugaagaauacacggauuacaugcccucaaugaaaagauucagacgggaagaggaagaagcugguguucuaugguag

SEQ ID NO: 22950 - RNA, 9876 nt, Artificial Sequence
  derived and/or modified CDS sequence (opt6) from DENV-2__DQ645545__SS-prME
acagcggggguuauaauaaugaugauaccuacaguuguagcauuucauuuaacgacacggaacggagaaccgcauaugauaguuucacgacaagagaaagguaagagcuuacuauuuaaaacagaaaaugguguaaacauguguacuuuaauggcgauggaucucggcgaacuuugcgaagacacaauaacauauaauuguccacuccuacgacaaaaugaaccagaggacauagacuguugguguaauuccacgagcaccuggguuacguacggaacaugcacagcaacaggggaacacagacgugaaaagaggagugucgcucuagucccgcacguaggaaugggauuagaaacucguacagaaaccuggaugucuucacaaggugcauggaaacacgcacaaaggauugaaaccuggguucuuagacauccaggguuuaccaucauggcagcaauacucgcauacacgauagguacaacuuacuuucagagaguucuaauauucauauuguuaaccgcaguagcuccuagcaugacuaugcgcuguauugguauuucgaauagagauuucguggaagggguaaguggaggauccuggguugauauaguauuggaacacggcucaugcguaacgacuauggcuaaaaauaaaccgaccuuagauuuugaacuuauuaaaacggaggcaaaacacccggcaacucuuagaaaauacugcauagaagcaaaacugacuaacacaacaaccgcaaguagauguccuacacaaggggagccaucucuaaaugaggagcaagacaaaagauucgucugcaaacacucaaugguagacagggggugggggaauggauguggacucuuugggaaaggagggauaguaacaugugcaauguuuacauguaagaaaaacauggaaggcaaagugguacaaccugaaaaccuagaguauacaauuguuaucacaccacauucgggugaagagaaugcgguaggaaacgauacugguaaacauggcaaagaaaucaaagucaccccucaauccuccaucacagaagccgaacuaacuggcuacgguacggugaccauggagugcucuccuaggacugggcuagacuuuaaugaaaugguauugcuccaaauggaagauaaagcauggcuuguacaucggcagugguuucuagacuuacccuugccguggcuuccaggggccgacacgcaaggaucuaacuggauacaaaaagaaacuuuagucaccuucaaaaauccucaugccaagaaacaagaugucgucguacuugguucacaggaaggugccaugcacacagcucucacaggugcgacagaaauacaaaugaguucuggaaacuuauuauuuaccggucaucuaaaaugcagauugagaauggacaaacuccagcuaaaagguaugucauauuccauguguacuggaaaauucaaaguagugaaagaaaucgcugaaacucagcauggaacuauugucauacgcguacaauacgaaggagaugguucaccaugcaaaauaccguucgaaauuauggaccuugagaaaagacacguccucgggagguuaauuacaguaaacccaauuguaacaggaaaagauucucccgucaacauagaagcagagccaccuuuuggagacucguauauaauaauugguguagaacccggacaguugaaacugagcugguucaagaaaggaaguucaaucggccaaauguucgaaacuaccaugagaggugcuaaaagaauggccaucuuaggagauaccgcuugggauuuuggaaguuuagguggaguuuucacuagcaucggcaaagcauugcaucaagucuuuggcgcaauauacggagcagccuuuaguggcguauccuggacaaugaaaauucuaauaggcguaguaaucacauggauagggaugaacagccgcagcacaucucucaguguaagucucguucuugucggcgucguaacccucuauuuagguguuaugguucaagcggacaguggaugugucguuucguggaaaaauaaagaacucaaaugugguucagggauauucauaaccgacaauguucauacauggacagagcaauauaaauuucagccagaaucacccaguaaauuggcaagugcuauacagaaagcgcaugaagaagguauaugugggauucgaucugugacacgacuagagaacuuaauguggaaacagaucacaccggaacuaaaccauauuuuaucagaaaacgaagugaaacuaacuauuaugacaggggacauaaaaggaauaaugcaagcagguaaaagaucauuaaggccucagccaacugaauuaaaauacucauggaaggcuuggggaaaagcgaaaaugcugucuacugaguuacacaaccauacauucuuaauugacggcccagaaacggcugaguguccaaacacgaacagagcguggaauagccuggagguugaagacuaugguuuuggugucuucacaacaaacauuuggcugaaguuaaaagaacgucaagauguauuuugugacucaaaacuaaugucagcggcaaucaaggauaauagagcugugcaugcggacaugggauacuggauugaaagcgcucuuaaugauacauggaaaauagaaaaagccagcuuuauagaggucaagaguugccacuggccaaaaucucauacgcuauggaguaacgggguauuagaaucagaaaugauuauaccuaaaaacuuugcuggcccagugucacaacacaacuacagaccagguuaucacacacaaacugcuggaccauggcaucuuggaaaacuggaaauggacuuugauuucugugaaggaacaaccgugguuguaaccgaagacugugguaaucgaggaccaucuuugagaaccacaaccgcaucuggaaaguuaauaacagaaugguguugcagauccugcacacugccacccuuaagauauagaggggaagacgguugcugguacggcauggaaauuaggccuuuaaaagaaaaagaggaaaauuuagugaauagucuaguaacggcuggucauggacagauagauaauuuuagcuuggguguacugggaauggcauuauuucuugaagagaugcuaagaacucgaguagggacuaagcaugccauauuguuaguagcugucucguuuguaacacuuaucaccgguaacaugaguuuuagagaccuaggucgaguuaugguuaugguuggugccaccaugacagaugauauagggaugggaguaacuuauuuagcgcuauuggcggcauucaaagucagaccaacguuugcggcaggacuccuacuucgaaaauugacuucgaaagaacuuaugaugacaacaauaggaauuguacuacuaucacagucuacuaucccagagacuauuuuagaauugacugaugcacucgcccuaggcaugauggugcuaaaaauaguacgaaauauggagaaauaccaacuggcaguuacgauuauggcuauuuugugcguuccuaacgcuguaauuuugcagaaugcauggaagguguccuguacaauauuggcagucguaucaguauccccuuuacuauuaacaaguagccagcaaaaagcagacuggauaccuuuagccuuaacuaucaaaggccucaauccuaccgcaauuuuucuuacuacacuaagucgaacaagcaaaaagcgcucauggccguuaaacgaagcgauuauggcuguggggauggucuccauacuagcuucgagucuucuuaaaaacgauauaccgaugacuggaccucucguagcgggaggguugcuaacagucuguuacguacuuacggggagaagcgcugaucuagaguuggaaagagcagcagaugugagaugggaagaacaagcagagauaucagggagcucgccaauucuuucgauaacgauaagugaggaugguuccaugucgaucaaaaaugaggaagaagaacaaacacuaacaauuuuaauccgaacagggcuacucgugauaucgggccucuuuccugugucgaucccaauuacagccgcagcuugguaccuaugggaaguuaagaaacaacgggcuggugugcuuugggaugugccauccccucccccuguagguaaagcagaacuggaggacggagcauaucgaauuaaacaaaaagggauauuagguuauagccaaaucggugcuggaguuuacaaagaaggaacuuuucauacaauguggcacguaaccaggggugcaguuuuaaugcacaaaggaaaaaggauagagccgagcugggcagaugucaagaaagaccuaauaaguuacggaggcggauggaaacuagaaggggaguggaaagaaggugaagagguccaaguucuagcgcuggagccaggcaaaaauccgagggccgugcagacgaaaccaggguuauuuaaaacgaauacaggaacgauaggagcaguuucacuagauuuuagccccggaacgucggguaguccaauaguagacaagaaaggaaaaguagucggacuauacggaaauggugucguaacuagauccggaacuuaugucagugccauagcucaaacugaaaaaucaauugaagauaauccagagauugaagaugacaucuucaggaaaaagcgcuugacaauaauggaucuccauccuggggcuggcaagaccaaaagauauuugcccgcgauugugcgggaagcuauaaaacggggucucagaacacuaauacuagcgcccacaaggguaguggcugcagagauggaagaagccuuaagggguuuaccuaucagauaucagaccccggcaauaagagccgagcacacgggccgagaaauugucgauuugaugugccaugcaacauucacuaugcgucuacugagcccaauaaggguaccaaauuauaaucucaucauaauggaugaggcgcauuuuaccgacccagcuucuauagcugcgagagguuauauaagcacgagaguggagaugggagaagcggccgguaucuuuaugaccgcgaccccuccaggaucuagagacccauucccucagagcaacgccccuauaauggacgaggaaagagagauaccggagcggagcuggaacagcgggcacgaaugggugacagauuuuaagggaaaaaccguuugguuugugcccucuauaaaagcuggaaaugauauugcagcuugccuaaggaagaaugggaaaaagguuauccaauuaucgagaaagacauuugauucugaauacguaaaaacacgaacaaaugacugggauuuugugguuacuacugacaucagcgaaaugggugcuaauuuuaaggcggaaaggguaaucgauccccgaagauguaugaaacccgucauccuaacagauggcgaagaaagagugauccuagccggaccgaugcccgugacgcauaguucggccgcacagagacguggacguguaggaagaaauccuaaaaacgaaaaugaccaauauauauauaugggagaaccccuggaaaaugacgaggacugcgcucacuggaaagaggcuaaaaugcuccuugauaauauaaacaccccagaggguaucauaccuucaauguucgaacccgagagagagaaaguggaugcaauugacggagaguacagauuaagaggagaggcacgaaaaacuuuuguagacuuaaugagaagaggggaccucccgguaugguuagcuuaucgaguagcagccgaagguaucaacuacgcagauagaaggugguguuuugacgguguuaaaaacaaucaaauacuugaagaaaauguagaaguagagauauggacaaaggaaggugaaaggaagaaacuaaaaccccguuggcucgaugcgagaauuuauucugauccucucgcucucaaggaguuuaaagaauuugccgccggaagaaagagcuuaacguuaaaucuuauaacugaaauggggcgauuaccgacauuuaugacacaaaaagcaagaaaugcucuagauaauuuagcgguguuacauacagcggaggcaggaggaagggcguacaaccacgcauuaagcgaauugcccgaaacgcuagaaacacucuuacuucuaacacuccuggcuacaguaaccgguggaauauuccuguucuuaaugaguggcaaaggcauugguaaaaugacccuagguaugugcugcauuauuacagcuagcguuuuacuaugguaugcacaaauacaaccacauuggauugcugcgucgaucauacuagaguuuuuccugauugucuuguugauccccgagccugaaaagcaaagaacuccucaagacaaccaauuaaccuacgucguaaucgcuauacuaacaguuguagcugcaacuauggcaaaugagauggguuucuuggagaaaacgaagaaagauuuuggucugggaggaauagcaacacaacaaccagaaaguaacauacuugauauagaucuucggccugcaucggcguggacacuauaugcgguugcaacaaccuuuauaacucccaugcuucggcacucuauugaaaauucuaguguaaacguaucauugacagcuauugcgaaucaagccacaguuuuaaugggcuuagguaaaggauggccccucaguaaaauggauaucggggucccauuauuagcaaucggauguuacucgcaagugaacccaaucacucuaaccgcagcacucuuacuccuuguagcacacuaugcuaucaucggcccaggauuacaagcaaaagcaaccagagaggcucagaaaagagcagcugccggaauuaugaaaaaccccacuguggauggaauaacuguaauugauuuagaucccauccccuacgauccaaaauuugagaaacaacucggacaaguuauguugcuuguucuuugcguaacgcaaguccuuaugaugcgaaccaccugggcucuaugugaagcucuuacauuagcgacaggaccaauuuccacucuuugggaagguaacccagggcgcuucuggaauacuaccauugcaguaaguauggcuaacauauucagaggcucauauuuagccggggcuggcuuauuguuuucgaucaugaagaacaccgcuaacacccguagaggcacaggaaauaccggcgagacccuuggagagaaauggaaaaaucgucugaaugcauuagguaaaagugaauuucaaauauacaagaaaucggggauacaagaaguggacagaacacuagcaaaggaaggaauaaagcggggugagacagaucaccaugcgguuagcagaggaucugcaaaguugcguugguucguagaaaggaaucuagucaccccugaaggaaaaguaauggacuuagguugcggccguggagguuggucuuacuacugcggagggcuaaagaacguaaaagaaguaaaaggguuaacuaaaggaggcccaggccaugaggagccaauaccuaugucgaccuacggauggaacuuggucagacuccaaagcgguguagacguauuuuucacgccgccagaaaaaugugacacccuauuaugugauauaggugaaucuagcccuaaucccacaguagaagcaggaagaacucuccggguguuaaacuuggucgagaacuggcuaaauaauaacacacaauuuugcauuaaaguucuuaauccguauaugccaagugucaucgagaaaauggaggcacuccagagaaaauauggaggugcacucguucguaacccccugucuagaaauucaacacaugaaauguauuggguaaguaaugcgucugguaauauaguaucaucagugaacaugauaucgagaaugcuaauuaauagauuuacaaugagacauaagaaagcgacguacgagccugaugucgaccuagguaguggaacuagaaauaucggaauagaaucagaaacaccaaauuuagacaucauuggaaaacggauugagaaaauuaaacaggaacacgaaacaaguuggcacuaugaccaagaucauccauauaaaacuugggcauaucacgggucguaugagacgaaacagacagguagugcaaguagcauggugaaugguguuguuagguuauuaacaaagccaugggaugucauuccaauggucacacagauggccaugacggauacaacaccauuuggacaacaaagaguauuuaaagagaagguggauacuagaacacaagaaccaaaagaagguacuaagaaacuaaugaaaaucaccgcagagugguuguggaaagaacuuggcaaaaagaaaacaccaaggauguguacccgugaagaguuuacgcguaaaguaagaucgaaugcagcguugggagcaaucuucaccgaugagaauaaauggaaaucagcaagagaagcaguagaagacucuggauucugggaacuuguagacaaagaacgaaauuugcaccuagaaggaaaaugcgaaacguguguauauaauaugaugggcaaaagagagaagaaauugggugaauuuggcaaagcgaaaggaagcagagcaauuugguauaugugguuaggagcacgauuucuugaguuugaagcauuaggauuuuugaaugaagaucauugguucaguagggaaaacucuuuaucugguguagaaggagaaggucuacacaaacuuggauacauacucagagaugucagcaagaaagaagggggagcaauguaugcggacgauacagccggaugggauacaagaauuacauuagaagauuugaaaaaugaagaaauggugacaaaccauauggagggugaacacaagaaauuagccgaagcuauauuuaaauuaacuuaucaaaauaaagugguucggguucaacgcccaacccccagaggaaccguaauggacauaauuagcaggagagaucaacguggcucagggcaaguaguuacguauggauuaaauacauucacaaauauggaagcacaauuaauucgucaaauggagggcgaaggaguauucaaaucaauacaacaauuaacugcaacugaggaaaucgcggucaaaaacuggcuugcgagaguagguagggaacgauuaagucgcauggcuaucagcggggaugacuguguggucaaaccauuagaugacagguuugcgagugcauugaccgcgcucaacgauaugggaaaaguccggaaggauauacaacaaugggagccuucaagaggauggaaugauuggacccaaguuccauuuugcucacaucacuuucaugaacugauuaugaaagacggaagaguauuaguaguacccugucgaaaucaggaugaauuaauuggcagagcccgaauuagccaaggggcaggguggucauuaagagaaacagcauguuugggaaagucauaugcacaaauguggagccuaauguauuuucaccggcgagaucuccgauuagcggcgaaugcuauaugcucugcuguacccagccauuggguaccgacuucaaggacuacguggagcauccacgcaacucaugaauggaugaccacagaagacaugcuaacagucuggaaucgcgucuggauucaagaaaacccuuggauugaagauaaaacgccugucgagucgugggaagaaauaccauaucuugguaagagggaggaucagugguguggaucguuaauaggguuaacaagucgagcuacuugggccaaaaauauacagacagcuauaaaccagguaaggagucuuauuggcaacgaagaauauacugauuacaugcccucuaugaaaagauucagaagagaagaagaagaggcgggagucuuaugguaa

SEQ ID NO: 22951 - RNA, 9876 nt, Artificial Sequence
  derived and/or modified CDS sequence (opt6) from DENV-2__DQ645546__SS-prME
acugcugguguaauaauaaugaugauacccacuguaguagcauuccauuuaacaacccgaaauggagaaccgcacaugauugugucacgucaagaaaaagguaaaucgcucuuauuuaaaacagaaaaugguguuaauaugugcacacuaauggcaauggaucuaggagaacuaugcgaagauacuauaacauauaacuguccacugcuucgccaaaaugaacccgaagauauagauuguugguguaauucaacaucuacauggguuaccuacggaacauguacugcuacaggugaacaucgacgagagaaaagaaguguggcucuagugccacacguaggaaugggucuagaaacgaggacagaaacauggaugagcagugaaggggcuuggaaacaugcgcaaagaauagaaacguggguacuuagacauccuggauucaccauaauggcugcaauuuuagcauauacuauaggaaccacguacuuucaacguguauugaucuuuauacuacucaccgcgguagccccuucaaugacaaugagguguaucggaauuucaaauagggauuucguagaagguguauccgggggaagcuggguugacauagugcucgaacauggaucauguguuaccacuauggcgaaaaauaaacccacuuuagacuuugaauuaauaaaaaccgaagcgaaacauccagcuacucuucgaaaauacuguauagaagcgaaacugacuaacacaacaacagcuagccgcuguccuacacaaggagaaccuagucucaacgaagaacaagauaaaagguuuguaugcaaacacucaaugguagauaggggauggggaaacggguguggacuuuuuggaaaagguggaaucgugacuugugcgauguuuacaugcaagaaaaauauggaaggaaaaguuguucagccugaaaaccuagaauauacaaucgucauaacaccucauagcggagaagaaaaugcugugggaaaugacacagggaaacaugguaaagaaaucaaaguaacgccucaaucuagcaucacggaagcagaacucacaggauaugggacaguuacaauggaauguucgccccggacaggucucgauuuuaacgaaaugguuuuacugcaaauggaagacaaagcaugguuaguacauaggcaaugguuucuggaucucccucugccauggcuuccgggggcggacacacaaggaucaaauuggauccaaaaagaaaccuuggugacuuucaaaaauccgcacgcuaagaaacaagacgucguuguacuagguagccaagaaggugcuaugcauaccgcacuuacaggagccaccgaaauacagaugucuucaggaaaucugcuuuucacugggcauuuaaaaugcagauugcgcauggauaaauuacagcugaaaggaaugucuuacagcaugugcaccgguaaauucaaaguuguuaaagaaauagcagaaacacaacacggaaccauugugauaagggugcaguaugaaggagacggcuccccaugcaaaauacccuuugaaaucauggaccucgaaaaacgacauguacuuggccgauuaauaacaguaaacccaauagugacugagaaagauagcccaguaaacauagaagcagagccgccauucggagauucauacaucauaauugggguugaaccuggccaauugaaacugucgugguucaagaaagggagcagcauuggacaaauguuugaaaccacaaugcggggagcgaaacgaauggcgauacucggagacacggcaugggacuucgguucccuaggggguguuuucacuagcauugguaaagcguuacaucaaguauuuggagcuauauauggugccgcuuuuucuggcguaucuuggacaaugaaaauauugauaggagugguaauaaccuggauaggaaugaauagcagaagcacuagccuaucuguuagucugguacugguaggagucguuacacuguauuuagguguaaugguccaggccgauucugguugcgucguauccuggaaaaauaaagaguuaaaaugugguuccggaaucuucauaacagauaauguacacaccuggacagaacaauauaaauuucaaccugaaucaccaucaaaacuggcgucggcgauacaaaaagcacaugaagaaggcauaugcgguauacgcucagucacccgauuggaaaacuuaauguggaaacagauaacgccagaauuaaaucauauucucagugaaaacgaggucaaacugacuauaaugaccggcgacauaaaaggcauaaugcaagccggaaagcgauccuugagaccccaaccuacagaacuaaaauauucauggaaagcgugggguaaagcgaaaauguuaucuacagaauuacauaaccacacauuucuuaucgauggcccagaaacugcagaaugcccgaacacuaacagagcuuggaauagccuagagguugaagauuauggauuugguguguuuacaaccaauauaugguuaaaacuaaaagagagacaggacguguucugugauucuaaguuaaugucagcugccauuaaagacaacagagcaguacacgcagauauggguuauuggauugaaagugcccuaaaugauacguggaaaauagaaaaagcgucuuuuauugaaguaaaaucaugucauuggccaaaaucacauacacuguggucaaacggaguccuggaaucagagaugauuauucccaaaaacuuugcagguccaguaagucaacauaacuauagaccggguuaucacacgcaaacugccgguccguggcacuuagguaaacuagagauggacuucgauuuuugugaggguacaacuguugucguaacagaggauuguggaaauagagggccuaguuuaagaacgaccacagccucaggcaaacucauuaccgaauggugcugcagauccugcacccuuccaccuuuacguuaccgaggugaagacggcuguugguauggaauggaaauacgcccgcuaaaggaaaaagaggagaauuugguaaauagucuuguuacugcaggccacggacaaauugacaacuucucucuggggguauuagggauggcuuuauuucuagaagaaauguugagaacacguguugggacaaaacaugcuauauuauuagucgcuguaucuuucguaacauugauaacaggcaacaugagcuuucgggaucuagggcgaguaaugguuaugguuggugccacuaugacggacgacauaggaaugggagugaccuauuuagcacugcuugcagccuuuaaaguuagaccuacguuugccgcaggguuauuguuacguaaacuuacuagcaaggaacucaugaugacuacuauugguaucguucucuuaucacaaucaacaauuccugagacaauucuugaauuaacagacgcauuagcacugggaaugauggucuuaaaaauaguaaggaauauggaaaaguaucaacuagccguuacaauaauggcaauauuaugcguuccaaacgcugugauauuacaaaaugcauggaaaguuucuuguacuauucuugcgguaguaucugugagcccacuauugcuaacaaguagucaacagaaagcugauuggaucccccuggcucuuaccauaaaagggcugaaucccacagcaauuuuucucaccacguugaguagaaccuccaaaaagagaagcuggccgcugaaugaagcuauaauggcaguagguaugguuuccauacuagcaaguucguugcugaaaaaugauaucccaaugacaggaccucuaguggcugguggucuacuuacaguuugcuacguauuaacaggacgaucagcugaccuugaacuagaacgugccgcagacgucaggugggaggaacaagcggagauuuccgggagcucgccaauucuaaguauaacuauaagugaagauggcucaaugagcaucaaaaaugaggaagaagaacagacccuuacgauacuaauccgaacaggacugcugguaauaagcggcuuauuuccuguaucaauaccgauaacugcagcggcgugguaucuaugggaggugaagaaacaaagagccggagucuugugggacguuccuucaccgccuccaguuggcaaagcagaacucgaggacggcgccuaucguauuaagcaaaaaggaauccugggcuauucacagaucggagccggcgucuacaaagaagggacguuucauacaauguggcauguuacgcgcggggcuguucuuaugcauaaagguaaacguauugaaccuucaugggcagaugucaagaaagacuuaauuaguuacggaggaggauggaaauuagaaggagaauggaaagagggagaagagguccaaguucuagcacuagaaccgggcaaaaauccucgggcaguacaaacuaagccaggccuauuuaagaccaauacaggcacgauaggagcaguaaguuuagacuucucuccaggaacaagugguucuccaauaguggacaagaaaggaaaggugguuggacuauauggaaacggugucguuacaagguccggaaccuaugucucagcgaucgcucaaacugaaaaaucuauugaagauaacccggaaaucgaggacgauauauucaggaaaaagagacucacuauaauggacuugcacccuggagcggguaaaacaaaaagauaucuaccugcaauagucagagaagcaauaaaaagaggucuaagaacauuaauacuagcuccuacuagaguaguugcagcggaaauggaagaagcguuacguggauuaccgauaagauaccaaacuccagcaauaagagcugagcauacuggaagagagauuguagauuuaaugugccacgcuacauucaccaugcgauuauuaucaccgauucguguucccaacuauaauuuaaucaucauggacgaagcacacuuuacagauccugcuucaauagcugcaagaggauacaucuccacaagaguugaaaugggagaagcagcaggaaucuucaugacggcaacaccaccaggaucgcgugauccuuuuccccaauccaacgcuccaauaauggaugaggaaagagagauacccgagagaucauggaauagcgggcacgaauggguaacagauuuuaagggaaagacuguuugguucguucccagcauaaaagcugggaaugacauagcugcaugccuccggaaaaacggcaagaaaguuauucagcuuucuagaaagacauucgacagugaauacguaaaaacuagaacuaaugauugggauuucguaguaacaacagacauaucggagaugggagcaaauuuuaaagccgaaagagugauagaucccaggagaugcaugaaaccgguuauucuaaccgauggugaagaaaggguaauucuggcagguccuaugccaguaacacauucguccgccgcacaacgacguggacgaguuggcaggaacccuaaaaacgagaacgaucaguauaucuacaugggggagccgcuagaaaaugacgaagacugcgcacauuggaaggaagcuaagaugcuccuagacaauauuaauacuccagaaggaauaauuccgucuauguuugaacccgagagagaaaaggucgacgcgauagauggagaauaucgcuuacggggagaagcacggaaaacauucguagaucucaugcgcagaggcgauuugccuguuugguuagcauaccgagucgcagccgaaggcauaaauuaugcggauagacgcugguguuucgacggcgucaaaaacaaccaaauuuuggaggaaaacguagagguggaaauuuggacuaaagaaggggaaaggaaaaagcuaaaaccgagaugguuagaugcaaggauuuauagcgaucccuuagcccucaaagaguuuaaagaauuugcggcugggagaaagagcuugacuuugaaccugauaacagaaaugggucgacuaccuacauuuaugacucaaaaagcacggaaugcuuuggauaauuuagcuguauugcacaccgcagaagcaggagggagagcuuacaaccacgcccuaucugaacuuccugaaacauuagaaacacuacuacuauuaacacuacuagcuacagucacagguggaauauuuuuguuuuuaauguccggcaaagggauuggaaaaaugacauugggcauguguuguaucauuacagcauccguuuugcucugguacgcucagauacaaccccauuggauugcggcaucaauaauacuugaguuuuuccuaauaguacuguuaauaccggaaccugagaagcagaggacaccccaagacaaucaguugacauacguugugaucgcaauacuaacaguugucgcugccacuauggcuaaugaaaugggcuuucuugagaaaacuaagaaagauuucggcuuaggugguauagccacacagcaaccugaaucaaacauccucgacauugaucuaagaccugcgagcgcauggacucuauaugcaguagcaacuacguucauaacuccgaugcuccggcacucaauugaaaacagcucaguaaauguuucacuaaccgcuauugcgaaucaagcaaccgugcuaaugggguuaggaaaagguuggccucugaguaaaauggauauuggaguuccccuacuugcgauagguuguuacagccaagucaacccuauuacuuuaacggccgccuuacuacuauuaguggcccauuacgcuauaauaggaccgggauuacaagccaaagcaacuagagaagcacagaaaagagcagccgcagggauuaugaagaauccuacgguagacgguauaaccguuauagauuuagauccgaucccauacgauccaaaauucgaaaaacagcuaggacaaguuauguuacuuguauuaugcgugacgcaagucuuaaugaugagaacaacaugggcacuaugcgaagccuuaacacuagcaacuggcccaaucagcacguuaugggaaggcaauccgggccgauucuggaacaccacaauagcaguuucaauggccaacauauucagagguucuuacuuagcgggugcgggcuuauuauuuucaauaaugaaaaacacugccaauacaagaaggggaacuggaaauaccggcgagacucuaggagaaaaguggaaaaauagauugaacgccuuagggaagucggaauuucaaauauauaagaaaagugggauacaggaaguagaccgaacacuggcuaaagaggguauuaaacgaggagaaacagaccaccaugcaguuagucgugguagcgccaaacucagaugguucguugagcguaauuuaguaaccccggaagguaaaguaauggaucuuggcuguggacggggagguuggaguuauuacugcggugggcucaaaaacgucaaagagguuaaaggacuuacaaaaggagggcccggacacgaagaaccaauacccauguccacuuauggauggaaccuggugaggcuacaaucgggaguugauguauucuuuacacccccggaaaaaugugacacucuacugugcgacauaggggagaguucaccgaacccaaccgucgaagccggaagaacucuaagaguauuaaaucuaguagaaaauuggcugaacaauaauacccaguuuugcaucaaagugcuuaaccccuauaugccgucgguaaucgagaagauggaggcacuacagcgaaaauaugggggagcguuaguccguaacccacugaguagaaauucuacacacgaaauguauuggguaaguaaugccaguggaaacaucgugaguagcgucaacaugauuagccguaugcuaaucaaucgcuuuacaaugcgacauaagaaagcuacguacgaaccagacguugacuuaggauccggcacacguaauauagguauugaaagugaaacaccaaaucuagacauuauaggaaagagaauagagaaaauaaagcaagaacaugaaacgagcuggcauuaugaccaagaccacccuuacaaaacuugggcguaccauggaaguuacgagacaaaacagacagguagugccucaucuauggugaacgggguaguacgguugcuaacuaaaccgugggauguuauaccaauggugacacaaauggcuaugacugauacuacaccguuuggucagcaacguguguuuaaggaaaaaguggauacacgaacgcaagaaccaaaagaaggaacaaagaaacuaaugaaaauuacagcugaauggcuauggaaagaguuaggcaagaagaaaacgcccagaaugugcacgcgggaagaguucacaaggaaagugagaucaaaugccgcacuuggggcuauauuuacagacgaaaauaaauggaaaagugcgagagaagcgguagaagacagcggauuuugggaguuaguagacaaagaacgaaacuuacaucuugaagguaagugugaaacgugugucuauaauaugaugggaaaaagggaaaagaaacugggugaguucgguaaggccaagggaaguagagcaauaugguauaugugguuaggcgcgagauucuuagaguucgaagcacuaggcuuccucaaugaagaccauugguucucccgcgaaaauucucuuucugggguugagggugaaggacugcacaagcucggauauauccuacgagacguuucuaaaaaggagggaggagcuauguaugcagacgacacagcaggaugggauaccaggauuacacuagaagaccucaagaacgaagaaaugguaacgaaucauauggaaggggaacacaagaaacuagcugaagcgauauuuaaacugacauaucagaauaaaguaguacggguacagaggccaaccccacgcggaacuguaauggauaucauuuccaggagggaccaacgaggauccgggcaaguaguaacguauggguuaaacaccuuuacaaacauggaagcucagcucauucgucaaauggaaggugaaggcguuuucaaaucuauacaacaacuuacagccacggaagaaauagcugucaagaacugguuagcccgaguuggaagggaaagauugucuaggauggccauaucaggggacgacugcgugguaaaaccccuggaugaccgcuuugcaucugcucucacagcacuaaaugauauggguaaaguaaggaaagauauccaacagugggaacccucaagaggcuggaacgacuggacccaaguaccauuuugcucccaucauuuccaugaacuaaucaugaaggacgggcgaguuuuaguggucccaugcagaaaccaagaugagcuaauaggcagagcacguauaagucagggcgcugguuggagcuuacgagaaacugccuguuuaggcaaaagcuaugcucaaauguggucacuaauguauuuccauagacgagacuuacgccuagccgcaaacgcuauaugcucagcugucccuucucauuggguaccaaccucuagaaccacgugguccauucaugcaacacacgaguggaugacgacagaggacauguugacagucuggaacaggguuuggauccaagaaaauccauggauugaagauaagacaccaguagaaagcugggaagagauacccuaccucgggaaaagagaggaucaauggugcgggaguuugauuggacuuacaagucgagcuacgugggccaaaaauauacaaacugcgauaaaccaggucagaucgcuaauaggaaacgaggaauacacagacuacaugcccaguaugaaaagauuccgacgggaggaagaagaagcaggcguauuaugguga

SEQ ID NO: 22952 - RNA, 9876 nt, Artificial Sequence
  derived and/or modified CDS sequence (opt6) from DENV-2__DQ645547__SS-prME
acagcaggcguuaucauaaugaugauacccacugucguagcguuccacuuaacgacgaggaacggggagccacacaugauugucucacgacaagagaaagguaagucacuuuuauucaaaacugaaaauggcguuaacauguguacguuaauggcaauggauuugggugaacucugcgaggauacuauuacauauaauugcccauuauuacgacagaacgaaccagaggauauugauuguuggugcaacaguacuuccaccuggguaacauaugguacuuguacagcuacaggagaacaucgaagggagaaacguaguguagcauuaguaccacacguagggaugggucuagaaacgcgaacugagacauggaugucaagugaaggugcauggaaacaugcacaaaggaucgaaacauggguccuuaggcauccaggauucaccaucauggcugcuauucuagcauauacaauuggcacaacuuauuuucaaagaguuuuaauauucaucuuguuaacagcuguagcucccucuaugacgaugcgauguauagguauaaguaaccgugauuucguagagggcguaucaggcggcaguuggguagacaucguacuggaacacgguucguguguaacaacuauggcaaagaacaaaccuacauuagacuuugaguugauaaaaacagaggccaaacacccagcaacgcuacggaaguauuguauagaagcuaaacuaacaaacacaacaacagcgucccgauguccaacucaaggcgaaccgagucuuaacgaagaacaagauaaacgauuugugugcaaacauaguaugguagacaggggauggggaaacgguugcgguuuauucgguaaaggaggcauugugacaugugcgauguucacaugcaagaaaaauauggaagguaaagucgugcagccggaaaauuuagaauacaccauuguuaucacuccccauaguggugaagaaaaugcuguuggcaaugauacagguaaacauggaaaagaaauuaaaguaacaccucaguccagcaucaccgaagcagaacuuacgggguauggcaccgugacaauggaaugcaguccaaggacggguuuagacuuuaaugaaaugguacuccugcagauggaagauaaagcauggcucgugcaucgacaaugguuucuugaucuaccccugccaugguuaccaggggcagauacacaaggaucuaacuggauacaaaaagagacacuaguuacauucaaaaacccacacgcgaaaaaacaggauguugucguucuaggaagccaggaaggcgccaugcauacugcacuaacuggagcaacagaaauucaaaugucaucaggaaaucuuuuauuuaccgggcacuugaaauguagauuaagaauggacaaacuacaguugaaaggcaugaguuauaguaugugcacaggaaaauuuaaaguagucaaagaaauagcggaaacgcaacauggaacuauagugauaagaguacaauacgaaggcgacgguaguccuuguaaaauuccauucgaaauaauggacuuagaaaaacgccauguucuugguagacuuauaacggugaauccgaucguaacagaaaaagauaguccagugaauauagaagcugaaccuccauucggcgauagcuacauaaucauagggguagagccgggacaguuaaaacucagcugguuuaagaaagggucuaguauaggucaaauguuugagacuacuaugcgcggugccaaaagaauggcuauuuuaggagauacagcaugggauuucggcagucucggaggaguauucacuucaauaggaaaagcuuuacaccaagucuucggggcaauauauggcgccgcauuuucuggaguauccuggacuaugaagaucuuaauagguguagugauaacuuggauaggaaugaauucuagaaguacuuccuugucaguuucacuaguguuagucgggguaguuacacuauaccuaggcguuaugguccaggcugauagcggaugcguagugucuuggaaaaacaaagaacuuaaauguggaagcggaaucuuuauaacagauaauguccauaccuggacagaacaguauaaauuccagccugaguccccaucaaagcuagcuucugccauacagaaagcacaugaagaggguaucugugguauuagaagcguuacacgacucgagaaucucauguggaagcaaauuaccccagaacuaaaucauauauugucugaaaaugaaguaaaauuaacgauaaugaccggugauauaaaggguauuaugcaagcuggcaaaaggucccuacgcccccagccuacagagcuaaaauacucuuggaaggcaugggggaaagccaagaugcuuagcacugagcugcauaaucacacauucuuaaucgacggaccugagacagcugaaugucccaacacaaaucgugcauggaauucgcuagagguugaagacuacggguuuggaguuuucacaacaaacauauggcuaaagcuaaaggaaagacaggauguauucugugauucaaaauuaaugagcgcagcaauaaaagauaaccgagcagugcaugcugacaugggauacuggauagaguccgcauuaaaugauaccuggaaaauugagaaagcgucauuuauagaagucaaauccugccacuggccuaaaagucacacauuauggagcaaugguguauuagaauccgaaaugauaauuccuaaaaauuuugcaggaccaguaagucaacauaacuauaggccaggcuaucacacccaaacagcggggccuuggcauuuaggaaaauuggaaauggauuucgauuuuugugaagguacaacaguagucguuacugaagauugcgguaaccgagguccaucacuacgaacaaccacagcaucggggaagcuaauuacagagugguguugccgaaguugcacccuuccaccucucagauauagaggugaagauggcuguugguauggaauggaaauaaggccguugaaagaaaaagaagaaaacuuaguaaauucuuuaguaacugcaggucaugggcagauugauaacuuuucccuuggcguacuagggauggcauuguuucuagaagaaaugcuucgaacacggguuggaacaaaauaugcaauauugcuaguagcaguaaguuuuguaacauuaauaacuggcaacaugucauuccgugacuuagggcgcguaaugguuauggugggcgcaacaaugacggaugauaucggcaugggcgugaccuaucuagcuuugcuugcagcuuucaaaguaagaccaacauucgcugcgggacuguuauugaggaagcuaacuaguaaggaacuaaugaugacaacuauagggauagucuuacuuagucaaagcaccauaccugaaacaaucuuggaauugacagaugcgcucgcuuuggggaugaugguuuugaagauuguaagaaauauggaaaaauaccaacucgcaguaacaauaauggcaauacucugcguuccaaaugcagugauauugcaaaaugcuuggaaagucucguguacaaucuuggcagucguauccgucagcccgcucuuguuaacaucuucacaacaaaaggcagacuggauuccacuugcgcuaacgauuaaaggauuaaacccuaccgcaauuuuucuaacgacgcuaagcagaacuucgaagaaacgaagcuggccacuaaaugaggcuauaauggccguaggaaugguaucaauauuagcaucaucucucuuaaaaaacgauauaccaaugacugggcccuuaguugcagguggauugcuaacagugugcuauguauuaaccggucgaagugcagauuuagaacuagagcgggcugcugacguuaggugggaagaacaagcagagaucagcgguucuagccccauauuaagcauuacuauaagugaagaugguucaaugagcaucaaaaacgaagaagaggaacaaacuuuaacuauauuaauccgaacaggauuacuagucauaucaggacuauuuccagugucuauuccgauaaccgcugcggcuugguauuugugggaagucaaaaaacagagagcaggaguauuaugggauguaccaucuccaccaccaguugggaaagcagaacucgaggacggagcuuaucguauaaaacaaaaagguauucuagguuauagucagauuggugcagggguuuauaaggaagggaccuuccauacaauguggcauguaacccggggagccguucucaugcauaaagggaagcggaucgaaccgaguugggccgacgucaagaaagaucucaucucuuacggaggcggauggaagcuagagggugaauggaaagaaggagaggaaguacaaguacuagcucuagagcccgguaaaaaccccagagcuguucaaaccaaaccaggcuuauucaaaaccaauacagggacaaucggcgccguuucacuggauuuuagcccagggaccuccggaucaccuauaguugauaaaaaagguaaaguuguaggucuuuaugggaaugguguagucaccagaagcggcacuuacguaucagcaauagcccaaacugagaaauccauagaggauaacccugagaucgaagacgacauauucaggaaaaaacgucucacuauaauggauuuacaucccggggcuggcaaaacaaaacgauaccuaccagcaauaguuagagaggccauaaaacgagguuuacgaacucuaauccuagcaccuacacgaguuguagcugccgaaauggaagaagcauugagaggguugccuauaagauaccagacaccagcaauccgugcugaacauacaggaagggaaauuguagaucuaaugugccacgcaacauucacaaugagguuacugucaccaaucagaguaccaaauuacaacuuaaucaucauggacgaagcccauuuuacugauccggccucaauagccgcacgcgguuacauuucuacgagggucgaaaugggcgaggcugcagguauauucaugacagcaacgccacccggaagucgcgaucccuucccgcaaucgaacgcaccgauaauggacgaagagcgugaaauaccagaacgaaguuggaacuccggacaugaauggguaacugauuucaaggguaaaaccgugugguuuguucccaguauuaaggcaggaaaugauauagcggcaugucuaagaaagaauggcaaaaaggugauccagcucagucgaaaaacauucgauagcgaguauguuaaaacaaggaccaacgauugggauuuuguggugacaacugauaucucugaaaugggagcaaauuuuaaagcagaaagaguaauugacccacgcagaugcaugaagccgguuauuuugaccgauggugaagaaaggguaauuuuagcugggcccaugccgguaacccauaguagcgccgcucaaaggagaggacgaguaggacgaaacccuaaaaacgaaaacgaucaauauauuuauaugggcgaaccucuggagaaugaugaagacugcgcgcauuggaaggaggcaaaaauguugcuggauaauaucaauaccccagaaggaauaaucccuucuauguuugagccagaaagagagaagguagacgccauagauggagaauaccgacuacgaggugaagcacgcaagacuuucguagauuuaaugagacguggcgaucuacccguuugguuagcguaucgcguugcugccgaaggaaucaauuacgccgaucguagaugguguuucgauggcguaaaaaacaaccaaauacuugaagagaauguugaaguugaaaucuggacuaaagaaggagaaaggaaaaaauuaaaaccuagauggcuagacgcucgaauauacagcgauccccucgcucugaaagaauucaaagaauuugccgccggaagaaaaucauuaacacuaaauuuaauaacagaaaugggucgauugccaacauucaugacacagaaggcaaggaacgccuuagacaaucuagcgguauuacauacugccgaggcggggggcagagcuuauaaccaugccuugucugaacuuccagaaacccuggaaacuuuauuauuguuaaccuugcuagccacagucacagguggaauuuucuuguucuugaugaguggcaaagguauugguaaaaugacucuuggcauguguugcauaauuacagcuuccguacuccuaugguaugcacaaauacaaccgcauuggauagcugcuucgauuauccuagaauuuuuucuuauuguauuauuaauaccagaaccugagaaacagagaacaccacaagacaaccaauuaaccuacgucguuauagcgauauugaccguaguggcugccacaauggcuaacgaaaugggauuccuagaaaaaaccaaaaaagauuucggacucgguggaauagccacacaacaaccugaaucuaacauauuagauauagaucuaaggcccgcaucugcauggacucucuaugccguagcaacaacauucaucaccccaaugcuaaggcauucuauagaaaacaguucagugaacguaucguuaacagcaauagcaaaccaagcgacaguacuuaugggacuaggaaaagguuggccuuugucaaagauggacauuggaguuccguuacucgcgauaggcuguuacucacaaguaaaccccauuacgcuaaccgcagcguuacuuuuauuaguugcacauuaugcuaucauuggaccaggauugcaggcuaaagcaacaagggaagcacagaaaagagcggccgcgggaauaaugaagaauccaacuguugacgggauaaccgucauagaccuugauccgauaccuuaugauccaaaguucgagaaacaacuaggacagguaaugcuacuaguucuauguguaacgcaaguacucaugaugaggacgacuugggccuuaugcgaagcacuaacgcuagcaacagguccaauaucuacuuugugggaagggaacccaggccgauucuggaacacuacaauugccguuucgauggcuaauauauuccgaggaucauaucuagcaggagcuggcuugcuauuuucaauaaugaagaauacggcgaacacacgaaggggcacaggaaacacaggagaaacguuaggagagaaauggaaaaaucgccuaaacgcucucgguaagucggaauuucagauuuauaaaaaaagcggaauacaggaagucgauagaacacuggcaaaagagggaauuaaacgaggagaaacggaucaucacgcggugagcagggggagcgcaaaguugagaugguucguagaaaggaacuuaguaacuccagagggaaaaguaauggacuuaggaugcggacgaggaggauggucuuauuauugcgggggacuaaagaauguaaaagaaguaaaagggcucacuaaagguggaccuggccacgaggaaccaauuccaaugucgacuuaugguuggaaucuagucagguuacagucagguguagacguuuuuuuuacuccacccgaaaagugugauacguuacuaugcgauauaggggaaucgaguccuaauccgacuguagaggcaggcaggacauuacggguacuaaaccuugucgaaaauuggcucaacaauaacacacaauuuugcaucaaaguuuugaacccuuauaugccaaguguaauagaaaagauggaggcccuucaaagaaaauacgguggugcucuaguccggaacccauugucgagaaauucuacucaugagauguauuggguaagcaaugcuucagguaacauagugucaaguguaaauaugauaaguaggaugcuaauuaaccguuuuacaaugagacacaaaaaagcaaccuaugaaccggauguagauuuagggucagguaccagaaacauaggcaucgaguccgagacgccaaacuuagauauaaucggcaagagaauagagaagauuaaacaagaacacgaaaccaguuggcauuacgaucaagaucacccauacaaaacgugggccuaccacgguucuuaugagacuaaacaaacuggaucagcuagcaguauggugaacggagucguaagguuauugaccaaacccugggaugucauuccaaugguaacacaaauggcgaugacggauaccaccccguucggacaacaaaggguauuuaaagaaaagguggauacacguacacaagaaccaaaagaagggacaaaaaaacugaugaaaauuaccgcagaaugguuguggaaagaacucgguaagaagaaaacaccgaggauguguacccgagaagaauuuacgcguaaaguacgaaguaaugcggcuuuaggagcaauuuucacugaugaaaacaaauggaagucagcacgcgaagcugucgaggauuccggcuuuugggaauuaguagacaaagagagaaacuuacauuuagaaggaaaaugcgaaacuuguguauacaauaugauggggaaacgagaaaagaaacuuggagaauucggcaaggcaaaagggucuagagccauuugguauauguggcugggugcacgauucuuagaauucgaagcacucggauuucucaacgaagaccacugguuuuccagggagaauucauuaagcggcguggagggugaaggacuacacaaauuagguuacauccuaagagauguaucuaaaaaggaagggggagcaauguacgcagacgacacugcggguugggacacuagaauaacacucgaagaucuaaaaaaugaggaaauggugacaaaucauauggaaggcgaacauaaaaagcuagcagaagcaauauuuaaauuaacauaccaaaauaaggugguccgaguacaaaggcccaccccuaggggaaccguuauggauauaaucaguaggagagaccaaagaggcuccggacaagugguaacauacggacuaaauacauucacaaauauggaggcucaguugauuagacaaauggaaggagaaggagucuucaaauccauccagcagcuuacagcgaccgaagagaucgcaguaaaaaauuggcuagcgagggugggaagggaacgcuugaguaggauggccauaagcggugacgauuguguuguuaagccacuagaugacagauuugcaucugcacuaacugcgcuaaacgacauggguaaaguaagaaaagauauucagcaaugggagccuagucggggauggaaugacuggacccaaguaccguuuuguagccaucacuuccacgagcuaauaaugaaagacggcagaguauugguaguuccgugcagaaaucaagaugaauuaauugguagagcuagaaucucucaaggugcuggaugguccuuaagagaaacagcuuguuuagguaagaguuacgcucaaauguggagucugauguauuuccauaggagagauuuaagauuagccgcaaacgcgaucuguucagcgguaccaucacacuggguuccuacuaguagaacaacauggagcauacaugcaacgcaugaguggaugacuaccgaggacauguuaacaguauggaauagaguguggauacaggagaauccauggauagaagauaaaacaccaguagaaucaugggaggagaucccuuaccuagggaaaagagaagaucaaugguguggaucacuuauuggcuuaacaucgagagcuaccugggcaaaaaauauucagacagcaauaaaucagguccguuccuugauagguaacgaagaguacacagauuauaugccaaguaugaaaagauuuagaagagaagaggaagaagcgggaguccuuugguaa

SEQ ID NO: 22953 - RNA, 9876 nt, Artificial Sequence
  derived and/or modified CDS sequence (opt6) from DENV-2__DQ645549__SS-prME
acagcagggguuauuauaaugaugauaccaacaguaguugcuuuucaucugacuacaaggaauggggaaccacacaugauaguaucaagacaggaaaaagguaagagcuuacuauuuaaaacagaaaauggaguaaacauguguacauuaauggcaauggaccuuggagaacuaugcgaagacacaauaacuuauaauuguccuuugcuacgccaaaaugaaccagaagauauugacugcugguguaauaguacuucuacguggguaacauacgggacaugcacagcaacuggcgaacauaggcgagagaaacgcagugucgcuuuaguaccacauguaggaaugggauuggaaaccaggacagaaacauggaugaguucugaaggggcauggaaacaugcacaaaggaucgaaacauggguauuacgacacccagguuucacuauaauggcagcaauccuugccuauaccaucggaacuacauauuuucagcgcguuuugaucuucauacuucugacggcuguagcaccaucuaugacuaugagaugcauuggaauaucaaaccgggacuucguagaaggaguaucuggaggaagcuggguggacauuguacuugaacacgggucgugcguaacaacaauggcuaaaaauaaacccacguuagauuuugaauuaaucaaaaccgaagcaaaacacccagccacuuuacgaaaauauugcauugaagccaaacuuacuaauacuaccacugcaagccguugcccuacacaaggagaaccgaguuuaaacgaggagcaagacaaacguuuuguaugcaaacacaguaugguagacagagggugggguaauggaugcggauuguucgguaaaggaggaauuguaacaugugcgauguucaccuguaagaaaaauauggaaggaaaaguaguacaaccagagaauuuagaauauacuauuguaauaacaccccacucgggagaagaaaaugcaguuggaaacgacacagggaaacacggaaaagaaaucaaaguaacgccucaaucuucaauaaccgaggccgaauuaaccgguuaugguaccguaacuauggagugcagucccaggacaggacuagauuucaacgagaugguccuucuucaaauggaagacaaagcgugguugguccauagacaaugguucuuggauuuaccucugccguggcuacccggugccgacacucaaggaucaaauuggauccaaaaagaaacccucguaacauuuaaaaacccucaugcgaagaaacaggauguagugguuuuggggucacaagaaggggcaaugcauacugcguuaacuggagcaacggaaauacaaaugaguaguggaaaccuacuauuuacuggacaccugaaauguaggcuaaggauggauaaacuucaauuaaaaggcauguccuacucgauguguacaggaaaauucaaaguaguuaaagaaauagcagaaacgcaacauggaacuauuguaauaagagugcaauaugaaggagacgguagccccugcaaaaucccuuuugagauaauggaccucgaaaaacgacauguuuuggggcgucuaauuacaguuaacccaauaguuacagaaaaagacucaccugucaacaucgaagcugagccaccauucggagauagcuauauuauaauuggagucgaaccagggcagcuaaaacuaucuugguuuaagaaaggaucaucaauaggccaaauguuugaaacaacaaugagaggugcaaaacgaauggcaauauugggagauacagcaugggauuuuggaucuuuaggcggagucuuuacaucuauuggaaaagcguuacaccaagucuuuggugccaucuauggagccgccuuuaguggaguuucauggacaaugaaaauacuaaucggcguaguaauaacauggauuggcaugaacucgcggaguaccucgcucucagucagcuuaguccugguuggcgucgugacgcuauacuuaggagugaugguucaagcagauagcgguugcguuguuaguuggaaaaauaaagagcugaaaugcggcucggguaucuucaucacagauaacgugcauacuuggaccgaacaguauaaauuucagccugaaaguccgaguaaacuugcaucagcaauucagaaagcgcaugaagaaggcauaugugggauuagaagcguuacacgucucgaaaaccuaauguggaaacagauuacuccugaauuaaaucauauuuugucagaaaaugagguaaaacuaacuauaaugacgggagauauaaaaggaaucaugcaagcagguaaaagaucacuuagaccucaaccuacagaauuaaaauacucguggaaagcaugggggaaagcaaaaauguuaaguacggaacuacauaaucauaccuucuuaauagauggaccagagaccgccgaaugcccuaauacaaauagagcauggaacucauuagaaguggaagacuauggauuuggaguuuuuacaaccaauaucuggcuaaaauuaaaagaaagacaagacguauucugugauucaaaacucaugagcgcagcaauaaaggacaauagagcaguccaugcagauaugggauauuggauagaaagugcccugaacgauacauggaagauagagaaggcuucauuuauugaagugaaguccugucauuggccuaaaagucauaccuuauggaguaacggaguccuugaaagcgagaugauaauaccgaaaaacuucgcaggcccugugucucagcauaauuaccgaccagguuaucauacccaaacugcuggaccguggcaucuaggaaaguuagaaauggacuucgauuucugugaaggcacaacaguggucguuacagaagauugugggaauagaggaccaucccuaagaacaacuaccgcaagugguaaacuaauuacagaguggugcugucgaucauguacgcuacccccucugagauacaggggcgaggacgguuguugguaugggauggagauacgaccccucaaggaaaaagaagaaaaccuuguaaauagcuuaguuacagcgggacacggucaaauagauaacuucucacuuggugucuuggguauggcguuguucuuggaagaaaugcugcguaccagagucgggacaaaacaugcuauucuuuuaguugcuguaucauucgugacuuuaaucacagguaacaugucguuuagggauuuagggagagucaugguaaugguuggggccaccaugacagacgauauuggcaugggaguuacauaccuagcccuccuagcugcauucaaaguaagaccaacguucgcugcagguuuacucuuaagaaaacuuacaaguaaagaauuaaugaugacaacaauaggaauuguuuuacuuucacaauccacaauaccagagaccauucuugagcuaacugacgcccuagcacuaggcaugaugguacuaaaaauuguuaggaacauggagaaauaccaauuggcgguuacgaucauggcaauauuaugugugccuaacgcugugaucuuacagaaugcauggaaaguuucauguacuauuuuggccgucguguccguuucuccgcuuuuauuaacaucaucacaacagaaagcagauuggauuccccuggcuuuaacgauuaaaggucuuaaucccacagccaucuuucucacaacuuuaucccgaacuuccaagaaaagaagcuggccauuaaaugaagcaauaauggcuguagguaugguaagcaucuuagcaucuagccucuuaaagaaugacauucccaugacuggaccuuuagucgcagggggacuauuaacugugugcuacguccuuaccggccgaucagcggaucuugaauuagaaagagcugcugacguacgaugggaagaacaagccgaaauaaguggcagcucaccgauauuguccauaacuauaucggaagauggcucaaugagcauuaaaaacgaagaggaagaacaaacccuuaccauucuaauccgaacgggauuacuuguaauuagcggacuauuuccuguaucuauuccgauuaccgcagcugcaugguaccuaugggagguaaagaaacaacgugcugggguucucugggauguccccagcccuccuccaguggguaaagcugaacuugaggauggagcuuaccgcaucaaacaaaaaggcauucuggguuacucucagauaggagcaggaguauauaaggagggcaccuuccacacuauguggcaugugacgcgaggagccguucuaaugcauaaagguaagcgcaucgaaccuucaugggcugacgucaagaaagauuuaauaucauauggcgguggauggaaauuggaaggagaauggaaagagggggaagaaguccaagucuuagcguuggaacccggcaaaaacccaagagccgugcagacaaaaccuggauuguuuaaaacaaauacgggcacgauaggggcuguaucacucgacuucucuccugggacaucgggaucgccaauaguagauaagaaaggaaagguuguaggauuauauggaaauggaguagugacgagaagcggaacauacguauccgcuaucgcucaaacagaaaaaucuauagaggauaacccugaaauagaagaugauauauuuaggaagaaaagacuuaccauuauggaucuacacccgggagcuggaaaaacaaaaagauaccucccagcuauuguuagagaggccauaaaacguggauuacggaccuuaauauuagcuccaacgagaguaguagccgcagaaauggaagaagccuuaaggggucugccgaucagauaucaaacaccggcaauucgugcagaacauacuggacgggaaauaguagaucuaaugugucaugcuacauuuacgaugcgacuucuauccccaauccggguccccaacuauaaucuaauaauaauggacgaagcucauuuuacagauccugcauccaucgcggcgcguggauacauaaguacuagaguugagaugggggaggcugcuggaauuuucaugacagcuacaccaccuggcaguagagacccauuuccacaaaguaaugcaccaauuauggaugaagagagagaaauaccagaaagaagcuggaauagcgggcaugaaugggucacugauuuuaaaggcaaaacagucugguucgugccuuccauaaaagcgggaaacgauauugccgccugccuccgcaaaaaugggaagaaaguaauccaguugucuaggaaaacauuugauagugaguauguaaagacgaggacaaaugauugggauuucguaguaacaacagauauuagugaaaugggagcuaacuuuaaggccgagagaguaauugauccaaggaggugcaugaagccggugauacugacagauggugaagagagagugauccuugcgggccccaugccuguaacacauucauccgcugcccagaggagaggaaggguuggucguaaccccaaaaaugaaaaugaccaauacaucuacaugggugaaccauuggaaaacgacgaagacugugcacacuggaaagaggccaaaaugcuacuagauaauauuaauacacccgaagguauaauaccaaguauguuugaaccagaacgagaaaagguagaugcgauagauggggaguaucgucuuagaggugaagcucguaaaacauucguggauuugaugcgaagaggugacuuacccguaugguuagcguaucgaguagcagcagaagguauuaacuacgcagacagaagguggugcuucgauggugucaaaaauaaccagauccuggaggaaaacguagaaguugaaauuuggacgaaggaaggugaacguaagaaauugaaaccgagauggcuggaugcaagaauauauagugauccauuggcacucaaagaguuuaaagaguuugcggccggacgaaaaucauuaacacuaaauuugaucacggaaaugggucgcuugccaacuuuuaugacacaaaaagcucggaaugcucuagacaaccuugccgugcuucauaccgcugaagcgggugguagggcauacaaucacgcauugucagaauugccagaaacccuugaaacuuuacuauuacugacuuuauuagccacuguaacaggagggauuuuucuauuucucaugaguggaaaaggaaucggaaagaugacucucggcauguguuguauaaucaccgccucgguccuguugugguaugcucaaauacaaccacacuggauugcagcaaguauaauucuagaguucuuucuuaucguauuacucauccccgagccggagaagcaaagaacuccucaagauaaucaacuuacauacgugguaauagccauucucacaguaguagcggcuacaauggccaaugaaaugggauuuuuggagaaaaccaagaaagauuucggguuaggagggauagcgacacaacagcccgaauccaacauucuggauauagauuuaaggcccgccucugcauggacacuauaugcuguugccaccaccuuuaucacaccuaugcuacgccacaguauagaaaauucaucaguuaacgucucgcugacggccauugcuaaccaagcgacugucuuaaugggauuagguaaagguuggcccuuaagcaaaauggacauaggaguaccucugcuagcaauagggugcuauucgcaaguuaacccgauaacucuaacagccgcauuguugcuacuuguggcucacuacgcuauaaucgggcccggacuacaagcaaaggcuacaagagaagcgcaaaaacgagcagcagcaggcauuaugaaaaauccaacaguggaugggaucaccgucaucgaucuugauccaauacccuaugauccaaaauuugaaaaacaacucggacaggucaugcuuuuaguuuuaugcguaacccaagucuuaaugaugcgaacaacaugggccuuaugcgaagcucuaacccuggcgacagguccuaucagcacauuaugggaaggaaauccgggcagauuuuggaauacgaccauagcgguauccauggcaaacauauuucgagguucauauuuagcgggcgcaggacuacuauucucaauaaugaaaaacacagcaaauacuagaaggggcacaggcaauacaggagaaacauuaggagaaaaauggaaaaauagauuaaaugcucuuggaaaaagcgaauuucaaauuuauaagaaaagcggaauccaagaaguugaccguacuuuggcaaaggaagguauaaaaaggggcgaaacagaucaccaugcagucucaagagggucggcaaaguuaagaugguuuguagaaaggaacuuaguaacuccggaaggaaaagucauggauuuagggugcgguagaggagguuggagcuauuauugcggaggucucaaaaauguuaaagaagugaaggguuuaacuaagggagguccgggccaugaggaaccaauaccaaugucgacuuaugguuggaaccugguuagacugcaaucagguguagauguguucuuuacgccaccugaaaaaugcgauacgcugcugugugacauaggagaaaguagcccaaauccuacgguggaggcagggaggacucuaaggguucuaaaccucgucgaaaauuggcuuaacaacaauacacaauuuuguauaaaagucuuaaacccguauaugcccucagugaucgaaaagauggaggcuuuacaaaggaaauacggaggagcacuuguaaggaaucccuuaagcagaaauaguacacacgaaauguauuggguuaguaacgcaagcggaaacauuguaaguagcguuaauaugaucagucggaugcuaaucaaucgcuucacuaugaggcauaagaaagcaacuuaugaaccugacguagaucuaggaucgggcacaagaaacauuggaauagagucugaaacuccaaaucuagauauuaucgggaagagaauagagaaaauaaaacaggaacaugaaacuagcuggcauuaugaccaagaucauccauacaaaacgugggccuaccauggaucauaugagacuaagcaaaccgguagugcaagcaguauggugaacgguguaguacgccuauuaacaaaaccaugggacgucauccccaugguaacucaaauggcuaugacugauacgaccccguucggacaacagcgaguguuuaaaguaaaaguugauacacgaacacaggagccuaaagaaggcacgaagaaacucaugaagauaaccgccgaguggcuauggaaagaauugggcaagaagaaaacaccgagaaugugcacaagagaggaguuuacaagaaaaguacggucaaaugcugcacuaggcgcgauauuuacugaugaaaacaaauggaaaagugcaagggaggcaguagaagacucuggguuuugggagcuaguagauaaagaaagaaaccuacauuuagaaggaaaaugugaaacauguguguauaauaugauggguaaacgggagaagaaacugggggaguucggaaaggcgaaaggaucaagagccauaugguauauguggcucggugcgagguuucuagaguuugaagcgcucggauuccuaaaugaggaccacugguuuagcagagaaaauuccuugucgggcguugaaggugaaggauuacacaaauuaggcuauauucuaagggauguuagcaagaaggaagggggcgcuauguaugcagaugauaccgcuggaugggacacuagaaucacacuagaggacuuaaagaaugaagagaugguaaccaaucauauggagggugaacauaagaaacuugcagaggcaauauucaaacuaacguaucaaaauaaaguuguucgaguccaacgaccaacaccacgagguacuguaauggacauaauaagucggcgagaccagagagguagcggacaaguagucacauauggucucaacacguuuacuaacauggaagcacagcuaauuagacaaauggagggggaaggaguauucaagaguauacaacaauugacggcaaccgaagaaauugcagucaaaaauugguuagcacgaguaggcagagaacgccuaucucgaauggcuauaucaggagaugauuguguaguaaaaccucuugacgacagauuugcuucagcgcuuaccgcacuaaacgacauggguaaagugcgaaaagauauacaacagugggaaccaucgagaggauggaaugacuggacacaaguuccguuuuguucacaucauuuccaugaacuaauaaugaaagacggaaggguacugguugucccgugucgaaaucaagaugaauugauaggucgcgcacgcauuucccagggugcaggguggucacuuagagagacggccugucuggggaaaucuuacgcgcagauguggagucuuauguacuuccaucggcgugaccuucgacuagcugcgaacgcuauaugcagcgcugugccuucacauugggugccaacaucucguacaacauggucaauacaugcaacacaugaauggaugacgacagaagauauguugaccguauggaauaggguauggauacaggaaaauccauggauagaagauaaaacaccuguugaaaguugggaagaaauaccauacuugggaaaaagggaggaucaaugguguggaucauuaauuggccuaacuucucgugcaacuugggccaaaaacauucagaccgcaauaaaucaaguacggagcuugauagguaacgaagaguacacagauuauaugccgucaaugaaaagguucagacgggaagaagaagaggcugguguacuaugguga

SEQ ID NO: 22954 - RNA, 9876 nt, Artificial Sequence
  derived and/or modified CDS sequence (opt6) from DENV-2__DQ645550__SS-prME
acggcaggggugauaauuaugaugauuccaaccguaguugcauuucacuuaacuacucggaacggagaaccacauaugauuguuucgcgccaagaaaaagguaaaaguuuacuauucaaaacagaaaauggugucaauauguguacccuaauggcaauggaucuaggggaacuuugcgaagauacaauaacauauaauugucccuuauuaagacagaaugaaccugaagacauugacuguugguguaauuccacaucgaccugggugacauauggaacauguacugcaacaggagaacaccgcagagaaaaacgaucaguggcauuaguuccucacguuggaaugggacuggaaacaagaacugaaacauggaugaguucagaaggugcauggaaacaugcacaacgaauugaaacguggguccugcgacacccuggauuuacaauuauggccgcgauacuagcguauaccauagggacaacauauuuccaaagaguucuaauuuuuauauuguugacggcggucgccccuucuaugacaaugagauguauuggaauauccaauagagacuuuguugaaggagucucagguggaagcuggguagacauuguauuagaacauggcaguugugucacaaccauggccaaaaauaaaccaacacuagacuuugagcuaauaaaaacagaggcuaaacauccggcuacucugcguaaauauugcauagaagccaaacuuaccaacacgaccacugcaagcagauguccaacucaaggugaaccaagccuuaaugaagaacaagacaaacguuucguauguaaacauagcauggucgacagggguugggguaauggcugcgguuuauuuggcaaaggaggaauuguuacaugcgcaauguuuaccugcaagaaaaauauggaaggcaaagugguucaaccagaaaaccuggaauauacaaucguaaucacgccucauucaggagaggaaaacgcagugggaaaugauacagguaaacacggaaaagagauuaaagucacaccucaaaguucgaucaccgaagcugaacuaacagguuauggaaccgucacaauggaauguagcccucggacaggauuagacuuuaaugaaauggucuugcuacaaauggaagauaaggcguggcucguucaccgacagugguuucucgacuugccacuacccuggcugccaggagcugacacgcaggguucgaauuggauacaaaaagaaacuuuaguaacauucaaaaauccgcaugcuaagaaacaagauguuguagucuuaggaucacaagagggcgcuaugcacaccgcacugacuggagcaaccgaaauccaaaugagcaguggaaaucuacuauucaccgggcaccucaaguguagauuacgcauggacaaacuacaguuaaaaggaaugucuuauuccauguguacugggaaguuuaagguuguuaaagaaaucgcugaaacgcaacacggaacaauugucauaagaguucaauaugaaggagacgggucacccugcaaaaucccuuuugagaucauggaucuagaaaaacgacacguacucgguagauuaaucacuguuaaccccauaguaacagaaaaagauucgccaguaaauauagaggccgaaccaccauucggagauucguacaucauaauuggaguagaacccggacaauuaaagcuauccugguucaagaaagguaguucaaucggacaaauguuugagacuacuaugcggggugcuaaacggauggcaauacugggagauacggcuugggauuucggaaguuuaggagguguauucacaaguauuggaaaagcccugcaucagguauucggagcaaucuauggggcggcguucaguggcguuucuuggacgaugaagauacuuauaggggucgucaucaccuggauuggcaugaacucaagaucuaccagucuaucugucagcuuaguacucgucggagucgugacgcuauacuuaggggucaugguacaagcagauucuggcuguguaguaagcuggaaaaacaaagaacuaaaaugcggaucagguauauucaucacugauaacguacacacuuggacagagcaguauaaauuccaaccagaguccccaucgaaacuggcuucagcaauucaaaaagcacaugaagaggggaucuguggaauacgcaguguuacccgguuagaaaaucuuauguggaaacagauuacgccugaguugaaccacauuuuaagugaaaaugagguaaaacuaacgauaaugacuggggacauaaaagguauaaugcaagcugggaaaaggaguuugaggccccaaccaacggaacuaaaauauucguggaaagcaugggguaaagcaaaaaugcugaguacugaacuucauaaccacacauuccuuaucgaugggccggaaacggcagaaugucccaauacaaauagagccuggaauagcuuagaaguggaagacuaugguuuuggagucuuuacaacaaauauaugguuaaaacuaaaagagagacaggacgucuucugugauaguaaacuuaugagugcggccauaaaggauaacagagcgguccacgcggauauggguuacuggauagaaucagcacuaaaugauacguggaaaauagaaaaagcaucuuuuauugagguaaaaucaugucacuggccgaaaucacauacccuauggagcaauggaguacuagaaagugagaugauaauccccaaaaacuuugcaggaccaguuucacaacauaauuauagacccggguaucauacacaaacagcgggaccauggcauuuaggaaaacuagaaauggacuucgauuucugcgaaggcacuacaguuguaguaacagaagauugcggcaaccgugguccaaguuuacgaaccacgacugcguccggcaaacuuauuaccgaaugguguugccgaaguuguacguuaccaccucuccgauacagaggagaagauggaugcugguaugggauggaaauuagaccacuaaaagaaaaggaggaaaaccugguaaacagccugguaacggcaggacauggccaaaucgauaauuucucacucggaguacuagguauggcauuauucuuagaagagauguuaagaacaagagucggaacuaaacaugcaauccuucucguagcagugaguuuuguaacacugaucacuggaaacaugucuuuccgugaucuggggcgcgucaugguaauggucggugcaacaaugacagaugacauuggcauggguguuacuuaccuggcauuacuagccgcuuuuaagguaaggccgacuuuugcagcgggacuuuuacuuagaaaguuaacaucaaaggaguugaugaugacuacgauaggaauuguauuacuaucacaauccacuauacccgagacaauucuagaguuaacagacgccuuggcuuuagguaugauggugcuaaagauuguacgaaauauggaaaaauaucaguuagccgucacaauuauggcuauccucugcguaccgaaugcaguaauacuacaaaacgccuggaaaguuaguuguacgauccuagcgguaguaucggugagccccuuauuacucacaaguagccaacaaaaagcugauuggauaccacuugcacuuacuaucaaaggauuaaacccuaccgcuaucuuucuaacuacguugucaagaacaaguaagaaacgaaguuggccccuaaacgaggcuauaauggcagucgguaugguuuccauccuagcgaguagccuacucaaaaacgauauaccaaugacuggcccguugguagcagggggucuacugacagucuguuaugugcuaacgggacgauccgcagaucuagaacuagaacgcgccgcagaugucagaugggaagaacaggcugagauaagcggaucuucgccaauucuaucaaucacgauuucugaagaugguagcauguccaucaaaaaugaggaggaggaacaaacucucacgauccuaauucgaacaggauugcuggucauaucuggauuauuucccguaaguauaccaaucacggccgcggcgugguacuuaugggaaguaaagaaacaacgugccggaguacucugggauguacccucuccaccaccgguaggcaaagccgaacuugaagacggagcauaucgaaucaaacaaaaagggauauuaggguacucccaaaucggagcugguguauauaaagaagggacuuuucacacaauguggcauguuacaagaggagcuguuuuaaugcauaaagguaaaagaaucgaaccgucaugggcggauguaaagaaagacuuaaucucauauggaggugguuggaaacucgaaggagaauggaaagaaggagaagaaguacaaguucuagcacuggaaccuggcaagaaccccagagcaguucaaacuaaacccggauuauuuaaaacuaacacaggcacaaucggagcugugagccuagauuuuaguccaggaacuucgggaucacccauaguggauaagaaaggaaaaguagucggacuuuaugggaacggugugguaaccagaucugguacauacguuagugcaauagcucagacagagaaaagcaucgaagacaauccagaaauugaagacgauauauuucgaaagaaacguuuaacgauuauggauuuacauccuggggccgguaaaacgaaaagauauuuaccagcuauuguucgagaagcaauuaaaagagggcugcguacacuuauacucgcuccaacacgcguuguagcugcagaaauggaggaagcauugcguggauuaccaauacguuaccagacccccgcaaucagagcagaacauacuggccgagagauuguugaccugaugugucaugcaacuuucacuaugcgucuacuaagucccauaagaguccccaacuauaaucuaauaauuauggaugaagcacacuuuacagauccugcgucgauagcagcaaggggcuauauuucaacacggguagagaugggagaggcugccggcauauuuaugacggcaacuccaccaggaucaagagacccauuuccacaaaguaacgcaccaauuauggaugaagaacgagaaauaccggagagaucuuggaacagugggcacgaauggguaacagacuuuaaaggaaaaacagucugguucgugccaagcaucaaggccgguaaugauauugcagccugucucaggaaaaacggcaagaaaguuauacaauuaucgcgaaaaaccuuugacucugaauauguuaaaaccaggaccaacgacugggauuuuguagucacuacggauauaagugaaaugggcgccaacuucaaagcugagagaguaauagauccuaggcgauguaugaaacccguaauauugacugauggagaggaacguguuaucuuggcgggaccaaugccugucacacacagcagcgcggcgcaacgacguggucgcguaggaagaaauccuaaaaacgagaacgaucaguacauuuacaugggggaaccacuugaaaacgaugaagauugcgcacauuggaaagaggcaaaaauguuguuagacaacauuaacaccccugaagggaucauaccuagcauguuugaaccugagagagaaaaaguugacgcgaucgauggcgaauaucgacuucguggcgaagcaaggaaaacuuuuguugaucuaaugagacgcggggaucuuccaguguggcuggcauaucgcguagcugcagaagguauuaacuaugcagaccguagauggugcuucgacggugucaagaauaaccaaaucuuagaagaaaacguagagguggagauauggacaaaggaaggagagagaaagaaacuaaaaccgagauggcuugacgcgaggauauacagugauccacuagcuuuaaaagaguuuaaagaguucgcagcaggaagaaaaucccuuacccuaaauuuaaucacagagaugggucgcuuaccaacauuuaugacacagaaggcacguaacgcauuagauaaucuagcaguucuacacacugcugaagccgguggucgugcauauaaccaugcacuaagugagcuaccugaaaccuuagaaacgcuacuuuuacuuacuuuacuugcuacagucacuggcggcaucuuuuuauuucuuaugaguggaaaaggcauaggcaaaaugacauuaggcaugugcugcauuauuacugcuuccguccuuuuaugguacgcacaaauucaaccccauuggauagcagcuaguauuauacuggaauuuuucuuaauaguacuacuuaucccugaaccugagaaacaacguaccccgcaggauaaccaguuaacauauguagugauagcuauauuaacuguggucgccgcgacgauggccaaugagaugggcuuuuuagagaaaaccaagaaagacuuugguuuagguggaauagcuacacaacaaccagagaguaacauccuugacauugacuuacguccggcuagugcauggacauuauacgcuguagcaacaaccuucaucacaccgaugcuccgccauucaauagaaaauagcagugucaaugugagcuugacugccaucgccaaccaggccacaguacucauggggcuaggcaaagguuggccauuaaguaaaauggauauagguguaccacuguuagcgauaggauguuacucacaagucaacccaauaacguuaacagcggcacuucuacuccuaguugcacauuaugcuauaauagguccagguuuacaagcaaaagccacucgugaagcacaaaagagagcugcagcaggaauaaugaaaaaucccacaguggauggaauaacagugauagaucuugauccuaucccguaugacccuaaguuugaaaaacaacuuggccaagugaugcuucugguuuuaugcgugacucagguucugaugaugcggacgacaugggcucuaugugaagcccuaaccuuagcaacgggcccaauaucaacauuaugggaaggaaauccggguagauuauggaacacaacgauagcaguuucuauggcaaacauauuuagaggcagcuaccuagcuggcgcuggauuauuguucuccaucaugaaaaauacugcgaauacgcgacgugguaccggaaauacuggugagaccuugggugaaaaguggaaaaacagauuaaaugccuuaggcaaaucugaguuccagaucuauaagaaaagugguauucaagaaguagauagaacguuggcgaaagaagguauaaaacgcggcgaaacagaucaccacgccguuaguagaggaagugcuaaacuacgaugguucguggaaaggaacuuagugaccccggagggcaaaguuauggaccuaggauguggucggggagguugguccuauuauugcggagggcucaaaaauguaaaagaaguuaaaggacugacgaaaggggguccgggacaugaggagccuauuccuaugagcacauacggcuggaauuuaguuagacuccaaagcgguguagacguguuuuucacuccacccgagaaaugcgacacuuuauugugugauauuggugaaagcaguccuaauccgaccguggaagccggcagaacacuacgaguacuuaaucuaguggaaaauuggcucaauaacaauacucaauuuuguauuaaagucuuaaacccauauaugcccagcguaaucgagaaaauggaagcacuccagaggaaauauggaggugcauuaguuagaaauccucugucuaggaauagcacacaugagauguauuggguauccaaugcuucggguaauauaguaaguaguguuaauaugauuagucguauguuaauaaacagguuuacaaugcgucauaagaaagccacuuaugaacccgaugucgacuuaggauccgguacucgcaauauugguauagaguccgagacccccaauuuagacauaauagguaaacguauagagaaaauuaaacaagagcaugagaccagcuggcacuaugaucaagaccauccauauaagacaugggcuuaccacgguagcuaugagaccaagcagaccgggagugcuaguucgaugguaaauggcguaguaaggcuacuaacaaagccaugggacguaaucccaauggucacucaaauggcuaugacagacacaacuccguuugggcaacagagaguauucaaaguaaaaguagacacuagaacgcaggagccgaaagaggguacuaagaagcugaugaaaauuacugcggaaugguuauggaaagaacuaggcaagaagaaaaccccacguauguguacucgggaagaauuuacaagaaaagucagaucaaacgcagccuuaggugcgauuuuuacugacgaaaacaaauggaaaagcgcaagggaagcaguagaagacucuggguuuugggagcuaguugacaaagagaggaauuuacauuuagaaggaaaaugugaaacauguguauauaauaugaugggaaaacgagagaagaaauuaggcgaguucggaaaggcaaaggggucacgggcuauuugguauauguggcuuggagcucguuuucuagaguucgaggcacuaggcuuucuaaaugaagaccacugguuuucuagagaaaacagucuuucuggugucgaaggggagggacuccacaaauuaggguauauauuaagagacgugagcaagaaagaaggaggugcaauguacgccgacgacacagccggaugggacacaagaauaacacuagaagacuugaaaaaugaagaaaugguaacaaaucauauggagggcgaacauaagaaacucgcugaggcaauauucaaacucacauaucaaaauaaaguaguaagagugcagagaccuacuccacgaggaacagucauggauauuaucagucggagagaucaaagaggaucgggacaagucguaacauacggauuaaauaccuucacgaacauggaagcacaauuaaucaggcagauggaaggagaaggcguguucaaauccauacaacaguuaacagcgacugaagaaaucgcugucaaaaauugguuagcaagaguagguagagaaagguuaagccgaauggcaauaucaggagaugauugcguugucaaaccacuggaugauagauuugcauccgcuuuaaccgcgcuaaacgauaugggaaaaguuagaaaggacauacagcaaugggaaccuucaagaggauggaacgacuggacacaaguccccuuuuguucacaucacuuccacgaauuaauuaugaaagacggccgaguuuugguagucccaugucguaaucaagaugaacuaauaggacgagcaagaauaucgcaaggugcuggguggucccuacgggagacugcguguuuaggaaaaagcuaugcucagauguggagcuuaauguauuuccauagaagagaccuucgcuuagcagcaaacgcuauauguuccgccguaccaucucacuggguuccuacaucacgaacaacgugguccauacaugcaacacacgaguggaugacuacggaagacauguugacgguguggaacagggucuggauucaggaaaauccguggauagaggacaaaacaccaguugaaagcugggaagaaauacccuauuuaggaaaaagggaagaccaauggugcggcagcuuaaucggacucacgucuagagcuacgugggccaaaaacauacaaacagcaauaaaucaaguuagguccuuaauuggcaaugaggaauauacagacuacaugccguccaugaaacgguuuagaagagaagaagaagaagcaggcguauuaugguaa

SEQ ID NO: 22955 - RNA, 9876 nt, Artificial Sequence
  derived and/or modified CDS sequence (opt6) from DENV-2__DQ645551__SS-prME
accgccgguguuauaauuaugaugauuccuacaguuguagccuuucaucugacuaccagaaauggagaaccucauaugauaguauccagacaggaaaaaggaaaaucuuuauuguucaaaacggaaaauggaguaaacaugugcacgcuuauggcuauggacuuaggggaacuuugugaagacacgaucacguauaacuguccauugcuaagacaaaacgaaccagaggacauagauuguuggugcaauuccacuucaacuuggguaacauacggaacguguaccgcuacgggugaacauagacgagagaaaagaucaguugcuuuaguaccgcacguaggaaugggucuugaaacgcgcacagaaacguggaugucaucagaaggagccuggaaacaugcacaaagaauugaaacauggguucuucgacauccuggcuucacuauaauggcagccauacuagcauacaccauuggcacuaccuauuuucaacgggucuuaauauuuauacuccuaacugcuguugcuccuucaaugacgaugagaugcauaggaaucagcaaccgagauuuuguugaggguguaucugggggaucaugggucgauauuguguuagagcacggaucguguguuacuacaauggccaaaaauaaaccaacuuuggauuuugaacuaauaaaaacugaagcuaaacacccggcuacacugagaaaauauuguauagaggcgaaacuaacgaacacaacgaccgcgucgcgaugcccuacacagggggagccuucacugaacgaggagcaggauaaacgauuuguuuguaaacacucaaugguagauagaggaugggguaaugguuguggccuauucggaaaaggagguaucguaacaugcgcuauguuuacgugcaagaaaaauauggaagguaaagucguacaaccagagaaucuugaauacacaauagugaucacaccucauaguggagaagaaaacgcuguggggaaugauacaggcaaacauggaaaagaaaucaaaguaacgccacagucgucuauaacagaagcggaacucacgggcuacgguacugugacaauggagugcuccccaagaacaggacuugacuuuaacgaaaugguucuucuccaaauggaagauaaagcaugguuagugcacagacaaugguuuuuagaccuaccucuaccauggcuccccggagcugauacccagggcagcaauuggauacagaaagaaacauuaguuacuuuuaaaaauccucaugcgaagaaacaagauguagucguucuuggcagccaagaaggcgcaaugcacacagcccugacaggcgcuaccgagauccaaauguccucaggaaacuuacuauucacgggccaccuaaaauguagauugcgaauggacaaacuccaacuaaaagguaugaguuacagcauguguacagggaaauucaaagucgugaaagaaauugcagagacacagcauggaacuauugucauuagaguucaauacgaaggagauggcucaccaugcaaaaucccuuuugagauuauggaccuagagaaacgccauguguuaggcagauuaaucacuguaaacccaauaguuacagagaaagacucaccggucaacauagaagccgagccuccauucggugauagcuacauaauaaucgguguagaaccagggcaguuaaaacuaucuugguuuaagaaaggaagcucaauaggacagauguucgagacaacuaugagaggugcuaaacgaauggcgauucuaggagacaccgcaugggacuuugguaguuuaggagggguguuuacaagcauugggaaagcacuacaucaagucuuuggggcaauauauggagcagcuuuuagugguguaucguggacgaugaaaauacucauaggaguaguaauaacuuggauugguaugaacucacgaaguacaucucuuuccgucucuuugguucuaguaggggugguaacuuuauaccuggguguaaugguucaagcugauaguggaugcgucguaaguuggaaaaauaaagaacucaaguguggcagcgggauuuuuauuacugauaacguucacacuuggacagaacaauacaaauuucagccagaaucucccucaaaauuagcaucagcuauacaaaaggcacacgaagaagggauauguggcauaagaagugucacaagauuggaaaauuugauguggaaacaaauuacuccggaacuaaaucacauucuuucagagaacgaaguaaagcuaacgauaaugacaggggauaucaaaggaaucaugcaggcaggaaaaaggucauuacggccgcaaccaaccgaauuaaaauacucuuggaaggcuuggggaaaagccaaaaugcuaucuacggagcuucauaaccauacuuuucuuauagacggaccugagacagcugaaugcccaaacacaaaccgugcauggaacucacucgaaguagaagauuaugguuucggaguguuuaccacaaacauuuggcucaaauuaaaagaaagacaagacguauuuugugauucgaaacucaugucagccgccauuaaagauaauagagcaguacaugcagacaugggauacuggauagaaucagcucuuaaugauaccuggaaaauugaaaaagcaaguuuuaucgaaguaaaaucaugucauuggcccaaaucgcauacguuauggucuaacggaguuuuagaaucugaaaugaucauucccaaaaauuucgcaggaccagugagccagcacaacuaucgaccaggauaccauacacagacggcaggaccguggcaucuuggaaaauuggagauggacuucgauuucugugaagguacaacaguagugguuaccgaagauugugggaauagagggccuaguuuacggacuacuacugcaagcggcaaauuaauaacagaauggugcuguagaaguuguaccuuaccuccccuuagauaccgaggggaagacgguugcugguauggaauggaaauucguccacuuaaggaaaaagaagagaaucuugucaauucccuuguuacggcuggacauggacaaauagauaauuuuaguuuggguguucugggaauggcccuuuuccucgaagaaauguuacgaacaagaguaggaaccaaacacgcaauauuauuaguagccguauccuuuguaacucuuauaacgggaaauaugucauuuagggacuugggacgaguaaugguaaugguuggcgcaacuaugacggacgacauaggaaugggaguaacauauuuggcacuauuagcggcuuucaagguaaggccuacguuugcggcuggucuacuucucagaaaacucacauccaaagaacuuaugaugacaacuauagguauuguacuccuuagccaauccacuauuccagaaacaaucuuagagcucacagaugcucucgcccuaggaaugauggugcuaaagauagugagaaacauggaaaaauaucaauuagcgguaacuauaauggcgauuuuauguguaccaaaugcgguaauccuacaaaacgcauggaagguaucaugcacgauauuagccguuguuaguguaagccccuuauuauuaacuucaagccagcagaaagcugacuggauuccacuagcacugacaaucaaaggguugaauccuacagcuauauuccuaacaacauuaucaagaacaucgaaaaagagauccuggccacucaacgaagcaaucauggccgucggaaugguuucaauacuggcaaguucauuacuuaaaaaugacauccccaugacaggaccgcuaguagcugguggguuacuaaccgucugcuacguccucacggguaggagugccgauuuagaacuugaacgagcagccgauguaagaugggaagaacaagcagaaauuucgggaucaucuccaauucuaucuauuacuauaucggaagauggaagcaugagcaucaaaaaugaagaagaagaacaaacacuaacgaucuuaauuaggacagguuuacucguuauaucugggcuauucccaguaaguauaccaauuacagcagcggccugguauuuaugggaagucaagaaacaacgggcaggaguauuaugggauguaccaagcccaccaccagucggcaaagcugaauuagaagacggggccuaucguaucaaacaaaaagggauuuuaggauauagccaaauuggugcaggggucuacaaagaagguacuuuccacacuauguggcacguuacacgaggagcuguacuuaugcauaaaggaaagcguauagaaccaaguugggcugauguuaagaaagaucuaaucagcuaugggggagguuggaaacuugaaggugaauggaaggagggugaagagguucaagucuuggcguuggagccaggcaagaauccgcgggcaguacaaacaaagccgggccuuuuuaagacuaacacaggaacuauaggggcuguuagucucgauuucucaccaggcacauccgggaguccuauaguugacaagaaagggaagguuguuggauuauacgguaauggaguggucaccagaucagguacauacguaucugccauagcgcaaacagaaaagucuauagaggauaacccagaaauagaagaugauauauuuaggaagaaacgacuuacuauaauggacuuacaucccggugcuggaaagacuaaacgauaccugccagcaaucguacgggaagcuauaaagaggggacuaagaacauugauauuggcuccaacacggguuguggcugcagagauggaggaagcguuacgcggucuaccuauuagguaccaaacuccugcgauaagagcagagcauaccggcagagagaucguagaccuaaugugucacgccacuuuuaccaugcgguuacucagcccaaucaggguaccuaacuauaaccuaauaauaauggacgaggcacacuuuacugauccagccucaaucgccgcucgaggcuauauuaguacaaggguugagaugggagaagcggcaggaauuuuuaugacugcuacuccuccaggcucacgggaccccuuuccgcagucaaacgcaccgauaauggaugaggaacgagaaauacccgaaagaucauggaacucggggcaugaguggguaacagauuuuaaaggcaaaacuguaugguuugugccgucuauaaaagcugguaaugauauagccgcaugucugcgaaagaauggaaagaaagucauucaauuaaguagaaaaaccuuugacagugaguauguaaaaacccguacaaaugacugggacuucguuguaacaacagauauaagugaaaugggagcgaauuuuaaagcagaacguguaauagaucccagacgauguaugaaacccgugauauuaaccgauggcgaggagagaguuauacucgcagggccaaugccagucacccacucuucggcagcgcaacguagaggcagaguuggacgcaaccccaaaaaugagaacgaucaauacauauauaugggugaacccuuagagaaugaugaagauugcgcacacuggaaagaagcuaaaauguuauuagauaauauuaacacuccugaagguaucauuccaucuauguucgaaccagaacgcgaaaagguugacgcaauagacggagaauauagguuaagaggagaagccaggaaaacuuuuguugauuuaaugaggagaggcgacuuaccagucuggcuagcauauagaguggccgcggaaggaauaaauuauacagacagaagguggugcuucgauggugucaaaaauaaucagauccuagaagagaacguugagguggaaauuuggacuaaggagggagagaggaagaaacuuaaaccgaggugguuagacgcacgcauauacucagacccccucgcacugaaagaauuuaaggaauuugccgcgggaagaaaaagucucacucuuaaucuuauaacagaaauggggagacuaccuacuuucaugacucagaaagcuaggaacgcauuagacaaccuggcagucuuacacacagcagaagccggaggcagagcauauaaucacgcucuauccgaacucccugaaacacuugaaacauuauuauuauugacauuacuagcuacaguuacaggaggcauuuucuuauuucuaaugucgggcaaaggaauaggaaagaugacacuaggcaugugcugcauuauaacugcgucaguauuguugugguacgcacaaauucaaccccauuggauagcagcaaguauaauauuagaguucuuucuuauaguacuauuaauuccggaaccagagaaacagcgcacaccacaggacaaccaguuaacguacgucguaauugccauauugacagucguagcugcaacgauggcuaaugagauggguuuucuugagaaaacuaagaaggauuuuggcuuaggaggcaucgcgacacagcagccagaaucuaauauacuagauaucgaccuaaggcccgcgucagcuuggacguuauaugcgguggcaacaacauucauaacuccuaugcuucgucacucaauagaaaauuccucaguaaauguaaguuugacagcaaucgcaaaccaggcgacggucuuaauggguuuaggaaaaggguggccauuaucaaaaauggacauaggaguuccuuuauuagcaauuggguguuauagccaggugaauccaaucacacuuacugcagcacuacuccuccuaguugcacauuaugccauuaucggaccuggccuacaggcaaaagcaacucgagaggcacagaaaagagcagcagcggguauaaugaaaaaccccacuguagacgguauaacuguaaucgaucuagacccuauacccuacgauccaaaguucgaaaaacaacucggacaaguaaugcuuuuaguacuaugcguaacacaggugcuaaugaugagaacaacgugggcgcuaugcgaagcgcucacuuuagccacgggacccauuagcacccucugggaggguaaucccgguagguuuuggaauaccacgauugcaguuucuauggccaauauauucagaggguccuaccucgcaggagcagguuuacuauuuucuauaaugaagaacaccgccaacacucgucgggguacaggaaauacgggugaaacacuaggagaaaaauggaaaaauagguuaaacgcgcuugguaagucagaauuucaaauuuacaagaaguccggcauccaagaaguggauagaacacuagcgaaagaaggcauaaaacgaggcgagaccgaucaccaugccgucucgcgugguucagcaaaacuaagaugguuuguagagagaaaucuaguaacccccgaaggcaaaguaauggaccuugguugugggagagguggauggucauauuauuguggaggucuuaaaaacgucaaagaagugaagggcuugacaaagggagggccaggccaugaagaaccaaucccgaugagcacguacggcuggaaccuugucagauugcagucgggagucgauguauucuuuacuccgcccgagaagugcgauacauuacuuugcgauauaggagaaucuagcccaaacccaacgguugaagcaggaagaacauugaggguauugaaccuaguagaaaacugguuaaacaacaauacccaauucugcaucaagguacuaaacccuuacaugcccucaguaauagagaaaauggaagcucuacagcggaaauacggaggagccuuaguucgcaacccacugagccguaacucuacucacgaaauguacuggguuucaaaugcuaguggcaacauaguaagcucagucaacaugaucucgaggauguugaucaauagauuuacuaugagacauaagaaagcuacuuaugaaccggacguggauuuagguucuggaacgaggaacauagguauagaaagugagacaccuaauuuagacauuauaggcaaaagaauugagaaaauaaaacaagaacacgaaacuagcuggcauuacgaucaagaucauccauauaaaacgugggcauaucaugguucauaugagacgaaacaaaccgggagugccaguaguauggucaauggaguaguacgcuuauugacaaagccaugggauguaauaccaauggugacucagauggcaaugacggacacaaccccauucgggcaacagagaguauuuaaggaaaaagucgauacaagaacucaggaaccaaaagaggggacaaagaaauuaaugaaaauaacagcugaaugguuguggaaagaguuagguaaaaagaaaacacccaggaugugcacuagggaagaguucacaagaaaaguaagguccaacgccgcauuaggugcaauauuuacugacgaaaauaaauggaaaagugcacgcgaagcgguugaagacucaggauucugggagcugguugacaaagaacgaaaccugcauuuagaagggaaaugugagacuugcguguauaauaugaugggaaaacgcgagaagaaauugggagaguuuggaaaagcaaaaggaagccgagcuauuugguauauguggcugggugcuagauuucuagaauuugaagcauugggauuuuuaaacgaggaucacugguuuagucgcgaaaacucuuuauccggggucgaaggcgaagguuuacauaaauuaggcuauauacuucgugaugugagcaagaaagaagggggcgcgauguacgcugaugauacggcaggaugggauacacggauuacguuagaagaucuuaagaaugaggaaauggugacaaaccacauggaaggagaacacaagaaacuagccgaagcaauauucaaacucacauaucagaacaaagucguaagaguccaaaggccaacaccuagaggaacgguaauggauauaauuagucgccgcgaucagcgagguucuggucagguagucacauauggauuaaauacuuuuacuaauauggaggcacaguugauucgacaaauggagggcgaagggguauucaaaaguauccagcaacucacagcgaccgaagaaauagcagucaagaacugguuggccagaguaggacgagagcgucuguccagaauggcaauuucaggugaugacugugucguaaaaccacuggaugauagauucgccuccgcauuaaccgcauuaaaugacaugggcaaaguucguaaagauauccagcaaugggagcccagucggggguggaaugauuggacgcaaguaccauucuguucucaucauuuucaugaacuaaucaugaaagaugguaggguauuaguaguaccaugucgaaaucaagaugaauuaauugguagagcccggauuucacagggagcagguuggagucucagggaaacggccugccucgggaaaucauaugcacaaaugugguccuuaauguauuuccaucgcagagaucuacgauuggccgcaaaugcaaucuguagugcagugccuucacacuggguccccacguccagaacaacguggucaauccacgcuacucaugaauggaugacuacagaagauauguuaacgguguggaacagaguauggauccaagaaaauccuuggauagaagauaaaacaccuguggaaucaugggaagaaauuccauaccuaggaaagcgagaggaucaauggugugguaguuuaaucgguuuaacuagcagggccacuugggcgaagaauauucaaacggcuauaaaccaagucagaaguuuaauaggcaaugaggaauauacugauuacaugccaucaaugaaaagauucagaagagaagaagaggaagcagggguacucugguaa

SEQ ID NO: 22956 - RNA, 9876 nt, Artificial Sequence
  derived and/or modified CDS sequence (opt6) from DENV-2__DQ645552__SS-prME
acggcugguguuauaauaaugaugauuccuacuguaguagccuuccauuuaacuaccagaaacggugaaccgcauaugauuguaagucgacaggaaaaaggaaaaagccucuuguuuaaaacagaaaacggaguaaacauguguaccuuaauggcgauggauuuaggagaguuaugcgaagauaccauaacauauaacugcccguuauuacgucaaaaugaacccgaagacaucgacuguuggugcaacucuacuagcacguggguuacguaugggacuugcacagcuacaggggaacacaggcgagaaaaacggagcguagcgcugguaccacauguggggaugggacucgagacuagaacagaaaccuggaugagcagugaaggagccuggaaacaugcacaaagaaucgaaaccuggguacugcgacauccaggcuuuacaauaauggcagcaauucuggcuuauacaauaggcaccacauacuuccaacguguauuaauuuuuauacuccuaacggcuguggcgccuucgaugacgaugagaugcauagguauaaguaauagagauuuuguagaaggcguaucaggcggaucgugggucgacaucguacuagaacaugguagcugcguuacaacgauggccaaaaacaaaccgacauuagauuuugaauuaauaaaaaccgaagcgaaacacccagcuacucugagaaaauauugcauagaggcaaaacuaacaaacacaaccacagcuucacgcuguccaacgcagggugaacccucauuaaaugaagaacaagauaaacgcuucgucugcaaacacaguaugguggaucgaggauggggcaaugguuguggucuauucgguaaaggagguauuguaacgugcgccauguucacaugcaagaaaaauauggaagguaaaguaguacagccagaaaaucuagaauauacaauagucaucacgccacauucaggcgaagaaaaugcuguuggaaacgauacaggcaaacacggaaaagaaaucaaagucacaccgcaaucaucaauaacugaggcagaacuuacgggguacggcacaguaacaauggaguguucuccuagaacuggucuagacuuuaaugaaaugguauuauuacaaauggaagauaaggcuugguuaguccaccgccaaugguucuuggauuuaccacucccauggcuuccuggcgcagauacucaagguucgaauuggauucaaaaagagacauugguaacguuuaaaaacccucacgcuaagaaacaagacguaguaguauuagggagucaagaaggagcaaugcacacugcccuaacaggggcaacagaaauacagaugucaaguggaaauuuguuguucacgggacaccuuaaauguagacuucgcauggacaaauugcaauuaaaaggaaugucauauucaaugugcacagguaaauuuaaagucguaaaagagauagcagaaacacaacacggaacaauagucauuaggguucaguaugaaggagacgguuccccguguaaaauuccauuugaaauaauggaucuagaaaaacgacacguacuaggccgauugaucacgguaaauccaauaguaacugagaaagauucaccuguaaacauugaagcagaacccccauucggcgauucauacaucauuauaggaguagaacccggucagcuaaaauuaucaugguuuaagaaaggauccuccauuggccaaauguuugaaacaacaaugaggggagccaaaaggauggcgauauuaggagauacagcaugggauuuuggaaguuuggguggaguuuuuacaaguaucgguaaagccuuacaccagguauuuggugcuauuuacggcgcugcuuuuucggguguaaguuggacaaugaaaauccucauugggguaguaauuacuuggauaggaaugaacucacgaagcacaucccucucaguaucgcuuguucuaguugguguugucacauuguaccuuggugucauggugcaggcugacuccggaugcguagucaguuggaaaaacaaagagcucaaauguggaagcgggauauuuauuaccgacaauguacacacuuggacggaacaauauaaauuccagccugaaucuccaaguaaacucgcgucagcuauucagaaagcacaugaagaagguaucugugggauaagaucaguuacgagacucgagaaucucauguggaaacaaaucacucccgaacugaaccacaucuugucugagaaugaaguuaaauugaccaucaugacaggggauauaaaagguauaaugcaggcgggaaaaagaaguuuacguccucagccaacagaauugaaauauucauggaaggcuugggguaaagcaaaaaugcuuucuacagaacuccacaaccacacauuccuuaucgauggaccugaaacagcggaguguccaaacacaaaucgugcauggaauagcuuagaaguagaagauuauggcuuugguguguuuaccacuaauaucuggcuaaaauuaaaagaacgucaagauguauucugcgacaguaaacuaaugucagcggcaaucaaagacaaucgcgccguacacgccgauaugggauauuggauagaaagcgcuuugaacgauaccuggaaaauagagaaagcguccuuuauagaaguaaaaucaugccauuggccaaaaagucacacauuguggagcaauggaguuuuagaaucagaaaugauuauaccgaaaaauuucgccggaccagugucgcaacauaacuauagaccagguuaccauacucagacagcuggucccuggcacuuagguaagcuagaaauggacuucgacuuuugugaaggaacaacggugguggugacugaagacuguggaaaucgaggcccaucacuacgcacaaccacagcgagugggaaauuaauaaccgaaugguguuguagaaguuguacacuaccacccuuacguuauaggggcgaagauggauguugguaugggauggaaaucagaccgcuaaaagagaaagaagaaaaccugguaaauucucuaguaaccgccggacauggucagauagacaacuucucguuaggcgucuuaggaauggcacucuuccuugaagaaaugcuucgcacaagaguuggaacaaaacaugcaauacuccuuguggccguaaguuucguaacuuuaauaacgggaaauaugucauuuagagaucucggcaggguuaugguaaugguaggggcuacgaugacagaugauauugguauggguguaacguaucuagcacuucuggcggcuuucaaaguacgccccaccuucgcagccggacuucuauuacguaagcuaaccaguaaggagcugaugaugacaacaaucggcauaguacuauugagucaaucaacaaucccagaaacaauccuugaacuaacagaugcauuagccuuaggaaugaugguauugaaaaucguuagaaacauggaaaaauaccagcucgccguaacaauaauggccauucuguguguuccaaaugccgugauacuacaaaacgcuuggaaagugaguugcaccauucuugcugucguuucagucucaccauuauugcucacgucuagucaacaaaaagcggauuggauuccccuugcgcucacgauaaaagguuugaauccgacagcuauauuccugacaacacucagucguacguccaagaaacgcaguuggccuuuaaaugaagcaaucauggcagucggaauggugagcauucucgcaaguagccuacucaaaaaugauauaccaaugacaggcccucuaguugccggcgguuuacuaaccgucugcuacguacuuaccggucgaagugcugauuuagaauuagaacgcgcagcggauguuaggugggaggagcaggcagagauuucgggaaguucaccaauauuaucaauaacgauaucugaggaugggucaaugaguaucaaaaaugaagaggaagaacaaacuuuaaccauacucauaagaaccggccuauuaguaauaaguggacuauuuccggugaguauaccaauuacagcagcagcaugguaucuuugggaagucaagaaacaacgcgcagggguucuuugggaugugccaagcccaccgccagugggaaaagcagagcuugaagacggcgcauauagaauaaagcaaaaggggauucuuggguauucacaaauaggagcaggcguauacaaagagggaacuuuucacacaauguggcauguaacgagaggugcaguguuaaugcauaaaggaaaaaggauagaaccgucgugggccgauguuaagaaagaucuaaucagcuauggaggcggcuggaaauuagaaggggaauggaaagaaggagaagaagugcaagugcuugcacuagaaccaggcaaaaacccucgcgcgguucaaacuaaaccaggguuauuuaaaacgaacaccgggaccaucggcgcgguaucucuagauuuuucaccaggaacaucugguucaccuauaguugacaagaaagguaaagucguugguuuguaugguaauggugucguaacucgaucugguacauacgucagcgcuaucgcccaaacugagaaaagcauagaagacaaccccgaaaucgaagaugauauauucaggaagaaacgacuuacgauaauggaccuacauccuggagcggguaaaacgaaaagauacuuaccggcuauagucagagaagcaauaaaaaggggauuaaggacacuuauucuagcccccacaagagugguggcggcugaaauggaggaagcacuuaggggguuaccaaucagauaucagaccccggcaauuagggcagaacauacugggagggaaauaguggaucuuaugugucacgcgacauuuaccaugagacucuuauccccuaucaggguaccuaauuacaauuugauuauuauggacgaagcgcacuuuacugauccggcaaguauagccgcacgaggguauaucaguacccgaguagaaaugggggaggccgcagguauuuuuaugacggcgacacccccagguagccgagauccauuuccccaaucaaaugcuccaauaauggaugaagaacgggaaaucccagaaagaucauggaacagcggccacgaguggguuacggacuuuaaagguaaaacaguuugguuugugccuaguaucaaagcagguaaugauauugcagcaugcuuaagaaagaaugggaaaaagguaauacaauugucacgaaaaacguuugauagugaauacguaaaaacucgaacuaacgauugggauuuuguagucaccacagauauauccgaaaugggagcaaauuuuaaagcggaaagagugauugacccuaggcgaugcaugaaaccaguaauauuaacugacggagaagaacgggucauucuugccgggcccaugccugucacccacagcagcgccgcucaacgcaggggccgagucggaagaaauccgaaaaaugagaaugaucaauauauuuauaugggggagccauuggaaaaugacgaggauugugcacauuggaaagaagcaaagaugcuucuugacaacauaaauacaccagaggguaucauuccaucuauguucgaacccgagcgcgaaaagguagaugcaauagauggagaauauagauuacgaggugaagccagaaaaacauuuguggauuugaugagacgaggagauuuacccguauggcuagcguacagaguagccgcagaagguauaaauuacgcagacagacguugguguuuugaugggguuaaaaauaaccagauauuagaagaaaauguagaaguggaaauauggaccaaggaaggagaaagaaagaaauuaaaaccgagauggcucgaugcuagaauauacucggauccacucgcucuaaaggaauuuaaggaguucgccgcaggccgaaagucuuuaacccuuaaucuuauaacagaaaugggcaggcugccaacguuuaugacucagaaagcaagaaacgcccuugacaacuuagcuguauuacauacggccgaggcugguggaagggcauauaaccacgcccucucagaauuaccagaaacuuuagaaacguuacuauuacuuacgcuauuagcuacuguuacaggagggauuuuucuauuccuaaugagcgguaaagggaucggcaagaugacucuuggaauguguugcauaauaacagcgucaguccugcuaugguaugcacagauacaaccucacuggaucgcugcauccaucaucuuagaguucuuucuuaucguuuuacuaauuccagaaccugaaaaacaaagaacuccacaggacaaucaacucacguauguuguaauugcaauuuugacugugguagcagcaacaauggcgaaugaaaugggcuuccuagagaaaacuaaaaaggacuucggauugggagguaucgccacacaacaaccagaaagcaacauauuagauauagaccuacguccagccagcgcauggacccuguacgcagucgccacuaccuucauaacaccaaugcuaagacauucuauugagaacaguuccguaaauguaucuuuaacugccaucgcaaaucaggcgacuguacuaaugggauugggaaaagguuggcccuuguccaaaauggacauaggcgucccgcuccucgcaauuggauguuauagucaagugaacccaaucacccuaacagccgcccuauuguuacuuguagcucauuacgcaaucauaggaccaggucugcaagcaaaagcgacucgggaagcacaaaaacgggcugcugccggaaucaugaagaauccaacagucgaugguauuacagugauagaucuagauccaaucccauaugacccaaaguuugagaaacaacugggccaagucaugcuucuuguucuaugcguaacucaaguauugaugaugaggacaacaugggcucuuugcgaggcacuaacacuagcuacuggaccaauauccacccuuugggagggaaaccccggcagauucuggaauacuacuauagccgucucaauggcuaacauuuuuaggggaucauacuuagcuggugccggacuucuauucagcaucaugaaaaacacugcuaauacucgacgagggaccggaaauacaggagagacacuuggagagaaauggaaaaaucggcuaaaugcccuggguaagagcgaguuccaaaucuauaagaaaucagggauucaagaagucgauagaacgcuagccaaagaaggaauuaaaaggggcgagacugaucaccacgcuguaagucguggcucagccaaacuaagaugguucguagaaagaaauuuaguaacucccgaaggaaaaguuauggacuuaggguguggacggggcggguggucuuacuauuguggugggcuaaagaacguuaaagaaguaaaaggauuaaccaaagggggacccggacaugaggaaccgauaccuaugagcacguacggcuggaauuuaguuagauuacagagcggaguagacguguucuucacgccuccugaaaaaugugauacacuauuaugugacauuggugagaguuccccuaaccccacuguagaagccgguaggacucuaaggguguuaaaucugguagaaaacugguuaaauaacaacacccaguucuguauaaaagucuuaaacccguauaugccaagcguaauugagaaaauggaggcauuacaacgaaaauacggaggagcucucgugaggaaccccuugucucgcaauaguacucacgaaauguauuggguuaguaaugcuucagguaacauaguuagcucuguuaauaugauuucaaggaugcuuauaaaccguuuuacuaugagacacaagaaggcaacauaugaaccagauguggaucuaggaucugguacgaggaacauaggaauugaaucggaaacacccaaucuugauauuauuggaaaacgaauugagaaaauaaaacaagagcacgagaccucauggcacuaugaccaagaccaccccuauaaaacaugggcauaucacggaucauaugaaacaaagcagaccgguagugcgagcaguaugguuaauggagugguucggcuuuuaacaaaacccugggauguuauuccaaugguuacccaaauggcuaugacagauacaacuccuuuugggcaacagcguguuuucaaagaaaaagucgacacaagaacucaagagccaaaagaagggacuaagaaacucaugaaaauaacggcagaauggcuauggaaagaauuaggcaagaagaaaacucccaggauguguacgcgcgaggaguucacacgcaaggugaggaguaacgcggcgcugggagcuauauuuacugacgagaauaaauggaaaucagcaagagaagcaguggaagauuccggauuuugggaguuggucgauaaagagagaaaccugcaccuggagggaaaaugugaaacuuguguauauaacaugauggguaaacgcgagaagaaauuaggggaauuuggaaaagcaaaggguagcagagcgauaugguauauguggcuaggagcacgguuuuuggaguuugaagcgcugggauuuuugaaugaagaccacugguucucucgggaaaauagcuuauccggaguggaaggugaaggcuuacauaaacuuggauacauauugagagauguuucuaagaaagaaggaggggcaauguacgccgacgacacagccgggugggauacacgaaucacauuagaagauuugaaaaacgaggaaaugguaacuaaccacauggagggugaacauaagaaacuagcagaggcaauuuucaaacuaacuuaucaaaacaaaguuguacggguccaaagaccaaccucgagaggcaccguaauggacauaaucucgaggcgcgaccaaagagguucaggacaaguggugacauacggacuaaacacauuuacuaacauggaggcccaacuuauuagacaaauggaaggagaagguguauuuaaauccauucaacaauugacagccaccgaagagauugcggucaaaaauugguuagcgcgggucggacgugagagauuaucucggauggccaucuccggagaugauuguguuguaaaaccauuagacgacagauucgcuucggcacucaccgcccucaacgacaugggaaaaguucguaaagacauacaacaaugggaaccuucucgaggauggaaugacuggacacagguaccguucuguagucaccauuuccacgaacucauaaugaaagauggaaggguauuaguuguaccaugcagaaaucaagacgaacuuaucgggagggcgcggaucucucagggugccgguuggagucuacgugagacagccugccuaggcaaguccuaugcacaaauguggucgcuuauguacuuccauaggagagaucuucgauuggcagcuaacgcgauuuguagugcugugccaucucauugggugccuacgagcagaacaacguggucaauacacgcuacccaugaauggaugaccacugaggacaugcuuaccguuuggaauagagucuggauacaagaaaauccauggauagaagauaaaacuccuguggaauccugggaagaaauucccuacuugggaaagcgagaagaucaaugguguggcucuuuaauaggauugacaaguagagccaccugggccaagaacauucagacagcaauaaaucaaguccguagccucauaggaaaugaggaauauacagauuacaugcccaguaugaagcgguuucgaagggaagaggaagaggcaggcguauuaugguaa

SEQ ID NO: 22957 - RNA, 9876 nt, Artificial Sequence
  derived and/or modified CDS sequence (opt6) from DENV-2__DQ645553__SS-prME
acggcaggaguuauuaucaugaugauaccuacaguaguugcuuuucaucuuacaacaaggaacggagaaccacauaugaucguaucccgacaagaaaaagguaaaucacuacuauuuaaaacagaaaaugguguuaauauguguacacuaauggcaauggauuuaggggaacugugcgaagauacuauaacguauaacuguccucuuuugagacaaaaugaaccagaagauauagauuguugguguaacagcacuagcacauggguaacauacggaacuuguacugccacaggagaacauaggagggagaaaagguccguugcccuagucccacauguagggaugggccucgaaacaagaacagaaacauggaugagcagcgaaggagcauggaaacaugcccaacgcaucgaaacauggguucuacgucacccgggauuuacaauaauggcagcaauacuugccuacacaaucggaacgacauauuuucagagggugcuuauauucauacuuuuaacugccgucgcuccaucgaugacgaugagauguauuggaaucaguaacagagauuuuguagaagggguaagcggagguagcuggguugacaucguacuagaacauggcagcugugugacaaccauggccaaaaauaaaccuacacuagacuucgagcucaucaaaacugaagcgaaacacccugcaacacuacggaaauacugcauagaggcuaaauuaacuaacaccacuaccgcuucuagauguccuacgcaaggagaacccucuuuaaacgaagaacaagauaaacguuuuguuuguaaacauagcaugguagaccgagguuggggaaaugguugcggucuuuucggaaaaggcggaauuguuacaugcgcaauguucacaugcaagaaaaauauggagggcaaaguuguccagcccgagaacuuagaauacacgauugugauuacaccacauagcggagaagaaaaugcaguaggaaacgacacugggaaacaugguaaagaaauaaaaguuacgccgcaguccuccauaacagaagcugaacuuacugguuacggcacuguuacaauggaguguaguccgcgaacaggacuugauuuuaaugaaaugguuuuauuacaaauggaagauaaagccugguuaguacaucgacaaugguuuuuagaucugccuuugccuuggcuacccggagcagauacccaaggcaguaacuggauucagaaagagacucugguuacauucaaaaacccucaugcgaagaaacaagauguaguaguucuaggaucacaagaaggggcaaugcacacagcauuaaccggagcgaccgaaauccagaugagcucaggcaauuuacuauucacaggccaucugaaaugcagauuaagaauggauaaacuucaauugaaaggaaugagcuauucgauguguacuggaaaauuuaaaguuguaaaagaaaucgccgaaacacaacauggcacuauuguaauaagaguacaauaugaaggggaugguucaccauguaaaauacccuucgaaaucauggaucuggagaaacgccacguccuuggacggcucauaacaguaaacccuauaguaacugaaaaagacaguccagucaauauugaggcugagccacccuuuggagauaguuacauaauaauaggugucgaaccaggacaauugaaacuaucaugguucaagaaagggaguagcauuggucaaauguuugaaacuacgaugagaggugcaaaaagaauggccauacuuggagauacggcaugggauuucggcucacccggaggcgucuuuacgucaaucggcaaagcauugcaucaaguuuucggugcaaucuacggagcggcauuuucaggaguaagcuggacaaugaaaaucuuaauaggaguaguaauaacuuggauaggcaugaacucgcgcucuacaagucuaaguguaucacuuguguugguagguguuguaacccucuauuuagggguaaugguacaagcugauucaggguguguuguuaguuggaaaaauaaagaacuaaagugugguucagggauauuuauaaccgacaacgugcacacuuggacagaacaauacaaauuucaaccggaaucccccaguaaacuagcuagcgcuauacaaaaagcccaugaggaaggcauuugcgggauucgauccguaacuagauuagaaaaucugauguggaaacaaauaacgcccgaauuaaaucauauucuuucagagaaugaggugaaacuaaccauuaugacgggugacauaaaagggauuaugcaagcaggcaagcgaagucuacgaccucaaccuacugaguuaaaauauucauggaaggcguggggaaaagcaaaaauguuaucuacugaauuacauaaucauacauuucuuaucgacgguccugaaacagccgaauguccaaacacaaaccgagcguggaacucacuagaaguagaggauuacggguucgggguauucacaacgaacauaugguugaaacuaaaagagcgacaagauguauucugugauaguaaacuuaugucugccgccauaaaggauaaccgugcaguacaugcugacaugggguacuggauagaaagugcguuaaacgauacguggaaaauagaaaaagccucauuuauagaagugaagucaugccauuggccaaagagucacacauuguggucgaacggaguacucgaaagugaaaugauaauuccgaaaaacuucgcaggaccuguuucccaacacaauuacagaccuggguaucacacgcaaacagcuggacccuggcauuuagguaaauuagaaauggauuucgauuuuugugaaggaaccacaguagucguuacagaagacugugguaauagagggccgucauugagaacaacaacagcaagugggaaacuaaucacugaaugguguugucgaaguuguacgcuuccaccucugcgcuauaggggagaagaugggugcugguaugguauggagaucagaccacuuaaagagaaagaggagaaucuaguuaauagcuuaguaacagcaggucacggacaaauagacaauuucucauuagguguguuaggaauggcacucuuucuagaagaaaugcucaggacaagagucggaacaaaacacgcaauauuauuaguugcgguuucuuucguaacccuaauuacggggaacaugagcuuucgagacuuaggaaggguuaugguuaugguaggagcaacaaugacugaugacauagggaugggcguuacuuauuuagcccuucucgcagcguuuaaaguccgaccaacauuugcugcuggcuuguuacugagaaaacuaacaucuaaagaacuaaugaugaccacuauaggaaucguacuacuaagucaaucaacaauuccugagacgauauuagaacugacagacgcgcuggcguuaggcaugauggugcuuaagauuguaaggaacauggaaaaauaucaguuagcaguaacaauuauggcaauuuuguguguaccuaacgcggugauacuucaaaaugcuuggaaaguaucguguacuauacuggcaguuguuucagugagcccacuacuccuaacaaguucucagcaaaaggcagauuggauaccucuugcacuuacaauuaaaggauugaauccaacagcuaucuuuuuaacgaccuuaagucgcacaucuaagaaacgcaguuggccucucaacgaggcaaucauggcuguuggcauggucuccauccuagcuagcucauuacuaaagaaugauauaccuaugacaggcccucuggucgccggugggcuauuaacuguuuguuacguguuaacgggaagaucagcagaccuagaauuagaaagagcagcugauguccguugggaggagcaggcugagauaucaggaaguucuccaauauugagcauuacaauuucggaagacgguuccaugagcauuaaaaaugaagaagaagaacaaacucuaacaauucucauacgcacaggucuccuaguaauaucgggguuauucccaguaucaauaccaauuacugcggcagcaugguaccucugggaagucaagaaacagcgugcgggugugcugugggauguaccuucaccuccaccaguuggaaaagcggaguuggaggauggagcuuaccguauaaaacagaagggcauucuaggauauucacaaaucggcgcuggaguuuauaaagagggaacauuccacacaauguggcacguaacuagaggugccguauuaaugcacaaaggcaaacgcauagaaccgagcugggcugacgucaagaaagaucuuauaucguauggcggggguuggaaacucgaaggagaauggaaggaaggagaagaaguacaaguuuuagcucuugaaccagguaaaaacccuagagcuguucagacuaagccgggucucuucaaaacaaauacaggaacaaucggggccgucagcuuggacuucucaccuggaacaucuggaaguccgaucguugauaagaaaggaaagguaguagggcuuuacggaaauggaguuguuacucguuccgguacguaugugucugcaaucgcucaaacagaaaaaucgaucgaggacaaccccgaaauugaagaugauaucuuucggaaaaagagacuaaccauaauggauuugcacccgggggcugguaaaacaaaaagauaucuaccagcaauugugcgugaggcaauuaaaaggggacuaagaacacuuauacuggcgccaacuagaguugucgccgcugaaauggaagaagcauuacgugguuugcccauacgauaucagacaccagcaauaagggcagagcauaccgggagagaaauaguagacuuaaugugucaugcaacuuucaccaugagauuguuaucgccaauaaggguuccaaauuacaauuuaauuauaauggacgaagcacacuucacugacccagcgaguauugccgcacgaggauacauuagcacacgcguggaaaugggggaggccgcugggaucuuuaugaccgcuacucccccagguucaagagauccguucccgcaaucgaacgccccgauaauggaugaggaaagagaaauacccgagcguaguuggaauaguggacaugaaugggucacagauuuuaaagggaaaacuguaugguucguaccaucaaucaaagcaggaaacgauauagcagcaugucuacguaagaauggaaagaaaguaauccagcuaucgagaaaaaccuuugauucugaguauguaaaaacgaggaccaaugacugggacuuuguaguuacgacagacauuuccgaaaugggagccaacuucaaagccgaacgaguaauugacccgcggagauguaugaaaccaguuauauuaacagacggagaagaacgaguuauccuggcugguccaaugcccgucacucauaguucggcugcacaaagaaggggaaggguugguagaaaucccaaaaaugaaaacgaucaauauaucuauaugggcgaaccucuagaaaacgaugaagacugugcacauuggaaagaagcaaaaaugcuacuggauaacaucaacacuccggaagguauaauuccgucuauguuugaaccagaacgagaaaaggucgaugccauugauggagaauaccgacuaagaggagaagcuagaaaaacuuucguugauuuaaugagaagaggagaucuaccaguaugguuagcguaucggguugcugcagagggaauuaacuacgcggauagacgauggugcuuugacggugucaagaauaaucaaauauuagaagagaacguggaaguagagauauggacuaaagaaggugaaagaaagaaacugaaacccagguggcuagacgcacgaauauacagugauccacuggcacuaaaagaauuuaaagaauuugcagcagguagaaaaagccuaacgcugaaccugaucacagaaaugggacgccugccuacauuuaugacacaaaaagcccgcaaugcuuuagauaaucuagcaguuuuacacacugcagaggccggcggcagagcauauaaccaugcucuuagcgaacuacccgaaaccuuagagacauuguugcugcucacacuauuggcuacuguaacaggcgguauuuuucuuuuccuaaugagcggaaaagguauugguaaaaugacacuaggcaugugcuguauaauaaccgcauccguccuuuuaugguaugcgcaaauacagccucauuggaucgcagcuaguauaaucuuagaguucuuccuaauuguucuuuuaauccccgaacccgaaaagcaaagaacaccccaagacaaucaacucacauaugucgucauugcaaucuuaacuguuguggcagccacuauggcgaaugaaauggguuuucucgagaaaaccaagaaagauuucggauuaggaggcaucgcaacccagcaaccagaaucuaauaucuuggacauugaucuucgaccagcgucugcguggacucuauacgcgguagcuaccacauuuaucacgccuauguugcggcauuccauagaaaacaguucagucaaugucucauuaacagcaaucgcaaaccaggcaacaguccucaugggcuuagguaaagguuggcccuugagcaagauggauauaggaguucccuugcuugcuauuggauguuauucacagguaaacccuauuacguuaacggcugcauuacuucuccuaguagcucauuacgcaauuaucgguccgggacugcaggcaaaggcgacgcgugaggcgcagaaaagggcagcagccggaaucaugaaaaauccaacggucgacggaauaacagucaucgaucuggaccccauaccauaugacccuaaauucgagaagcagcuaggacagguaauguuauugguauuaugugucacgcaaguucuuaugaugcgaacuacuugggcucucugcgaagcauuaacuuuggcgacaggacccauaucgacauuaugggagggaaauccgggucgcuucuggaacaccacuaucgcuguaagcauggcuaauaucuuccgcgguucuuaucuagcuggagccgggcuacuauuuaguaucaugaagaacaccgcaaacaccagaagagguacuggcaacacuggagaaacauuaggugaaaaguggaaaaaucggcuuaacgcguuaggaaaaucugaauuucaaaucuacaagaaaucugguauucaagaagucgaucguacccuugcaaaggaagggaucaagagaggggaaacggaucaucaugcugugucgagggguucggcaaaguuacguugguucguugaaagaaaucuagucacacccgaagguaaaguaauggacuuaggcugcggucguggcgggugguccuauuauuguggaggccuuaaaaauguaaaggaagucaaaggacuaacaaaaggaggaccaggccaugaggaaccuauaccaaugagcacauauggguggaacuugguacgauuacaaagugggguugacguauucuuuacaccgccagaaaaaugugauacuuugcuaugugacauaggggaaucaaguccuaaucccacgguggaggcgggucgaacguuacgcguauuaaaucuuguagaaaacuggcuaaauaacaauacacaauuuuguauuaaagugcuuaauccuuacaugccuagcguaauugagaaaauggaagccuuacaaagaaaguacggaggugcgcuaguuagaaauccccuuagcagaaauucaacgcaugaaauguacuggguuaguaaugcgaguggaaacauaguuucgucaguuaauaugauaagccgcaugcuaauaaacagguuuacgaugaggcauaagaaagcgacauacgaaccugacguagauuuaggauccgggacacgaaacauaggaauagaaagugagacaccuaaucuagauauuauagguaaacggaucgagaaaaucaaacaagaacacgagacgagcuggcacuaugaucaagaucauccauauaagacuugggcauaucacggauccuaugaaacuaaacaaacugguagugcuaguaguaugguuaacgguguagucagacuccuaaccaaacccugggauguuauaccuaugguuacucaaauggcaaugacugacacgacgccuuuuggacagcagaggguguuuaaggaaaagguggacaccaggacacaagagccaaaagaagguaccaagaaacugaugaagaucacugcugaauggcuuuggaaagaacuggggaagaagaaaacuccuaggauguguacgcgagaagaguucacacguaaagucagaucaaacgccgcuuuaggugcaauauuuacugaugaaaauaaauggaaaagugcacgagaagcuguagaagauagugguuuuugggaacuugucgacaaagaaagaaaccuucaccuagaaggaaagugcgaaacauguguauauaacaugauggguaaacgagagaagaaacuuggugaguuugguaaagcuaaaggcagcagggcaaucugguauaugugguugggggcuagguuuuuagaauuugaagcacuuggguuucuuaaugaggaucauugguuuagccgcgagaacucauuaucuggaguugagggagaaggacuacacaagcuagguuacauauuaagggacguuaguaagaaagaaggaggugcaauguacgcggacgacaccgcuggaugggauacaagaaucacucuagaagaccugaaaaacgaagagauggucacaaaucauauggaaggcgaacauaagaaauuagcggaagcgauauuuaaauuaacguaucaaaacaaagucguuaggguacaaaggccaacaccuagagguacggucauggacaucauaagccggagagaucaacgcggcucgggacaaguaguuaccuaugguuuaaauacuuuuacaaacauggaagcccaacuuauuaggcaaauggaaggcgaaggcguuuucaaaucgauccaacaacucaccgccacggaggaaauagcugucaaaaauuggcucgcuagaguaggaagagagcgccuuucccgaauggcuauauccggugaugacugugugguaaaaccauuagaugaucgauuugcuagcgcgcugaccgcgcuaaacgacaugggaaaagugcguaaggauauacagcaaugggaacccucaagaggcuggaacgauuggacacaagugccauuuugcucacaucauuuucacgaauuaauaaugaaagaugggagaguauuagucguaccgugcaggaaccaggacgaacuaauugguagagcccgaauaagccaaggcgcuggcuggucacuaagagaaaccgcuugccuaggcaaaucauacgcacaaaugugguccuuaauguacuuccauaggagggaucuaaggcucgcggcgaaugcaaucuguagugcggucccgucgcacuggguuccuacgaguagaacgacguggucuauucacgcaacgcaugaguggaugacuacugaagauaugcucgcaguauggaauagaguauggauacaagaaaauccauggaucgaagauaaaacaccuguagaaucuugggaagagauuccguaccuaggcaagcgugaagaucaguggugugggucccuaauaggauuaaccucuagagcaaccugggcuaaaaacauccaaacagcgauuaaccaagugagaucauuaauaggaaaugaggaguauacagauuacaugccgaguaugaaaagguuuaggcgcgaagaagaggaagcaggaguacuaugguaa

SEQ ID NO: 22958 - RNA, 9876 nt, Artificial Sequence
  derived and/or modified CDS sequence (opt6) from DENV-2__DQ645554__SS-prME
acugcugguguaauaaucaugaugauaccaaccguaguagcauuccacuuaacgacucgaaacggagaaccgcauaugaucguaucccgacaagaaaaaggaaaaagccuucuguuuaaaacagaaaacggagugaauauguguacucucauggcaauggaucuuggagaauugugugaagauacaauaaccuauaauuguccauugcuaagacaaaaugaaccagaagacauagacugcugguguaacucgacauccacuuggguuaccuacgguacaugcacagcaacgggugaacaucgacgagaaaaacguaguguugcuuuagucccucauguugguaugggucuggaaacacgaacggaaacguggaugagcucugaaggugcuuggaaacaugcgcaaaggauagaaacauggguguuaagacacccagguuuuaccauaauggccgccauucuagccuauacaauuggaacaacguacuuucaaagaguauuaauauuuauccuuuugacagcuguagccccgaguaugacaaugagauguaucggaauauccaaccgcgacuuuguagaagggguaagcggaggaucauggguugacauaguucuugaacaugguagcuguguaacgaccauggccaaaaacaaaccgacccuagauuuugaacuaauaaaaaccgaagcaaaacaucccgcaacauuaaggaaauauuguauagaggcgaaacuaacaaauacgacgacggcuucaagguguccaacucaaggagagccaucacuuaaugaagaacaagauaaacgauucgucugcaaacauucuaugguggaccgaggguggggcaauggaugcggccuuuucgggaaagggggaauuguaacgugcgcaauguuuaccugcaagaaaaauauggagggcaaagugguacaaccggaaaaucuugaguauacaauuguaauaacuccucacucaggagaggaaaaugcaguagggaacgauaccggcaaacaugguaaagagauaaaagucacaccucagucgucuauaaccgaagccgagcuuacugguuauggaacaguuacuauggaaugcucaccuaggacaggcuuagacuuuaaugaaaugguucuuuugcagauggaagauaaagcauggcucguacauagacaaugguuccuagaucuaccguuaccuuggcuaccuggagcagauacgcaaggcucaaauuggauucagaaggaaacacuugugacuuuuaagaauccccacgcuaagaaacaggacgucgucguauuggguucucaggaaggugcaaugcacacugcucuaacaggcgcaaccgaaauucaaaugucuaguggaaauuuacuuuuuacgggacauuuaaaaugcaggcuaaggauggauaaacuccaguugaaaggaaugucauauucuauguguacaggaaaguuuaaaguaguaaaagagauugcugaaacgcaacacggaacaauuguaauucgagugcaguaugaaggcgacgguucacccugcaagauaccauuugaaauaauggauuuagagaaacgccauguguuagguagauugauaacagucaauccaauuguaacugaaaaagauucgcccgucaacauagaagcagaaccucccuuuggagacagcuauauaaucauagguguugaaccagggcagcuaaaauuaaguugguuuaagaaaggguccaguauugggcagauguuugagacuacaaugagaggagcgaaaagaauggcuauacuaggugacaccgcuugggauuuuggcagcuuagguggaguauucaccucaauugggaaagcauuacaccagguuuuuggagcaauauauggggccgcauucuccggggugucauggacgaugaaaauacuaauaggagucguaauaacuuggauuggcaugaauaguagaagcacuucuuuaucagugagucuaguauuagucgggguaguaacucuuuauuuagguguaaugguccaagcagacagcgggugcguagucuccuggaaaaauaaagaauugaaaugcgguucaggaauauucauaacugacaauguucacacauggacugagcaauacaaauuucaaccugaaucccccucgaaacucgcaagugcgauacaaaaagcacaugaagagggaauaugcgguaucagaagcgucacgcgacuugagaaucuaauguggaagcaaauaacuccugagcugaaucacauucuaucagaaaacgaagugaaacuaacaauuaugacuggagauauaaaggggauuaugcaagcggguaaacggagccuaagaccgcaaccaacugaacuuaaauauucauggaaagccuggggaaaggcuaagauguuaagcacggaacuacacaaucauaccuucuuaauagauggacccgaaacagcagaaugcccgaauaccaacagagcauggaacucucuugaagucgaagauuaugguuucgggguuuucacaacuaauauaugguuaaaguuaaaagagagacaggauguauuuugcgauuccaaacuaaugagugcagcuauuaaggacaacagagcagugcaugcugacaugggcuacuggauagagucugcccuuaaugacacauggaaaaucgagaaagcaucauuuaucgaggucaagucuugucauuggccaaaaucucauacauuguggaguaauggugugcuugaaucagaaaugauaauacccaaaaauuuugcagggccaguaucucaacauaauuaccgcccgggauaucacacacaaaccgcuggucccuggcaucuuggaaaauuggaaauggauuuugauuuuugcgagggaacuacuguuguaguuacagaggauugugguaauagaggaccaucacugcggacaacgacugccagugguaaguuaauaacggaauggugcugccgcaguuguacuuuacccccacuacgguaccguggugaggauggauguugguacgggauggagauccgaccuuugaaagaaaaagaagaaaacuuaguaaacucccucguaacagcgggucauggucagauagacaacuuuucacucgggguauugggaauggcacuauuuuuagaggaaaugcuacgaacgaggguagguacaaagcaugcgauacuauuaguagcaguaaguuuugugacauuaaucacagggaauaugucguuuagagaucugggccgugucaugguuaugguaggugccacaaugaccgaugauauugguauggguguuacauaccuggcgcugcuagcugccuucaaaguacggccaacguucgccgcgggauuauuguuaagaaaacucacaucuaaggaguugaugaugacuacaauuggaaucguacuucucagucagaguacuauuccggaaacaauacuagaacuaacggaugcauuggcuuuagguaugaugguguuaaaaauaguaaggaauauggagaaauaucaacuggccguuacaauaauggccauacuuugcguaccaaaugcaguaauauuacaaaaugcauggaaaguaucauguacaauacuggcaguaguuagcguuaguccgcucuuacucacgucaagccaacaaaaagcagauuggauaccacuagcguuaacaauaaaagggcuuaacccaaccgcuaucuuuuugacuacacuuucgagaacgagcaagaaaagguccuggccacugaaugaagcaaucauggcggucgguauggugucaauacuagcuucuucauugcuuaaaaacgacaucccaaugaccgggccgcuaguagccggaggacuacucacuguguguuacguacuaaccggcaggagcgcggaucuagaacuagaaagagcagccgaugucagaugggaagaacaggcagagauaucagguucaaguccuauauuaaguauuaccaucucugaagacggcaguaugagcauuaaaaacgaagaagaagaacaaacccucacaauucuaauacguacgggauugcuggucauuagcggacuauuuccgguuucuauuccuauuaccgcagcugccugguaccugugggaaguaaagaaacaaagagcugguguacuuugggacgucccaucgccaccgccagucgggaaagcugagcuugaagauggagcauauagaaucaaacaaaagggaauuuuggguuacucacaaauaggugccgguguuuauaaagaaggaacauuccacacaauguggcacguaacgaggggagcugugcucaugcauaagggcaaaagaaucgagccaaguugggcagacgucaagaaggauuuaauaagcuacggaggaggauggaaauuagaaggugaauggaaagaaggugaagaaguccaaguucuagcuuuagaaccuggcaaaaauccuagagcaguacaaacaaaaccaggcuuauucaaaacgaauacgggaaccauaggggcugucuccuuagauuuuuccccggguacgucagguucgccuaucguugauaagaaagguaaaguggucgggcuauacgguaauggggucgucacgaggucaggaacuuacguaucugcuauagcacaaacugaaaaaucaauugaagacaauccagaaaucgaagacgacauauucagaaagaaaagacuaacuaucauggauuugcacccaggcgccgggaaaacgaaaagauaccuaccugcaauugucagggaggcaauaaaaaggggauuaagaacauuaaucuuggcuccgacaagaguuguugcggcagaaauggaggaagcacuacguggacuaccaaucagauaucaaaccccagcuaucagggcagaacacacaggaagagaaauaguggaucuuaugugccacgcgacuuucacuaugcguuuacuaucuccuaucagaguucccaacuacaauuuaauuauaauggaugaagcccacuuuacggacccagccuccauugcggcuagaggauauaucucuacgcgagucgaaaugggcgaagcggcuggaauauuuaugacugcaacaccacccggaagucgugaucccuuuccgcagaguaaugccccgauaauggaugaggaaagggaaauacccgaaagaagcuggaacagugggcaugaaugggugacagacuucaaagguaaaacugugugguuugugccaucuauuaaagcugguaaugacauagcugcgugucuaagaaagaacgguaagaaagugauccagcucaguagaaagacguucgauuccgaauauguaaaaacuagaacaaaugacugggauuucgucguuacaacagauauaucugaaaugggugcuaacuuuaaagcugaacgugucauugacccgagacgguguaugaagccagugauacugacugacggugaagagagagucauccuggccggucccaugcccguuacacacuccagcgcggcacaaaggagggggcgaguaggaagaaaccccaaaaaugaaaacgaccaguauauauauaugggugaaccguuagaaaacgacgaagauugugcccauuggaaagaagccaaaaugcuuuuagauaauauaaacacaccggaagguauaauaccaaguauguuugagccugaacgagaaaagguagaugccaucgacggugaauacaggcuaagaggugaagcccgaaaaaccuuuguagaucuaaugagacgcggugaucuucccguauggcucgcuuaucgcguagcagcagaagggauaaacuacgcugaccgucgguggugcuuugauggagucaaaaauaaucaaaucuuagaagagaauguagaagucgaaauuuggacaaaagaaggagaaaggaagaaauugaaaccccguuggcuggaugcgcgaauauacucggauccucuagcguuaaaagaauuuaaagaauuugcggcuggacggaaaucguuaacacucaaccugauaacagaaaugggcagauuacccacauucaugacccaaaaagcacggaacgcauuagauaaccuagcaguccugcacacagcugaagcuggaggcagagcauacaaccaugcauuaagcgaacuaccagaaaccuuggagacguuacuauuacuaacguuacuugcaacggugaccgggggcaucuuccuauuucuaaugagcggaaaaggaauagggaaaaugaccuuaggaaugugcuguauaaucacagcuagugucuugcugugguacgcacaaauacaaccgcacuggaucgcagcaucaauaauauuggaguucuuccuaauuguccugcuaauccccgaaccagaaaagcagcggacaccacaagacaaccagcugacuuaugucguaauagcaauauuaacaguaguagccgccacuauggcuaaugaaaugggguuucuagagaaaacuaagaaagacuuuggacuagggggaaucgcaacacaacaacccgaaucaaauaucuuagacauagacuuacguccugcuuccgcauggacccuuuacgccguugcaacuacuuucauuacuccuauguuaaggcacuccauugaaaauucguccguaaacguuucccucacagcuauugcaaaucaggcuacuguuuuaauggggcuggggaaaggauggccauugucaaaaauggacaucggaguaccucuauuagcuaucgggugcuauagccaaguaaaucccaucacgcucacagcggccuuguugcuccucguugcucauuacgcaauuauuggaccuggcuuacaggcuaaagcaacacgagaagcucaaaaacgagccgcagcuggaaucaugaaaaaccccacgguagacgguauaaccguuauagaucuagauccaaucccauaugacccaaaauuugaaaaacaguuaggccagguaaugcuauuaguacuaugcgucacacaaguuuuaaugaugcgaacuaccugggcauugugugaagcauuaacgcuugcaacaggaccaauaucaaccuuaugggaaggcaaucccgguagguuuuggaacaccacaauagcagugaguauggcaaauaucuuuagagggagcuaccucgcaggagcgggauuauuauuuagcauuaugaaaaacacagccaacacaagaagaggaaccggcaauacuggagaaacacugggugaaaaauggaagaacagacucaacgcguuagguaagucugaguuccaaauauauaagaaaucagguauucaagaaguagacagaacacucgccaaggagggaaucaagcggggagagaccgaccaucacgcggucagccgugguucagcuaaguuacgaugguucguugaacguaauuuagugacaccagaggguaaagucauggaccugggaugugguagaggggguuggagcuacuacugcggcggacucaaaaauguuaaagaagucaaaggguugacaaaaggagguccugggcacgaagaaccaauuccuaugagcacuuauggguggaaccugguuagauuacaaagugguguagacguauucuuuacgccgccagaaaaaugugauacucuacugugcgacauaggagaaucauccccaaaccccacaguagaagcaggaagaacgcuuagaguucuaaacuuaguugagaacugguuaaacaacaacacccaauuuugcaucaaaguucucaacccguauaugccgucuguaauugaaaagauggaagcacuccaaagaaaauacgggggugcacugguaagaaacccuuuguccagaaauaguacucaugagauguauuggguaagcaacgcaucugguaacauaguaucuuccgucaauaugauaucacgaauguugauaaaucgguucacuaugaggcauaagaaggcaaccuaugaaccggauguggaucuaggcagcggcacaagaaacaucggaaucgaauccgaaacgccaaauuuagacauaauagguaaaaggauagagaaaauuaaacaagaacaugagacgucuuggcauuacgaccaagaccacccuuacaaaacuugggcauaucacggauccuacgagacaaaacaaacaggaagugccagcagcaugguaaacggcguuguucgauuauuaacaaaaccgugggauguuauuccgaugguaacucagauggcuaugacggauaccaccccauuuggucaacaacguguguucaaagagaaaguggacacacguacacaagaaccaaaggaaggaacgaagaaguuaaugaaaauaacagcagaaugguuguggaaagaacuaggaaagaagaaaacgccaagaauguguacacgugaagaauuuacaagaaaagugcgcagcaacgcagcguuaggggcuauuuuuaccgaugaaaacaaauggaagucagcaagagaggcaguggaagauucgggguuuugggaacuuguagacaaagaaagaaauuuacauuuagaaggaaagugugaaacauguguauacaauaugaugggaaaaagggagaagaaacucggagaauuuggaaaagcaaaagguucgagagcaauuugguauaugugguuaggugcccgguuucuagaauuugaggccuugggauuucuaaaugaggaucacugguuuucucgcgaaaacagccugucagguguugaaggagaaggacuacacaaauuaggauauauacuccgggaugugaguaaaaaggaaggcggagcaauguaugcugacgauacagcggguugggacaccagaaucacuuuagaagaucugaaaaacgaggaaauggugacuaaucauauggaaggagaacauaagaaauuagccgaggcaauuuuuaaguuaacauaccagaauaaaguaguaagaguacaaagacccaccccacgaggaacaguaauggacauaaucucuagaagagaccagagaggaaguggacaaguaguuacuuaugguuugaacacguucacaaacauggaggcucaacuaauccggcaaauggagggagaaggaguauucaaaagcauacaacaauuaacagccacagaagaaauugcaguaaagaacuggcuggcuagaguuggucgugagcggcuaucaaggauggcgauuagcggagaugauugcgugguaaaaccacucgaugauagguucgccucggccuuaacagcgcucaaugacaugggcaaaauuagaaaggauauacagcaaugggaaccuucuagaggcuggaaugacuggacccaaguaccauuuugcucgcaccacuuccaugaauuaauuaugaaagauggccggguucuagucguucccugucgcaaccaagacgaauuaauuggaagggcacgaauuagucaaggugcuggauggucauuaagagaaacugcuuguuuagguaagagcuaugcacaaauguggaguuuaauguauuuucacagaagggacuugagguuggcugcaaaugcaauaugcagcgcaguaccuagucauuggguuccuacgucgcgaaccacauggaguauucacgcgacucaugaauggaugacaacugaagauaugcuaaccguauggaauagggucuggauccaagagaauccguggauagaagacaaaacaccgguggaaagcugggaagaaauaccuuauuuggggaaacgagaggaucaaugguguggcagucuaauugggcuaacaagccgagcaacuugggcuaaaaauauucaaacugccaucaaucaaguuaggaguuuaauagggaaugaagaauauacggauuauaugccuucgaugaaaagauucagaagggaagaagaggaagcggguguauuaugguaa

SEQ ID NO: 22959 - RNA, 9876 nt, Artificial Sequence
  derived and/or modified CDS sequence (opt6) from DENV-2__DQ645555__SS-prME
acagcuggugucaucauaaugaugauuccaacagucguagcguuucauuuaaccacacguaacggagaaccacauaugauuguaaguaggcaagaaaagggcaaaucauugcuauuuaaaacagaaaaugguguuaacaugugcacguuaauggccauggaccugggggaacuaugugaagauacaauaaccuacaauuguccccuucugcgucaaaaugaaccugaagacauugacugcuggugcaauaguacauccacgugggucacauauggaacauguacggccacuggagaacaccggagagagaagcggagcguugcauuaguuccccauguggguauggguuuggaaacaagaacagaaacguggaugagcucacagggggcauggaaacaugcccaaagaauugagacguggguacuucgccauccgggcuucacgauaauggcagcgauacuugcauacacuauagguacaacuuacuuucagaggguauugauauucauccuccucaccgcaguagcaccaagcaugacgaugagguguauuggaauuuccaauagagauuuuguggaggggguaucgggaggaagcugggucgauaucguacuagaacacgguucuugcgucacgaccauggcgaaaaauaaaccaacuuuagacuuugaauuaauaaaaacagaggcuaaacacccggcuaccuuaagaaaguacuguauugaagcuaaauugaccaauacaacaacugcaagucgaugcccaacgcaaggugaaccuucacuuaacgaagaacaagauaaaagauuuguuugcaagcacaguauggucgaucgcggauggggaaacggauguggauuguuugggaaagggggaauagugacuugcgcaauguuuacaugcaaaaaaaauauggaaggaaaaguuguacaaccagaaaauuuggaauacacuauaguaaucaccccccauaguggcgaagaaaacgcugucggaaaugacacaggaaaacauggaaaagagauaaaaguuacaccgcaaucgaguauaacagaagcagaguugacaggguacggaacgguuacaauggaauguagcccgcguacuggauuagacuuuaaugaaaugguauuacuacaaauggaagauaaggccuggcugguacauagacaaugguuucuagacuugcccuuaccuuggcuaccaggugcagacacacaaggaagcaacuggauccaaaaagaaacuuuaguuacguucaaaaacccacaugccaaaaaacaagauguugugguguuagggagucaagagggugcuaugcacacugcauuaacaggcgcuacagagauucaaaugucaagcggaaacuugcuuuuuaccgggcauuuaaaaugccggcuaagaauggacaaauuacagcugaaaggaaugaguuacagcauguguacugguaaguuuaaagucguaaaggaaauagcugagacacaacacgggacuauuguuaucaggguccaauacgaaggggauggaucaccaugcaagaucccauuugaaauaauggauuuggaaaagcgacacgugcucggucgacugauaacagucaacccaauaguuacugagaaagacaguccuguuaauaucgaagcagagccaccauucggagauucuuauaucauaaucggcguagaaccuggccaauuaaagcucucgugguuuaaaaaagggagcucgauuggacaaauguucgaaacuacuaugcggggugcaaaacggauggcaauccuuggagacacagcgugggauuucgggagccuaggaggcguauucacaaguaucggaaaggcauugcaucaaguauuuggggcuauauauggggcggcguuuucaggggucucuuggacaaugaaaauacucauaggaguuguaauuacauggaucgguaugaacucacgauccaccagucuuucgguuucccuuguauugguaggaguagucaccuuguaucuggguguaaugguacaggcagacucagguuguguuguaucauggaagaacaaagaguuaaaguguggaucugguauuuucauuacugauaauguacauacguggacagaacaguauaaauuucagccagaaucaccgagcaaacuggcaagugcaauacaaaaagcucaugaagaagggauaugugggaucaggucugugacaagguuggaaaacuuaauguggaaacaaaucacuccagaacuaaaucauaucuuaagugaaaaugagguuaaacugacaauuaugacaggggacaucaagggaauuaugcaggcgggcaagagaaguuuaagaccccaaccaaccgaacuaaaauacuccuggaaagcuuggggaaaagcaaagaugcuuaguaccgaacuccauaaccacacauuuuuaauagacgggccagaaaccgcggaaugccccaauacaaacagagcguggaauaguuuagaaguagaggacuacggcuuuggcguuuuuacuacaaauauuuggcuaaagcuaaaagaacgacaagaugucuuuugugauuccaaauuaaugagcgcggcaauaaaagauaaucgugcaguucaugcugacaugggauacuggauagaaagcgcgcuuaacgauaccuggaaaauagaaaaagcaagcuuuauagagguaaaaucaugucauuggccaaaaagccacacguuauggagcaauggcgugcucgagucagaaaugaucauaccgaaaaauuucgcaggccccgugagucaacauaauuaucgaccaggcuaccacacucaaacugccggaccauggcacuugggaaaauuagaaauggauuucgacuucugugaaggaaccacggugguagucacagaagauugcgguaaucggggaccgucuuugaggacuacaacugcgagcgguaaacuaauaacagaauggugcuguagaaguuguacuuuaccaccguuacguuauagaggggaagacgggugcugguauggaauggagauccguccguugaaggagaaggaagaaaauuuaguaaauucuuuagucaccgccgggcauggucagauagauaauuuuucucuaggagugcuaggaauggcacucuuucuugaagaaaugcuuaggacucgaguaggaacuaaacaugcuauauuguugguugcuguuucguuuguaacacucauuacagguaacaugucauucagagaucuaggccgcgugaugguaauggucggagcaacuaugacagaugacauaggaaugggagucacguauuuagcgcuccuggcagcguuuaaagugcggcccacguuugcugccggacuucuacuucgaaaauuaacuuccaaagaauugaugaugacaacaauugguauaguguuacuaucccaaucgacaauuccggaaacuauuuuagaacuuacugaugcgcucgcccuagggaugaugguucuuaaaauugugcgcaauauggaaaaauaccaacuagcaguuaccauaauggcaauuuuauguguuccuaacgcgguuauacuacaaaacgcauggaaaguuucauguacaauuuuagcgguuguaaguguuagcccucuacugcugacuucaucacaacagaaagcagacuggauaccacuagcacuaacaauaaaaggauuaaauccgaccgcaaucuucuuaacuacccugagucgcacuaguaagaagagaagcuggccuuuaaacgaagccaucauggcgguagguaugguaaguaucuuggcauccucauuacuaaaaaaugauauuccuaugaccgguccauuaguagcgggagggcugcuuacgguuuguuacgugcuuaccggacguucggcggaucuggaauuggaaagagcggcagauguucguugggaagaacaggcagagauaucuggaaguagcccaauucugagcauaacaauuagugaagaugggagcaugucgauaaagaaugaggaagaggaacaaacuuuaacaauucuaauuaggacuggacuucuaguaauaaguggacuguucccaguaucaauucccauuacugccgcagcgugguauuuaugggaaguaaaaaaacaacgggccgguguguugugggacguucccaguccgccgcccguagguaaggcagaauuggaagacggugcauauaggauaaaacaaaaaggaauauuaggguacucacaaauaggcgcaggagucuacaaggaagguacuuuccauacgauguggcauguuacccgaggugcuguccuaaugcauaaaggaaaaaggauagaaccuucaugggcagaugucaaaaaagacuuaauaucuuauggaggcggauggaaacuagaaggugaauggaaagaaggugaagaaguccaagucuuggcauuagaaccaggcaagaauccaagagcagugcaaacuaagccugguuuauucaaaacuaauacagggacuauuggcgcuguuucauuagauuucaguccagggacaagugguucacccaucguagauaaaaaaggaaaaguaguaggauuauacggaaacggaguagucacgcguucugguaccuaugucucagccauagcucagaccgaaaagucaauugaggauaauccugaaauagaagaugacauauuucgcaaaaaaagauuaacuaucauggacuuacacccaggggcggguaaaacuaaaagauaucuuccagcaauugugcgcgaggcaaucaaaagaggacuaaggacucuuaucuuagccccgaccaggguagucgcggcagagauggaagaagcacugcgcgguuuaccaaucagauaccaaacacccgcgauaagagcugaacacacuggaagagaaauaguagaccuuaugugucacgcuacuuuuaccaugcggcuccuaucgccuauucguguaccuaauuauaaccuaauaaucauggaugaagcgcauuuuacugauccugccucuauugcagcaaggggauacauaucaacucgcguagagaugggugaagcagcugguauuuucaugacugcgacaccuccugguucuagggacccauuuccucaauccaaugccccuauaauggaugaagaaagggaaaucccagaaagauccuggaauucgggucaugaaugggucacugauuuuaaaggcaagacuguaugguuuguaccaucaaucaaagccgggaaugauauagcagccuguuugagaaaaaauggcaagaaagucauccaauugagucgaaaaacauuugauagcgaauauguaaaaacaagaacaaaugacugggacuucguaguaacuacagauauuagugaaaugggagccaacuucaaagccgaacggguuaucgacccccgcagauguaugaagccagugauacuuacagauggagaagaaagagucauccuggcuggaccaaugccagugacucauagcucggcagcucaaaggcgcggaagaguaggaagaaacccaaagaaugaaaaugaucaauacaucuauaugggugaaccucucgaaaacgaugaagauugcgcgcauuggaaagaagcuaaaauguugcucgacaacauaaauacccccgaagguauaauaccaagcauguuugagccggagagggaaaaaguugacgcgauagacggggaauaccggcuacgaggcgaagcaagaaaaacauucguggauuugaugcggcgaggagacuuaccagucugguuagccuauagaguagcugcugaaggaauaaacuaugcugauagaagauggugcuuugacggaguuaaaaacaaucagauucuugaagaaaauguugaaguugagauauggacaaaggaaggcgaaagaaaaaaguuaaaaccgaggugguuggacgcucgaaucuacucagauccacucgcccugaaagaauuuaaagaauuugcagcuggcaggaaaaguuuaacucuaaacuugauaacggaaauggguagacucccaacuuucaugacccaaaaggcaagaaaugcacuagauaaccuagcaguauugcacacagcggaagccggaggacgagccuauaaucaugcccugucagaguuaccagaaacacucgagacacuacuccuguuaacccugcuagcaacugugaccggcgggaucuucuuguuuuuaaugucaggaaaagggauaggaaaaaugacguuaggcauguguuguauaauaacugcaaguguuuuauugugguaugcgcaaauucaaccacacuggaucgcagccuccauaauuuuagaguuuuuuuugauuguacuucuaauaccagaaccagaaaaacagaggacgccucaagacaaucaacugacauauguggucauagcuauacucacaguggucgcugcaacuauggccaaugaaauggguuuccuagaaaaaacuaaaaaagauuuuggacuuggugggauugccacgcaacaaccugaaucgaauauauuagauauagaccuacggccugccagugcuuggacguuguacgcgguugccacgacauuuauuacgcccauguuacggcacucuaucgagaauaguaguguaaacgucucuuuaacugccaucgcgaaucaagcgacaguccuaauggggcuugggaaagguuggcccuugaguaaaauggauaucggagucccauugcuagcuaucggaugcuacucccaaguuaauccgauaacccuaacagcggcacuguuauuacucgucgcacacuacgcaauaauaggucccggucuucaagccaaggcgacacgugaggcgcaaaagcgggcugcagcugggauaaugaaaaauccuacaguagacgguauuacgguuaucgauuuggauccuauuccguaugaccccaaauuugagaagcaacuaggacaaguaaugcuauuaguacuuugcguaacucagguuuuaaugaugcguaccacaugggcucuuugugaagcgcuuacucucgccacagggccaauuucuacacucugggaaggcaacccggggcgguuuuggaauacaacaauugcagucucuauggcuaacauauuuagaggaucauaccuagcaggggcgggguuauuauuuaguauuaugaaaaacacagccaauacuaggaggggaacaggaaacacaggugaaaccuuaggagaaaaauggaagaaccggcuaaacgcauuggggaagagugaauuccaaaucuauaaaaaaucaggaauccaagaagucgauaggacucuagcgaaagaaggaauuaagcgaggagaaacagaccaucacgcagucuccagagguagugccaaauuaagaugguucguggaaaggaaucuagugacacccgaaggaaaagugauggaucuuggguguggcagaggaggauggucuuauuacugcgggggccucaaaaauguaaaagaaguuaagggauugacgaaaggcgguccugggcaugaagaaccaauccccaugaguacauauggguggaacuuaguacgccugcagagugguguagauguguucuucacucccccagagaaaugugauacuuugcuuugugauauaggagaauccucaccaaacccgacaguugaagcagggagaacauuacgaguauugaaccuaguggaaaauuggcuaaauaacaacacccaauuuuguauuaagguucuaaacccguauaugccaaguguuauagaaaagauggaagcucuacaaaggaaauauggcggugcucuagucagaaacccccucucaagaaacucuacccaugaaauguacugggugucuaacgcaucagggaauauuguaucuuccguuaacaugauuagucgaaugcuaaucaacagguucacgaugaggcauaaaaaagcuacauaugaaccugacguugaucuagggaguggcacucgaaauauaggcauagagucagaaacaccuaauuuagauauaauaggcaaacgaauagaaaaaauuaaacaagaacacgaaacuucauggcacuaugaucaggaccacccauauaaaacuugggcauaucacggaagcuaugaaacaaagcaaacuggcucggcgucaucaaugguaaauggagugguuagguugcuaacuaaaccuugggaugugauaccaauggugacacaaauggcaaugacugauacuacacccuuuggucaacaacggguauucaaggaaaaaguagacacgcgcacacaggaaccaaaagaaggaaccaaaaaguuaaugaagauaacugcagaguggcucuggaaagaacugggaaaaaaaaaaacuccacgcauguguacaagagaagaauucacuagaaagguacgaaguaaugcugcuuuaggagccauauucacugaugaaaauaaauggaaaagcgcgcgagaagcugucgaggauaguggauuuugggagcuaguugauaaagaacgaaaucuccaucuagaaggaaaaugcgagacaugcguuuauaauaugaugggcaaaagagagaagaaacuaggcgaguuugguaaagccaaaggcucaagagccauuugguauauguggcuaggagcgcguuuucuagaauuugaggcauuagguuuucuaaaugaggaucauugguucucuagagaaaauagcuuaucggguguagaaggagaaggguuacacaagcuuggauacauuuugagagaugucuccaagaaggaagguggcgcuauguacgcagacgauacugcggguugggacacacgaauaacguuagaggauuuaaaaaaugaagaaaugguaacuaaccauauggaaggagaacacaaaaaacuagcagaagcgaucuuuaaauuaacauaucagaacaaaguuguaaggguacaacgacccacaccaagagguacaguuauggacauaauaagccgaagagaucaaagaggcuccggucaagugguaacauacggacuaaauacauucacaaacauggaggcgcaacuaauuagacagauggaaggggaggguguguuuaaaagcauacaacaacuaacggcuacugaagaaaucgcuguuaaaaauugguuggcgagaguugggagagagaggcuuucgagaauggcgauaaguggagaugauuguguaguaaagccucuagaugaccgauuugcuucagcuuuaacagcacuuaaugacauggggaagguaaggaaagauauacaacagugggaaccuucaagagguuggaacgacuggacacaagugccauuuuguucacaccauuuccacgaauuaauuaugaaggacggacguguccuaguaguuccauguagaaaucaagacgaacuaauagguagggcaagaauuagucaaggagcgggauggagucuacgagagaccgcaugucuaggaaaaaguuacgcucaaauguggaguuugauguauuuccauagaagggaucuaagacuagcagcaaaugcaauauguagugccguuccgagucacugggugccaacaucuaggacaacauggaguauccacgccacgcaugaguggaugacgacggaagauaugcuaacuguuuggaauagaguuuggauccaagagaauccauggaucgaagauaaaacaccaguagaaucaugggaagaaauaccauaucuuggaaaacgugaagaucaauggugcgggucacuuauuggguuaacgagccgagcaacaugggccaagaacauccaaacggcaauuaaucaaguaagaucacuuauaggaaacgaagaauauacagauuacaugccuucgaugaaaagguucagacgagaagaagaggaagcaggaguucuuugguag

SEQ ID NO: 22960 - RNA, 9876 nt, Artificial Sequence
  derived and/or modified CDS sequence (opt6) from DENV-2__DQ645556__SS-prME
acagcuggggugauaauuaugaugauacccaccgucguggcuuuucacuuaacaacacgaaacggagaaccgcacaugauaguaagccgacaagaaaaaggaaaaaguuuacuuuuuaaaacggaaaauggaguuaauauguguacuuuaauggcuauggaucuuggagaauuaugcgaagauaccauuacauauaauugcccacuacuaaggcaaaaugaaccagaagacauagauugcugguguaauagcacgagcacauggguaaccuacggaacuuguacagcaacaggugaacauagacgggagaaaaggaguguagcucuggugccgcaugucgguaugggauuagaaacgagaacugaaacauggaugaguucugaaggagcauggaaacaugcacaaagaauugaaacauggguucuucgucauccaggauuuacgauaauggcugcaaucuuggcauauacuauuggaacaacauauuuucaaagaguauugaucuucauacugcuuacagcuguugcaccgagcaugacgaugagauguauagguauuucuaaccgugauuucguggaaggugugucaggaggaagcugggucgacauuguccuggaacacgguucaugcguaacaacaauggccaaaaauaaacccacucuugacuucgaauugauaaaaacagaagccaaacauccugcuacacuucguaaauacuguaucgaagcaaaacugaccaacaccacaacugcgaguaggugcccaacgcaaggagaaccuucacuaaaugaagaacaagacaaacguuuuguaugcaaacauucuauggucgauagaggauggggaaacgggugugguuuauucggaaaagggggaauaguaaccugugcgauguuuacuugcaagaaaaauauggaaggaaaaguaguccaaccugaaaauuuggaauauacaauuguaaucacaccacacucaggagaagaaaaugcaguugggaaugauacagggaaacauggcaaagaaaucaaagucacuccucaaaguaguauaacugaagcagaauuaacaggcuauggaacaguaaccauggaauguucaccaagaacaggcuuagauuucaacgaaauggugcugcuccaaauggaagauaaagcauggcuaguacacagacaaugguucuuggaucucccauuaccaugguuaccaggagcagauacucaggggucuaauuggauccaaaaagaaacauuaguaacauuuaaaaauccccacgccaagaaacaagauguggucguucuuggaucgcaagaaggagcaaugcacacagcacuaacuggugcgacugaaauacagaugaguucaggcaaucuucuuuucacgggucauuuaaaauguagauuaagaauggauaaacuucagcuaaaagggaugucuuauucaaugugcacggguaaauucaaaguaguuaaagaaauagcagaaacacaacaugguacuauuguuauacgaguccaauaugaaggugacggcagcccaugcaaaaucccauuugaaauuauggaccuugagaaacggcauguacugggaagauuaaucacaguuaacccuauaguuacugaaaaagauucuccaguaaauauagaagccgaaccuccauuuggggacagcuauauuauaauaggaguagaaccgggacaauuaaaauugucaugguucaagaaaggaucuucuauuggccagauguuugagacaacuaugcgaggcgcaaaacgaauggcaauacugggagauaccgcuugggauuucgguagucuagggggaguauucacuucaauaggaaaggcuuuacaccaagucuuuggugcuaucuauggagcugcuuuuagcggagugucuuggacuaugaaaauucuaauaggagucguaauaaccuggauaggaaugaacagcaggucaacaagucugagugugagcuuaguucuuguuggcguagucacauuauauuugggaguaaugguacaggcggacagcggcuguguuguuucuuggaaaaacaaagaauuaaaaugcggcaguggaauauuuauaacagacaacguacauacguggacagaacaguauaaguuccagcccgaaaguccaucuaaauuagcuucagcaauacaaaaggcccaugaagaaggaauaugcggcauuaggucuguaacacggcuagaaaaucuuauguggaaacaaaucacacccgaacuaaaucauauccuaagcgagaacgaagucaaacuaacaauaaugacaggugauaucaaggguauuaugcaagcaggaaagagaucacuuagaccacaaccaacggaacuuaaguacaguuggaaagcaugggguaaagcaaaaaugcugucuacggaacuacacaaucacacauuccuuaucgacggucccgaaacugccgaguguccuaauacuaaucgugcuuggaacucccuugaaguugaggacuauggcuuuggaguauucacgaccaacauaugguuaaaacuaaaagaaagacaagauguauuuugugauucuaaacuuaugagcgcggcaauaaaagauaauagagcgguacaugccgauaugggauacuggauugagagcgcguuaaacgauacauggaagauagagaaagcaucauuuaucgaaguuaagaguugucauuggccaaaaucacacacgcuauggucuaauggaguacuagaauccgaaaugauuauuccaaagaauuuugcaggaccagucucccaacacaauuaucgaccuggauaucacacccaaacugccgguccuuggcaucuaggaaaauuagaaauggauuuugauuuuugugaaggaacaacugugguaguuaccgaagauugugggaauagggggccuucccuaaggacuacgaccgcaucaggaaaauuaauuacugagugguguugccgcagcuguaccuuaccuccacucagauacagaggggaagauggaugcugguauggaauggagauaaggccauugaaagaaaaagaagaaaaucucguaaauucgcuagucacagcaggacauggacaaauugacaacuuuucacuuggcguuuuagggauggcauuauuuuuagaagagaugcuuaggacucguguagguacgaaacaugcuauucuguugguagcagugaguuucgucacgcuaauuacagggaacaugagcuuuagagaucuaggucguguaaugguuaugguaggagcaacuaugacagaugacauugguauggguguaacguaucucgcccuacuggcagcauuuaaagucaggccaacauuugcugcugguuuguugcuaagaaaacugaccagcaaagaacuaaugaugacgacaauagguaucguucuacuuucucagaguaccauacccgaaacaauacuagaacugacggaugccuuggcccucggaaugaugguccucaaaauagugagaaauauggaaaaauaucagcuagcgguuacaauaauggcaaucuuguguguaccgaaugcugucauauuacaaaacgcuuggaagguaaguuguacgauccucgcuguuguuucgguaucaccauuguuacugacaaguucgcagcaaaaagcugacuggaucccuuuagccuuaacuauaaaagggcuuaauccaacugcuauauucuugacgacacuuagcagaacuagcaaaaagcgauccuggccgcuaaaugaggcaauaauggcaguaggcauggucuccauccucgcaucaucguuacugaaaaacgauauaccaaugacuggacccuuaguagcgggagggcucuuaacaguauguuauguccuuacaggcagaagugcugaucuagaacuggagcgagcagcagauguccgaugggaggaacaagcugaaaucucuggguccucuccuauauuaucaaucacuauaucagaggaugggaguaugucaaucaaaaaugaagaagaagaacaaacacuuaccauuuugauuagaacuggccucuuggucaucuccggauuauuucccgucuccaucccuauuacagcugcagcaugguauuuaugggaggucaagaaacaacgcgccggaguauugugggacguaccuagcccaccacccgucggaaaagcggaauuagaagacggcgcguacagaaucaaacaaaagggaauuuugggguauucucagauaggugcuggaguauauaaagaaggcacauuccauacuauguggcauguuacaagaggcgcuguacucaugcauaaaggaaagagaauagaaccuucuugggccgaugucaagaaagaucuaauaagcuauggaggaggauggaaauuagaaggagaauggaaagaaggugaagaaguucaaguucuagcacuugaaccagguaagaacccucgggcaguacaaacuaaaccaggauuauuuaagacuaacacuggaacuaucggagcaguuucccuagacuucucuccugguacuucgggcucuccaaucgucgauaaaaaggggaaggucguuggcuuauaugggaacggaguagucacuaggucaggaacguauguaagugcuauagcucaaacggagaaaaguaucgaagauaauccggaaauagaagaugauauauuuagaaagaaacgacucacaauaauggauuuacauccaggagcgggcaaaaccaagagauaccuaccugcgauaguuagagaggcuaucaaaaggggucuaagaacgcuuauacuggcaccuacaagaguugucgcggcugaaauggaagaggcuuugcgcggcuuaccgauuagguaccaaacgccagcaauaagagcugagcauacagggcgugaaaucguagacuuaaugugucacgcaacauuuacgaugagacuacuuucaccgauacguguacccaauuauaauuuaauuauaauggacgaagcucacuucacugauccagcguccaucgccgcccgaggauacauuagcacacguguagaaaugggggaagcagcugguauauuuaugacggcuacgccuccagggucucgagacccguuuccgcaaucaaacgcuccaauuauggacgaagaacgugaaauaccggaacguaguuggaacucuggacaugaauggguuacugauuucaaaggaaagacggucugguuuguuccaucaauaaaggccgguaaugauauagcggccuguuuacggaaaaauggcaagaaaguuauacaacuaucucgaaaaacguucgacucggaauauguaaaaacacgcacuaaugauugggacuuuguaguuaccacagacaucagugaaaugggugccaauuuuaaagcugaaaggguaauagacccacgcagauguaugaaaccaguaauucuaacagacggagaggagagaguaauuuuagcagguccaaugccuguaacacacucgucagcugcacagagaaggggaagagucggacguaaucccaaaaaugaaaacgaucaauauauauauaugggagaaccacuggagaaugacgaagauugugcucacuggaaagaagcuaaaaugcuccuugauaauauuaauacaccggaagggauaauucccaguauguucgaaccggaaagggaaaaggucgacgcaauugauggagaauaccgucuaagaggugaggcacgaaaaacuuuuguugauuuaaugcgaagaggggauuuaccgguauggcuugccuaucgugucgcggcggaagggaucaauuacgcggauagaagaugguguuucgacggaguaaagaacaaucagauacuugaagaaaacguggagguugaaaucuggacuaaagaaggugaacggaagaaacuaaaaccgcgauggcuggaugcgagaauauauagugauccgcuagcacuaaaagaauuuaaagaauuugcugcaggaagaaaaucucuuacgcucaaccuuauuacugaaaugggaagacuuccaacguucaugacacagaaggcgcgaaaugcguuggacaaucucgcaguucugcacacagcggaagcaggaggacgugcauacaaccaugcccuaagcgaauuaccugaaacccuggaaacauuauuacuccuaacgcuuuuagcaacugucacaggugguauauuuuuguucuuaaugucgggaaagggaauuggcaagaugacacuaggaaugugcugcauaauaacagcaagcguauuacuaugguacgcacagauacagccacauuggaucgcggcauccauuauucuagaauuuuuccuaauaguccuauugauuccagaaccugaaaagcaaagaacuccccaagauaaucaacuaacuuacguugucauugccauuuuaacagugguagcggcgacaauggcaaacgaaaugggcuucuuagaaaagaccaagaaagauuuugggcuuggaggaauagcuacacaacaaccggaaucaaauaucuuagacauugaccugaggccggcaucagcuuggacauuauacgcuguugcuacgacuuuuauaacuccgaugcugcgccacagcauugaaaauucgucagucaacguuagccucacagcuauagccaaccaagcaaccgucuuaauggguuuagguaaggguuggccuuuaucaaagauggauauaggcgugccauuacucgcaauugguuguuacucacaagucaaccccaucacguuaaccgcugcacuacuacuccuaguggcacacuacgcaaucauaggaccuggccuccaagcaaaagcuaccagagaggcucagaaaagggcugcugcgggcauuaugaaaaacccaacgguagaugguaucacaguaaucgacuuagacccgauacccuacgauccuaaguuugagaaacaacuuggucaagugaugcuucuaguccuaugcgugacccaaguacucaugaugaggacuacaugggcuuuaugcgaagcgcuuacguuagcaacaggcccgaucucgacucuaugggagggaaauccaggaagguucuggaauacuacaauugcagucagcauggcaaacauauuuagagggaguuaccuagccggggcaggacuucuauucucaauaaugaaaaauacagcaaauacaagacguggaacagguaauacaggagaaacucucggagagaaauggaaaaaccgacucaacgcgcuaggcaaaucggaguuccaaauuuauaagaaaaguggcauucaagagguugaucguacuuuggcaaaagaagguauaaaaagaggugaaacugaccaucaugcaguuagucgugggagugcaaagcuacgaugguuuguagaaagaaauuuaguuaccccagagggaaaagugauggaccuuggcuguggcagaggaggguggagcuacuauuguggaggucuuaagaaugucaaagaggugaaagguuuaaccaaaggcggaccaggucaugaggaaccaauaccaaugucuacuuaugguuggaaccuaguacgccuucaaucggggguagauguguucuuuacaccaccagagaaaugugauacacuauuaugcgacauaggagagucaucgccaaaccccacaguugaggcugggaggacauuacgcgugcuaaacuuaguggaaaauugguuaaauaacaauacucaauuuugcauaaaggucuuaaauccauacaugccuucuguuauagagaaaauggaggcacuucaacgaaaauauggaggugccuugguaagaaauccccuaagccguaacaguacucaugaaauguauuggguaucaaaugcuucagguaacauaguaagcuccguaaauaugauuagccgaauguuaauaaacagguucacuaugaggcacaagaaagcaacuuaugaaccagacguagaucuagguucagguacgagaaauauagguauagagagcgaaacaccgaaccuagauauaauaggaaaacgaauagagaaaauaaaacaagagcaugagaccuccuggcauuacgaucaagaucacccuuauaaaacaugggcauaccacggaaguuacgaaaccaaacagacaggaagcgcaucaucuaugguuaauggaguaguucgauuacuaacaaaaccuugggauguuaucccuaugguaacucaaauggcaaugacugauacuacuccauucggucagcaaaggguguucaaggaaaagguugauacaagaacucaagagccuaaagaagguacuaagaaacuaaugaagauaacagcugaaugguuauggaaagaauuaggcaagaagaaaacaccucggauguguacuagggaagaauuuacuagaaaagucagaucuaacgcugcacuuggagcaauuuuuacagaugagaauaaauggaaaagcgccagagaagcaguggaagacucuggauuuugggagcuaguagacaaggaaagaaauuugcauuuagaaggaaaaugugagacuugcgucuauaauaugaugggaaaacgggagaagaaauugggagaguucgggaaagcgaagggaagucgugcaauaugguauauguggcuaggggcacgcuuuuuagaguucgaagcucugggauuuuuaaaugaagaccauugguucucgagagaaaauucgcuuucggggguagaaggggaaggacuucauaaauuagguuauaucuuacgagaugucucuaaaaaggaagggggugcaauguaugcagaugauacugcgggaugggauacccgaauuacacuagaggaucucaaaaacgaagaaauggugacgaaucacauggaaggagaacacaagaaacuugcagaagcgauauucaaauuaacauaccaaaacaaggugguucguguccaacgcccuacuccgagggguacugucauggacaucauuaguagaagggaccagagagggucgggccagguaguaacauacggauuaaauacuuuuacaaauauggaagcgcaacuuauuagacaaauggaaggagagggcguuuucaaaaauauacagcaguuaacggccacugaagagauagcaguuaaaaauuggcuagcacgugugggaagagaaagacugaguagaauggccauaucuggggaugacuguguaguaaagccguuagacgauagauuugcaagcgcgcugacugcauuaaaugacauggguaaaguccgaaaagauguccaacaaugggaaccgucaagggguuggaaugauuggacgcaaguaccauucuguucgcaccauuuucaugaacuuaucaugaaagauggaagaguacugguuguaccuugucgaaaucaggaugaauuaauaggacgagcaaggauuucccagggagcaggguggucacucagagaaaccgcuugucucgguaaaucauaugcucaaauguggucuuugauguauuuucaccgacgcgauuuacgucuugcugcuaaugccauuuguagugcaguuccaucacauugggugccaacaagucguacaacuuggucuauucacgcuacucaugaauggaugaccaccgaagauauguuaacaguguggaauagaguuuggauucaagaaaauccuuggauugaagauaaaacaccagucgaaaguugggaagaaauuccuuaucuaggcaaacgagaagaccaauggugcgguucgcuaauuggauuaacaucuagagcgacuugggccaaaaauauacagaccgcaauaaaucaagucagaagucuaauuggaaaugaagaguacacugacuauaugccgaguaugaaacgauuccgaagagaggaagaagaagcgggaguacuaugguaa

SEQ ID NO: 22961 - RNA, 9876 nt, Artificial Sequence
  derived and/or modified CDS sequence (opt6) from DENV-2__AF204178__SS-prME
accgcaggaaugauaaucaugcuaauuccuacuguuauggcauuucauuuaacuacuagaaauggggaaccacauaugauagugucucgacaagaaaaaggaaagagcuuauuguuuaaaacgggggaugguguaaauauguguacacugauggcuauggaucccggagaacuuugcgaagauacaauuaccuauaaaugcccuuuacuaaaacaaaacgaacccgaagauaucgauuggugguguaauaguacaagcacuuggguaacuuauggaacuuguacgaccaccggggaacaucgcagagagaaaagaucaguugcucuagugccacacgugggaaugggauuagaaacaaggacugaaacauggaugucauccgaaggggcguggaaacaugcacaacgaauagaaacguggauauuacgacaucccggauucacaaugauggcggcaauauuggcuuauacgauagggacaacccauuuccaacgggcccugaucuucauucuacugacggcaguugcacccucgaugacaaugcgauguauaggaauuagcaaucgagauuuuguagaagggguaucggguggcaguuggguagauaucguucuggaacacggcaguugugugacuacuauggccaaaaacaaaccaacacuggacuuugaacuuauuaaaacugaagcuaaacaaccagcuacacuacguaaauauuguauagaagcaaaacuaaccaauacuacaacagauucuagaugcccgacucaaggugaacccucccucaaugaagaacaggauaaaagauuuguaugcaaacacucuaugguagauagggguugggggaacgguuguggucuauucgguaaagggggaauuguaacauuugcuauguucacaugcaagaaaaacaugaaaggaaaggucguacaaccagaaaacuuagaauauaccauuguaaucacaccacacagcggagaggaacacgcaguagggaaugauaccgggaaacaugggaaagaaauaaaaaucacaccgcaaucaucaaucacagaagcugaauuaacuggguaugggacggucacaaugaaauguagucccagaacaggauuggauuuuaacgaaaugguuuuauugcagauggaaaacaaagccugguuaguccaccgacaaugguucuuagaccuuccccuaccaugguuaccaggagcagauacgcaaggaucaaauuggauacaaaaagaaacauuagucacuuuuaaaaauccgcaugcgaagaaacaagauguagucgugcucgguucacaagaaggggcuaugcacacagcguugacuggagccacagaaauacaaauguccucaggaaaucuacuuuuuacgggucaucuuaaaugccgauuaagaauggauaaauuacaauuaaaaggaauguccuauucuaugugcaccggaaaauucaaaguuguaaaagaaauagccgaaacgcaacaugguacaauagucauacgcgugcaauacgaaggggaugggucgccaugcaaaauacccuucgagauaauggaucucgaaaaacgacacguauuagggagacugauaacuguuaauccuaucgucaccgaaaaagacaguccagugaauauagaggcugaaccaccauuuggagacaguuauauaauaauuggugucgaaccaggacagcugaaauuaaauugguuuaagaaaggguccucgauaggacaaauguucgagacuacuaugaggggcgccaaaagaauggcgauacuaggcgacaccgcaugggacuuugggucacuaggaggcguuuuuacgucaauaggcaaagcucuacaucaaguuuuuggagcaauuuacggugccgcauuuucaggcguaagcuggacuaugaaaauauugauaggggugaucaucacuuggauaggaaugaacucaaggagcacaucauuaagcguuucguuaguguugguaggugucguaacucuuuaccuaggagugaugguacaagcagauagcggaugugugguuuccuggaaaaauaaagaauuaaaaugugguucugggauauuuauuacugaugacgugcacacuuggacagagcaauacaaauuucagccugagucaccuucaaaacuagcuagcgcuauacagaaagcacacgaagaagguauauguggaauaagaagugugaccagacuugaaaaccuuauguggaaacagauuacgccagaacuaaaccacauacuuagugaaaaugaaguaaaauuaaccauaaugaccggugacauaaaaggcauuaugcaagcagggaaacgaagucugcggccacaacccacagagcuaaaguauucguggaaaacguggggcaaggcuaagaugcucucaacugaaagccacaaucaaacguuccuaaucgauggaccugaaacagcagaauguccaaauacaaaccgagcauggaacucacuagaaguagaagauuauggguucggcgucuuuacuaccaauauuugguuaaaacuacgugaaaaacaagaugucuuuugcgauucaaaacuaaugucagcuguaaucaaggacaauagagccgcacaugcggacaugggguauuggauagagucagccuugaaugauacuuggaaaauugagaaagcaucuuuuauagaaguaaagucuugucacuggccaaaaagucauacccucuggucuaaugggguauuagaaucagaaaugaucauacccaaaaacuucgcaggcccugugucacagcauaacuacagaccaggauaucacacacagacagcagggccauggcaucuuggaaaauuggaaauggauuuugacuuuugugaagggacaacaguaguaguaacagaggauugcggcaaccguggaccgucauugcguacaaccacagcuucagguaaacuuauuacagaauggugcugccguucuugcacauuaccaccccuacguuacaggggugaagacggauguugguauggaauggagauacguccgcuaaaggaaaaagaagaaaaucucguaaauucacugguaacagccggacacgggcagauagacaauuuuagccugggcguccuugggauggcccucuuucuggaagaaauguuaagaacaagaguggguacaaaacaugccauucucuugguagcgguaaguuucguuacuuuaauuaccgggaauaugaguuuucgugaucuagggagaguuaugguaaugguaggagcuacuaugacagacgauauuggcaugggagucaccuacuuggcccuuuuagccgccuuuaaaguucgaccaacauuugcggcuggacuauugcuacguaaguuaacaucuaaagaguugaugaugacaaccauaggaauaguucuuuuaucucagucgaccaucccagaaacgauucuggaacuaacggaugcauuagccuuaggcaugaugguauuaaaaaugguacguaagauggagaaauaucaacuggcaguaacaauuauggcgauucuaugcgugccuaacgcagucauauuacaaaacgcauggaaaguuucauguacaauacuagcggucgugaguguaucuccucuguuuauuacaucgucucaacaaaaagcugauuggauaccuuuggcacuaaccauaaagggccugaacccaaccgcaauauucuuaacaacccuaucgaggacaaauaaaaagaggucauggccuuuaaacgaagccaucauggcuguuggaaugguaaguauccucgcaaguucacuucucaaaaaugacauaccuaugaccgguccccugguugccgguggacucuugacagucuguuacguacuuacuggcagaagugccgauuuagagcuugagagagcugcugaugugaagugggaagaucaagcggaaauuaguggaucuaguccgauccuaucaauaacuauauccgaagacggaucaaugagcauuaaaaaugaagaagaagaacaaaucuuaacaauauuaauuagaacuggguugcuaguaauuucaggucuauucccaguuagcaucccgauaacugcugccgcaugguacuuaugggaagucaagaaacaaagagccggaguacuaugggacgucccaucuccuccuccuguuggaaaagcugaauuagaagauggagcauauaggaucaaacagaagggcauucuagguuauucucaaauaggugcuggaguauauaaagaaggcacauuccacacaauguggcauguaaccagaggugcaguucuaaugcauaaaggaaaaagaaucgaaccuagcugggcagauguaaagaaggauuuaaucucauauggcggaggauggaagcuggaaggcgaauggaaggagggagaagagguucagguauuggcacucgaaccaggcaaaaauccacgagccguacaaacaaagccaggauuguuuaagaccaacgccgguacuauaggagcgguaagucuugacuuuucaccgggaacaagcgggaguccaauuauugauaagaaaggaaagguaguugggcucuaugguaauggaguggugacacgaucuggagcauacguaagugccauugcucaaacggagaaaucgauagaagauaacccagaaauugaagacgacauauucagaaaaagaaaauugaccauaauggacuuacacccgggcgcggguaaaacuaaaagguaucucccagcaauuguaagggaagccauaaagagaggccuaagaacacuuauucucgcuccaacaaggguaguagcagccgagauggaggaggcccucagggggcuacccauacguuaucaaacaccggcaauucgggccgagcauacgggaagagagauuguagaccugaugugccacgcuacuuuuacaaugcgacuuuugaguccaguucgcgugccaaauuacaauuugauuauaauggaugaggcccacuucacugacccugcgaguauugcugccagagguuacauuaguacucguguagaaaugggugaggcagcugggauauuuaugacugcaaccccucccgguagccgugaccccuuuccucaaaguaaugcuccaauaauggaugaagaacgggaaauaccagaacggucauggucaagcggucacgaauggguaaccgauuuuaaagguaagacuguuugguucguaccauccaucaaagccggcaaugacaucgcggccugucucagaaagaaugggaagaaaguaauucaguuaucgcgcaagaccuucgacuccgaauauguaaaaacccguacaaacgauugggacuucguagucacaaccgauauuagcgaaaugggcgcuaauuucaaggcugagagggucauugauccgcgaagaugcaugaaaccagugaucuuaacugauggugaagagagaguuauucuagcuggaccaaugccaguaacacacucaucggcagcucagaggagaggccguauaggaagaaaucccaagaacgaaaacgaucaguauauauauaugggugagccccuagagaacgacgaggacugugcacacuggaaagaggcaaaaauguuacuagauaacauaaacacaccugaaggaaucauacccucuauguuugagccagagagggagaaggucgaugcgauagacggcgaauaccgauuacguggagaagcaaggaaaacuuuuguggauuuaaugaggagaggggaucuaccuguuugguuagcuuauaggguugccgcugaagggauaaacuaugccgacaggagauggugcuucgauggaaucaaaaacaaucaaauacucgaggaaaauguagaaguugaaauauggacaaaagagggugaaagaaagaaguuaaaaccacgaugguuagacgccaagaucuacagugaucccuuagcgcuaaaagaauuuaaagaauuugcagcaggacgaaagagcuuaacacucaaucucauuacggaaaugggaagacuaccuacuuuuaugacacaaaaagcacgcgacgcgcuggacaaucuggcuguccuacauacugcagaagccggcggcagagcauacaaucaugcauuguccgaauuaccagagacacuugagacuuuacuacucuugacauuacuagcgacuguaaccggugggaucuuccuguuucuaaugagugguagagguaucggaaagaugacccuagggauguguuguauaauaacggcuuccauuuuauuaugguacgcacagauacagccacacuggaucgcagccaguauaauccuugaguucuucuuaauaguauuguuaauuccagaacccgaaaagcaacgaacaccucaagacaaucagcuuacguaugucguuauagcgauauuaacgguagucgccgcuacaauggcuaacgaaaugggauuucuagagaaaaccaagaaggaccuuggccuggggaguaucacgacacaacagcccgagaguaacauacuggacauagacuugaggccugcaagugcuuggacguuguacgccgucgcuacaacauucguuacaccaaugcuccgacacuccauugagaauaguagcgugaacgugagccuaacugcuauagcuaaucaagccacuguccuaaugggccugggaaaagguuggccuuuaagcaaaauggauauuggcgucccacuucuggcaauugguuguuacagucaaguaaaucccaucacacuaacagcagcguuauucuuauuaguugcacacuaugcaauaauugguccuggauuacaagccaaggcuacacgagaagcgcagaaaagggcagcggcuggcauaaugaaaaauccgacgguugauggaauuaccgucauagauuuagauccaauaccguaugacccgaaauucgaaaaacaauuaggccaaguaauguuauugguucuauguguaacacaaguguuaaugaugcgaacaacuugggcauuaugcgaagcacugacccucgccaccgggccaauaucgacuuuaugggaaggaaauccaggacguuucuggaacacuacaaucgccguuucgauggcuaacauuuuccgaggaucauaucucgccggugcgggcuuauuauuuucuauuaugaaaaacacuacgaacacgcgaaggggaacuggaaauauuggagaaacuuuaggugaaaaauggaaaauacgauugaaugcacuagguaaaucagaguuucaaaucuauaagaaaucgggaauacaggagguagacaggacauuagccaaagaaggaauaaaaagaggagaaaccgaucaccacgcgguaaguagaggcagcgccaaacugagaugguucguagagcgaaacauggugacgccggagggaaaagucguggaccuagguuguggaagaggaggauggaguuauuacugcggaggcuuaaagaacguacgagaagugaagggucuaacuaaagggggaccaggacaugaagaaccgaucccuaugucaaccuauggauggaauuuaguacggcuacaaucaggggucgacguauucuucacuccuccagaaaaaugcgacacucugcuaugcgacauaggugaaaguuccccaaacccaacagucgaagccggccgaacucuucgaguguuaaauuugguagaaaauugguugaacaauaauacgcaauuuuguauuaaaguccucaauccguacaugccaaguguuauagagaaaauggaaacauuacaacguaaguaugguggugcacuuguuggcaacccacuaaguagaaacucgacucaugaaauguacuggguuucgaacgcauccgguaauauagucuccucgguuaauaugauaucaagaauguuaaucaacagguuuacgaugagacauaagaaagcaacuuacgaaccagacguugacuuaggaaguggcacgcgaaauaucggaauugaaucagaaaucccaaaccuugauauaauaggaaaacggauagagaaaauaaaacaggaacaugaaacaucauggcauuacgaccaagaccauccauauaaaaccugggcauaucaugggagcuaugaaacaaagcaaacaggcucggcaucuaguaugguaaacggaguaguucguuugcuuacuaaaccgugggaugugguuccaaugguaacccaaauggcaaugacagacacaacaccguuuggacaacaacguguuuucaaggaaaaagucgauacccggacccaagaaccuaaagagggcaccaagaaacuuaugaaaaucacagcugaauggcuauggaaagaauuaggcaagaagaaaacaccgagaauguguacuagagaagaguucaccaggaaaguaagaucgaacgcagcauugggugcaauuuucacagaugaaaacaaauggaaaagcgcacgagaggcuguagaagacaguagauuuugggaguuaguagauaaagagcguaaucugcaucuagaaggcaaaugugaaacauguguuuauaacaugauggguaaacgagagaagaaacuuggugaguuuggaaaagcaaaaggcuccagagcuauuugguauauguggcucggagcacgauuucucgaauuugaggcgcuuggcuuucucaacgaagaccacugguucaguagagaaaauucccuaaguggcguagaaggagaaggacuauacaaauuaggguacauacuacgagaugucaguaagaaagaggguggugccauguaugcugaugauacugccgggugggacacgaggauaacauuagaagaucucaaaaaugaagaaauggucacaaaucacauggaaggcgaacauaaaaagcuagcggaagcaauauucaagcugacguaccagaacaaaguaguaagagugcaaagaccgacaccucgaggcacagucauggacauaauuagccgaagagaucaaagagggucaggccaaguaggcacguacggacuaaauacguuuacaaacauggaagcccaauuaauaagacagauggaaggagaaggaguuuuuaaaucaauacaacaucuaacgguaaccgaagaaaucgcuguccaaaacuggcuagcucgaguuaggcgagaaagacuaucgaggauggcuauaucaggagacgauuguguggucaaaccacuugaugauagauuugcaucagcacuaacagcucuaaaugacauggggaaagugagaaaagacauccagcaaugggaacccuccaggggauggaacgauuggacucaagucccuuucuguucccaccacuuccacgaauuaauaaugaaagacggccgaguccuaguuguaccgugcagaaaucaagaugaacuaauaggacgugcuagaauaucucaaggugcuggauggucgcuuagagaaacugcgugucucggcaaaucauaugcacaaauguggucauuaauguauuuccaccgaagagauuugcgccuugcagcaaacgcaauuuguagugcagugccaagucacuggguaccaacuucaagaacaacauggucaauacaugcuaagcacgaauggaugacuacugaagauauguuaacugucuggaacagagucuggauucaggaaaaucccuggauggaagacaaaaccccaguagagaguugggaggaaauuccauaccuuggcaaaagagaagaccaauggugcgggucucuuauagguuuaacuagcagagcaacaugggccaaaaauauccaaacagcuaucaaucaggucagaucuuuaauaggcaacgaagaauauacagauuacaugcccaguaugaaacgauucagacgggaggaagaagaagcuggaguucuuugguga

SEQ ID NO: 22962 - RNA, 9876 nt, Artificial Sequence
  derived and/or modified CDS sequence (opt6) from DENV-2__AF204177__SS-prME
acggcggguaugauuauaauguuaaucccaacuguuauggcauuccaucuaacaacacgcaauggagaaccacacaugaucgucucucgucaagaaaaaggaaaaucucuauuguucaaaacgggagacgguguaaacauguguacgcugauggcuauggacuugggugaacuuugugaagauacaauaacauacaaauguccuuuacucagacaaaaugaaccugaagauauagacuguugguguaauucaacaagcacauggguaaccuacgguacuuguacaacuacaggggaacauagacgugagaaaagauccguagccuuaguaccacauguaggaaugggacuagaaacgcggacugaaacauggauguccagugaaggugcauggaaacaugcucagcggauugaaacuuggauucugcgacauccaggauucacaaucauggcagcuauacuugcuuauaccaucggaacuacccauuuucaaagagcgcuaauauuuauucucuuaacagcaguugcaccgucaaugacaaugagguguauuggaaucaguaaucgagauuucgucgaaggcguaaguggcgguucauggguugauauaguauuagaacauggaucuuguguaacaaccauggccaaaaauaaaccaacccuagauuuagaacuuauaaaaacagaagcaaaacagucugcaacauuacggaaauauuguaucgaagcuaaacuaacuaauaccacuacugaaagccgaugucccacacagggugaaccuaguuugaaugaagaacaagacaaacgauucguauguaaacauucgaugguugacagaggaugggguaacggauguggacucuucggaaaaggagguaucguuacuugcgcuauguuuacuugcaagaaaaauaugaaagggaaagugguucaaccugaaaauuuagaauacaccauagucauuacaccccauagcggcgaagaacaugcaguggggaaugauacugggaaacaugguaaagaaauaaaaaucacaccucaaucaagcaucaccgaagcagaacuaacaggguacggaacugucacuauggaaugcucgccaaggacaggacuggacuuuaacgaaauggucuuguugcagauggaaaacaaagcguggcuuguacacagacaaugguuccucgaucuacccuuacccugguugccuggcgcagauacacaaggaucaaauuggauacaaaaagaaacacuuguaacguuuaagaacccacaugcaaagaagcaagauguggucguuuuagguucgcaggaaggggcaaugcauacagcucugaccggagcgacugaaauacaaaugagcaguggaaauuuauuauucacaggucaucuaaaaugucggcuacgaauggauaaguuacaauugaaagggaugucauauucaauguguacagggaaguuuaaaguggucaaagaaauugcugaaacacagcauggcacgauaguaauaagaguacaauaugaaggcgaugguaguccuuguaaaauuccauucgaaauaauggaucuagagaaacgacauguucuaggaaggcucauaaccguaaaucccauagucaccgaaaaggauuccccggugaacauagaagcagaaccacccuucggcgacagcuauauaauaauaggaguagaacccggccaguuaaaacuaaacugguucaagaaaggaaguucaauaggacaaauguucgaaacaaccaugcguggagcaaagcguauggcaauccuaggggauacagcaugggacuuuggaucacuugguggugucuucacaucuauaggaaaagccuuacaucaaguuuuuggagcaauauacggcgcagccuuuucaggcgugaguuggacuaugaaaauacuaauugguguaauaauuaccuggauaggaaugaacucucguagcacuagccucucugugagucuaguacucguuggagucguaacucuuuauuuagggguaaugguucaagcugauucgggcugcgucguaucuuggaaaaauaaggaguugaagugugguaguggaaucuuuauuaccgauaauguacauacguggacugaacaauacaaauuucaaccagaaucacccagcaaguuagccucagcuauacaaaaagcucaugaagaggguauaugugguauaagaucugucacgagacuagaaaauuuaauguggaagcaaauaacaccagaguuaaaucauauccuaucugaaaacgagguaaaacuuacgauuaugacgggugauauaaaagguaucaugcaagcuggaaaaagaagccuccggccacaaccgacggagcuaaaguacucuuggaaaacguggggaaaggcuaaaaugcucagcacugaaagccauaaucaaacauuccuuauagaugguccagagacagcagaaugucccaacacaaauagggcauggaacucguuggaggucgaagauuauggauucggaguauucaccacaaacauauggcuaaagcuccgcgaaaagcaggauguauucugcgacaguaaauuaaugagugcugcgauuaaagauaauagagcgguacaugcggauaugggguacuggaucgagucagcucuaaaugacacauggaaaauagaaaaggcaucuuuuauagaaguuaaguccugccauuggccuaagucccacacuuuauggagcaaugaagucuuagaauccgagaugauaauucccaaaaauuucgccgguccuguuagucaacauaauuaucguccuggauaucauacacaaacagcagggccauggcauuuaggaaaauuggagauggacuuugacuuuugcgagggaacgacgguuguaguaacagaggauugugguaaucgaggacccagcuuacgaaccacuacagcaucuggcaaauuaauaacagagugcugcugcagaucuugcacacuaccgccccuucgauauaggggagaagaugguugcugguacggaauggagauaagaccccucaaagagaaagaagaaaaucuaguaaacagccuggucacggcaggucauggucaaauagacaacuuuucauuggggguuuugggcauggcgcuauuccuggaagaaauguugagaacgagagucgggaccaaacacgcuauccuccucguggcuguuaguuucguuaccuuaauuaccgguaauaugucguuuagagaccuggguagaguaaugguaaugguuggagcaacgaugaccgacgauaucggcaugggggucacauacuuggcacuuuuagcagcauucaagguacgacccacauucgcagcaggucucuuauuaagaaaauugacaaguaaagagcuaaugaugacaacuauuggaaucguucuccuaucgcaaaguacuaucccagagaccauauuggaauugaccgaugcucuagcgcuaggaaugaugguauuaaagauggugcgaaaaauggagaaauaccaacuugcugucaccaucauggccauuuuaugcgucccuaaugccguuaucuuacagaaugcguggaaaguguccuguacaauccuggcugucguaucugucucacccuuauuccugacgaguucacaacagaaagcagauuggauuccacuagcauuaacaauaaagggucucaacccaacagcgauauuuuuaacuacauuaagcaaaacuaacaagaaaagaaguuggccucucaaugaagcaauaauggcgguggguaugguuaguauuuuagcaucuaguuuauugaaaaacgacauaccuaugacugguccucuuguagcaggaggcuuacugaccgucuguuacguauuaacagguaggucagcagaucuagaauuggaaagagcggcugauguaaaaugggaggaucaggccgagaucaguggaaguucaccaaucuuaucaaucacaauauccgaagacggcaguaugaguauuaagaacgaagaggaggaacaaauacuuacgauauuaauacgaacggguuugcucgugaucucaggacuauucccaguuucuauaccaauaacggcagccgcaugguaucuuugggaaguuaagaaacaaagagcgggaguacucugggacgucccuucuccacccccagugggaaaagccgaauuggaagacggugcuuacagaauaaaacaaaaaggcaucuuaggauauagccaaauaggggccgguguauauaaggagggcacuuuccauacaauguggcaugucacuagaggugcaguccuaaugcacaagggcaaacgaauagaaccaagcugggccgaugucaagaaagacuugauuagcuaugcuggcggguggaaacuugagggcgaguggaaagagggagaagagguacagguccuugcauuagaacccggcaaaaauccaagggcaguccaaaccaaaccaggcuuauuuaaaacuaaugcugguacaauuggggcaguuucauuagacuuuucaccuggaacgucugguucaccuauaaucgauaagaaaggaaaaguaguagguuuauacggcaaugguguagucacgaggaguggugcguacgucucugcuauagcacaaacugagaaaaguauagaagauaauccugaaauugaagacgauauauuuagaaagagaaaacuaacuauaauggacuuacauccaggagcgggaaaaacaaaacgauauuuaccugcgaucgucagagaggcaauuaagagaggacucagaacacuaauuuuggcaccaacaagaguggucgccgccgaaauggaggaagcacuaagagggcuccccauacgauaccaaacuccugcaauuagggccgagcacaccggacgugaaauaguagacuuaaugugccaugcaacuuucacaaugcgccuguuaucuccuguaagaguucccaauuauaauuuaaucauaauggaugaagcucauuuuacagauccagcuagcaucgcggcacguggauauaucaguaccagagucgagaugggcgaagcagccggcauauucaugacagccaccccacccggaagucgagauccauucccccaaucaaaugcaccuauaauggacgaggaaagagagauuccagaaagaaguuggucaucgggucaugaaugggucacagacuucaaggguaaaacugugugguuuguacccucaaucaaagcgggaaacgauauagccgcgugccuucgaaagaaugggaaaaagguuauucaguuauccagaaaaacguucgacagugaauaugugaagaccagaacaaacgacugggacuuugugguaacaacggauauaucugaaaugggagccaauuuuaaagcugagagaguaauugauccaagacggugcaugaaaccuguuauccuaacagauggagaagaacgcgucauacucgcaggaccaaugccagucacacauucaagcgccgcccagaggagaggaagaaucgggaggaauccaaagaaugaaaaugaccaauacaucuacaugggggagccccucgagaaugacgaagauugugcccauuggaaagaagcuaaaauguuacuugauaauauaaacacuccggaagguauaaucccgagcauguuugagccagagcgagagaagguagaugcaauugacggagaauaucgacuccguggcgaagcuagaaaaacauucguagacuuaaugagacgaggagaccuucccguuuggcuugcauaucgaguggcagcagaggggauaaauuacgccgaucgaagaugguguuucgauggaaucaaaaacaaucaaauuuuagaagagaaugucgaaguagagauuuggacaaaagaaggcgaacgcaagaaauugaagcccagauggcuagacgcacguaucuacagugauccguuagcuuuaaaggaauuuaaagaauuugcagccgguagaaaaucacuuacgcuuaauuuaaucacagaaauggguaggcuaccgacauucaugacacaaaaagcaagagaugcucuugauaaucuagcaguauuacacacggcugaagcgggugggagggccuauaaucaugcgcucagugaacuaccugagacacuagagacucuguuacuuuuaacauuauuagcaacgguuacgggcggaauauucuuauuccuaaugucgggaagaggaaucgguaaaaugacucuggggauguguuguauaauaacagcuucaauacuucuuugguaugcucaaauucagccgcacuggauagcugcaucaauaauacucgaguucuucuugauaguguugcuaaucccugaacccgaaaaacaacguaccccacaggauaaucaacuaacguauguaguaaucgcaauacuaacagugguugcagcaacuauggccaacgaaaugggguuucuggagaaaacgaagaaagacuuaggacuuggcucuauuacaacacaacaaccggaaagcaacauuuuggacauugaucuacguccugccagugccuggacacuauaugcagucgcaaccacauucguuacccccauguuaaggcacagcauugaaaauaguagugucaauguaagucuaacagccaucgcaaaucaagcaacaguucuuaugggacuagggaaaggauggccccuuucuaaaauggacauagguguaccauuacuagcuauaggauguuauucacaaguuaacccuauaacgcuaacagcagcucuauuucuacugguugcacauuacgcgauaauaggaccgggauugcaagcaaaagcaacaagagaggcucagaaaagggccgcugcagguaucaugaaaaauccuacaguggauggcauaacgguaauugauuuagaucccaucccuuaugauccuaaauucgagaaacaauuaggacaaguuaugcuacuggucuuauguguaacacagguacuaaugaugagaacaacuugggcauugugugaggcucuaacgcucgccaccggaccuauaucaacguuaugggaagguaauccugggcgauucuggaacaccacuauagcuguaucgauggccaauauuuucaggggaagcuacuuagcuggugccgggcuacuauuuucaauuaugaagaacacuacaaacacaagacgugguacuggcaauauaggagagacgcuaggagaaaaguggaaaagccgauuaaaugcucucggcaaaucagaguuccagauauacaagaaaucggguauucaagagguggaccgaacacuugccaaagaaggaaucaaacguggggaaacugaucaccacgcgguguccagagguucggcaaaauuacgaugguuuguugaacgaaauaugguuacuccggaagguaaaguagucgaccucggaugcggucgaggaggauggucuuauuauugcggaggacuaaagaauguucgcgaagucaaagguuuaaccaaaagagguccaggacacgaggaaccgaucccaaugucaacuuauggcuggaaucugguaaggcuucaaucaggaguggacguauuuuucaccccgccagaaaaaugugacacauuacuaugugacaucggagagucaucuccuaacccuacuguagaagcaggaagaacauuacguguacuaaauuuaguugaaaacugguuaaauaauaacacucaauucuguaucaaaguucuaaaucccuacaugccaagcgugauugagaaaauggaggcuuuacaacgaaaauacggaggggcccuaguuagaaacccucuuaguagaaauucgacucaugaaauguauuggguuuccaaugcaagcggaaacauagucucaucuguaaauaugauuucuagaauguuaaucaauagauuuacaaugagacauaagaaagcgacuuacgaaccagauguggaucucgguaguggaacaagaaauauuggaauagaaucggagauuccgaaucucgacauuauagggaaaagaauagagaaaauuaagcaggaacaugaaacguuauggcacuaugaucaagaucauccguauaaaaccugggcauaucacggcagcuaugaaaccaagcaaacgggaagugcauccucuauggucaauggcgugguacgucugcuaacaaagccaugggauguuguucccaugguaacccaaauggcuaugacugauacaacuccuuucggccagcaaaggguauucaaagaaaaaguagauacgcgaacacaggaaccuaaggaagguacuaagaaguuaaugaaaauaacagcugaaugguuauggaaagaauugggcaaaaagaaaacuccuaggaugugcacacgggaagaguucacaaggaaaguaagaucuaaugcugcuuugggcgcgaucuuuacagaugaaaauaaaaggaaaucagcucgagaagcgguggaagauagucgguuuugggaauuaguggauaaggaaagaaauuugcaccucgaagggaaaugugaaacuugcguuuacaacaugaugggaaaaagagagaagaaacugggagaguucggcaaagcaaagggaaguagagccauuugguauauguggcuaggcgcuagauuucuagaguucgaagccuugggauuuuuaaaugaagaccacugguucagcagagagaauagccuaucaggcguagaaggugaggggcuucauaaacuaggcuauauucucagagacgucagcaagaaagaagguggagcuauguacgcagacgacacggcaggaugggauacucgcauaacgcuagaagaucugaaaaaugaagaaaugguaacuaaucacauggaaggagaacauaagaaauuggccgaagcaaucuuuaaauuaacuuaucaaaauaaagugguccgcguacaacgcccuaccccacggggcacggucauggauauuauaaguagaagagaccaaagagguucaggccaggucggaacauauggauuaaauacauucacuaauauggaagcgcaacuuauuaggcagauggaaggugaaggaguauuuaaaucaauacaacaucuaacugucacggaggaaauugcuguacaaaauuggcuggcuagaguaggaagggaaagguuaagucgaauggccauuagcggagacgacugcgucguaaaaccgcucgaugaccgauucgcaucugcucuaacggcauuaaaugacaugggaaaggugcgcaaggacauacaacaaugggaacccucacggggguggaacgacuggacucaaguacccuuuugcagucaucauuuucaugaacuuauaaugaaggauggaagagucuugguuguuccaugccguaaucaaaaugaacuuauugggagagcaagaauaagccaaggugcaggguggucacuccgagaaacagcaugucuagguaaguccuaugcgcaaauguggucguuaauguauuuucaucgcagagaccuucguuuagcagcuaaugcaauauguagugccgucccaucacauugggugccgacaaguagaaccaccuggagcauacaugcuaaacaugaauggaugacuaccgaggauaugcuaacuguuuggaauaggguauggauacaagaaaacccauggauggaagauaagacauccguagaaucuugggaagagauccccuauuuggguaaaagagaagaucaauggugugguagccuaauaggacuaacaagccgagcaacgugggccaaaaauauacaaacugcaaucaaccaagugcgaaguuugaucggaaaugaggaauauacagacuacaugccuucaaugaaacgauuuaggagagaagaagaggaggccgguguauuaugguaa

SEQ ID NO: 22963 - RNA, 9876 nt, Artificial Sequence
  derived and/or modified CDS sequence (opt6) from DENV-2__DQ645540__SS-prME
acagcugguguaauuauuaugaugauacccacaguuguagcauuccaucuaacaacuagaaauggugaaccacauaugauaguuagcagacaagaaaaaggaaaaaguuuauuguuuaaaacagaaaaugggguuaauaugugcacauuaauggcaauggaucugggugaacugugugaagauacuauaacuuauaauuguccucuguuaaggcaaaaugaacccgaagauauagacuguugguguaacuccacuuccacauggguuacauacggaacauguacagcaacaggugaacauaggcgugagaaaagaucuguagcucucguuccucauguaggcaugggucucgaaacaagaacugagacauggaugagcucagaaggagcauggaaacacgcccaacgaauagagacuuggguucuacgacauccagguuucacuauuauggcagcaauacuugcuuauacaauaggaacuacauauuuccagcguguucuuauuuuuauucuucuaacagccguagcaccauccaugacaaugcgaugcauuggaaucagcaacagggauuucguagaaggagucucuggcggcaguuggguagauaucguucuagaacauggcuccuguguaacuacuauggcgaaaaacaaaccaacauuggauuuugaacuuacuaaaacugaagcuaaacauccagcgacacuuaggaaauauugcaucgaagcaaaauuaacaaacacaacgacagcaucaagauguccaacgcaaggagaaccuucacuaaacgaagaacaagacaaaagauuuguauguaaacacaguaugguagacaggggcuggggcaauggaugcggccuauucgguaaaggcggaauuguuacgugcgccauguuuaccuguaagaaaaacauggaaggaaaaguaguacaaccagaaaacuuggaauauacaauuguuauuacuccacacuccggggaagaaaaugcggucgguaaugacacagguaaacacgguaaagagauuaaaguaacgccccaaucaagcauaacagaagcagaguuaacgggcuauggaaccguuacuauggaauguagcccccggacaggguuagacuucaaugaaaugguauuauuacagauggaagauaaagcauggcucguccaccgacaaugguuucuugaucuaccucuuccauggcuaccaggagcugauacucaaggaucaaauuggauacagaaagaaacucugguuacuuuuaaaaacccccacgcuaagaaacaagaugucgugguacuggggucacaagaaggugcgaugcacacagcacuuacaggcgcgacagaaauacagauguccucgggaaauuuacuauucacaggacaucuaaaauguaggcuaaggauggauaaacuacaacucaaaggcaugaguuauuccaugugcacagggaaauucaaaguugugaaagaaauagcagaaacacaacacggcacgauagugauacgcguucaauacgaaggagauggguccccguguaaaauuccauuugaaaucauggauuuggaaaaacgucacguacuaggaagauuaauuacaguaaauccgauaguuacagaaaaagauaguccaguaaauauagaggcagagccuccguucggagauagcuauauaauuauugguguagaaccaggacaacugaaauugagcugguuuaagaaaggaucaagcauuggacaaauguuugaaaccacaaugaggggcgcaaaaaggauggcuauacuaggugauacagcaugggacuucgggucauuagguggcguauucaccuccauaggaaaggcuuuacaccaaguauucggcgcaauauauggggcagcauuuucagguguaagcuggacuaugaaaauucuuaucggcgugguaauaacuuggauagggaugaacuccagaucgacaucauuaucgguuaguuugguccucguaggugugguaacucucuaccucgguguuaugguacaagcugacagcgguuguguaguaucuuggaaaaacaaagaauugaaaugcggaucggguauauucauuacggacaaugugcacacuuggacagaacaguacaaauuucagccugaaagcccaucgaaacuagcaagcgcaauucagaaagcacacgaggaaggaauaugugggauucggucggugacuagacucgaaaaucuuauguggaaacagauaacacccgaauugaaucacauacugagcgagaacgagguaaaacugacgauuaugacgggagauauuaaaggaauuaugcaggcggguaaacgcagcuuacguccccaaccaacagaauuaaaauacuccuggaaggcuuggggaaaggcaaaaaugcuuuccaccgaauugcauaaucauacguuucuuauagaugguccagaaaccgcugagugccccaacaccaaucgagcauggaacucuuuagaaguagaagacuacggauuugggguuuuuaccacuaauauaugguuaaaguuaaaagaacggcaagauguuuucugugacaguaaacuuaugucugcagcaauaaaagauaauagagccguacaugccgauaugggguauuggauagaaucagcucuaaaugacacauggaagauagagaaagcuaguuuuaucgagguaaaaucaugccauuggccgaaaucucauacccucuggagcaauggcguacuugagucagaaaugaucauuccuaaaaauuuugccggcccugucagucaacauaauuaucgaccaggcuaccauacacaaacugcagguccuuggcaccucggcaagcucgagauggauuucgauuuuugugaggggacgacaguuguaguaacagaagacuguggcaauagaggcccaucauuaagaacgacaacggccagcggaaaacugaucacugaauggugcuguaggucauguacucuacccccuuugagauacagaggagaggauggauguugguaugguauggaaauuagaccuuugaaagaaaaagaagaaaauuuaguuaauucauugguuacugcuggccacggccaaaucgacaacuuuucauuagguguauugggaauggcguuauuccuagaagaaauguuaagaacuagagucggaacaaaacaugccauauugcuaguugcggucagcuuuguaacauugauaacugguaauaugagcuuuagagacuugggaagagucaugguuaugguaggagccacaaugacagaugacauaggcaugggagucacguaccuggccuuguuagcagcauuuaaaguaagacccacauuugccgcugggcuguuauuaagaaaacuaacgagcaaagaguuaaugaugacuacaauugguauagugcuucuaucucaaaguacgauaccugaaacuauuuuagaauuaacagaugcgcuugcacugggaaugaugguccucaaaauaguuagaaauauggaaaaguaucagcuagcgguaacgauuauggcaauauuauguguaccuaacgcaguaauauugcaaaaugccuggaaaguaagcuguaccauauuggcagugguaucugugagcccguuauugcugaccucuucacaacaaaaagcugacuggauaccauuagccuuaacuauaaagggacuaaaccccacagcaauauuucuaaccacauugucccggaccagcaagaaaagaaguuggcccuugaacgaagcuaucauggcuguaggaaugguuucaauacuagcaucaucgcuacuuaaaaaugacaucccaaugacaggaccucuaguagcuggugguuuacuaacaguuuguuauguacugacuggccgcagugcugacuuagaacuggagagggcugccgauguccgaugggaagaacaagcagaaaucucagguaguucgccaauacuaagcauaacaauuucggaggauggcucaaugaguaucaaaaaugaagaggaagaacaaacacuaacuaucuuaauaagaacuggucuacuuguaauaaguggacuuuuuccagucaguauuccaauuacugccgcggcaugguauuuaugggaaguuaaaaagcaaagagcaggagugcugugggauguaccaaguccaccaccaguugguaaagcagaauuagaggauggagcuuauagaauaaaacaaaagggcauauuagguuacucacaaauaggagcagggguauauaaagaggguacauuucacacuauguggcacgugacaaggggagccguucuaaugcacaaagggaaaaggaucgagccaucgugggcggauguuaagaaagaucugauaucguacggaggcggguggaaauuagaaggcgaguggaaagagggggaggaaguacaaguguuagcucuugaacccgguaaaaacccuagagcaguucaaacuaaaccuggacucuuuaagacgaacacugguacaauaggggcugucucucuagacuuuucaccggguacaucggggucaccaaucguagauaagaaaggcaaaguaguaggacuguaugggaaugguguaguaacccgaucugguaccuauguaagugcaauagcucaaaccgagaagucaaucgaagacaauccggaaauagaagacgauauauuucgcaagaaacgguuaacaauuauggauuuacacccuggagccgguaaaacaaagcgauaucugccugcaauuguuagggaagcuauaaagaggggacugcguacuuuaauauuagcacccacaagagucguggccgcugaaauggaagaagcguugagaggacuaccuauccgauaccaaaccccugccauaagagcagaacacacaggucgggaaauuguugauuugaugugccaugcaaccuuuacaaugagauuauuaagucccauuagaguuccuaauuacaaccucauaaucauggaugaagcgcauuucacagauccagcuagcauugcagcuagaggcuacaucaguacaaggguggaaaugggugaggcggcggguauauucaugaccgccacuccuccaggaaguagagacccguuuccacagucuaaugccccaaucauggaugaagaacgugagauuccugaaaggucuuggaacucaggucacgaauggguuacggauuucaaagguaaaacaguuugguucguuccgagcaucaaagccgggaaugacaucgcagcguguuuaaggaaaaaugggaagaaagugauucaacuuagccgaaaaacguucgauucggaauacguaaaaacccgaacaaaugacugggauuucguagugacgacggacauuagcgaaaugggcgcuaauuuuaaggcugagaggguuaucgauccccgacgcugcaugaagcccguuaucuuaacagacggagaggagagagugauauuagcaggcccaaugccagucacacacucaagcgccgcacagaggcgaggccgaguagggcggaacccgaagaacgagaaugaccaguacauauacaugggcgaaccuuuagagaacgacgaagacugcgcacauuggaaagaagccaaaauguuacucgauaacauuaauacgccagaaggaauaauacccuccauguucgaaccagaaagggaaaagguagaugcuaucgauggagaauauagacuaagaggcgaagcucgaaaaacguuuguagacuuaaugagaagaggggauuugccaguauggcuggccuaucgcgucgcagcugaaggcauaaacuaugccgauagacgaugguguuuugauggagucaaaaauaaucagauacucgaggaaaauguagaaguagaaaucuggaccaaagagggugagaggaagaaauuaaaacccagauggcuagacgcgcgaauauacagugacccauuggcuuuaaaagaauuuaaagaauuugcagcuggucgaaagagccucacuuugaaccuaauuaccgaaauggguagguugccaacguucaugacgcaaaaagcucgaaacgcauuagacaacuuagcaguuuuacauacugcggaagccgggggaagggcuuauaaccaugcgcugucagagcuaccagaaacacuugaaacacucuugcugcucacacuccuagcaaccgucacuggagggauauucuuguucuuaaugagcgggaaagguauaggaaaaaugacgcuugggauguguugcauaauuacugcgaguguccugcugugguaugcucaaauucagccacacuggauagcggcaucaauaauucuugaauuuuucuugauaguacuacucauacccgaaccagaaaaacaacguacaccucaagauaaucagcuaacuuacguagucauugccauauugaccguuguggcugccacaauggcuaacgaaaugggauuccucgagaaaacgaagaaagacuucggccuaggugguauugcuacucaacaaccagaaucaaauauauuagacaucgacuuaagaccugcuuccgcuuggacgcuauaugcuguugcgacaaccuucaucacaccaauguugcgccacagcauagaaaacucgucuguaaauguuucucuuacggcaauagcuaaucaagcgacuguauugauggguuuggguaaaggauggccuuuaucgaaaauggauauaggagucccacuguuagcgaucggaugcuacucacagguuaauccgauaacuuuaacagcugcacuacuucugcuuguagcgcacuacgcaauaauuggaccaggguuacaggcaaaagcaacuagagaggcacagaaaagagcugcagccggcauaaugaaaaauccgacaguugauggaauaaccguaauugaccuagacccuauuccauacgauccgaaauucgaaaagcagcuaggucaaguaauguuguuaguucuaugugucacgcaaguacuaaugaugagaacgacuugggcguuaugugaggcucuaacgcucgcaacaggucccauaucgacauugugggaaggaaauccgggaagauuuuggaacacuacgauagcuguuaguauggcgaauauuuuucgcgggagcuaucuugcaggagcaggcuuacuguuuucaaucaugaaaaauacagccaauacacgaaggggaacaggaaacacaggggagacuuuaggagaaaaauggaagaauaggcuaaaugcgcuaggcaagagugaauuucagauauauaagaaaagcgggauccaagaagucgacaggacccuagcuaaagaaggcauaaaaaggggcgaaaccgaccaccaugcaguuucaaggggcucagcgaaacuaaggugguuuguggaaagaaaccuugucacaccggaaggaaaaguuauggaucucgguuguggccguggaggcuggaguuacuauuguggaggcuuaaagaacgucaaagaagucaaaggguuaacuaaaggagguccuggacacgaggaacccauaccuaugaguacauacgguuggaaucuaguaagauuacagagcggcguagacgucuuuuucacuccaccggaaaaaugugacacauuguuaugugauaucggagaaucauccccgaacccgacagucgaagcaggaagaacguugagaguucuuaacuuaguugagaacuggcuaaacaauaauacgcaauuuugcaucaagguacucaacccauauaugccuuccguaauugaaaagauggaggcacuacaaagaaaguacggaggagccuuaguaagaaauccccucucgagaaacucaacccaugaaauguauuggguaucaaacgcaagcggcaauauagugucgucgguuaacaugauaaguagaaugcuaauuaauagauuuaccaugcgucauaaaaaggcaacguacgaaccagacguagauuuagggucaggcacacgcaauauaggaauagaaagcgaaauaccaaacuuggauauuaucgguaaacgaauugagaaaauuaagcaagaacacgaaacaucauggcacuaugaccaagaccacccauauaaaacaugggcauaccaugguucuuaugagacaaaacaaacggguagcgcaucuagcaugguaaaugguguugugcgcuuacuuacuaaaccuugggauguaaucccuaugguuacacaaauggcaaugacagauacgacccccuucgggcaacaaagaguuuuuaaaguaaaaguugauacacguacacaggaaccuaaagaaggcacgaagaaauuaaugaaaaucacagcagaaugguuauggaaagaauuagggaagaagaaaacaccgcguaugugcacuagagaagaguuuacacgcaaaguacgaucaaaugcagccuuaggagcgauauuuaccgacgaaaauaaauggaaguccgccagggaagcaguagaagacagcggguucugggaauugguagauaaggaacguaaucuucaucuggaaggaaaaugugaaacauguguuuacaacaugauggguaagcgugagaagaaacuaggcgaauuuggaaaagcgaaaggaagccgagccauaugguauauguggcuaggcgcuagguuccuagaguucgaggcauuaggauucuugaacgaggaucacugguuuagcagagaaaauagucuaagcggagucgaaggugaaggucuacacaaauugggcuauauccugcgugaugugaguaaaaaggaaggcggggcuauguaugcagacgacacagcaggaugggacacacguauaacuuuagaggaucuaaagaaugaagagaugguaaccaaucacauggagggggagcacaagaaacucgccgaagcuauuuuuaaauuaacguaccaaaauaagguagucagaguacaacgaccgacaccuagggguaccgucauggacauaauaagucguagagaccaacgaggauccggccaagucgugacuuauggucuaaacacguuuacuaacauggaggcucaguuaauuagacaaauggaaggagaaggugucuuuaaaaguauacagcaacuuacugcaacagaagaaauagcagugaaaaacuggcuagcaagaguaggaagggagaggcuuucuagaauggcaauaaguggugacgauugugugguaaaaccucuagacgacagauuugcuucggcgcuuacggcacucaaugauauggggaaagucaggaaagauauacaacaaugggagcccagcagaggauggaacgacuggacgcagguaccauucuguagccaccauuuccaugaauuaauuaugaaggauggacgcguccucgucguaccauguagaaaccaagaugaacuaaucggaagggcaagaauuucucaaggggcaggauggucccuacgagagacagcuugcuuagguaaaucuuaugcacaaauguggucacuuauguauuuucacagaagagaccuccgauuagcugcaaaugcuauauguuccgcugugcccagucauuggguacccacaucuagaacaacuuggucaauccacgcuacucaugaauggaugacaacagaagacauguugaccgucuggaaucguguguggauacaagaaaacccguggauagaagauaagacgccuguggagaguugggaagaaauaccauauuuaggaaaacgugaagaucaauggugcgggaguuuaauaggucuuacgucucgugcgacuugggcgaaaaauauacaaacagcgaucaaccaaguaagaagucuaauaggaaaugaagaauauacagauuacaugccaagcaugaaaagauuucgacgggaagaggaggaagccggaguacugugguaa

SEQ ID NO: 22964 - RNA, 9876 nt, Artificial Sequence
  derived and/or modified CDS sequence (opt6) from DENV-2__DQ645541__SS-prME
acagcagguguuauaaucaugaugauacccacagucgucgcauuucaccucacgacgagaaacggggaaccucacaugauagucucacgucaagaaaagggcaaaagucuacuguuuaagacggaaaaugguguaaauauguguacacuaauggcuauggauuuaggagaacucugugaagauacaauaaccuacaauugcccgcuccuaagacaaaaugagccugaagauauugauuguuggugcaacucgacaucuaccuggguuacuuaugggaccugcacagcuacaggagaacacaggagagagaagagaucuguugcuuugguaccgcacgucgggaugggacuagagacuagaacugaaacauggaugucgagcgaaggagcauggaagcacgcgcaacguauugaaacuuggguguuaaggcauccugguuuuacgauuauggcggcgauacuagccuacaccauaggaacaacauauuuccaacguguucuuauuuucauucuauuaacggcgguagccccaucaaugacaaugcguugcauaggaauuagcaauagagacuuuguggagggcguaagugguggaucaugggucgauaucgucuuagagcaugguagcugcgugacgacaauggcuaagaauaaaccaacucuagacuuugaauugacuaaaacugaagcgaaacauccagcgacacuacgaaaauacuguauugaagcaaaauuaacaaauacaacuacggccucccguugccccacgcaaggagagccuucccugaacgaggaacaagacaaacgauuuguguguaaacauagcaugguggaucgagguuggggaaaugguuguggucuauucgguaaaggugguauagugacuugcgcuauguucacuugcaaaaaaaauauggaaggaaagguagugcaacccgaaaaucucgaauacacaauuguaauaacgccgcacucuggagaggagaaugcagugggaaaugacaccgguaaacacgguaaagaaauuaaaguaacaccgcaaagcagcauaacagaagcagagcuaacaggguacgguacugucaccauggaguguucaccuagaacgggauuagauuuuaaugaaaugguuuugcuacaaauggaggacaaagcauggcuuguccauaggcaaugguucuuagaucuuccccuaccuugguuaccuggagccgacacccaagguagcaacuggauccaaaaagaaacguuaguaacauuuaagaacccacaugcuaaaaagcaagauguaguagucuuagguucccaagagggggccaugcauacagcacuuacgggagcgacagaaauacaaaugagcucugguaauuuguuauuuacaggucacuugaaaugcagauuacguauggacaaacuacaauuaaaggguaugagcuacucuaugugcacggggaaauucaaaguaguaaaggaaauagcugaaacgcagcacgggacgauagugauacgaguacaauaugagggcgaugggaguccaugcaaaauaccuuuugagauaauggauuuggaaaaacggcacguauuagggcgguuaauuacagucaacccgauagugacagaaaaagacaguccaguuaauauagaggcagaaccacccuuuggugauucauauaucauaauuggagucgaaccaggucaacuaaaacugucuugguucaagaaagguucaaguauuggucaaauguuugaaacuaccaugcgaggugcuaaacgcauggcaauucucggcgauacagcuugggauuuugguagccuggguggaguguuuacuaguauaggaaaagcacuccaucagguguuuggggcuauauacggcgcugcauuuagcggcguuucauggacuaugaagaucuuaaucggaguuguuauuacauggaucggaaugaauaguaggucgaccagucuaagcguaucauugguauuaguuggagucguaacauuguacuuagguguuaugguccaagccgauagcgggugugugguuucguggaaaaauaaggagcuuaaauguggcuccgggauauuuaucaccgacaacguacauacguggacagaacaauacaaguuccagccugaaaguccaucgaagcuugcuagugcgauccaaaaagcacaugaagaaggaauuugcgguauuagguccguaacgcgacuugaaaaucucauguggaagcagaucacaccggaacuaaaccauauuuuaagcgaaaaugaaguaaaacuaaccaucaugaccggggauaucaaaggaaucaugcaggcuggaaaaagaagccuucguccacaaccgacagaauugaaguacaguuggaaagcauggggcaaagcgaaaaugcugucaaccgaauugcacaaccacacguucuuaaucgacgguccagagacugcggagugcccaaauacuaacagagccuggaacagcuuagagguugaggauuacggcuuugguguuuucacgacaaacauauggcugaaacuaaaagaaaggcaagauguguuuugugauaguaaauuaauguccgcugcuaucaaagacaacagggccguacacgcagauaugggauauuggaucgagagcgcacucaaugacaccuggaaaauagaaaaagcuaguuuuauagaagugaaaaguugccauuggccaaaaagccacacuuuguggucuaauggcgucuuagaaagugaaaugauuauuccuaaaaauuucgcuggccccgucagccaacauaauuauaggccaggauaccacacgcaaacagcaggaccauggcaucuaggaaaguuagaaauggacuuugacuuuugcgaagggacaacggucgucguaacagaggacugcggcaaucgaggcccuucacuuaggacaacaaccgccagcggcaaauugauaacggaaugguguugccgauccuguacuuuacccccauuaagguaucgaggugaagauggguguugguacggaauggaaauaagacccuuaaaagaaaaagaggaaaaccuugucaauucccuagugacagcugggcauggacaaaucgacaauuucagcuuaggcgucuuaggcauggcgcuuuuccucgaggaaaugcuuagaacucgcgugggaacaaaacacgcgauauuauuagucgccguaucuuucguuacgcuaauaacagggaauaugaguuuucgagauuugggaaggguaaugguaaugguuggagcuacaaugacagaugacauuggaaugggaguaacguaucuagcacuguuagcugcuuuuaaaguaaggcccacauucgcagcaggacuauuauuaagaaaacuuacgaguaaagaacuuaugaugaccacaauugguaucguauuauugucccaaagcacgauaccagaaacaauuuuggaguugacugaugcacuugcacugggaaugaugguccuaaaaauaguuagaaacauggaaaaauaucaauuagcaguaacaauuauggcgauccuaugugugccuaaugcaguuauucuacaaaaugcuuggaaagucaguuguacgauucuggcgguagugaguguaaguccuuuauugcucacgagcagucagcaaaaggcugauuggaucccauuagcucuaacuauuaagggucuaaacccgacagcaauauuuuuaacuacucuaagcagaacgucaaagaagagguccuggccacuaaacgaagcuauaauggccguuggaauggugucgauauuagcaucuucacuauuaaaaaacgauauaccaaugacagggccauuaguugccggaggguuacucacaguauguuauguacuuacugguagaucugcugaucuggagcuagaacgagcagccgacgugagaugggaagagcaagcggaaauuaguggcaguucucccauauuaucuauuacaauuucggaagauggaucaaugagcauaaaaaaugaagaagaagaacaaacuuugacaauacucauucguacaggcuugcuugucauaucagggcuguuuccagugaguauaccuauaacugcggcagcuugguaucuaugggaggucaaaaagcaaagagcggguguauugugggaugucccaucgccuccuccggucgggaaagcugaacuugaagacggggcguauagaauuaagcaaaagggaauauugggauacagccaaaucggagcaggaguauacaaggaaggaaccuuccacacuauguggcacguuacgagaggagcaguacuaaugcauaaaggcaagcguauagaaccauccugggcagauguaaagaaagaucugauuagcuaugggggaggcuggaagcuagaaggcgaauggaaagaaggugaagaaguccagguacuagcauuagagcccgggaaaaacccucgagcuguacagacaaaacccgggcuuuuuaaaacaaauaccggaacaauaggggcagucaguuuagauuuuucuccgggcaccucagguagcccaauagucgauaaaaaaggcaagguagugggucucuacggcaauggaguugucaccagaagcggcacuuacguaagcgcaauagcucaaacugaaaaaucuauagaagacaacccugaaauagaagaugauauuuuuaggaaaaaacgacucacaauaauggaccuacaucccggggcuggaaaaacaaaaagauacuuaccugcaauaguucgagaagcaauaaaaagggguuuacgcacucuuaucuuggcaccuacccguguaguugccgcugaaauggaagaagcucuacggggcuuaccuauaagguaucagacuccggcaauacgagcagaacauacagguagagaaauugucgaucuaaugugucacgccacauucacuaugagauuacucaguccaauuaggguucccaauuacaaucuaauaauuauggacgaagcacauuuuacagacccugcaucaauagcagcacggggauacaucucaacacguguggagaugggggaagccgcugguauauuuaugacagcaacucccccaggaucucgugauccuuucccgcagucaaacgcacccauaauggaugaagaaagagaaauuccugagcgaaguuggaacaguggacaugaaugggugacugacuucaaggguaaaacagucugguuuguuccaaguauaaaggcggguaacgacauagcugcaugucuucguaaaaacggcaagaaggugauacaacuaucucguaagaccuuugacagugaauauguaaaaacaagaaccaaugacugggauuuuguaguuacaacagacauuuccgagaugggugcaaauuucaaagcggagcgagucauugacccuagacgcuguaugaaaccagugauacuaacggauggagaagagagaguuauacuagcagggcccaugcccguaacccauaguucagcggcccaaaggagagggcgcguaggacgaaacccaaaaaaugaaaaugaucaguauauauauaugggagagccauuagaaaaugacgaggacugugcccauuggaaagaggccaaaaugcucuuggauaauauaaacacaccagaaggaauaauaccgaguauguuugagccagaaagggaaaaaguagaugcuauagacggagaauacagauugagaggagaggcacggaagacauucguagaccuaaugaggcggggcgauuuaccagucugguuagcauauagaguggcagcggaaggaauaaauuaugcugaccgacguugguguuucgacggagucaagaacaaucagauacuagaggaaaauguggagguugagauauggaccaaagagggggaacgaaagaaauuaaaaccuagguggcuggacgcacgaauauacucggauccacuagcgcuuaaagaauucaaggaauuugcggcagggagaaagagucucacccuaaaccuuauaacugagaugggccgacuuccgacuuucaugacucaaaaagcacguaacgcauuagauaauuuagcaguuuugcauacagcagaagcaggcggcagagccuauaaccaugccuuaagcgaguuaccugagacccuagaaacauugcuacucuuaacacuauuagcaacaguaacaggcgguauauuucucuuucucaugucgggaaagggcauaggaaaaaugacuuuaggaauguguugcauaauaacagcuaguguuuuacuaugguacgcccagauucagccgcacuggauugccgcauccauaauccuugaauuuuuucuaauaguauuacucauaccagaaccggaaaaacaaaggacgccccaggauaaccaacuuacuuacguugugauagcaauacuaacugucguugcugcgacuauggcaaacgaaauggguuucuuagaaaaaacaaagaaagacuucggcuuaggugguaucgcaacacaacaaccugaaucaaacauacuugauauagaucugagaccggcauccgccuggacauuauaugcuguggcaaccacauuuauaacgccuaugcuacgucauaguauugagaacucaucggucaaugugucuuugacagcaauagcaaaccaagcaacaguucuaaugggacugggaaaagguuggcccuugagcaaaauggauauugggguuccucuacuagcaauuggcugcuacagccaaguaaacccuauaacacuaacggcggcuuugcuacuacugguugcacauuaugccauaauagggccagguuugcaagcgaaagcaacucgagaagcacaaaaaagggcagcugcggguauuaugaaaaaucccaccgucgacggaauaacuguuauugauuuagacccaauaccauaugacccgaaauuugaaaaacagcuggggcaagucaugcuguuaguguuguguguaacgcagguucuaaugaugcgaacgacaugggcucuaugcgaagccuuaacauuagcuacugguccgauaucaaccuuaugggagggaaaccccggaagauucuggaacaccacgauugcgguaaguauggcaaauauauuuagagggaguuauuuagcaggggcugggcuacuauucaguauuaugaaaaacacagccaacaccagaaggggcacaggaaauacuggugaaacucuuggagaaaaauggaagaaucggcugaacgcacuuggaaaaucagaauuucaaauuuauaaaaaguccggcauacaggagguagaucguacuuuagcgaaagaaggaauuaagagaggcgaaacagaucaccaugccguuagucguggcagcgcaaaacuacgaugguuugucgaaagaaaccuaguuacuccugaaggaaaaguuauggauuuaggaugcggaaggggagguuggaguuauuauugcggugguuugaagaacguaaaagagguuaaaggacuaacaaaagggggacccgggcaugaggaaccgaucccuaugaguacauaugguuggaaccuaguacgacuucagucuggcguagacgucuuuuuuacuccaccagagaaaugcgauacauuguuaugugacauaggagaaagcucuccuaacccaacuguagaagcuggaagaacguuacgggugcuaaaucuuguugagaauugguuaaauaacaacacucaguucuguauaaaaguacuuaauccuuacaugccauccguuaucgagaaaauggaggcccuacaaagaaaguaugggggggcacuaguuagaaauccucuaucaaggaacuccacccaugaaauguauuggguaucaaaugcaaguggaaacauagucucuagugucaacaugauuaguagaauguuaauaaaucgauuuacaaugaggcauaagaaggccacauaugaaccggauguggacuuagguagcgguacccguaacauagggauugaaagugaaacaccaaaccuagauauaauagggaaacgcaucgaaaaaauaaaacaagaacacgagacaucauggcauuaugaucaggaccacccauauaaaacuugggcauaucaugguuccuaugaaacaaagcaaacgggcucagcuaguucaauggugaauggagugguucguuuauugacaaaacccugggaugugauaccaaugguaacucagauggcuaugaccgauaccacgccguuuggacaacaacggguauucaaagagaaaguagacacucggacucaagaacccaaagaaggaacuaaaaaauugaugaaaauaaccgcagaaugguuguggaaagaauuaggaaaaaaaaaaacgccaagaaugugcacacgagaagaauuuacccgaaaaguaagaaguaacgcugcacucggugcuauauuuacagaugaaaacaaauggaaaagcgcuagggaggcuguugaagacaguggauuuugggaguuggucgacaaagaacgcaaccuucaccuagaagguaaaugcgaaacauguguauacaauaugauggggaagcgggagaagaaacucggagaguuuggaaaagccaaggggucucgcgccauaugguauaugugguuaggagcgagauuucuugaguucgaagcgcuagguuuccuaaacgaagaucauugguucucgagggaaaauagucucagcgggguugaaggagaaggauuacacaaguugggguacauucugcgagacgucucaaaaaaggagggaggggcaauguacgcugaugauacugcaggaugggacacacguaucacuuuagaggaucuaaagaaugaagaaaugguuacgaaucauauggagggugaacacaaaaaauuagcagaagcaauuuuuaaacucacauaucagaauaagguuguccgaguccaaagaccgacaccuagggggacaguaauggacauaauaaguagaagagaucaaaggggaaguggacagguagugacuuacgguuuaaacacauucacaaauauggaagcccaauuaauccgacagauggaaggagaggggguauuuaagucuauacaacaauuaacagcaacugaggaaauagcuguuaagaauuggcuugcucggguugguagagaacgguuaucuagaauggcgauaucaggugacgauuguguugucaaaccacuagacgaucgauuugcauccgcuuugaccgcgcuaaaugauauggguaaaguuaggaaggauauccagcaaugggaaccuaguagaggguggaaugauuggacucaaguuccguucuguagccaucauuuucacgaacuaauuaugaaggacggaagaguacucguaguccccuguagaaaccaggaugagcucauaggaagagcgagaauaagccaaggugcagguuggagcuuacgagaaacagcaugucugggaaaaucauacgcucagauguggagccugauguacuuccauagaagagauuuacgucuugcagcuaaugcuaucugcuccgcagugccuagccauuggguuccaacaucgcgcacaacauggucaauccaugcaacccacgaauggaugacuaccgaagauauguugacugucuggaacagaguauggauacaggaaaauccauggauagaagacaaaacaccaguggaaagcugggaagaaaucccguaucuuggaaaaagagaggaccagugguguggaucacugauuggacugacuagcagggcaacgugggcuaagaacauacagaccgcaaucaaccagguucguucuuugauuggaaacgaagaguauacggacuacaugccuuccaugaaaagauuuaggagagaagaagaagaagcgggagugcuaugguaa

SEQ ID NO: 22965 - RNA, 9876 nt, Artificial Sequence
  derived and/or modified CDS sequence (opt6) from DENV-2__DQ645542__SS-prME
acagcuggaguuaucauaaugaugaucccaacaguaguggcauuccaccuaacaacucgaaauggugaaccgcauaugauuguuaguaggcaggaaaaaggaaaaucauuauuauucaaaaccgaaaacggcguaaauauguguacacuuauggcuauggacuugggugaauuaugcgaagacacuauaacuuacaacugcccucuauugagacagaaugaaccagaagauauagauugcugguguaacucgaccagcacaugggucacuuacggaacuugcacggcuacaggugaacaucgaagggagaaaagaaguguggccuuaguaccccauguaggcaugggauuagaaacgcgcacagaaacuuggaugagcucugaaggcgcauggaaacacgcgcagagaauagaaacauggguccugagacacccaggauucacaauuauggcagcaauuuuggcauauaccauaggaacaaccuauuuucaaagaguauuaauuuuuauacuauuaaccgcggucgcuccgaguaugacaaugcgaugcauugguaucucgaauagagauuucgucgaaggaguauccggaggguccuggguagauaucguguuagaacacgggagcugugugaccacgauggcuaaaaacaaaccgacccuagacuuugaacuaaccaaaacagaagcaaaacauccggcaaccuugaggaaauauugcauagaagccaaacuuacuaacacuacaacagcaagucgauguccaacucaaggugaacccagucuaaaugaagaacaagauaaacgauuugucuguaaacauagcaugguagauagaggguggggcaacgguuguggccuauuugggaaaggagggauagucacaugcgcgauguuuacauguaagaaaaacauggagggaaaagucguucagccggaaaaucuagaguauacuauaguaaucacgccgcauaguggagaggaaaacgcgguaggaaaugauaccgggaaacauggcaaagaaauuaaaguaacaccccagucaaguauaacagaagcggaacugacgggauauggcacaguuacgauggaguguagcccacgaacuggacuggacuucaaugaaauggugcuauuacaaauggaggauaaagcauggcuaguucauagacaaugguuuuuagacuuaccccugccgugguuacccggagcggauacccaaggcagcaacuggauacaaaaagaaacauuaguaacauuuaaaaacccgcaugcuaagaaacaggauguaguaguucucgggucacaggagggggccaugcacacugcuuuaacgggugcaacagaaauccaaaugucaucuggaaacuuauuauuuacgggucaccucaaauguagacuacgaauggauaagcuccaacuuaaagggaugaguuauucgaugugcacaggaaaauucaaaguuguaaaagaaauugcagagacucaacaugguacuauagucaucagaguucaauacgaaggugacggcucaccuugcaaaauuccauuugaaauuauggaccuagaaaaacggcacguacuagguaggcuaauaacagugaauccaauaguaacagaaaaggacucacccguaaauaucgaagccgaacccccuuuuggagauaguuauauaauuaucggagucgaaccaggccagcuuaaauugucaugguuuaagaaagguaguagcauaggacaaauguuugaaacgacaaugagaggggcaaagagaauggcgauauugggggacacagcuugggauuuugguucacucggugguguguuuacuucuauaggaaaggcauuacaucaaguguucggagcaauauacggcgcagcuuucucuggaguuaguuggacaaugaaaauauuaauaggagucguuaucaccuggauugggaugaacucaagaucgacaagccucagugugagccugguucucguagguguaguaacccuauauuugggcguuaugguacaggcagauucagguugcgucguuagcuggaaaaauaaggaacuaaaaugcgggucaggcauauucauaaccgacaacguacauaccuggacggagcaauacaaauuucagcccgaaucaccaaguaaacuagcgucagcaauacaaaaagcgcaugaagaaggaauaugugggauucguucaguaacaagauuagaaaaucuuauguggaaacaaaucacaccugaguuaaaucacauucuaucagagaacgaagucaaauuaacuauuaugacaggagauauuaaaggaauuaugcaagcuggaaaacguucauuaagaccccagccaaccgaguuaaaauacuccuggaaggcaugggguaaagcgaaaauguugucuaccgaacuacauaaucauaccuuuuugauagacggacccgaaaccgcugaaugcccaaauacuaaucgagcauggaacucauuggaggucgaagacuauggcuucgguguguuuacaacuaauauauggcucaaauugaaagaacgacaagaugucuucugugauucgaaacuaaugucugcugcgauuaaggauaacagagcaguacacgcagacaugggauacuggauagagagcgcccugaacgauacauggaagaucgaaaaagcgucguuuaucgaaguaaaaaguugucauuggccaaaaucgcauacucuauggucaaauggaguauuagaaucagagaugauuauuccaaagaauuuugcuggaccuguuucacaacacaauuauagaccaggcuaccauacacaaacagcaggacccuggcacuuaggcaaacuagaaauggacuucgauuuuugugaagguaccacaguugucguuaccgaggauuguggaaacagagguccaagccuaagaaccaccacugcaagcggcaagcucauuacggaaugguguuguagaaguuguacacugccaccauuaagauauagaggcgaagauggcugcugguacgguauggagauacgaccacuaaaagagaaagaggaaaaucuaguaaauucuuugguaaccgcaggucauggccaaauugauaauuuuagccuagguguacuagggauggcucucuucuuagaagagaugcugcgaaccaggguggggacaaaacacgccauacuauuaguggcugucagcuuugucacacuaauaacaggaaauaugagcuuuagggaucugggccgaguaauggucaugguaggagcaacaaugacggacgacauagguaugggggugaccuauuuggccuuauuagcggcauuuaagguucggccaaccuuugccgccgggcugcuauuaagaaaacuuacaagcaaagaacugaugaugacuacaaucgggauagucuuacuaucacaaucuacuauaccagaaacaauuuuggagcuaacugaugcacuagcuuuaggaaugaugguacuaaagaucgucagaaauauggaaaaguaucagcuagccguaacaauaauggcgaucuuaugcguucccaaugcaguaauauugcaaaacgcauggaaaguaagcuguacaauauuagcuguugucagcguaagucccuugcuacucacaagcagccagcagaaagcagacuggauucccuuggcauuaacaaucaaaggcuuaaacccuaccgcuauuuuucuuacuacacuuaguagaacuagcaaaaagaggagcuggccccuuaaugaggcgauaauggccgucggaaugguaucaauacucgcuucaagccuacucaaaaaugauauucccaugacagggccuuuagucgcugguggacuucuuacgguuuguuacgugcuaaccgguagauccgccgauuuagaguuggaacgagccgcugauguacgaugggaggaacaagcagaaaucagcggaagcaguccgauacucucgaucacaaucagcgaggacggauccaugucgaucaaaaaugaagaagaagaacaaacauugacuaucuuaauuagaaccggucuucuuguuauuagugggcuuuuucccgugaguauaccuauaacugcggcggcaugguaucugugggagguaaagaaacagagggcuggagugcuaugggacgugccgucgccaccuccaguuggaaaagcagagcucgaagacggagcauauagaauaaagcaaaagggaaucuuaggcuauagucagauuggggcaggggucuauaaagaaggaacauuucauacuauguggcacgugacuagaggugcaguucugaugcacaaaggaaaacgcauugaaccuucaugggcugacgugaagaaagauuuaaucaguuauggggguggcuggaaacuugaaggagaauggaaagaaggagaggaaguucaaguauuagcuuuagaaccaggcaaaaauccaagagccguucaaacuaaaccagguuuguuuaaaaccaauaccggaacuaucggggcuguguccuuagauuuuucacccggaacaucuggcaguccuauugucgacaagaaagguaaggugguagguuuauauggaaacggcguugugaccagaucaggaacauauguuucugcuauagcacaaaccgagaaaaguauugaagauaaucccgagauagaagaugauauauucaggaagaaaagacugacgaucauggauuugcacccuggagcaggaaaaacgaaaagauacuugcccgcaauaguccgagaggcaaucaaaagagggcuaagaacuuugauccuagcaccuaccagagugguggcugccgagauggaagaggccuuacggggccucccgauucgauaccaaacucccgcaauaagagccgagcacacaggcagggaaauaguugaucucaugugucaugcuacauucacgaugagacuucucucccccauuagaguuccaaacuauaauuugaucaucauggaugaggcccauuuuacagauccagcaagcauagccgccaggggcuacauaucuacuagaguagaaaugggagaggcagcugguauuuuuaugacagcaacaccuccagguucacgagauccguucccacaaucaaaugcacccauaauggacgaagaaagagaaauaccagaacgaucauggaacaguggccaugaauggguuacagacuucaaggguaagacuguaugguuuguaccaucaauaaaagccgggaaugauauagcagcuugcuugaggaagaacgguaagaaaguuauucaacuaucgcggaaaaccuucgauucagaguaugugaagacccgaacuaaugacugggauuucguaguaacaacugauauaagugaaaugggagccaauuuuaaagcagaaaggguaauugaccccagacguuguaugaaaccaguaauucuaacagauggagaggaaaggguuauacuagccggaccaaugcccguaacccauuccuccgcagcacaaagacguggacgaguaggucguaaccccaaaaaugagaacgaucaauauauauauaugggagaaccacucgaaaacgaugaagauugcgcgcauuggaaggaggcuaaaauguuacuagacaacauaaacaccccggaaggcauaauaccuucaauguucgaaccugaacgagaaaaaguagaugcaaucgauggggaauaccgacuucguggugaagcacggaaaacauuuguggacuugaugcgacgcggagauuugccaguauggcuggcauauaggguugcugcugaagguaucaauuacgccgacagacgguggugcuuugacggaguaaagaauaaucagauacuugaggagaauguagaaguagaaauauggacuaaagagggagaaagaaagaaauuaaaaccaagauggcuugaugcaaggauauauucugauccauuggcauuaaaagaauuuaaagaauuugcggcaggccggaaaaguuuaacauugaaccuaauaaccgaaaugggaagacugccaacuuuuaugacacaaaaagcuagaaaugcacuagauaaccuugccguauuacauacagcagaagcagggggccgcgcuuauaaccacgcucucagugaacuaccugaaaccuuagaaacucuccuauuacuaacguuauuggcaacagucacugguggaaucuuuuuauuccuaaugucuggcaaaggaauagguaaaaugacacuaggcaugugcugcaucauuacugcuucaguucuacuaugguaugcacagauacaaccacacuggauagcagcauccaucauuuuagaguucuuucuaauaguauuacuaauuccagaaccggaaaaacaacgaacuccacaagacaaucaacuuacauaugucgucauagcaauacugacuguaguugcagcuacaauggcgaaugaaaugggauuccucgagaaaacuaagaaagacuuugggcuagggggaauugcgacacaacaaccagaaucaaacauauuagauaucgauuuacgaccugcaucagccuggacccucuacgcuguagcaacuacguuuaucacaccuaugcuacgacauaguaucgaaaauagcagugucaauguuucgcuuacagccaucgcaaaucaggccacuguacucaugggacuugguaaaggauggccgcuaaguaaaauggacauaggaguuccacuccuugcgauagggugcuauucacaggucaauccgauaaccuuaacagccgcccuuuuauuauuaguagcacauuaugcuauaauagggccaggucugcaagccaaagcaacaagagaagcgcagaagcgugcugccgccggaauaaugaagaauccaacaguggauggaaucacuguuauagauuuagacccuauaccguacgauccaaaauuugagaaacagcucggucaaguaaugcugcuaguccuauguguaacccaaguacuuaugaugcgaacuacaugggcacuuugugaagcauuaacauuggcaaccggaccaauuucaacauuaugggaagggaaucccggaagguuuuggaauaccacgauugcuguaucgauggcaaacauuuuuagagguucauaucuggcaggagcaggacugcuauucaguaucaugaagaacacugcaaauacaagaagaggaacgggcaacaccggagagacauuaggcgaaaaauggaaaaaucgacuuaacgcauuggguaaaucugaguuccaaauauacaagaaaagcggcauacaagagguagacagaacgcuagcgaaggaaggaauaaaaagaggcgagacggaccaucacgcaguuagucguggcagugcuaaacuuaggugguuugucgaacggaaucuuguaacuccggaaggaaagguaauggauuuaggcuguggucgcggaggauggucuuauuacugcgguggacugaagaacguaaaggagguaaagggauugacaaaagguggccccggucaugaggaaccuauuccaaugucgacauauggguggaaccuaguaagauuacaaucaggaguagacguauucuuuacaccaccugagaagugcgacacacuguuaugcgauaucggugagucgucuccaaauccaacagucgaagcaggacgaacauugcgaguuuuaaaucuaguagagaauugguuaaacaacaacacgcaguuuuguauaaaaguauugaauccuuacaugccuuccguaauagagaaaauggaagcauuacaacgaaaauacgguggagccuuaguaagaaauccucuaagcagaaacucuacccacgaaauguacuggguaagcaaugcaucgggcaacauaguuucaucgguuaacaugauuagccgaaugcuaauaaacagauucacuaugcggcauaaaaaggccacuuaugaacccgauguggauuuagguucagguacacgaaacauagggauagaaagugaaauaccaaaucucgauaucauagguaagagaauugagaaaauaaaacaagaacaugaaacaaguuggcauuaugaucaagaucaccccuauaaaacuugggcauaucaugguucguaugaaacaaaacaaacagggucggcaucaucuauggucaacggaguaguacgacuauuaacuaaaccaugggacguaauuccgaugguuacgcagauggcuaugacugacacuacacccuucgggcaacagcgaguauuuaaagaaaagguugacacgcgaacccaggagccaaaagaagggacuaagaaauuaaugaaaauaacugcggaauggcuguggaaggaacucgggaagaagaaaaccccucggauguguacgagagaagaguucacucguaaagugcguuccaaugcagcgcuaggagcgauauucacagaugaaaauaaauggaaaucagcacgagaggcaguugaagacucaggauucugggagcuagucgauaaggaaagaaacuuacaucuugaaggaaaaugcgaaacguguguuuauaauaugauggggaagagagagaagaaauuaggugaauuuggaaaagccaaaggaucuagagcuauuugguacauguggcucggagcucgauuccuugaguucgaagcucucggguucuugaacgaggaucauugguucagcagagagaauaguuugucuggaguagaaggcgagggauugcauaaguuaggauauauacucagagauguaagcaaaaaggagggcggggcuauguaugcagaugacacagcagguugggacacucguauaacccuagaagaccucaaaaacgaagaaaugguaacaaaucacauggaaggagaacauaagaaacuagcagaggcgauuuuuaaguuaacauaccaaaacaaaguuguuagaguccagaggcccaccccacgcgggacuguuauggauaucauuucucgcagggaucaaaggggaaguggacaaguaguaacuuacggucuaaacacguucaccaacauggaagcacaauuaauccgacaaauggaaggggaaggaguuuuuaaaucgauccaacaauuaaccgcaacugaagaaauagccguuaaaaauugguuagcuagagugggucgcgagagacuaucucgaauggccauuagcggcgacgauugcguaguaaaaccguuggacgacagauuugcgagugcacuaacagcacuuaaugacaugggaaaagucagaaaagauauacaacaaugggaaccuucaagaggguggaaugauuggacucaaguaccauuuuguagucaucauuuccacgagcuuauaaugaaggacggaagaguucucguuguuccuugucggaaccaagacgaacuuauugggagagcacgcaucucucaaggggcuggauggucauuaagggaaacugcaugccuggguaagucuuacgcucaaauguggucgcuaauguacuuccaucggagagacuuaagacuagcagccaaugcgauaugcagcgcuguccccucgcauuggguucccaccucaaggacuacauggagcauacacgccacacaugaguggaugacaacugaagacauguuaacaguuuggaauagaguuuggauacaagaaaacccauggauugaggauaaaacgccgguugaaagcugggaggagaucccguauuuagguaaacgugaagaucagugguguggcagcuugauagguuuaacaucgcgggcuacaugggcuaaaaauauccaaacagcaauaaaccaaguccguucucuaauaggcaacgaagaauacacugacuauaugcccaguaugaaaagauuuagacgcgaagaagaagaagcugguguccuaugguag

SEQ ID NO: 22966 - RNA, 9876 nt, Artificial Sequence
  derived and/or modified CDS sequence (opt6) from DENV-2__AY702036__SS-prME
acugcaggaguaauugugaugcuaauaccuacugcgauggcauuucaucuuacgacuagaaauggugaaccacauaugauaguaggccgacaagaaaaaggaaaaagucuauuauuuaaaacagaagauggggugaauaugugcacgcuaauggcaauugaucuaggcgaacugugcgaagacacuauaacauacaaaugcccuuuguuacggcagaaugaacccgaagauauagauuguugguguaauucuacuuccacguggguuacguacgguacauguacaacaacgggugaacacaggagagaaaaacguucuguagcuuuagugccccauguagggaugggauuagaaacaagaacugaaacguggaugucgucugaaggggcguggaaacacguucaaagaauagaaacauggauauuacgacauccggguuucacaauaauggcagcuauccucgcguacaccauuggaacuacucacuuccagagagcgcuuauauucauauuacugacagcgguagcaccguccaugacaaugcgauguauagggauuuccaauagagacuuuguagaaggaguaucggguggaucauggguggauaucguacuagaacauggaaguuguguaacaacuauggcuaaaaauaaaccaacguuggauuuugaauuaauaaaaacugaagcaaaacaacccgcaacacuacgcaaauauuguaucgaagcaaaacuaacuaacacuacaacagaaagcagaugcccuacccaaggugaaccaucguugaaugaagaacaggacaaaagauuuauaugcaaacauuccaugguggacagagguugggguaacggauguggauuauuuggaaaagggggcauuguuacgugugcaauguucaccuguaagaaaaauauggaagggaaagucgugcaaccugaaaauuuagaauauacuauugugauuacaccgcacaguggggaagaacacgcagugggcaaugauacuggcaaacaugguaaagaaauaaaaaucacaccacagucaucgauaacagaagcagaauuaacuggauaugguacaguaacuauggaauguucaccgaggacaggucuggauuuuaacgaaaugguacuauugcagauggaagacaaagcguggcucguacaucggcaaugguuucuugaccuuccucugccaugguuaccaggggcugacacgcagggcucaaacuggauacagaaagaaacgcugguuacuuuuaaaaauccucacgccaagaaacaggacguuguaguccuagggagucaggaaggcgccaugcauaccgccuuaacaggagcuacggaaauccaaaugucuagcggaaacuuacuguucacuggucauuuaaaaugcagacuuagaauggacaaauuacaacuuaaagguauguccuauucaaugugcacgggaaaauuuaaaauuguuaaagaaauugccgaaacccaacacgguacaaucgucauaagggugcaauaugaaggagacggaucgccguguaagaucccuuuugaaaucacagacuuggaaaaacgacauguauuaggccgguuaauaaccguuaaucccauaguaacagaaaaagauaguccugucaauaucgaagcagaaccaccuuucggggauucuuacauaauuauugggguagaacccggacaacuaaaacuaaauugguuuaagaaaggaucaaguaucgggcaaauguucgagaccacgaugagaggugcuaaaagaauggcaauauugggagauacugcaugggacuucggaucuuuaggaggugucuucacgucaaucgguaaggcucuacaccaggucuuuggagcuauauacggcgcagcuuuuucagggguuucguggacaaugaaaauacugauaggugucauuaucacauggauaggaaugaauagccguaguacgucacuaucuguaucucucguacuuguaggcgucguaacccuuuaucuuggagcgauggugcaagcggauucaggguguguuguauccuggaaaaacaaagaacuaaaguguggaucagggauuuucauuacugacaacguccauacguggacagaacaauauaaguuucaaccagagagcccuucuaagcuagcuagcgccauccaaaaagcucacgaagaagguauuugcgggauucggagcgucacccgauuggaaaacuuaauguggaagcaaauaacuccugaacugaaucacauauugucugagaaugaggugaaauuaacaauuaugacaggcgauauaaaaggcauaaugcaagcaggcaaaagaucccuacggccacaaccaacagagcucaaguacaguuggaaaacguggggcaaagcuaagauguuaaguacugaaucccacaaccaaacauuuuugaucgauggaccggaaacggcugaaugcccaaauacgaaccgagcauggaacucucuugagguugaggacuacggcuuuggaguguuuucaacaaauaucuggcuuaaauuaagagaaaagcaggauguauuuugugacaguaaauuaaugucggcagcgauuaaggauaaucgcgcuguacacgccgacauggguuauuggauagaaagugcgcuaaacgauacauggaaaauggaaaaagccucuuuuauagaaguaaaaucaugucauuggccaaagucucacaccuuauggagcaaugguguucuagaaagcgaaaugauuauucccaaaaacuuugcaggcccuguaucacagcauaacuauaggccaggguaucauacgcaaacagcugguccauggcauuuggguaaauuagagauggacuuugauuuuugugaagguaccacuguuguaguaacagaagauugcgguaaccggggucccagucuccgcaccaccacagcgaguggcaaguuaauaacagaaugguguugucggagcuguacccucccaccacugagguaucggggagaagauggaugcugguacggcauggaaauaaggccucuaaaagaaaaggaagaaaaucuaguuaauuccuuaguuacagcgggccauggucagauugacaacuuuaguuugggcguacuaggaauggcuuuguuccuagaagagauguugagaacgagaguaggaacuaaacacgcuauccuucuuguagcagucucuuucgucacacugauuacaggaaacaugucguuucgagaucuuggccgagugaugguaaugguaggcgcgacaaugacagacgauauagguauggguguaacauacuuagcccugcuggcggcguuuaaaguucgacccacuuucgcagcaggauuacuauuacggaaauuaacaaguaaggaguugaugauggcaacaauagggauagcuuugcugucacaaucuacaaugcccgaaacaauauuggagcuuacagaugcauuagcgcuagguaugaugguacugaaaauugugcggaauauggagaaauaucaacuugcagugacaauaauggcuauaagcuguguaccuaaugcuguaauacuacagaaugcauggaaaguaucauguacaauacuggcggcuguaucuguuuccccucuguuauuaacaaguucgcaacaaaaagcggacuggauaccccuugcacuuacuauaaaaggucuaaacccaacagcaauauuucuaacaacuuuaucccgcacuucuaagaaacguaguuggccucuaaacgaagcaauaauggccguugguaugguuagcauacuugccucgucacuucugaaaaaugauauuccaaugacugguccucuuguagcgggagguuuauuaacaguuuguuauguuuugacugggaggucugcagaccuugagcucgaacgugcagcggacguuaaaugggaagaucaagcagaaauaucggguucgaguccaauuuuaucaauuaccauaagcgaggauggcagcaugagcaucaaaaacgaagaagaagaacagacguugacaauauugauacgaacggggcuauuaguaauaaguggcguauucccaguuagcauuccaauuaccgcggcugcaugguaucuaugggaaguaaagaaacaaagagcggguguauuaugggacguucccaguccgccgccgguaggaaaggcugagcuggaggacggggccuaucguauaaagcaaaggggaauuuuaggguauucacagauuggagcgggaguauauaaagaggggacuuuccacacuauguggcauguaacaaggggugcugugcucaugcauaggggaaagcggauugaaccuucaugggcugaugucaagaaagaucuaauuaguuacggagggggauggaagcuagaaggagaauggaaagagggcgaagaagugcaggucuuagcacuugaaccaggcaaaaauccgagagcuguccaaaccaaacccggaauauucaaaacuaacacagguacuauaggagcgguuucauuagacuucucaccggguaccaguggaucuccuauaguugaucgaaagggaaaaguaguaggacuauauggcaacggugugguuacccgcucaggagccuauguuagugcaauagcgcaaacagaaaaaucuauugaagauaacccagagaucgaagaugauauauuccggaaaaagagauuaaccaucauggaccuccacccaggcgcuggaaaaaccaaacgcuaucugccagcgauagugcgcgaagcaauaaaucgaggacuaagaacucugauuuuagcaccuacuagaguaguagccgccgaaauggaagaagcccuccguggucucccaaucagauaucaaacuccugcaauuagagccgaacacacagguagagaaauagucgaucuaaugugucacgcgacuuuuacuaugagauuacuuucccccguacguguaccaaacuauaacuugauuaucauggaugaagcucacuuuaccgacccagcauccauagcugcaaggggauacauaaguaccagaguugaaaugggcgaagcagcagguauauuuaugaccgcgacuccacccgggucaagagacccguucccucaaucuaaugcuccuauuauggaugaagaaagagagauuccagaacgaucuuggaacucggggcacgaauggguaacagacuucaaagggaagaccguaugguuuguaccgagcaucaaagcggggaacgauauagccgcaugcuuaaggaaaaaugggaagaaaguaauacaacuaaguaggaagacauuugacucagaauauguaaaaacaagagcaaacgauugggauuuuguaguaacgacagauauaagugaaaugggcgcaaacuucaaagcugaaagaguuauagauccgcgcagaugcaugaaacccguaauuuugacagauggagaggagcgagucauuuuagcaggaccaaugccugucacacacucuagugcagcacaacgccgaggucggauaggacgaaaucccaaaaaugaaaaugaucaauacaucuacaugggcgaaccauuagaaaacgacgaggauugugcacacuggaaggaagccaaaaugcuuuuagauaauauuaacacaccagaagguauaauaccaucuauguuugaaccugaacgugagaaagucgacgcaauagacggcgaguauagacuccgaggugaggcaagaaaaacauuuguagaucuuaugagacgaggcgacuuaccuguauggcuagcauacaaggucgcagcggaaggaauaaauuaugcugacagaaaauggugcuucgauggcaucaaaaauaaccaaauauuagaagagaacgucgaggucgaaauauggacaaaagagggagaacgaaagaaacuuaagccaagaugguuagaugcucggauauauucugacccauuagcucuaaaagaguucaaggaauuugcagccgggagaaaguccuuaacccuuaaucuuauuacagaaauggguagguuaccuacauuuaugacccaaaaggcuaggaaugcucuggauaaucuagcugugcuacauacagcggaagcgggagggagagcguauaaucaugcauugucagaguugccugaaacuuuagaaacucuguugcuauugacuuuguuagcaaccguaacaggugggauuuuccucuucuugauguccggaaaagguaucggcaaaaugacauuagguaugugcuguauuauuacagcuucgucucuauuaugguaugcacagauacaaccacacuggaucgcagccagcauuauacuagaguucuuccuuauaguguuauuaauuccggaacccgaaaaacaaagaacaccacaggacaaucaacuaacauacgucguuauagcgauauuaaccgugguugcggccacgauggcuaaugagaugggauuuuuagagaaaaccaagaaagauuugggccuaggauccauaacaacacaagaaagugaaagcaauauacuugauauagaccuaaggccagcuagugcuuggacauuauacgcgguagcaacuacauucguaacgccgauguugcgacauaguauagaaaacagcuccguuaacguuucauuaacagcgauugcaaaccaagcaacaguuuuaaugggauuaggaaaaggcuggccacuaucaaaaauggauauagggguccccuuauuggcaauuggcuguuauucucaagugaacccaauuacgcuuacugcagcucugcuacuauuaguggcccauuacgcuauaauaggaccuggacuacaggccaaggcaacgagggaagcucagaagagagcagcagcagguauaaugaaaaacccuacuguagacggaauuacagucauagauuuagaaccgauacccuacgauccaaaguuugaaaaacagcuuggacaaguuauguuacugauauuaugugugacacaaguucuaaugaugagaacaacaugggcacucugcgaagcccucacacucgcaacuggucccauuucaacuuugugggaaggaaacccaggccgauucuggaacacaaccaucgcaguuucuauggcaaauaucuuuaggggaucguauuuagccggagcgggguuacucuuuaguauaaugaagaauacgaccaauacaagaagaggaacagguaacaucggggaaacacuuggagaaaaauggaaaaguagauuaaaugcauugggcaaaucugaguuucaaauauacaagaaauccgguauacaagagguagauaggacccuagcuaaagaaggcauaaaaagaggagagacagaccaccacgcuguuagucguggaagugcaaaacugaggugguucguugaacguaauaugguuacaccugaaggcaaaguaguugaucuagggugcggaagaggaggaugguccuauuauuguggaggguugaagaauguccgcgaaguaaaaggucuaacuaaaggagggccuggacaugaggaaccaauaccaaugucaaccuaugguuggaauuuaguaagauuacaaucggguguggauguuuucuuuacgccucccgaaaagugcgauacacuauuaugugacaucggagagaguuccccaaaucccaccauugaagcgggaaggacacuaaggguauugaaccuuguagaaaacuggcuaaauaacaauacacaauuuuguauuaaaguuuuaaacccuuauaugcccucaguaauugagaaaauggagacgcuacaaagaaaguauggaggcgcucuagugcggaauccccuaucacguaauagcacacaugaaauguacugggugaguaacgcaacagggaacauaguuagcucgguaaauaugauuuccagaauguugauuaacagauuuacuaugaaacauaagaaagcaaccuaugaaccggacguagauuuaggaucagggacgcgaaauauuggcauagaaucugaaauuccaaaccuugacauuaucgguaaacgaauagagaaaauuaagcaagaacaugagacuucauggcauuaugaccaagaucacccuuacaaaacaugggcuuaucacggaagcuacgaaaccaaacaaacggguagugcgucaucaauggucaacggagucguuagacuucuaaccaagccaugggaugucguuccuaugguaacccagauggcuaugaccgacacaacccccuucggucaacaaagagucuuuaaggagaagguagacacgaggacacaagaacccaaagaaggaacuaagaaacuaaugaaaauaacugcugagugguuauggaaagagcuaggcaaaaagaaaacaccacguaugugcacacgggaagaguucacucguaagguaaggucgaacgcugcgcuaggagcaauauuuacagacgaaaacaaauggaaaagugccagagaagcaguagaagacggacgauucugggaauuaguugaucgagaaagaaaucuucaucuagaaggaaaaugcgaaacuuguguauacaacaugaugggaaaaagagaaaagaaguuaggcgaguucggaaaagccaaaggcucgagggccaucugguauauguggcucggagcuagauucuuagaguucgaagcccuugguuuucuaaaugaagaucauugguucaguagggguaacucgcuaucagguguugaaggagaaggauugcauaggcucggcuacauccucagagagguaggaaagaaagaaggaggagcgauguaugcugacgauacugcaggaugggauacuagaauaaccuuagaagaucucaaaaaugaagaaaugguaacaaaucacaugaaaggagaacauaagaaauuagcagaagcuauuuuuaaacuuacauaccaaaacaaagucguacgaguucaacggccuacuccucgagguacaguuauggauauaauuucuaggagagaccaacgcggaaguggccaaguaggcacguauggacuaaacacauucacuaacauggaagcacaacucauuaggcaaauggaaggggaagggauuuuuaaaaguauccaacacuuaacugcaaccgaagaaauagcuguacaaaauuggcuugcccgaguaggcagggaacgacuaucaagaauggcgauuuccggugaugauugcguaguaaaaccaauugaugaccgcuucgccagugcauuaaccgcucuuaacgauaugggaaaaguuagaaaagacauccaacaaugggaaccaucucgugguuggaaugauuggacacaaguaccguucuguucacaucauuuccaugaauuaguuaugaaggacggacgaguacuuguggugcccugcaggaaucaagaugaauuaauugggcgcgcaagaauaucacaaggcgcuggguggucucucaaagaaacugccugccucgggaaaucauacgcccaaauguggaccuuaauguacuuccaccguagagauuuaagacucgcugcaaaugccauauguuccgcagucccaagucauuggguaccaaccagccgcacaacaugguccauacaugcuaaacacgaauggaugacuacagaggauaugcuggcaguuuggaaucgaguauggauccaagaaaauccauggauggaggacaaaacuccgguagaaucuugggaagaaguaccauaccucgggaaacgugaagaucaauggugugguaguuugauaggucugacgagcagagcaacuugggccaaaaauauacagaccgccauaaaccaaguaagaucccucauagggaaugaggaauauacagauuacaugccuucaaugaaaagguuccgacgugaagaagaggaggccggugucuuaugguaa

SEQ ID NO: 22967 - RNA, 9876 nt, Artificial Sequence
  derived and/or modified CDS sequence (opt6) from DENV-2__AY702034__SS-prME
acugccggcguaauagugauguugauuccuacagcgauggcauuucacuugaccacccgaaauggagaaccgcauaugauagucggacgucaagagaaaggcaaauccuugcuuuuuaaaacagaagauggaguaaacauguguacauuaauggcuauagaccugggggaacuuugcgaagacacuauuaccuacaaauguccauuacuuagacaaaaugaaccggaagauauagacugcugguguaacagcaccucuacgugggugacauacgguaccugcacgacuacaggagaacaucgaagagagaaaagaucugucgcccuaguaccccacguaggcauggggcuagaaacuagaacggaaacuuggaugucaucagagggugcauggaaacauguccaaaggauugaaacauggauucuaagacaucccgguuucacaaucauggcugcgauccuagcguacacaauagggacaacccauuuccagagagcacuuauuuucauauuguuaacggcgguugcacccagcaugacaaugagaugcauugggauaaguaauagagacuuuguggagggaguaucaggugggagcuggguagauauaguacuagagcacggcaguugugucacaacuauggcuaaaaauaaaccuacacuagauuuugaguuaaucaaaacggaagcuaaacagccagccacauuaaggaaauauugcauagaggcgaaacucacaaauacaaccacagagagcagauguccuacacagggugaaccgagccuuaaugaggaacaagacaaaagguuuauuuguaaacacaguaugguugacagaggauggggcaacggaugcggauuguucggaaaagggggaauagucacaugugcaauguuuacgugcaaaaaaaacauggaaggaaaaguggugcagccagagaaucuugaauacacaauaguaauaacaccacauucaggagaagaacaugcuguaggaaacgauacugguaagcacgggaaggagauaaagauuacaccacaaucuagcauaacggaagcggagcuaacggguuacggaaccguuacaauggaaugcucuccacguacugggcuagacuuuaaugagaugguucuccuucagauggaagauaaagcgugguugguacaccgccaaugguucuuagaucugcccuuaccauggcugccaggugccgauacacaagguaguaauuggauccaaaaggaaacucugguuacauucaaaaauccacaugcuaaaaaacaagacguugucguacuaggaucacaagagggagccaugcacacugcucugacaggcgccacagaaauacaaaugaguucugguaacuugcuuuuuacagggcauuuaaaauguagauugagaauggauaaacuucaacuaaaagguaugagcuacagcauguguacugggaaauucaaaauaguaaaagaaauagccgaaacgcaacaugguacuauagugauucgcguacaauacgaaggggacggaucaccuugcaaaauuccauuugaaauaacagaucuugagaagaggcauguauuagggagacuaaucacuguuaauccaauaguuacagaaaaagauuccccaguaaauauagaagcagagccuccguucggcgacucguauauaauaaucggcguggagccuggucaacuaaagcuaaauugguuuaaaaaagggaguucgauaggccagauguuugaaacuacaaugaggggagcgaagcgcauggcaauacuaggagacacagccugggacuucggcagcuuagggggaguuuuuacgucuauaggaaaagcgcugcaucaaguuuucggcgcaauauacggagcugccuucucggggguaucguggaccaugaaaauccuuauaggugucauaauuacuuggauagggaugaauagccgcucaacaucgcuuucaguaucccugguauuaguggguguaguaaccuuauaucugggggcaaugguccaagcagacagcggauguguaguuagcuggaaaaauaaggaauuaaagugugggaguggaauauuuaucacagacaacguacacacuuggacagaacaauacaaauuucaaccggaaucuccaagcaaacuugcuagugcgauucaaaaagcgcacgaggaggggaucugcgggauuagaagugugacucgccuugagaauuuaauguggaagcaaauuaccccagaacuuaaucacauacuaucugaaaaugagguaaagcuuaccaucaugacaggggauaucaaaggcauuaugcaggcaggcaaacgaagucuucgaccacagccaacggaguuaaaauacucuuggaagacgugggggaaggcaaaaauguugucaacggaaagccacaaccaaacauuuuugaucgacggaccagagacugcugaauguccaaauacaaauagagcauggaacucccuagagguggaagacuauggauuuggagucuucacuaccaacauuuggcucaagcugcgugagaagcaagacguauuuugcgauaguaaacuaaugucggcagcgauaaaagauaaucgugcuguacaugccgauaugggauacuggauugaaucggcacuuaacgacaccuggaaaauggaaaaagcgucauucauagagguuaagucgugucacuggccuaaaucacacacacuguggucaaauggggucuuagaaagugaaaugauaauaccaaaaaauuucgcaggaccugucucacaacauaacuauagaccaggguaccacacucaaacugcaggacccuggcaucuuggaaaacucgaaauggauuuugauuucugugaagggaccacuguuguuguaacugaggacugugguaauagggguccgagccuccggacgacaacggccucugguaagcuaauaacagaauggugcuguagaaguuguacucugccaccucuaagguauagaggggaagauggaugcugguauggaauggagauacggcccuuaaaggagaaagaagaaaaucuugugaauaguuugguaacugcuggccauggacaaauagacaauuucagucugggcguucugggaauggcucuuuuucucgaagagauguuacguacccgagugggaacgaagcaugcaauacuauuagucgcagugaguuuuguaacccugauaacuggcaauaugagcuuucgggaucuugguagaguaauggugauggugggagcuacuaugacugacgacauagguaugggugugacauaccucgcuuuacuagcggcauuuaagguuagacccacauucgcagcagguuuacuauugagaaaauugacuaguaaggaauuaaugauggcaacaauaggaauagcacuacucucacagagcacgaugcccgagacuauccuggaacucacagaugcacucgcacugggaaugaugguucugaaaauagucagaaacauggaaaaguaccaacuagccguaacaaucauggcaauuuccugcguaccaaacgcuguuauucuucaaaaugcuuggaagguaagcugcacuauucuagcagcugugucagugagcccauugcugcucacaagcucacaacagaaagcugacuggauaccauuagccuugacaauaaagggccuaaauccaaccgcuaucuuccuaacaacuuuaaguagaacaucgaaaaagcggagcuggccauuaaaugaagcgauaauggcgguugggaugguuucaauacuugcuuccaguuuguuaaaaaaugauauaccaaugaccgggccauuaguggcuggggguuuacuaaccguuugcuauguacucacaggcagaagugccgaccuagaacuugagagggcagcagauguaaaaugggaagaucaagcugaaauaagugggaguagcccgauauuaaguauaacaauaucagaagauggaagcaugaguauaaaaaaugaggaagaagaacagacauuaacuauauugauucguacuggccuguuaguaauaucaggaguauuuccagugaguauaccgauuacggcugcagcuugguacuuaugggaaguaaaaaaacaacgcgcagggguccuaugggauguaccgucuccuccaccagucggaaaagcagagcuugaagauggugcguauagaauaaaacaaaggggcauauuaggauacagucaaauaggcgcuggaguuuauaaagagggcacguuucacacaauguggcauguaacaagaggugcaguucuaaugcaucgugguaaaagaauagagccuucgugggccgacguuaagaaagauuuaauaagcuaugguggaggguggaaacuagaaggcgaguggaaggaaggugaagaaguacaagugcuagcguuagaaccaggcaagaauccuagagcagugcaaacuaaaccggguauuuucaaaacaaacacgggaacaauaggugcagucucguuagauuuuucuccuggaaccucaggaucgccaauagucgauaggaaaggaaaaguagucggauuauaugggaauggugugguaacuagaucaggcgcuuauguuucugcaauugcacaaacagaaaagucaauugaagauaacccugaaauagaagaugauaucuuccguaagaaaaggcuaacaaucauggauuuacauccgggggcggguaaaaccaagcgauauuuaccagccauagucagagaagcuauuaaucggggucugagaacacuaauucuggcgccaacgcggguaguugccgcugaaauggaagaagcccuuagaggccugcccauacguuaccaaacgccugcuauccgagcagaacacaccgggcgugaaauugucgauuuaaugugucaugcuacauucacgaugcgauuacuaagucccguccguguuccuaauuauaauuuaaucaucauggaugaggcacauuuuacggauccagccucaauagccgcgcgaggauauauauccacccgcguagaaaugggugaagccgcuggaauauucaugacagcgacuccuccugggagccgugauccauuuccacaaucuaacgcuccgauuauggaugaggagcgugaaauaccggagcguucguggaacucuggacaugaauggguuacugacuucaaagggaaaacaguaugguuuguucccaguauuaaagcaggcaaugauauugccgcaugcuugagaaaaaacggaaaaaaaguaauacaauugucacgaaaaacauucgacagugaauaugucaaaacacgggcaaaugauugggauuuugucgucacgacagacauuucugaaaugggggcuaacuucaaagcagaaagagucauugauccaaggcguugcaugaagccagucauauuaacagacggagaagaaagagugaucuuagcaggucccaugcccgucacacacucaagugcagcgcaacgcagaggacgcauagggagaaauccuaaaaacgaaaacgaucaauacauuuauaugggagaaccacucgaaaacgaugaagauugcgcccauuggaaggaagcgaaaaugcuguuggauaauauaaauacgccugaaggaaucauuccaucaauguucgaaccugaaagggaaaaaguugaugcgaucgacggcgaauaccgucuaaggggagaagcucggaaaacguuuguggaccucaugagaaggggagaccuucccguauggcuagcauauaaaguagcagcagaagggaucaacuaugcagacagaaaauggugcuuugacggaauaaaaaauaaccagauauuagaagaaaauguugaaguagaaaucuggacaaaggaaggugaacggaaaaaauuaaagccaagauggcuugacgcccggauauauucggauccuuuagcacuuaaagaauucaaagaguucgcagcaggccguaaaucgcuuacacuuaaucucauaacggaaauggggagacuacccacguucaugacacaaaaggccagaaacgccuuagacaaccucgcaguuuugcacacagcagaggcuggcggcagggcauauaaucaugcacuaucagaacucccagaaacacuagagacuuuacuucuacugacacucuuagcuacaguuacaggugguauuuuccuauucuugaugagugguaagggaauaggaaagaugacacuagguaugugcugcaucauaacggcaucaaguuuguugugguaugcccaaauacagccccauuggaucgcugcuaguauuauauuggaauuuuuccuuauaguauugcugauacccgaacccgaaaagcaacgaacuccacaagauaaccaguuaacguauguuguuaucgcaauauuaacagucguagcggcgacuauggcaaaugaaaugggauuccuugaaaaaacaaaaaaagaucuaggacucgggaguauuacuacccaagaauccgaaaguaauauacuggacaucgaucuaagaccagcaucagccuggacauuauaugccguagcuacaacauucguuacaccuaugcugagacacaguauugaaaacucaagugugaauguuucauugaccgccauagcaaaccaagcaacgguuuuaaugggcuugggcaaaggcuggccauuauccaaaauggauauaggggugccuuuacuugcaauagguuguuacucgcaaguaaauccuaucacacuaacugcugcacuacucuuguugguagcacauuaugcaauuauagguccuggccuacaagccaaagccacacgggaagcacagaaacgagcagccgcggggaucaugaagaauccaaccguugacgguauaacuguaauagacuuagaaccuauaccauaugacccaaaguuugagaaacaacuagggcaagugauguuacucauacuuuguguaacgcaagucuuaaugaugcgaacgacuugggcuuuaugugaagcacuuacauuagcgacaggaccaaucagcacgcugugggaagguaaccccggacgguuuuggaauacaacuauagcaguuaguauggccaauauauuccggggaaguuaucuagcuggggcagguuugcuauuuagcauuaugaaaaauacuacuaauacaagacgaggcacaggaaauauuggggaaacauuaggagaaaaauggaaaucaagauuaaacgcauuggggaaaagugaguuccaaaucuauaaaaaaucagguauucaagaaguggauagaacauuagcaaaagaaggaauaaaaagaggugaaacagaccaucaugccgucucuagagguuccgcaaaacuacgaugguuuguagaacgaaacaugguuacaccagaaggaaaggugguugaucuugguuguggccgaggcggguggagcuacuauuguggagggcuaaaaaacguuagagaaguaaaaggauuaacgaaagguggcccagggcaugaagaaccaaucccaaugaguacauauggauggaauuuaguuagauugcagagcgguguagauguguuuuuuacgcccccagaaaaaugcgauacucuacugugugacauaggagaaagcucacccaacccaacuauagaggcaggaaggacacuucguguacuaaacuuggucgagaacugguugaauaauaauacacaauuuuguaucaagguauuaaauccauacaugccguccguaauagagaaaauggagacauuacaaaggaaauacggaggugcucucgucaggaacccucugucgcgaaauaguacacaugaaauguacugggugucaaacgcgaccgguaauauaguuucuucugucaacaugauuucaagaauguuaaucaaucguuucacgaugaaacacaaaaaagcuacauacgaacccgacguugacuuggguucuggaacucguaauauaggaauagagucugaaauuccuaaccuagauaucauaggaaaacgcauugaaaaaauaaaacaagaacaugagacuucauggcauuaugaucaagaucaucccuauaaaacgugggcguaucacggaucguacgagacaaaacagacaggaucggcaucaagcaugguuaacgggguggugagguuacuaacaaaaccuugggauguagucccgauggugacccagauggcaaugaccgauacuaccccuuuuggccaacaacgcguuuucaaggagaaagucgacacacgaacacaagaaccgaaagaaggcaccaagaaacuuaugaagauaacugcugaauggcuguggaaagaacuaggaaaaaaaaaaacaccucgaauguguacuagggaagaguuuacccguaaaguaaggaguaacgcagccuuaggcgccauuuucacggaugaaaacaaauggaaaucugcuagagaagcuguggaagauggccgauucugggaacuagucgauagagagaggaaucuccaccuagaaggaaaaugcgaaacuuguguuuacaauaugaugggaaaaagagaaaaaaagcuuggagaauuuggaaaagccaaagggagcagagcgauaugguauaugugguuaggagcuagguuucuagaauuugaagccuuaggauuuuuaaacgaagaccauugguuuucacgaggcaauucacuuagcggaguagaaggugaaggucuacauaggcucggcuauauucuaagggaaguagguaaaaaggaagguggcgcaauguacgcagacgauacagccggaugggacacucgaauuacauuagaggauuuaaagaacgaggaaauggucacaaaccauaugaaaggcgaacacaagaaacuagcagaagcaaucuuuaaacuaacuuaucagaauaaagucgucaggguucaaaggccaacgccgcgugguacaguuauggauauaauaucaaggagggaccagcggggaucaggccaagugggaacuuauggacuuaauaccuuuacuaauauggaggcccaauuaauaaggcaaauggaaggagagggaauuuuuaaaaguauacaacaccugacugcgacagaggagauugcgguccaaaauugguuagcuagaguaggucgugaaagauugagccguauggcaauaucaggggacgacuguguggugaaaccaauagaugacagauuugcauccgcuuuaaccgcauuaaacgacauggggaagguccggaaagacauccaacagugggagccaagucggggauggaacgauuggacucaagucccauuuuguucacaucauuuccacgagcuagucaugaaagauggcagaguauuagucguuccauguaggaaucaggacgaauuaauaggcagagcgcgaauaucucaaggugcgggcuggucauuaaaggaaacagcgugucuuggaaaaagcuaugcccaaauguggacuuugauguauuuucauagaagagaucuaagguuagcagcuaacgcuauaugcucagcaguuccgagccauugggucccaacaucaagaacuaccugguccauacaugcaaaacaugaauggaugacaacugaagacauguuagcaguauggaacaggguguggauccaagaaaacccauggauggaagauaaaacaccggucgagaguugggaggagguccccuaucugggaaaacgcgaagaccaguggugcgguucucuaauuggucucacuagucgugcuacaugggcgaaaaacauacaaacugccauaaaucaaguacguucucugauagguaacgaagaauauacggauuauaugcccucgaugaagagauuuaggcgagaggaggaagaggcgggaguauugugguga

SEQ ID NO: 22968 - RNA, 9876 nt, Artificial Sequence
  derived and/or modified CDS sequence (opt6) from DENV-2__AF208496__SS-prME
acugcugguguaaucguaaugcuaauaccuacagcaauggcauuucaucugacaacacgaaacggagaaccucauaugauuguuggacgacaagaaaaagguaaaagccuauuauucaaaacugaagaugggguuaauaugugcacauuaauggcaauagaucuuggugaacuuugugaagacacaauaacuuacaaaugccccuuuuugagacaaaacgaaccugaagacauugauugcugguguaauuuuacaaguacaugggucacauacggaacuugcacgacaacaggcgaacaucggcgcgagaaaagaagcguugcacucguaccccaugucgguaugggacuagaaacgcgcacugaaacauggaugagcagcgaaggagcauggaaacauguucaacguauagaaacauggauucuaagacacccggguuucacgauaauggcagcgauacuugcguacacuauugguaccacacauuuucagagagcucuaauuuuuauauuauugacagcaguugcgccaucaaugacgaugcgaugcauuggcauaaguaauagagauuuuguggaagggguuucaggagguagcugggucgacauaguuuuagagcacggaaguuguguuacuacuauggccaaaaauaaaccaacauuagauuuugaguuaauaaaaaccgaagcuaaacagccagcaaccuuacgaaaauacugcauagaagcaaaauugacaaauacaacaacagagagcagaugcccaacccaaggagagccaucucuuaaugaagaacaagacaaacgauuuauauguaaacacaguaugguugaucguggaugggguaaugguugcggauuguucggaaaaggaggaauugucacgugugcuauguuuacauguaagaaaaacauggaaggaaagguugugcagccggaaaaccuagaguauacgaucguaaucacaccgcacaguggugaagaacaugcaguugggaaugauacaggaaagcacgguaaagaaaucaaaaucacuccucaaucaucaauaacagaagcagaguuaacugguuacgguacgguaacgauggaguguucaccacgcacaggcuuagacuuuaaugaaaugguccuuuugcaaauggaagacaaggcuugguuaguacacagacaaugguuccuugaccuaccuuuaccaugguugccaggagcagauacacagggaaguaauuggauacaaaaagaaacccuaguuacguucaaaaauccgcaugccaagaaacaagacgugguaguacuaggaucucaagaaggagcuaugcauacugcuuuaacuggagcgacagaaauucaaaugucuagugggaaccugcuauucaccggccacuuaaagugucgucugcguauggacaaguuacaacuaaaaggaauguccuauagcauguguacugguaaauuuaagauaguuaaggaaauagcugagacacaacacggcacaauaguuauacgagugcaauaugaaggagacggaucaccguguaagauacccuuugaaauaacagaucucgagaaaagacacguuuuagggcgacucauuacuguuaacccaauaguaaccgaaaaagacaguccuguaaauauugaagcugaaccaccuuuuggugacucauauauuauaauaggcguugaacccggucaacuaaaauuaaauugguuuaagaaaggaucaucgaucggccaaauguuugaaacgacaaugagaggagcaaaaagaauggcuauucucggugacacggcuugggacuucggaagccuuggaggaguguucacuagcaucgggaaagcacuucaucaggucuucggcgcuauauacggagcugcauucucggguguuucuuggaccaugaagauacucauuggggugauaaucacguggauaggaaugaauaguagaucaacaucacuaucgguaucccuuguccuaguagguguagucacacuauaccuaggagcaaugguacaggcugauuccggauguguuguuaguuggaaaaacaaagaacuuaaauguggaucagguaucuuuaucaccgauaacgugcauacauggacagaacaguauaaauuucaaccagaaaguccaaguaaauuagcaucugcaauacaaaaagcgcaugaagaagguauaugcggaaucagaaguguaacgagacuugaaaaucuaauguggaaacagaucacuccagagcucaaccacauuuuaagcgagaacgaaguaaaauuaacuauaaugacaggggauauuaaaggcaucaugcaagcagggaaaagaucucuucgcccacaaccaacugaacuuaaauauuccuggaaaacgugggguaaagcaaagaugcuuucgacugaaucucauaaucagacuuuucuaauugacggcccugaaacugcggaaugucccaacacgaaucgagcauggaauaguuuggagguagaagauuauggauuuggcgucuucacaacuaacauaugguuaaaacucagagaaaaacaagacguauuuugugauagcaaguuaaugagugcagcgauuaaagacaaccgagccguccaugcagacaugggauauuggauagaaagugcacugaacgacacauggaagauggaaaaggcuucuuuuauagaaguuaagucgugccacuggccgaaaagccauacacuauggaguaacggaguccuggaauccgaaaugauaauucccaaaaacuucgcaggacccguaagccaacauaacuaucgcccgggcuaccauacacaaacagcaggaccuuggcacuuaggaaaauuggaaauggacuucgacuuuugugaagguacaacaguagugguaacugaagauuguggcaaccgggguccaucauuacguacaacaacggcuucaggaaaacuuauaacugaaugguguugucggucaugcacacuaccuccauugcgauaucgaggagaagauggauguugguauggcauggagauuagaccgcuaaaagagaaggaagaaaaucuagucaauagcuuggucaccgcaggacacggacaaaucgacaauuuuagccuaggcguuuuaggcauggcccuauuuuuagaagaaaugcuaagaacucgcguuggaacaaaacacgcaauacugcuugucgcaguaucauuuguaacucucauuacuggaaauaugucuuuucgcgaccucggacgcgucauggugaugguaggagcgaccaugacggacgacauagguaugggugucacuuaucuagcucucuuagcggcauucaaagugagaccgacuuucgcugccggacuauuacuuagaaaguuaacgucaaaggaacuaaugauggcuacgaucgguauugccuuauuaagucaaucaacuaugcccgagacaaucuuagagcuaacugacgcucuagcucuuggaaugaugguacuaaaaaucguccgaaacauggaaaaauaccaauuggcuguaacuaucauggcaauaucgugugugccaaacgcagucauacugcaaaacgcauggaaggugucaugcacgauauuagcagcgguaagcguuaguccauuacugcuaacaucaagccagcaaaaagcagauuggauaccauuggccuuaacaauaaaggguuuaaacccaaccgcuaucuuccuuacaacauuaucaagaacauccaagaaacgaagcuggccauuaaaugaagcaauaauggccguagggaugguaucaauauuagcuaguucauuauugaaaaaugauauaccgaugacaggaccuuuaguagccggcgggcuacuaaccgucugcuauguacuaacuggcagaagcgcagauuuagaacuggagagagcggcugaugucaaaugggaggaucaagcugaaauaucuggcucaagcccaauacucaguauuacaauaagugaagacggaucgaugaguauuaaaaacgaagaagaggaacagacucucaccauucuaauaaggacaggacuccucguaauaucaggagucuucccgguaucaaucccaauaaccgcggcggccugguacuuaugggagguuaaaaagcagagagcagggguauugugggacguaccuucgccacccccuguaggcaaagccgaguuagaagauggugcuuauagaauaaaacaaagaggcauucuuggauacagucaaauaggggcagggguguacaaagaggguacuuuccacacaauguggcacgucaccagaggagcaguuuuaaugcauaggggaaaacguauugagcccucaugggcagaugugaaaaaggacuuaauaucauauggaggaggauggaaacuggaaggugaguggaaagaaggugaggaaguacaaguacuagcgcuagaaccgggcaaaaacccacgagcgguacaaacgaagccugggauauucaaaacaaauacgggcacaauuggagcagucagcuuagauuuuuccccugguacaagcgggucaccuauuguugacaggaaagggaaagucgucggucuauauggaaacgguguaguaacaaggagcggagcuuacgucagcgccauagcacaaaccgagaaaagcaucgaagauaauccugaaauagaagacgauauuuuuaggaagaaacguuuaacaauaauggaucuacauccaggugcuggcaagacgaaaagauacuuaccugcuaucguaagagaagccauaaaacgaggccuaaggacccuuaucuuagccccgacgagaguugucgcggcugaaauggaagaagcauuaaggggcuugccuauaagauaccaaacgccugcuauacgagcugaacauacaggucgagaaauaguagauuuaaugugccacgccacauuuacaaugagauuacugaguccuguaagagucccaaauuacaaccuaaucauaauggacgaggcgcacuucacagauccugcaagcauugcagcgagaggguauauaucaacaaggguagagaugggagaagcugccgggauauuuaugaccgcgacaccuccgggaagcagagauccauuuccccaaucaaaugcgccuauaauggacgaagaaagagagauuccagaacggagcuggaacucugggcaugaguggguaacagacuucaaaggaaaaacgguaugguucgucccuuccauaaaggcggggaaugacaucgccgcaugucuaaggaaaaacggaaagaaaguuauccaauuaucgaggaaaacguuugacucugaauacgugaaaacacgagccaacgacugggauuuuguggugacgacagacauaagcgaaaugggugcuaacuuuaaagcagaaagagucauagaccccagacgaugcaugaaaccagucauuuugacagauggugaagaaagagugauccuagcuggcccaaugccaguaacgcacucuagugcugcgcagagaaggggcaggauaggcaggaaccccaaaaacgaaaaugaccaauauauuuauaugggagaaccgcuugagaacgacgaggacugcgcacacuggaaggaagcaaagauguuauuggauaauauuaauacgcccgaggguauaaucccuaguauguucgaaccggaacgcgagaagguggaugcuaucgauggagaauauagguuacggggcgaggcgagaaaaacguucguggacuuaaugcguagaggagauuuaccaguuugguuagccuacaaaguggcugccgaagguauaaauuacgcugaucgaaaaugguguuucgacgguaucaaaaauaaucaaauacuagaagagaacguugagguugagauuuggacuaaagaaggagaaagaaagaaacuaaaaccaagaugguuggacgcgcgcauauauucagacccacuggcacugaaagaauuuaaggaauuugcggcagggagaaaaucacugacacuuaauuuaauaacagagaugggaagacugccaacauucaugacucagaaagcaagaaaugcauuggauaaucuagccgucuugcauacggcagaagccggaggacgugcuuacaaccaugcucuuuccgaacuacccgaaacccuagaaacacuguuauuauuaacucuauuagcgacugugacaggcgggauauuuuuguuucucaugucuggaaaggguauuggcaaaaugacguuaggaaugugcuguauaaucaccgcaucuucuuuauuaugguaugcucaaauccaaccccauuggaucgcggcuucuauuauccuagaguucuuuuuaauaguauuacugauaccagaaccugaaaagcaacguaccccacaagacaaucaacuuacuuaugucguaauugccauuuuaacggugguagcagcaacaauggcaaaugaaaugggauuuuuagagaaaacgaagaaagauuuggguuuaggaucaauugcuacacaagagagugaaagcaauauccuugacauagauuuacgcccagcgucggcauggacacuguaugcaguagcaaccaccuuuguaacaccaaugcucagacauaguauagagaacucguccguuaacguaucacucaccgcgauugcaaaccaggcuacgguauuaaugggcuuagguaaggguuggccauuaucaaagauggauauuggagugccucuucuugccauaggguguuacucacaaguuaauccaauuacauuaacagcagcauuacugcuacuuguugcacauuacgcaauuauagggcccggccuacaagcuaaggcaaccagagaagcacaaaagagggcugcugcuggaauuaugaaaaacccgacaguggacggcaucacuguaauugaccuugaaccaauaccauaugauccuaaguucgaaaaacaacuuggucaagucaugcuccugauauugugcgugacgcaaguacuuaugaugcggacaacaugggcucugugugaggcacuuacccuggcaacagggccaauaucaacauugugggaaggaaaccccggcagauuuuggaauacuacuauagccgugagcauggcuaauauauuuagagguaguuacuuggcaggcgcagggcucuuguuuucuauuaugaagaauacgacuaacacaagaagaggaacugguaacauuggagaaacccuaggagagaaauggaaaucuagauuaaaugcucuagguaaaucggaguuucaaauuuauaagaagucaggcauucaagaaguugaucgaacucuugcaaaagaggguauuaagagaggcgaaacagaucaccacgccguaucuagaggaagugcuaaacuaagaugguucguugagagaaauaugguuacaccggagggaaaaguuguagacuugggauguggccgcgggggcuggaguuauuacugcgguggguugaaaaauguacgugaagugaaagguuuaaccaagggcggucccggacacgaagaaccaauuccuaugucaacauacgguuggaaucuaguucgucuacaaucagguguagauguuuucuuuacaccaccugaaaaaugugauacccuacuaugugauauaggugagagcucacccaauccaacuauugaagcgggccggacacuacgaguccuaaaucuaguugagaauuggcuaaacaacaacacacaguucuguauaaagguucuuaacccauacaugcccucagucauagagaaaauggaaaccuuacagagaaaauauggaggagcucuaguacgcaacccgcuuucgcggaacagcacccacgaaauguacugggucucaaaugcuacuggaaacauagucucgagcgucaacaugaucagucgcaugcugaucaacagauuuacaaugaaacauaagaaagcuacauacgaaccugacguagaucuuggaaguggaacgcgcaacauuggaauagagucagaaauaccuaauuuagauauaaucggcaaacgaaucgagaagauuaaacaagaacaugagacauccuggcacuacgaucaagaccauccuuauaaaacaugggcuuaucaugguucauacgaaacuaaacaaaccggcagugcgucaucaauggugaacggaguaguccggcuucuuaccaaaccaugggacgugguaccuaugguaacacaaauggcaaugacggauacaacuccauuuggacaacaaagagucuucaaggaaaaaguugacaccagaacucaggaaccuaaagaagguacaaagaaauuaaugaaaauaacggccgaauggcuuuggaaagaauuaggcaaaaagaaaacaccucgaauguguaccagagaggaauuuacucgaaagguuagaagcaacgcugcguugggagcaauauucacagaugagaacaaauggaaaagcgcuagagaagcaguagaagauggacguuucugggaacucguggaucgugaacggaaccugcaccuagaaggcaaaugugagacguguguguacaacaugauggguaaaagagaaaagaaacuuggugaguucggcaaggcgaaagggagucgagcaauuugguacauguggcugggagcuagauuucuagaguucgaagcacuuggauuuuugaacgaagaucauugguuuucuagaggaaauucccuuagugguguagagggugaaggacuccaucgauuaggauacauauuaagagaaguugguaaaaaggaaggcggagcuauguaugcugacgacacagcagggugggauacaagaauuacacuagaagaccugaaaaaugaagagaugguuacaaaucauaugaaaggugagcauaagaaauuagccgaggcuaucuuuaaacuuacauaucaaaacaaaguaguacgaguucaacggccaacaccuagggguacagugauggacauaauaagcagacgggaucaacguggcucaggucaaguuggcacauauggcuugaauacuuuuacaaacauggaagcacagcucauaagacaaauggagggugaagggauauucaaaaguauacagcauuuaacagcuacugaagagauagcuguccaaaauugguuggcaagaguaggaagggaacgauuaucacguauggcuauaucaggcgaugauugcguggugaagccuauagacgacagauucgcuagugcguuaacagcgcuaaaugacauggguaaaguuaggaaagauauccaacaaugggaaccaucacguggauggaacgauuggacgcaaguaccauuuuguucacaucacuuccacgaauuagugaugaaagacggaaggguuuugguugucccgugucgaaaucaagacgaacugauuggacgugcuagaaucucacaaggggccggauggucacuaaaagaaacagccugccuaggaaaaucauacgcccaaauguggacgcuaauguauuuccacaaaagagauuuacgguuagccgcaaaugcgauuuguucugcaguaccuagucauuggguuccuacuucacguacaacguggagcauacaugcgaagcacgaauggaugacaacugaagacaugcuagcuguauggaauagagucuggauccaggagaauccguggauggaagacaaaacuccuguggaaucgugggaagaaguaccauauuugggaaaaagagaggaucaauggugcggaaguuuaauaggacucacaaguagagcaacgugggccaaaaacauacagaccgcuauaaaccagguacgaaguuuaauagguaaugaggaauacacagacuacaugccaaguaugaaaagauucagacgagaagaagaggaggcaggaguccuaugguaa

SEQ ID NO: 22969 - RNA, 9876 nt, Artificial Sequence
  derived and/or modified CDS sequence (opt6) from DENV-2__AY702040__SS-prME
accgcgggcaugauaauaaugcucauuccgacugucauggcauuucaucuuacuacgaggaauggcgaaccacauaugauaguuucaagacaagaaaaagguaaaagccuacuauuuaaaaccaaagacggaaccaauauguguacucuuauggcaauggaucuaggagaauuaugcgaagauacgauuacuuacaaauguccguuuuuaaaacaaaaugagccugaagauaucgauuguugguguaauucuaccaguacuuggguaaccuauggaacguguacgaccacuggggaacaucgaagagagaaacgaagcguagcacugguaccacauguuggaaugggauuagaaaccagaacagagacauggaugucaucagaaggagccuggaaacacgcccagagaaucgaaacuuggauacuaaggcacccgggcuucacaaucauggcugcaauuuuggcauacacuaucggaacaacacauuuccaacgaguauugauuuuuauuuuacuuaccgcaauugcaccuagcaugacgaugcgguguauugguauuaguaaucgagacuuuguugagggaguaucaggagggaguugggucgauauaguacuagaacacggaucuugugucacaacaauggccaaaaauaaaccgacccuagauuuugaauuaauaaaaacggaagcuaaacaaccagcuacccuccgaaaauauuguauagaagcgaaauuaacuaacacuacaacugauucaagguguccaacccaaggagagccaacacucaacgaagaacaagacaaacgcuuuguauguaaacauagcaugguagauaggggaugggggaauggguguggacuuuucggcaaagggggaauaguuaccugugcaauguuuacaugcaagaaaaauauggaaggaaaaauaguccaaccagaaaauuuagaauacacgguaguuauaacuccccauucgggugaggaacacgcgguagguaaugauaccgggaaacauggaaaagaggucaaaauaacaccacaaagcaguauuacagaggcagaacuuacgggauaugguacugugacaauggaauguucaccgagaacgggucuggacuuuaacgaaaugguacuauuacagauggaagauaaagcauggcuaguucauaggcaaugguucuuagaucuaccacugccuuggcucccuggagcagauacucaaggaucuaauuggauucaaaaagaaacucuuguuacuuuuaaaaacccccaugcgaagaaacaagacgucguugugcuaggaucgcaagagggcgcuaugcauacggcuuugacaggagcaacugagauucaaaugucgucagguaaucuguuauucacuggacaccuaaaaugucguuuaagaauggauaaauuacaauugaaaggcaugaguuauuccaugugcacagguaaauuuaaaauuguaaaagaaaucgcagaaacacaacaugguacaauagucaucaggguucaauaugaaggagacgguucucccuguaagauaccauuugagauaauggacuuagagaaaagacauguccuaggaagguuaauuacuguuaacccgauaguaacggaaaaagacaguccuguaaacauagaagcagaaccacccuucggagacuccuacauuauaauuggaguggaaccaggccaacugaaacuugacugguuuaaaaagggaaguagcauaggacagauguuugaaacaaccaugagaggcgcaaaaaggauggcuauacuaggggacaccgcaugggauuucggcucccuugguggaguauuuacaaguauuggaaaagcgcugcaccaaguauuuggugcgauuuacggagcggcguuuagcgguguaagcuggacuaugaaaauauugauuggcguaauuaucaccuggauuggaaugaacaguaggucuaccucacuguccgugagucuaguuuuaguugguaucguaacguuauauuuggggguuaugguacaggcggauucuggaugcguaguaagcuggaagaacaaggaacuuaagugcgguaguggaauauuuguaacugacaauguacauacguggaccgaacaguacaaguuccaaccagaaagucccucaaaacucgccagugcaauucaaaaagcccaugaggaagguauauguggcaucaggucaguaacuagacuagaaaacuuaauguggaaacaaauaacuagcgaacuuaaucauauacuaucagaaaaugaaguaaaauugaccauaaugacaggugauauuaagggaauaaugcagguuggcaaaagaagccugagaccacaaccgacugagcuacgguauucguggaaaacauggggaaaagccaagaugcuguccaccgaauuacauaaucaaacauuuuuaaucgacggaccagagaccgcagaaugcccaaacacaaacagggcauggaacucuuuagagguagaagacuauggauucgguguguuuacuaccaauauuugguuaagacuccgcgaaaaacaggacgcauucugugacccaaaacuaaugucagcagcaauaaaagauaaucgcgcgguacaugccgauaugggguauuggauugaaagcgcucugaacgauacuuggaaaaucgaaaaagcgaguuucauagaggucaaaaguugucauuggccaaagucacacaccuuguggucuaauggcguccuagaauccgagaugguaauucccaaaaauuuugccggcccagucucacagcauaacaaucguccaggauaucacacacagacagcaggaccauggcaucuuggaaaauuagaaauggauuucgacuuuugugaaggaacaacgguagugguuacugaagagugugggaaccguggaccaagccuucgaacaacuacugcaucaggaaaauuaauaacagaaugguguugcagaaguuguacuuuaccuccuuugagguauagaggagaggauggauguugguacgggauggagauacgaccucugaaggagaaagaagaaaaucuaguuuccaguuuaguuaccgcuggacauggucaaauagauaacuucaguuuggguauccucgguauggcccucuuucuagaggagauguugcgcacgaggguugggacuaaacacgcgauacuauuaguugcaguaaguuucgucacacuaauuacaggaaauaugucauuuagagaucuaggaagaguuaugguaauggugggagccaccaugacugaugacaucgguaugggcgucacuuaucuugcacuucuagcagcuuuuaaaguaaggccaacuuucgcugcaggacuucugcuaagaaaacuuacuucaaaagaauugaugaugacaaccauaggaauaguauugcuaucucaaucuucaauuccagaaacgauuuuggaacuuaccgaugcuuuggcuuuaggaaugaugguacuuaaaaugguacguaauauggaaaaauaucaguuagcaguaaccauaauggcgauauuaugcguaccaaaugcagucauacuacaaaaugcauggaagguaagcuguaccauacuagcaguaguuucugugagcccgcuauugcugacaucaucgcaacaaaaggcagauuggauuccucuagccuuaacaauaaaaggucugaacccaacagcuauauuccuaacgacucugucaagaacuuccaagaaaagaucauggccauuaaaugaagcaauaauggcugugggaauggugaguauacuugccucaagccuacucaaaaaugacauuccaaugacggggccguugguagcgggcggucuacucacgguauguuacguacuaacaggucgauccgcagauuuagaacuugaaagggccacagauguaaaaugggaugaucaagcugaaauuagugguucaaguccgauuuuaucgaucauaauuucugaagauggcagcaugucuaucaaaaacgaagaagaagaacagacacuaacuauacucauucggacaggacuacugguuauuaguggucuuuuuccgguauccaucccaauaacagcagcagcuugguaucucugggaagugaagaaacaaagagcagggguguugugggauguacccaguccaccuccuguagggagagcagaauuagaagacggagcauaucgcaucaaacagaaaggcauacucggcuauucccaaauuggagccgggguauauaaagaggguacauuucauacaauguggcauguuacccggggugcaguauuaaugcauaaagguaaacgcaucgagccaucgugggcugacguuaagaaagauuuaauaaguuauggaggaggcuggaagcuagaaggcgaauggaaagaaggagaagaaguacagguacuggcacucgaaccaggcaagaacccaagggccguacagaccaaaccgggucucuuuaggacaaauacaggcacuaucggggcagucucgcuagauuucagcccagggacaaguggguccccuaucguagauaaaaagggaaaaguaguagggcuguacggaaauggcguuguaacaagagguggcgcuuacguaucugccauugcacaaacggagaaaaguaucgaggacaaccccgaaaucgaggaugauauauuucgaaaaaggcgguuaaccauuauggaccuucacccuggugccgggaaaacgaaaagguauuuaccagcaauaguaagggaagcaauaaaaagaggacugaggacauuaauacuugccccuacgcguguaguagcugcugagauggaagaggcguugcgugguuuaccgauccgauaucaaacuccagcaaucagggcagaacauacagggagagaaauaguagacuuaaugugucaugccacguuuacuaugcggcugcuuucaccaauacggguuccaaauuauaaucuuauuauaauggaugaggcucacuucacugauccagcgagcauugcagcgagagguuacauuagcacuagaguagaaaugggggaagccgcaggcauauuuaugacugcuacaccuccuggaucuagagaucccuucccacaauccaaugcgccaauaauggaugaggaaagggagauuccagaaagaucauggaacuccggccaugaaugggucaccgauuucaagggcaaaacagucugguuuguaccgaguauaaagacgggaaacgacauagcugccugucuuagaaagaacgguaaaagaguuauacagcugucgagaaaaacuuucgacucggaauaugucaagacacgaacuaacgauugggauuuuguagugaccacggauauaucagaaaugggugcuaacuucaaagcagaacgagugaucgauccaagacgauguaugaaacccguuaucuugaccgacggggaagaacggguaaucuuagcagguccgaugccagucacacacaguagcgcugcgcaaagaagagggaggaucggccgaaacccccgaaacgaaaacgaucaauauauuuauaugggugagccuuuggaaaacgaugaagauugcgcacauuggaaagaagcaaaaaugcuauuagauaauauaaauacgccggaggggauaauacccucaauguucgaaccugaacgagaaaagguagacgcgauugauggugaauacagauugaggggcgaagcgagaaaaacauucguugaucuaaugagaagaggagaccuuccuguauggcuagccuauaaaguagcggcagaaggcauuaacuaugcagaccgacgcuggugcuucgaugguacccggaauaaucagauauuagaagaaaacguagagguggaaauauggacgaaagaaggagagaggaagaaacuaaaaccaagauggcuagaugcgcgcauauacucagacccucuagcucuuaaagaauuuaaggaguucgcagcgggacgaaagagucugacguuaaauuuaauaacugagaugggaagacugcccacauuuaugacucaaaaggcaagggaugcacuggauaauuuggcaguguuacauaccgccgaggcaggagguaaagccuacaaccaugcguuaagcgagcuccccgaaacguuagaaaccuuacuuuuacuaaccuuguuagcaaccguaaccggcggaaucuuucucuuuuuaaugaguggaagaggaauagggaaaaugacauuagguaugugcugcauuauaaccgcaucuauacuuuuaugguacgcucaaauacagccgcauuggauagcagcuaguauaauacuagaguucuuuuugauagucuuacuuaucccagaaccugaaaaacaaagaacuccacaagacaaccaauuaacuuacgugauaauagcaauauuaacagucguagcagcgaccauggccaacgaaaugggguucuuagagaagacaaagaaagauuucggauugggacacaucgcaacccaacaaccugaaaguaauauuuuggauauugauuuacguccagcuagcgcuuggacucuauaugcuguagcaaccacguucaucaccccuaugcuaagacauucaauugaaaauucuucagugaauguaucacuaacagcaaucgcuaaucaagcuacgguguuaaugggauuaggaaaaggcuggccacuuucuaagauggauauaggcgucccuuuacuggcaauugguugcuauucacaaguuaauccuauuacacucacagcagcguuauuacuacucguagcucauuacgcuauaauaggaccuggacuacaagccaaagcaacgcgcgaagcacaaaaacgugccgcugccgguauaaugaaaaaucccacaguugacggaaucacaguaaucgauuuggauccuaucccuuacgauccgaaauuugaaaaacaauuaggccaaguaauguuauuaguucuauguguaacucaaguucuaaugaugcgaacaaccugggcacuuugcgaagcguugacucuagcgaccggccccguuagcacccucugggaagggaacccaggcagauuuuggaacaccacgauagcgguuucaauggccaauauauuucgaggaucuuaucuggcuggggccggccugcuauuuucuauuaugaagaauacaacaagugcucgacgagguacgggaaauaugggugaaacauugggagaaaaguggaaauccaggcuuaacgcuuugggaaaauccgaauuucaaauauauaagaaaagcggcauucaggaagucgauagaacacucgcuaaagaaggaauaaaaagaggagaaacagaucaccaugcgguuuccaggggaagugcaaaacucagaugguucgucgaacgcaacuuagucaccccagaaggcaaaguaguugacuuaggauguggacgaggcggauggucuuauuacugcggaggacucaaaaauguuagggaagugaaaggucuaacaaaagggggaccuggccaugaggaaccaauaccaaugucaaccuauggauggaaccuagucagacuucaaucaggaguugacgucuucuuuguaccgccagagaaaugugauacauugcugugcgauauaggugaaaguucaccaaaccccacgguagaagcgggaaggacccuacgaguucuaaauuuaguagaaaauugguuaaauaacaauacccaauucugcgucaaaguacuaaauccauacaugcccucgguaauugaaaggauggagacucuccaacguaaauauggaggagcguuaguuaggaacccauuaagccggaacuccacucaugagauguauugggugucaaaugccucggguaacauuguaucaucaguaaauaugauaagccgaauguugaucaauagauucacaaugagacacaaaaaggcuacuuaugaaccugauguagaccuugggucgggcacaagaaacaucggaauagagucugaaaccccgaauuuagacauuaucgggaaaagaauugagaaaauaaagcaagaacaugaaacaucguggcacuacgaucaagaccacccuuacaaaacgugggcauaccauggcucuuaugaaacuaaacaaacaggaucagcuuccucaauggucaacggaguuguaagacuccucacaaaaccaugggauguuauaccaaugguuacgcaaauggccaugacagauaccacgccuuuuggucaacaaaggguguucaaagaaaaaguagacaccaggacacaagaaccuaaagaaggcacgaagaaacuaaugaaaauaacagcagagugguuguggaaagaauuggguaagaagaaaacgccaagaauguguacaagggaggaauuuacgaagaaaguuagaucgaaugcggccuuaggagcaauauuuacagaugaaaauaaauggaaaagcgcucgugaggcgguugaagacaaucgauuuugggaguuaguugacaaagaaagaaaccuccaucucgaaggaaagugcgagacguguguguauaacaugaugggaaagagagaaaagaaguuaggugaauuugggaaagcuaaaggaaguagggcgauuugguacaugugguuaggugccagauucuuagaguuugaagcucuaggauuuuuaaaugaagaccacugguucucacgagaaaauucgcuuucagguguagaaggcgagggacuucacaaauugggauauaucuugcgcgagguaaguaaaaaggaagggggagcuauguaugcugaugacaccgccggaugggacacgcgaauaacaauugaagauuugaaaaaugaggaaaugauaacgaaucacauggccggugagcauaagaaacuagcagaggccaucuuuaaauuaacauaucaaaacaaaguuguaagaguacaacguccuacaccacgggggacaguaauggacauaauaaguaggaaagaccaaaggggcagugggcaaguugggacguacggacuaaauacauuuaccaacauggaagcacaauugauuagacaaauggaaggggaagguauauuuaaaagcauccaacaucugacagcuucugaggaaaucgcgguacaagacuggcucguuaggguaggaagagaaagauuaucgcggauggcaauuucgggagaugauugugucgucaagccguuggaugaccguuuugcuaaagcauuaacagcguuaaacgauaugggcaaagugcgaaaagauauacaacagugggagcccagccgugguuggaacgacuggacacagguaccauucuguagccaccacuuccaugaauugaucaugaaagaugggcgcacgcuaguagugccauguagaaaccaagacgaauuaaucggcagggcuagaauaucacaaggagcuggauggucccuaagagagaccgcauguuuaggaaaaucauaugcacaaauguggaguuuaauguauuuucaucgaagagacuuaagauuagcggcaaaugcaauuugcuccgcgguaccuagucauugggucccaacaaguagaacuaccuggucaauucacgcaucacacgaauggaugacaacggaagacauguuaacaguguggaaucgaguauggauccuugagaaucccuggauggaagauaagacuccggucgaaaguugggaggaaaucccguaccuugggaagcgagaggaucaauggugcggaagccuaaucggauuaacuucacgagcgacaugggccaaaaauauacagacagcuauaaaccaggugagaucauuaauagguaacgaagaauauacggauuauaugccaucgaugaagagguuuagaagagaggaagaagaagcgggcguucuuugguaa

SEQ ID NO: 22970 - RNA, 9876 nt, Artificial Sequence
  derived and/or modified CDS sequence (opt6) from DENV-2__AY037116__SS-prME
acagcaggaauaaucauuaugaugauaccgacgguuauggcuuuccacuuaacaacgcgaaacggagaaccacacaugauaguaaguagacaagaaaaagguaaaucucuacuauucaaaacggaaaaugguguuaauauguguacauuaauggcaauggaucugggugaauugugugaagauaccaucaccuauaauugcccguugcuacgacaaaacgaaccggaagauauagauugcgggugccauagcacgaguacuugggugaccuauggaacauguaccgcaacaggagaacaccgacgcgaaaaacgcaguguggccuuaguuccucauguaggaauggggcuugaaacuagaacagaaacauggaugagcucagaaggugccuggaaacacgcacaacggauugaaaccuggguacugcgccauccuggcuuuacaauaauggcggcaauauuagccuauaccauaggaacaacguauuuccaacgaguccuaauauuuauuuuacuaacagcugucaccccaucgaugacuaugagguguauagguauaaguaauagagauuuuguagaaggaguuucaggaggaagcuggguugacauuguacuugaacaugguucuugcgugacaacaauggccaaaaacaaaccaacgcucgauuucgaauuagugaaaaccgaagcaaaacacccggccacguuaagaaaauauugcauagaagcaaaacugacaaauacaacuaccgcaucaaggugucccacacaaggcgaaccaucucuaaacgaagaacaagacaaacgauuuguauguaaacauaguaugguggacaggggcuggggaaaugguuguggauuauuuggaaaagggggcauaguaacgugugcuauguucacuuguaagaaaaauauggaaggaaaagucguucaaccugaaaaucuagaauauaccauaguaauaacaccacacucgggagaagagaacgcaguggggaacgacacggggaagcacggaaaagaaauuaaaguaacaccccaaagcucuauaaccgaagcggaauuaacaggauauggaaccgugacaauggaauguaguccuagaacgggauuagacuucaacgaaauggucuuacuacaaauggagaauaaggcuugguuaguacauagacaaugguuccuggaucucccauugcccuggcuaccaggagcagacacccaaggaucuaauuggauccaaaaagaaacccuaguaaccuuuaagaacccacacgccaagaaacaagacguaguuguguugggaucccaagaaggggcgaugcauacugcauuaaccggggcaacagaaauucaaaugaguaguggaaauuugcuauuuacaggccaccuuaaauguagauuaaggauggauaaacugcaacuuaaagggaugaguuacagcauguguacagguaaauucaaagucgugaaagaaauagcugaaacccagcacggaacgauaguaauccgaguacaguaugagggagauggaaguccuuguaagauccccuuugaaauaauggacuuagaaaagcgucacguguugggcagacugaucacuguuaauccuauaguuacagagaaagauucaccuguaaacauagaggcugagccaccguuuggagacucauauauaauuaucgggguugagccaggucaacuaaagcugucgugguuuaaaaagggcucauccauaggccaaauguuugaaacaacuaugcguggcgcaaaaaggauggcaauauuaggagauacggcaugggauuuuggcucgcuaggagguguuuucacguccauugguaaagcccuacaccagguguuuggagccauuuauggggcugcuuuuucagguguaaguuggacgaugaaaauauuaauugguguaguaaucacauggauuggaaugaauagcagaucuacaagucuaucagucagccuaguacucguuggaguaguuacccuauauuuaggugucauggugcaagcggacagcgguuguguggugagcuggaaaaauaaagaacuaaaguguggaagcggcaucuuuauaacagauaacguucacacuuggacggagcaauacaaauuccaaccagagagcccuagcaaguuggcaagugcaauccaaaaggcucaugaggaaggaauaugugggauaagaaguguuacccguuuggaaaaucuuauguggaagcaaauaacacccgaauuaaaccauauacuaagcgaaaacgaaguaaaacugacgauaaugacaggcgacauaaaagggauuaugcaagcugguaaaagaagucugcgaccccagccgacagagcucaaauacaguuggaaagcguggggaaaagccaaaauguuaaguacagaauuacacaaccacacauuccuaauagacggaccagagacagcugaaugccccaauacaaauagagccuggaacucucuagaaguagaagacuaugguuucggaguauucaccacuaauauuuggcuuaaguugaaagaaaggcaagauguauucugugacucuaaauuaaugagugcagcgauaaaggacaacagagcaguacacgcagauaugggguauuggauugagagugcuuuaaacgauaccuggaaaaucgagaaagcgucguuuauagaaguaaaaucgugccacuggccaaaaucacauacauugugguccaauggaguacuggaaagcgaaaugauaauaccaaagaauuucgcggguccggucagucaacauaacuaucgcccaggcuaucauacacagaccgcugguccguggcacuuaggcagacuggaaauggauuucgauuuuugugaagggacgacaguaguggugacggaagauuguggcaauagaggaccuucacuaagaacaaccaccgcaucugggaaacuaauuacagaaugguguugucgaucauguacauuaccaccacuacgauaucggggagaagauggauguugguacggaauggaaauaagaccucugaaagaaaaagaggagaaucuaguaaauucauuaguaacggcggggcauggccagauugauaacuuuagccuuggaguacuuggaauggcacuauuccucgaggaaauguugcguacaagaguaggcacuaaacacgcaaucuugcuaguagcagucagcuuugucacucuaaucaccggaaauaugagcuucagggaucuagggcggguaaugguaauggucggcgcuacaaugacagacgacauuggcaugggagugacauacuuagcuuuguuagcugcauuuaaagugcguccaacauuugcagcuggacuuuuacuuaggaaauugacaagcaaagaauuaaugaugacaacaauuggaaucgugcuccuaucacaaagcacaaucccugaaacaauccuugaauuaacagaugccugggcucuaggaaugaugguguuaaaaaucguaagaaacauggaaaaauaucaguuggcuguuacgaucauggccauacuauguguacccaaugcaguaauauuacaaaaugcauggaaagugagcugcacaaccuuggcugugguuaguguaucccccuuguuauugacaaguucucaacaaaaagcagauuggauucccuuagcguuaacgauuaaaggacuaaacccaacagcaauuuuccuuacaacgcuaucuagaacaucgaagaaaaggagcuggccucugaacgaagccauaauggcaguggguaugguaaguaucuuagccucuucucuccucaaaaaugauaucccaaugaccgguccuuuagucgcuggaggauugcuuacaguuugcuacguacucaccggcaggucugcugauuuagaacuagagcgagcagcagaugucagaugggaagaacaggcugagauaucugguuccucacccauacuaagcauaacgauaagcgaggacggaucaauguccauuaaaaaugaagaagaagaacaaacccucacgauccuuauucgaaccggccuucugguuauaagugggcuauuucccgcaucgauacccauaacagccgcagcaugguaucuaugggaagucaagaaacagcgugcugguguauuaugggaugugccauccccaccuccagucggcaaagcggaauuagaggauggggccuaucgaauaaaacagaaagggauauuagguuauucccaaaucggagcuggaguuuauaaagagggaacguuccauacuauguggcauguaacuaggggugcaguacuuaugcacaaaggaaagcgaaucgaaccaucaugggcugauguaaagaaagaucugauuuccuauggaggaggguggaaauuggaaggagaauggaaagaaggagaagaaguccagguucuugcacuugaaccagggaaaaauccuagagccguucaaacaaaaccgggauuauuuaaaacaaacacaggaacaauuggagccgucucccucgauuuuucuccggggaccagcggaagcccaauaguagauaagaaaggaaaaguaguuggucuauauggaaauggaguuguaacucguagcggagcuuauguuucugcuauagcacaaacagagaaauccaucgaagauaauccagaaaucgaagacgauauuuucaggaagaaaagguugaccaucauggacuugcauccaggugcugggaaaaccaagcguuaucuaccagcuauuguucgggaggcaauuaagagaggccuucguacguugauacuagcuccaacuagaguaguugcagcggagauggaggaagccuugcgggguuuaccaaucagauaucaaacaccggcaauuagagcagaacauacuggccgugaaauaguugacuuaaugugucaugcaacauucacgaugaggcuauuaucuccgaucagggugcccaacuauaauuugauaaucauggacgaagcccauuuuacugauccugcuucaauagcggcuagaggcuacauuagcacgaggguagagaugggugaagcagcuggaaucuuuaugaccgcuacaccacccggaucuagagauccauuuccacagucaaacgcacccauuauggaugaagaaagagaaauuccugaaaggagcuggaacucaggacacgaaugggugacagauuuuaaagguaaaaccgugugguucgucccaucaaucaaggcagguaacgacauugcagcuugccugagaaagaacgggaagaaaguuauccaacugaguagaaaaacuuucgauagcgaguacaucaaaacuagaacuaaugacugggauuuugucguaaccacggacauuucggagaugggugcuaacuucaaagccgaaaggguuaucgauccucgacgaugcaugaaaccgguaauccucacggauggagaagagagaguaauucuugcuggaccuaugccgguaacacauucgucggcggcacaaagaagggggagaguuggaagaaaucccaaaaaugagaaugaucaguauauauacaugggagagcccuuggaaaaugacgaagacugcgcucauuggaaagaagcaaaaauguuacuggauaauauuaauacaccagaaggaauuauaccaucaauguuugagccagagagagagaaaguggaugcaauagauggggaauacagauuaagaggcgaagcacgaaaaacauuugucgacuuaaugcgaagaggggaccucccuguaugguuggcauauagaguagcagcugaaggaauaaacuaugccgacagaagauggugcuucgacggugugaaaaacaaucagauauuagaagaaaacguugaaguagaaauuuggacuaaagagggagaacgaaagaaacugaagccgagguggcucgacgcgcgcauauacucugacccccucgcucucaaggaauuuaaagaauuugccgcuggaaggaaaaguuuaacguuaaaucucaucaccgaaaugggaagauuaccuacguuuaugacacaaaaagcaagaaaugcauuagauaaccuggcggugcuacauaccgcggaagcaggaggacgugcauauaaccaugcacuaagcgaacuaccugaaacgcuagaaacgcuuuuauuacucacucugcucgcgacuguaaccggugguaucuuucuguucuuaaugagugguaaagguauugguaagaugacauuggggauguguuguauuaucacugcgaguaucuuguuaugguacgcucagauacaaccacauuggauagcagcaaguaucauuuuggaguucuuuuuaauagucuuauuaauaccagaaccugaaaaacaacguacaccgcaagauaaccaauuaaccuaugucgugauagccauacucacagugguagcugcuaccauggcaaacgaaaugggauuuuuggagaagacaaagaaagauuuuggucuaggaagcauugcuacucaacaaccagaaucuaauauucucgauauagaccuucgaccggcaucugccuggacacuauaugcuguggccacuaccuuuauaacaccaaugcucagacauucuauagaaaauaguucaguuaaugucucacuaacagcuauagccaaccaagcaacaguucuaaugggacuagggaaaggauggccauugucuaaaauggacauaggugucccucuccuagcgaucggaugcuauucucaagucaacccaauuacauuaacggccgcccuauuauuauuaguugcacacuaugcaauaauaggacccggucuacaagccaaagcgacgcgagaggcccagaaaagggcggccgccggaauaaugaaaaauccgacaguagauggaaucacuguaauagaucuugaccccauaccauaugacccaaaauucgaaaaacaacugggucaagucaugcuacugguauuauguguuacacagguacuaaugaugagaacaacuugggcucucugcgaagccuuaacccucgccaccggaccaaucaguaccuugugggaaggaaacccaggaagauuuuggaacaccaccauagcuguaaguauggcuaauauauuuagaggaucuuaccuagcuggagcaggccuacuauuuucaauaaugaaaaauacugcgaacacuagacgcggaacagggaauacuggggaaacacuaggugaaaaauggaaaaauagauuaaacgcacuugguaaaagugaguuccaaaucuauaagaagucagguauccaggaagucgauaggacguuggcaaaagaaggaaucaagcgaggagaaacggaucaccacgcagucucaagaggaagugcaaaacuccgcugguuugucgagaggaaccuagugacaccagagggaaagguaguugauuuagguuguggaaggggaggaugguccuacuacuguggggguuuaaagaaugucaaagaaguuaagggacuaacuaaaggaggaccaggucaugaagaaccuauuccgaugagcaccuacggauggaacuuaguucggcuccaaucgggcguagacguuuucuuuacaccgccagaaaagugugauacuuuauugugugauauaggagaaucuucgccuaauccaacgguagaagccggcaggacguuaagaguucuuaauuuaguagagaacuggcuaaacaauaacacgcaauucugcauaaaaguuuuaaacccguauaugccuucagugauagagaaaauggaagcacuucaacgaaaauauggcggagcuuuggucagaaauccacucaguagaaauuccacucacgaaauguauugggucaguaacgcaaguggaaacauaguuucuucgguaaauaugaucucaagaaugcuaauuaacagauucacaaugagacauaagaaagcaacguaugaaccugacguagacuuaggcaguggaaccagaaacauaggaauagaguccgagacaccuaacuuagauauuaucgguaaaagaauagagaagauaaaacaggagcaugagacuucuuggcacuacgaucaggaccacccauauaaaacgugggcuuaccauggcagcuaugagacaaagcaaacgggcuccgcguccagcauggugaauggaguaguacgauuauugacaaaaccgugggauauaaucccuaugguaacacagauggcaaugacugauacaacuccuuucggccaacaaagaguuuuuaaagaaaaaguagauacaagaacgcaagagccaaaggaagguacaaagaaacucaugaaaauuacugccgagugguuauggaaagaacuaggcaagaagaaaacaccacgaaugugcacacgagaagaguuuacucgaaaaguaaggaguaaugcugccuuaggggccaucuuuacugaugaaaauaaauggaaaagugcucgugaagcagucgaggauagcggauuuugggagcucguagauaaagaacguaaccuccacuuagaaggaaaaugcgaaaccuguguguacaauaugaugggcaaacgggaaaagaaacuuggagaguucggaaaagccaaaggcagcagagcaauaugguauauguggcuaggcgcccgguuccucgaguucgaagcguuaggauuucuaaacgaagaucauugguuuucccgcgaaaauucauuaaguggcguggaaggagaaggucuacauaaacuuggguauauucuacgggacguaaguaagaaagaaggcggcgcaauguaugcagaugacacagcggguugggacacacguauaacgcucgaagacuugaagaaugaggaaaugguaacaaaucauauggaaggugaacauaaaaagcuggcggaggcaauauuuaaacucaccuaccaaaauaaagucgugagaguacaaaggcccacccccagagguacugucauggacaucaucagucguagagaccaaaggggcaguggucagguaguaacauacggauuaaacaccuuuacaaauauggaagcacaacuuauacgucaaauggaaggcgaaggcgucuuuaaaucuauacaacauuuaacaguaacugaagaaauagcagucaaaaacugguuaguucgagucggucgagaacgauugucacgaauggcgauaucaggugaugauuguguaguuaaaccauuggacgacagguuugcaucagccuuaacugcucuaaacgacauggguaaaguaagaaaagauauucaacagugggaacccucaagaggauggaaugauuggacacaaguaccguuuugcagucaucacuuucaugagcugauaaugaaagacggaagaguauuaguaguuccaugucgaaaucaggaugaguuaauagggagagcaaggauaucgcaaggugcagguugguccuugcgugaaacugcuugucuuggaaaaagcuaugcacaaauguggagucuaauguacuuucaucgccgagaucuacguuuggcagcaaaugcuauaugcagugcuguaccaucucacugggucccaacaaguaggacgacuuggucuauucacgcuacgcacgaguggaugacgacugaagacauguuaacaguauggaaccguguuuggauucaagaaaacccauggauggaagauaagacaccuguagagucgugggaggaaaucccuuaucucgguaaacgcgaagaccaguggugcgguucauuaauaggacuuaccucgagggcgacaugggcaaagaacauacagacagcaaucaaccaagugagaucacuaauagguaaugaagaauauacggauuauaugccgucgaugaaacgguuccgaagggaggaagaagaagcagggguauuaugguga

SEQ ID NO: 22971 - RNA, 9876 nt, Artificial Sequence
  derived and/or modified CDS sequence (opt6) from DENV-2__AF169678__SS-prME
ucagcagguaugauuauaauguuaauuccaacaguuauggcauuccaucuaacgaccagaaauggggaaccacauaugauaguuucaauucaggaaaaaggaaaaaguuuacuuuuuaaaacagaagauggaguaaauaugugcaccuuaauggcaauggauuuaggugaauuaugugaagauacuauaacauauaaauguccuuuauuaaggcaaaaugaaccugaagacauagacuguugguguaacuccacaaguacauggguaaccuacggaaccugcacaacaacaggagaacauagaagagagaaaagaagcguugcauugguaccucauguuggaaugggguuagaaacgcgaacagaaacguggaugucuagcgaaggagcauggaaacaugcucaacguauugaaacauggaucuuaaggcauccgggauuuacuauuauggcagccauccuagcauauacuauuggaacuacccacuuccagagagcccugaucuuuauauuacuaacggcuguugcacccagcaugacaaugcgaugcauuggaauaucaaaucgagauuucguagaaggagucagcggaggaagcuggguagauauaguuuuagaacauggauccugugucacgaccauggccaaaaauaaaccaacacuugacuucgaacugauuaaaaccgaagcaaaacagccugcuacacuuaggaaauauuguaucgaagccaaauuaacaaauaccaccaccgaaagcagaugcccuacacaaggagaaccaucgcuaaaagaggagcaggauaaaagguucguuuguaaacauucgaugguggacagaggguggggaaacggaugcggcuuguucgggaaaggaggaaucguuaccugugcuauguucacuuguaagaaaaauauggaagggaaaauaguucaaccagaaaaccuagaauacacgauugucguuacuccccauucaggugaagaacaugccguggggaacgauacaggaaaacacgguaaagaaauaaaaguuacgccacaaucuagcaucacagaagcagaacucaccggauauggcacaguaacaauggaguguaguccccgcacaggguuagacuucaacgaaaugguucuccuacagauggaaaacaaagcauggcuaguacaucggcaaugguuuuuagaccuuccacuuccauggcugcccggggcagauacgcaagguaguaacuggauucaaaaagagacgcuuguaaccuucaaaaacccacaugccaagaaacaagaugucguaguucuuggaucccaagagggagcuaugcauacagcauugacaggagcgacagaaauacaaaugagcagcggaaauuuauuauuuacaggacaucuaaaauguagauugagaauggacaaauuacaacuaaaagguaugucauacagcaugugcacgggaaaauuuaaaguaguaaaagaaaucgcggaaacacaacauggaacuauugugauucgcgugcaauacgaaggggacgggucaccuuguaaaauaccguucgaaauaauggaucuggagaagcguuaugugcugggaagguugauaacaguaaauccaaucgugacagagaaagauagcccaguuaacauagaagcagaaccaccauuuggugauaguuacauaauaauaggaguagaaccagggcaacuuaaauuaaauugguucaagaaagggucaagcauugggcagauguucgaaacgacuaugcguggugcaaagagaauggcaauauuaggagacacugcgugggacuuugggucgcucggaggcguuuucacaucuauugggaaagcacuacaucaaguuuucggcgccauauacggcgcagcauuuucuggaguaucuuggaccaugaagauucugauaggagucauaauuacguggauaggaaugaacucuagaaguacaagucuguccguaucuuugguauuggugggaauuguaacacuauaccuaggugugaugguacaagcugauuccggauguguuguaaguuggaagaauaaagagcuaaaguguggaucuggaauuuuuauaacggauaacguucauacguggaccgagcaauauaaauuccaaccugaaucaccaaguaaacuagcgucagcaauccagaaagcacaagaggaggguauuugcggcauucguucgguaacaagacuagaaaauuuaauguggaaacagauaacuccagaauugaaccauauauuagcagaaaaugaagucaagcuaacuauaaugacaggcgacauuaaaggaauaaugcaagcgggaaaaagaagucuaagaccacaaccgaccgaauugaaauacuccuggaaaacguggggcaaagcgaaaauguugucuacagaaucccacaaccagacuuucuuaauagacgggcccgaaacugccgaaugccccaauacaaaucgugcuuggaacucguuagaaguugaagauuacggcuucgggguguucacaacgaauauauggcucaaacuuaaagaaaaacaggaugcauuuugcgauucaaagcucaugucagccgcgauaaaagacaaucgugccguccaugcagacaugggcuauuggauagagucagcauuaaacgacaccuggaaaauagaaaaggcaucauucauugaagugaaaaacugccauuggccaaaaagccauaccuuauggaguaauggaguauuggaauccgagaugauaauuccuaaaaaccuugcagggccggugagucaacauaacuacagaccaggauaucauacacaaaucgcaggcccuuggcaccugggaaaacuugaaauggauuucgacuuuugugacggcacaacaguugucgugacagaagauugcgggaacagagguccgagucuuagaacgaccacagcauccgggaaacugauaacugagugguguugcagaucauguacguuaccaccacuuagauacagaggcgaagauggcugcugguaugggauggaaaucagacccuuaaaggaaaaagaagaaaauuuaguaaacucucuaguuacagcgggacauggucaaguagauaauuuuucucuggggguuuuagguauggcuuuguucuuagaagagaugcuuagaacaaggguggguacuaagcacgcuauccuucuaguagccgucucuuucgugacucuuauuacuggaaauaugucuuuuaaagaccugggaaggguuguaguuauggucggagcuacgaugacugaugauauuggaaugggaguaacauaccuugcuuuacuagcggcauucaaagugagaccgacuuucgcugccggacucuuguuaagaaaacucacgaguaaagagcuaaugaugacaacaauuggaauuguauuacucucccagucuacaaucccggaaacaauacuggaauuaacugacgcacuugcauugggaaugaugguucuaaaaauaguuaggaauauggaaaaauaucaauuagcuguaaccaucauggcgauccucuguguaccaaaugcaguaauccuucaaaaugcauggaaaguaucaugcacaauccuugcugucguaucgguaucaccacugauauuaacaaguucacaacaaaagacagauuggauaccacuagcccuaacuauaaagggacugaacccgaccgcaauuuuucuaacuacacugucgagaacgaauaagaaacgaucauggcccuuaaaugaagcaauaauggcgguuggcauggucucuauuuuagccagcagucuacugaaaaaugacauaccaaugacggggccguuaguagccgggggauuauuaacagucuguuauguauugacggguaggucugcugaccucgaauuagaacgugcugcagauguaaaaugggaagaucaagcugaaauaucaggaagcagucccauuuuaucaauuacuauaucggaggaugguuccaugucaauuaaaaaugaagaggaagaacagacacuaaccauucuaauaagaacagguuuguuagugauuaguggucuauuuccagugucaauaccgauuacagccgcggcaugguauuuaugggaagucaagaaacaaagagcgggcgucuuaugggacgucccuagcccacccccuaugggcaaagcggaacuagaagauggugccuaucgaauaaagcaaaagggaauccuaggcuauucucaaauuggcgcagggguguauaaagaagguaccuuucacacuauguggcauguaaccaggggagcugucuuaaugcacaagggaaagcgaaucgaaccuagcugggccgaugucaagaaggaccuaauuucauauggagguggauggaaacuugaaggcgaguggaaagaaggagaagaaguacaaguacuagccuuagagccgggcaaaaaucccagagcaguucaaaccaaacccggccuuuucaaaacuaauacggguacuauaggugcaguaagccucgauuuuucaccaggaacaagugguucucccauaauagauaagaaagggaaaguuguagguuuauacgguaaugguguaguaacuagaucuggugcauacguaucagcaauagcacaaaccgagaaaaguauugaggacaacccagaaauagaggaugauauuuuuaggaagaaacgccugacgauuauggaccuacauccgggcgcggguaaaacaaaaagauaccucccugcgauaguucgcgaagcaauaaaacguggacuucguacucucauccuugcgccgacgagaguaguugcagccgagauggaagaggcacuaagaggacucccuauaagguaccagacgccugcaauuagggccgagcauacuggccgggaaauuguugacuugaugugccaugcuaccuuuaccaugcggcuacuaucacccgucagaguaccaaauuauaaccuuauaauuauggaugaagcucacuuuaccgacccagcuaguauagcugcuagagguuacauaucaacgagaguugaaaugggugaggcugcaggaauauucaugaccgcaacaccaccgggaaguagagauccguuuccccaguccaacgcgccaauaauagacgaagagagagaaaucccggaaaggagcuggaacucaggacacgaaugggucacggauuucaaaggaaaaacagugugguuuguuccaucgauaaaggcugguaaugacauagcggcaugucuccgcaaaaauggcaagaaagugauucaacugucgagaaagacauuugauucagaguauguaaaaacucggacaaacgacugggacuuuguggugacaacagauauuagcgaaaugggagcaaacuuuaaggcugaacgaguaauagauccgcguagauguaugaaaccagugaucuugacggauggugaggaacgaguuauacuagcagguccaaugccagucacacauucaucagcugcacaacgacggggccguauaggacguaauccgaaaaacgaaaaugaccaauauauuuauaugggagaaccuuuagagaaugaugaggacugcgcacacuggaaagaggcaaaaauguugcuggauaauauuaacacuccagaaggaauuaucccaaguauguuugaacccgagagagaaaaaguagaugcaaucgauggggaauauagacuaagaggggaagcucguaaaacauucguagauuugaugcgucguggagacuuaccagucugguuagcuuauaaggucgcugcugaagggauuaacuacgcugacaggagauggugcuuugaugggauucaaaacaaccagauccuagaggaaaacguagaaguggaaauuuggacaaaggaaggagaacggaagaaacucaaaccaaggugguuagaugcaagaauauacucugauccucucgcucuuaaagaauuuaaagaauuugcggcgggaagaaaaagucuaacucugaauuuaauuacagaaaugggccgauuaccaacauuuaugacucaaaaggcgcgagaugcccucgacaacuuagcuguacuucauacggcggaagcaggaggcagagcguauaaccaugcauuaucagaauugccagaaacacucgaaacacuauugcuccugacuuuacucgcuacaguaacaggaggaauauuucuauucuugaugagcggacgaggaaucggcaagaugacguuagggaugugcuguauaauuacugcaaguauauuguuaugguacgcacaaauacagccacauuggauugcugcuagcauaauacucgaguucuuuuugaucguauuacugauuccugaaccugaaaaacaacggacuccccaagauaaccaauuaacauauguaguuauagcgauacuaacugucgucgccgccacgauggcuaaugagauggguuuucuagagaaaaccaagaaagauuuaggauuugggucaaucgcaacacaacagccugagucgaacauccuugauauagaccuacgacccgccagugcguggacauuauacgcaguagcuacaacuuuugugacuccaauguuaaggcauucaauagaaaacaguagugucaacguaucauuaacggcaaucgcgaaccaagcuacuguuuuaaugggcuuaggcaaaggauggccacucagcaaaauggauauugguguaccauuacuugcaauuggcuguuacagucaaguaaauccaauaacauugacagcagcacuccuacuauuaguagcucacuacgcuauaauuggcccuggcuuacaagcaaaagccacccgagaggcccaaaagcgggcugcggcuggcauaaugaagaacccuacgguggauggaauuacuguaauagaccucgauccaauaccuuacgauccaaaauucgaaaagcaacuugggcaaguuaugcuucuaguacugugcguaacacaaguauugaugaugcgcaccacaugggcauuaugugaagcauugacucuugcaacagguccaauaucgacccuaugggaaggcaacccaggucgcuuuuggaacacgaccauagcagugagcauggccaauauauuucgaggaucauaucuagcgggugcaggucuacuauuuucuauuaugaaaaacacuacaaauacucguagagguaccggcaacaucggcgaaacauuaggagaaaaauggaaaagcagacuaaaugcacuuggcaaauccgaauuucaaauuuacaagaaaaguggaauccaggaagucgaucgaacacuggccaaagaagggauuaaaagaggcgaaacugaucaccaugcugugaguagggguucagcuaaauuaaggugguuuguagagaggaauaugauaacuccagaaggaaaaguuguugauuuaggcuguggcagaggaggguggucauacuacuguggaggucuaaagaacguacgcgaaguaaaaggacuaacaaaagggggcccaggccaugaggagccaauaccuaugaguacuuacggcuggaauuuaguccgauuacagucaggaguagacguauuuuucacaccuccagaaaaaugcgacacgcuucuaugcgacauaggagagaguagcccuaauccgacaguggaggcaggccguacccugagaguauugaaucucguugaaaacugguuaaacaauaauacacaauucuguauaaaaguguuaaaucccuacaugccaaguguaauugagaaaauggaagcauuacagcguaaguaugggggagcacuugucagaaauccguuaucuagaaauagcacucacgaaauguauugggucaguaaugcguccggaaacauuguuuccucagucaacaugauuucgagaauguuaauuaauagguucaccaugaaacacaagaaagcaacguaugaaccggacgucgaccucggaucgggaacuaggaauauuggcauugaaagcgagguuccaaacuuagauauaauaggaaaacggauugagaaaauaaagcaggaacaugaaacaucuuggcauuaugaccaagaccacccauauaaaacgugggcuuaucacggaucguacgaaacaaagcagaccgggucagccagcucaaugguuaacgggguaguaagacuucugacuaaaccgugggauguauuaccuacaguaacacagauggccaugacagacacgacccccuucgggcaacaaaggguuuuuaaggaaaaaguagauacgcgcacgcaagaaccgaaggaagggacuaagaaauuaaugaagauaacagcugaaugguuauggaaagaacugggcaagaagaaaacaccaagaaugugcacucgggaagaauuuacaagaaagguuagaagcaaugcugcucucggagcgauauuuacagacgagaacaaauggaagagugcuagagaggcuguggaagauagcagauuuugggaauuagucgauaaagaaagaaauuuacaccuugaaggaaaaugcgagacaugcguguacaauaugaugggaaagagggagaagaaauugggggaauuuggaaaagcgaaaggcucgcgagcuauuugguauaugugguuaggggcaagauuccuagaguucgaggcacugggauucuuaaaugaagaccacugguuuucccgagaaaauuccuugucggguguagaaggugaggggcuucacaaacucggcuacauccuacgcgauguaucuaagaaagaaggaggugccauguaugcagaugauacggccggcugggacacacggauaaccuuagaagaucuaaagaaugaggaaaugguaacgaaucacauggaaggagaacacaagaaacuagcagaagcaauauucaaacuaacuuaccaaaacaaaguugugcggguccaacgacccacaccgcgaggaacagucauggacauuaucagcaggcgagaccaacgaggaaguggucaaguagggacauacggauuaaauacauuuacuaauauggaggcucaacuuauacgccaaauggaaggagaaggaguuuucaaaaauauacaacauuuaacagccacugaagaaauagcuguacagaacuggcucgcucggguuggaagagaacguuugagcagaauggcgaucucaggggaugauuguguagugaaaccacuagacgauagauuugcuagugcuuugacggcacucaaugauauggguaaagugaggaaagauauucagcaaugggaaccaucccgaggauggaaugauuggacccaaguaccauucugcucccaucauuuucacgaauuaaucaugaaagacggucgcguuuuagucguaccauguaggaaucaggaugaauuaauagguagggccagaauuucacaaggcgcagguuggucauuacgagagacagcaugucuaggaaagagcuacgcacaaaugugguccuugauguauuuucaucgcagagauuugcgauuagccgcgaaugcaauuuguagugccguuccaucacauugggugccaacuuccagaacaacauggucuauucaugccaaacaugaguggaugaccacugaagacaugcucacgguauggaacagaguuuggauccaagagaauccauggauggaggacaaaacccccguugagucgugggaagagauaccauauuugggaaagagagaggaucagugguguggaucuuuaaucggguuaacuucucgagccacaugggccaaaaauauucaggcugcuauaaaucaggugcguucacuuauagguaacgaggaguauacggacuacaugccgaguaugaaaagauuccgaagagaggaagaagaagcuggaguauuaugguaa

SEQ ID NO: 22972 - RNA, 9876 nt, Artificial Sequence
  derived and/or modified CDS sequence (opt6) from DENV-2__AF169679__SS-prME
agugcaggaaugauaaucaugcuuauaccgacagucauggcauuccaccuaacgacaagaaauggugaaccucauaugaucguaucuauccaagaaaaagguaaaucauuacuauuuaaaacagaagacggaguaaacauguguacgcuuauggcaauggacuuaggugaacugugugaagauacuauaacuuauaaauguccacuucuacgacagaaugaaccggaagauauagacuguuggugcaacaguacaucaacauggguaacauacgguacuuguacaaccacuggcgaacaucggcgugagaaaagaagcgucgccuuagugccucaugugggaaugggucuagaaacuagaacagaaacguggaugucaucagaaggcgccuggaaacacgcacaaaggauagagacauggauacugagacauccaggguuuacgauuauggcugcaauauuagcuuauacaauaggaacuacacacuuucaaagagcacugauuuuuaucuuacuaaccgcaguagccccaaguaugaccaugagaugcauagggauaucaaauagagacuuuguagagggaguaaguggaggcucauggguggauaucguacuagaacauggaucuuguguaaccacaauggcuaaaaacaaacccacucuugacuuugaauugauaaaaacugaagcaaaacaacccgcaacucuaaggaaauacuguauugaagcuaaacuaacgaauaccacaacagaaucaagauguccaacgcaaggagagccgagucuaaaagaggaacaggauaaaagguucguaugcaaacacaguauggucgauaggggauggggcaauggaugcggauuguucggaaaaggaggaaucguaacaugcgcaauguucacauguaaaaagaauauggagggaaaaauaguucaaccugagaaucuagaauacacgauuguagucacgccccacucaggggaagaacacgcaguugggaacgacacggguaaacauggcaaagaaauaaaaguuacaccacaaaguuccauaacagaggcagaauuaacagguuauggcacaguaacgauggaauguucaccgcguacggggcuggacuucaaugagauggucuuguuacaaauggagaauaaggcuuggcugguacacagacagugguucuuggacuugccauuacccugguuaccaggugccgacacccagggaagcaauuggauacagaaagaaacuuuagucacauuuaaaaacccgcaugcuaagaaacaagacguugugguccuaggaagucaagaaggugcaaugcauacagcauuaacgggcgcaacggaaauacaaaugaguucugggaacuuacuauucacaggccaccuaaaauguagauugagaauggauaaauuacagcuaaaaggcaugagcuacaguaugugcaccgggaaauucaaaguaguaaaagaaauagccgaaacucaacaugguacaaucguaauaaggguccaauacgaaggcgacgguaguccauguaagaucccauuugaaauaauggaccuggaaaagagauauguuuugggccgauuaauuacgguuaauccuauuguaacagaaaaagacaguccaguaaauauagaagccgaaccgcccuucggggacaguuauaucauuaucggugucgaaccaggacaacugaaauugaauugguucaagaaagguucaucgauuggacaaauguuugaaacuacuaugagaggagccaaaaggauggccauucuuggugacacugcuugggauuuugguagucuagguggcguuuucacuucaaucgggaaggcuuuacaccaaguauuuggggcaaucuacggggccgccuuuagugggguaagcuggacaaugaagauccuaauagggguaauaauaacguggauagguaugaacucuagaaguaccagucuaucaguaucauuagugcuagugggaauagucacccucuauuuaggagucaugguacaggcggauagugguuguguagugagcuggaagaauaaggaauuaaaaugugggucagguauauucauuacagacaacguacacacuuggacugaacaauacaaauuucaaccggaaucgccaagcaaauuagccucggcaauucaaaaagcucaagaagaggguauuuguggcauuagauccguaacaagauuagaaaaccuaauguggaaacaaauuacaccggaguuaaaucauauacuagcagaaaaugagguuaaauugacaaucaugacuggagacaucaagggcauuaugcaagcaggaaagaggucacuacggccacaaccuaccgaacuuaaguauaguuggaaaacuugggggaaagcgaagaugcuaaguacggaaucccauaaccaaacuuuucuuauugauggaccaaaaacggcagagugcccaaacaccaaucgagcauggaacucauuagaaguugaagacuaugguuucggagucuuuacaacuaauauauggcugaaacuaaaagaaaaacaggacgcauuuugcgauaguaaauuaaugucagcugcgauaaaagauaauagagcaguacacgccgacaugggcuacuggauugaaucagcuuuaaacgauacauggaaaauagagaaagcuaguuuuauagaagucaagaauugucacuggcccaaaucccacacauuauggucaaaugguguacuagaaucagaaaugauuauaccuaagaaucuugcagguccagucucccaacauaacuauagaccuggguaccauacccaaauagcuggaccauggcaucuaggaaaguuagagauggauuuugauuuuugugauggaacaacaguugugguaacagaggauugugguaaccgagguccaaguuuaagaaccacaacggccucaggaaaauuaauaacugaauggugcugcagaucaugcacccuacccccauuaagauaucggggugaagauggaugcugguauggaauggaaaucagaccguuaaaggagaaagaagaaaauuugguaaacucucugguaaccgcgggacacggucagguagauaauuuuucgcugggaguccucgguauggcucuguuccuggaagagauguuaagaacuagaguugguacuaagcacgcuauauugcuagucgcagugucauucguuacauuaauaaccggcaacaugucguuuaaggacuuagggcggguaguugucauggugggggcuaccaugaccgaugacauugguauggggguaacauaucuagcacuauuggcagcguuuaaagugagaccgacauuugcagcugguuugcucuuacggaaauugacaagcaaagaguugaugaugacgacaauugguauaguguuacuaagccaaucaaccaucccugagacaauauuagaacuaacugaugcguuagcguugggaaugaugguucuaaaaauugugcggaauauggaaaaauaccaacuagccgugacaauaauggcgaucuuauguguaccaaaugcagucauucuucagaaugcuuggaaaguaucguguacaauauuagcagugguaagcguuucacccuugauucuaaccuccagccaacagaaaacagacuggauucccuuagcacugacgauuaagggccuuaacccaacugcgauauuucuuacuacauugucucguacaaauaagaaaaggucauggccacuuaaugaagcaaucauggcaguuggcaugguuucaauauuagccagcucuuugcucaaaaaugauauaccgaugacagguccccucguagccggcggacuacuuacaguauguuacgucuuaacuggucguagcgcugaucuugaacuugagcgcgcagcugacguaaaaugggaggaucaagccgaaauauccggaucgucucccauucuaaguauaacuaucucugaggauggcagcaugucaauuaagaaugaagaagaagaacaaacccuaaccauacuuauacgaacuggucugcuaguaauuagcggauuauucccaguaaguaucccaauuacugccgcggcgugguaucuuugggaagucaagaaacagagagcaggaguuuuaugggacgucccuucgccaccacccauggguaaggccgaacuggaagauggggcauacaggaucaagcaaaaagguauacucggauauucgcagaucggagcuggugucuauaaagaaggaacauuccacaccauguggcauguaacaaggggagccguauuaaugcauaaaggaaaaagaauagaaccgaguugggcagauguaaagaaagaucuaauaaguuacggagguggguggaaauuagaaggugaauggaaagagggugaagaagugcaaguguuggcauuagaaccagguaaaaacccuagggcaguucaaacgaaacccggcuuauucaaaacuaauaccggaacaaucggugcaguuucucucgauuucuccccaggaacaucuggcaguccaauaauagauaagaaggguaagguaguuggauuauacgggaaugguguagucacacguagcggagccuacgucuccgcaauagcucaaacagaaaaauccauagaagauaacccagaaaucgaagaugauauauuucgcaagcguagacuaacaaucauggauuuacaccccggggccggaaagacaaaaagguaccugcccgcaauagugcgagaagccauuaagcggggcuuaagaacacucauucuugccccaacuagagucguagcagcugaaauggaggaggcacuaagaggguugcccauucguuaucaaaccccagcgaucagggcagagcauacgggucgagagauaguugaccuuaugugucaugccacguucacuaugcguuuauugaguccaguacgcgucccuaauuauaaucuaaucauaauggaugaagcacauuuuaccgacccugcuaguauugcugcaaggggcuauauuuccacgagaguugaaaugggagaagcggccgggauauuuaugacugcgacaccaccaggaucucgggauccuuucccgcagucgaaugcaccaauuauggacgaggaaagagaaauaccagaaagaagcuggaacucaggacaugaaugggugacagauuucaagggaaaaacagugugguuugucccaagcauaaaagcgggaaaugauauagcugcuuguuuaaggaaaaauggaaagaaaguaauacaacucucucgcaaaacguucgauagugaauaugucaaaaccagaaccaaugacugggauuuuguugucacgacggacaucagugagaugggcgcaaauuucaaagccgagcgaguuauagauccaagaagaugcaugaaacccguaauuuuaacggacggugaagaaagaguuauacuugccgggccaaugccugucacacauucuagcgcagcacaaagacgcggccgaauaggaagaaauccuaaaaaugaaaaugaucaauauaucuauaugggagagccacuagaaaacgacgaagauugugcacauuggaaggaagcaaaaaugcuguuggauaauauuaacacaccggagggaauaauaccuucgauguuugagccagagcgagagaaaguggaugccauugauggggaauaucgacugcguggcgaagcaagaaaaacauuuguagauuugaugaggagaggcgaucuaccaguauggcuagccuauaaaguugcugcagaagggauaaauuacgcugauagaagaugguguuuugauggcaucagaaauaaccagauccuugaagagaauguagaaguggaaaucuggaccaaagaaggugaaagaaagaaauugaaaccaagauggcuugacgcaagaaucuauagugaucccuuagcucuaaaagaguucaaagaguuugcggcugguagaaaaucauuaacccugaaucucaucacagaaaugggucgucucccaacauuuaugacucagaaagcucgugacgcacuugauaaucuagcuguauuacauacagccgaagcuggcggcagagcuuauaaucaugcuuugucggaacuaccugagacauuagagacguuauuauugcuuacuuuguuagcaacgguuacaggagguaucuuuuuauuccuaaugaguggaagagguauuggaaaaaugacucuaggaauguguuguauuauaacagcauccauauuguuaugguacgcacaaauccaaccacauuggauugcagccucaauaaucuuagaauuuuucuugauagugcuacucauaccagaaccagaaaaacaacggaccccucaagauaaccaauugacauacgugguaauagccauauugaccguaguagcagccacaauggcaaaugaaaugggauuucuagagaaaaccaagaaagaccucggauucggcucaauagcuacacagcaaccagaaucaaauauacuagauauagauuuaagaccugcgucggccuggacucuuuaugcuguggccacaacguuuguuacaccaaugcuaagacacaguauagaaaauuccucagucaacguaucauuaaccgccauagcaaaucaagcgacgguacuaaugggacuagguaaaggauggccacuauccaaaauggauaucggcgugccucuauuggcuauuggaugcuauucccaagucaacccuauaacgcuuacggcagccuugcuucuucuaguagcucacuacgcaauaaucggaccuggccuacaagcaaaagcaacccgugaagcucaaaaacgagcagcagccggaaucaugaagaauccaacaguggacgggauuacgguuauugauuuagacccuauaccauacgaucccaaguucgagaaacagcucggacagguaaugcuccuaguauugugcguaacgcaaguccuaaugaugaggacaacaugggcacugugcgaagcgcuaacauuagcaacuggaccaauuucuacauuaugggaagguaauccaggacgauucuggaauacuacaauagcagucucaauggcaaauaucuuuagggguucguauuuagcgggagcuggauuacuguuuucgauuaugaagaacacuacuaacacacgacgagggacugggaacauuggugaaacucucggugaaaaguggaaaucaaggcucaaugcucugggaaaaucugaauuucagaucuauaagaaaucugguauucaagaaguugacagaacuuuagcuaaggaaggaauuaaaagaggugaaacugaucaucaugcuguaagccguggcuccgcuaaacuaagaugguuuguagagagaaacaugauuacuccugaggguaaaguaguagaucuagguugcgguagagggggauggucguauuauugugggggccuuaaaaauguuagagagguuaaagggcuaacuaaaggggguccuggccacgaggagcccauccccaugucuacuuaugguuggaauuuaguacgguuacaaucaggaguagauguauucuuuacgcccccugaaaaaugugacacguuacuuugcgauauaggcgaguccucccccaauccaacaguggaagcaggucgcacguugagggucuugaaccuaguggaaaauuggcuuaauaacaauacacaauuuuguauaaaaguacuaaauccauauaugccuucuguaauagagaaaauggaagcgcugcagcgcaaauacgggggcgcauuaguaagaaacccauuaucucgaaauucaacacacgaaauguauugggugucaaaugcaucuggcaauauaguaucaagugucaauaugaucaguagaauguuaauaaauagguucaccaugaaacacaagaaagccaccuaugaaccggaugucgaucuugggagugguacgcgaaauaucggaauugaaucagaaguaccgaaccuagauaucauagggaaaaggauagagaaaaucaaacaagaacacgagacaucauggcauuacgaucaagaucacccguacaaaacuugggcauaucaugguuccuaugaaacaaagcaaacaggaucagcgagcaguaugguaaauggagugguacgucuauuaaccaaaccaugggauguacuuccaacuguuacgcaaauggcgaugaccgacacaaccccauucggacaacagagaguuuuuaaagaaaaaguugauacccgcacacaagaaccaaaagagggcacaaagaaacucaugaaaauaacugcggaaugguuauggaaagaauuagggaaaaagaaaacgcccagaauguguacuagagaagaauuuacacggaaaguuaggagcaaugcugcuuuaggugcaaucuucacagaugaaaauaaauggaagucagcccgagaggcagucgaggacucgagauuuugggaauuaguggacaaagagagaaaccuccaucuagaagggaagugcgaaacauguguauauaauaugaugggaaaaagggagaagaaacugggagaauuugguaaagcuaaagguagucgggcuauaugguauauguggcuuggagccagguuucuugaguucgaagcacuuggguuccuaaacgaggaucacugguucagcagagagaacagucuaucaggaguagaaggcgaaggccuccauaaacuugguuauauacuaagagaugucagcaagaaagaagguggugcaauguacgcagacgauaccgcggggugggauacaagaauuacgcucgaagauuugaagaaugaagaaaugguaacuaaucacauggagggggaacacaagaaauuagcagaggcuauauuuaaacuaaccuaucagaacaaggugguuaggguacaacgaccuacaccacgaggcacuguaauggauauuauuagucgacgagaucaaagaggaaguggccaaguagguacuuacggcuuaaacacuuuuacuaauauggaggcgcaacuaauucgacaaauggaaggggaaggagucuuuaaaaauauacaacacuuaacagcuacagaagaaauugcaguccaaaauuggcuagccaggguugggcgagaaagacuaucgagaauggccauuucgggagaugauuguguaguaaaaccuuuagacgaccguuucgcgucugcucucacugcucuuaaugacaugggcaagguaagaaaggacauucaacaaugggaaccaagcagagguuggaaugacuggacacaaguuccguucugcagccaucacuuccaugaacuuauuaugaaagacggcagaguguuaguagucccgugccggaaccaggaugaauuaaucggacgggcacguaucucacaaggcgcgggcuggagucuacgagaaacugcaugucuggggaaaucguacgcacaaauguggucuuugauguauuuccauagaagagacuuacgauuagcggcaaacgcaauauguucugcagugccuucacauuggguaccgaccucgaggacuacuuggagcauacaugcaaaacaugaguggaugacaacagaggauauguugaccguguggaacaggguauggauucaagaaaauccuuggauggaagauaaaacuccuguagaaucaugggaagaaaucccauaccuugguaaaagagaagaucaauggugugggucucugauaggucuaacgucccgagcgacgugggccaaaaauauccaagccgcaauaaaucaagugcgaagucuaauugggaacgaagaauacacugauuacaugccuucuaugaaaagauucagacgcgaagaagaggaggccggggucuuaugguga

SEQ ID NO: 22973 - RNA, 9876 nt, Artificial Sequence
  derived and/or modified CDS sequence (opt6) from DENV-2__AF169680__SS-prME
agcgcgggaaugauuauuaugcuaauucccacggugauggcauuucaucuuacaacucgcaauggagaaccgcauaugauuguaucaauacaagaaaaagggaaaucuuuguuguuuaaaacggaagauggaguuaauauguguacacuaauggcaauggaccuaggugaacucugugaagauacuauaacauacaaauguccgcuacuuagacaaaaugaaccugaagauaucgacugcugguguaauuccacaucaacauggguaacauacgguacauguacaacaacaggagaacacagacgcgaaaaacgcucaguagcacucguaccgcauguuggaaugggacuggaaacuagaacugaaaccuggaugucaucagaaggugcuuggaaacaugcccaacguauagaaacauggauucuucgacaucccgguuuuacuauaauggcagccauuuuagcauauacgauugggacaacucauuuucaaagagcauugauuuuuauuuuguuaaccgcugucgcaccaucuaugacuaugcguuguauaggaaucaguaaucgagauuucguagaaggaguaucaggagguaguugggucgauauaguacuagaacauggauccugcguaacaacaauggcuaaaaauaaacccacucuugacuucgaauuaauaaaaaccgaagcgaaacaacccgcuacuuugcggaaauacuguauugaagccaaacucacaaacacuacgacagaaucacgcuguccaacucaaggagaacccucuuuaaaagaagaacaagauaaaagauuuguauguaaacacucuaugguagaucgagggugggguaauggauguggauuauuugggaaaggcggaauuguuacuugcgcaauguuuaccuguaagaaaaauauggaaggaaaaauugugcaaccagaaaaucuagaauauacuauaguugucacaccacacucaggugaagaacacgccguuggcaacgacaccggaaaacauggaaaagaaauaaaaguaacaccacaaucgucaaucacugaagcggaacuaacaggcuacgguacaguuacaauggaaugcagcccuagaacaggacuugauuucaaugagaugguguuguuacaaauggaaaacaaagcgugguuaguacaucgacaaugguucuuagaucucccacugcccugguugccaggagcugacacccaagguucgaauuggauccaaaaagagacccuagugacauuuaaaaauccucaugccaagaaacaagacguagucguacuaggaucccaggaaggagcaaugcauacugcuuugacuggcgccacagaaauucagaugucaaguggaaacuuguuguucacgggucauuuaaaaugucgacuacggauggacaaacuccaguuaaaagggaugucauauucuaugugcacgggcaaauuuaaaguuguaaaagagaucgcagagacgcagcauggaaccauaguaauuaggguacaguaugaaggagacggaucuccauguauaauaccuuuugaaauaauggaccuagagaaacgauauguuuugggucgacuaauaacuguaaacccuauugugacagaaaaagauucgccaguaaacauagaagcugaaccaccauuuggcgauucauauauuauuauuggugucgaaccuggacaauugaaacuaaacugguuuaagaaaggaucuucaauuggccaaauguuugagacuacuaugaggggcgccaaaaggauggcuauacuuggagacaccgcuugggacuuuggaucucuuggaggagucuucacgucaauaggaaaggcauuacaucagguguucggugccauuuauggggcugcuuucagcgguguuagcuggacaaugaaaauacugauaggcgucauaauaacguggauagggaugaacaguagaucaaccucucuuucuguaagucuaguccuaguggguauagugacauuauaucucggcgugaugguacaagccgacucaggguguguagucaguuggaaaaauaaggaacucaaaugugguagcgggauauuuauuacugacaacguacacacuuggacagaacaauauaaguuucaaccagaaucgccaucuaaacuagccagugcuauccaaaaagcccaggaggaagguaucuguggaauacgcuccgucacuagacuggaaaacuugauguggaagcaaauaacaccggaauuaaaucacauuuuagcagaaaaugaaguaaagcuaaccauuaugacaggagauaucaaaggaauuaugcaagcugggaaacgaagucuuagaccacaaccaacagaauuaaaauacucauggaagacuuggggcaaggccaagaugcuaagcacagaaucacauaaccagaacuuuuuaauagauggucccgaaacagcugagugcccaaacacuaacagggcguggaauagccuugaaguagaagacuacggcuuuggggucuuuacaacuaauguuugguugaaacucaaagagaaacaagaugcauuuugcgacaguaaauuaaugagcgcagcuauaaaggauaaccgagcaguacacgcugauaugggauauuggauugaaucagcacuaaacgauaccuggaaaaucgaaaaagccucuuucauagaaguuaagaauugucauuggccgaaaagucacacucuauggaguaauggugugcucgaguccgaaaugauuauucccaaaaaccucgcugguccagucucacaacacaauuaucggcccggcuaccauacgcaaauagcugguccauggcaucucgguaaacuugaaauggauuucgacuuuugcgauggcacaacggucguggugacugaggacuguggaaacagagguccauccuuacgaaccaccaccgccagcgggaaauugauaacugaauggugcuguagaagcugcacacuacccccacuaagguaccggggagaggacgguugcugguaugguauggagauccggccuuugaaagaaaaggaagaaaacuuagugaacagccuagugacugccggucaugggcaagucgacaacuuuagccuaggaguacuagguauggcacucuuccuagaagaaaugcucagaacaaggguaggcaccaaacacgcaauccuacuuguggcuguaucauuuguaacuuuaauuacgggaaacaugagcuucaaagauuugggucggguuguggugauggucggugcuacuaugaccgacgacauaggaaugggaguaacguauuuagcacugcuagcagcguucaaagugagacccacauucgcugccgggcuuuuauuaagaaaauugacgucaaaagaacucaugaugacaacaauaggaauaguccucuuaagccaaagcaccauaccggagacuauucuggagcuaacagaugcuuuggcacuuggaaugaugguguuaaaaaucgucagaaauauggaaaaauaccaauuagcaguaacuauuauggcaauacuuugcguuccaaaugcaguaauuuugcaaaaugcauggaaagucagcuguacuauacuagcgguaguaucuguauccccauuaauauugacgaguucacaacagaaaacugauuggauaccguuagcccucaccaucaaagggcuaaacccaacggccauauuuuugacaacguuaucaagaacgaauaagaaacgauccuggccucuuaaugaggcgauaauggccguagggauggucucaauucuagccucaagucuauuaaagaaugauauaccuaugacaggaccuuugguagcagggggacuuuugacaguuuguuauguguuaacuggaagaagcgcagaucuagagcucgaacgagcuaccgacguaaagugggaacgccaagcggaaauuuccggaucaagcccaauacuuuccauaaccauaucagaggacgggagcaugucgauuaaaaacgaagaagaagaacaaacacucacuauauuaauuagaacuggccuauuaguaaucucagggcuauucccaguaucgauuccuauaacggcugccgcaugguaccuaugggaaguuaaaaagcagcgagcaggcguccucugggauguaccuagcccacccccaauggggaaagcagagcucgaagacggugcauacagaauaaaacaaaaaggcauucuagguuauagccaaaucggugcaggcguuuauaaagaagggaccuuucauacuauguggcauguaacacgaggcgcgguccuaaugcauaagggcaagcgaauagaaccaaguugggccgacgucaagaaagacuuaauaagcuauggagguggguggaagcuagagggugaguggaaggaaggagaagaaguacaaguacuagcacuagaacccgggaagaauccgcgagcuguccaaacuaaaccaggacucuuuaagacaaauacuggaaccauuggagcagugagcuuagacuuuucgcccggcacuucaggaagcccaauuauagacaaaaaggguaagguaguuggacuuuaugguaaugguguagugacacggaguggugcuuauguaagcgcaaucgcacaaacagaaaaguccaucgaagauaauccagaaauugaggaugacauuuuucgaaaaagaaagaugacaauuauggaucuccacccgggagcagguaaaaccaaaagauacuuaccagcaauaguuagagaagcuauuaaacgcgguuuacgaacauuaauuuuggcaccaacgagaguugucgcugcugaaauggaggaagcgcugaggggauugccuauacgauaccaaaccccugcaauaagagcggaacauacuggaagggaaaucguagacuugaugugucacgcaacauucaccaugcgcuugcuuucaccaguucgagugccaaacuauaauuugauuauuauggaugaggcgcacuuuacggacccggcuucuaucgcagcacguggauauauaucaacaagaguggaaaugggugaagccgcaggcauuuucaugacggcuaccccacccggcucaagagaucccuucccccaaucgaaugcaccuauaauugaugaggagagagaaauaccugagagaucguggaacaguggacacgagugggugacagauuuuaaagggaaaacugucugguuuguaccuagcauaaaagcgggaaacgauaucgcagcaugucugaggaaaaauggcaagaaaguaauacaauuaucuagaaagacuuucgauagugaauauguaaaaacaaggaccaaugacugggauuuuguaguuacuacugauauuuccgagaugggugcgaauuucaaagcugagaggguaauugauccaagaagauguaugaaaccgguaauacucacggauggagaagaacgcgugauuuuggcugguccuaugccugucacacauucgucugcugcacagaggcgggguagaauagggaggaaccccaaaaaugaaaaugaccaauauauauauaugggcgaaccacuugaaaaugaugaagauugcgcgcauuggaaggaagccaaaaugcuguuagacaauauaaauacuccagaagguauuauaccauccauguuugaaccagaacgagaaaaaguugacgcaauugacggugaauauagacuacgaggagaagcaaggaagaccuuuguugaccugaugagacgaggcgaccuaccuguauggcuagcauacaaaguggccgcagaggguauaaauuacgcagacagaagauggugcuucgacggcauucgaaacaaccagaucuuagaggaaaauguagaaguugagaucuggacuaaggaaggagaaagaaagaaguuaaaaccuagaugguuagaugccagaaucuauagcgacccgcuagcuuuaaaagaguuuaaagaauuugcagccggucgaaagagccuuacacugaaucuaaucacagaaaugggaagauugccuaccuucaugacccaaaaagcacgagaugcgcuagacaaucuagcaguuuugcacacggcagaggcgggaggucgugcauacaaccacgcauuaucugaacuccccgagacuuuagaaacucuacuuuuacuaacauuacuugcgacuguaaccgguggaauauuuuuauuccuaaugucaggacgaggcauaggaaagaugacucuuggaaugugcuguauaauuacagccucuauucuacucugguacgcgcagauacagccacauuggauagcugcuaguauaauuuuagaguucuuucuaauuguacuguuaauaccagaaccugaaaaacagagaacaccacaagauaaucaauuaacauauguaguaauugcuauccuaaccgugguggcugcaacuauggcaaacgaaaugggauuuuuagaaaagaccaagaaagaccuaggauuuggaaguauagccacacaacaaccugaguccaacauauuggauauagaucugcguccugcaagugcauggacauuguaugcaguagcgacaacguuuguuacaccaaugcucagacacagcauagagaauagcucaguaaacguaucacuaacggcuaucgcuaaucaggcaacaguccuaaugggacuaggaaaagguuggccacuauccaaaauggacauuggagugccacuauuagcgaucggauguuacucgcaaguaaauccuaucacacuaacagccgcccuguuacuccuagucgcacacuaugcuauaauuggaccaggucuacaggccaaagccacgcgggaagcucagaaacgggcugcagcgggaauuaugaaaaaucccuccguggacgguaucacugugauagacuuggaucccauacccuaugacccgaaguuugaaaaacaacucggacaagugaugcuauuaguccucugcgugacucaaguuuugaugaugaggacaacaugggcacuuugugaggcucucaccuuggcgaccggacccauaucaaccuuaugggagggaaaucccggacgauuuuggaauacgaccauugcagucucaauggcuaauaucuuccgugguaguuacuuagcuggcgcgggcuugcucuuuucaaucaugaaaaauaccacgaacacaagaagagguacagggaauauaggagaaacacuuggcgagaaauggaagucacgacuuaaugcuuuaggaaaaagcgaauuucaaaucuauaaaaagagcggaauacaggaaguggaccguacacuugccaaagaaggaauuaaaaggggagaaaccgaccaucauacuguaucucgaggaagugcgaaauuacguugguuuguagagagaaauaugauaacaccggagggaaaaguuuuagacuugggauguggacgaggagguuggaguuacuauuguggagguuuaaagaacguccgugaaguaaagggacuaacaaaaggugguccuggucacgaagaaccgauuccaaugagcacauacggcuggaauuuaguaagauugcagagugguguggaugucuuuuucacuccaccagaaaaaugcgauacuuugcuuugugauaucggagagagcagcccaaauccuacaguagaagcaggcaggaccuuaaggguacuaaaucuaguagaaaacuggcuuaacaauaauacucaguuuuguauaaagguuuuaaacccauauaugccgagcguaauagagaagauggaggcuuuacagcgcaaauacggaggagcacuuguuaggaauccauuaucacguaacuccacgcaugagauguauugggugucaaaugccaguggaaauauuguaaguucuguaaacaugauaucaagaaugcuuaucaacagguuuacaaugaaacacaagaaagcuacauaugaaccagacgucgaucuagguucuggaacgcgcaacauaggaaucgaaucugaagugcccaauuuagacauuaucggaaaaaggauugagaaaauaaagcaggaacaugaaaccaguuggcacuacgaccaagaucauccauacaaaacuugggcguaccaugguucuuacgaaacaaaacagacaggaagugcaucuucuaugguuaauggugugguaaggcuacucacgaaaccaugggacguacuaccaaccgucacucaaauggcaaugacagauacuacaccauuugggcaacagagaguauuuaaagaaaaaguagacacacguacucaagaaccuaaagaaggaacaaagaaacuaaugaaaauaacggccgaaugguuguggaaagaauuagguaagaagaaaacuccaagaaugugcacgagggaagaguucacaaggaaaguaagauccaacgcagcccuaggagcaauauuuacugacgaaaauaaauggaagucagcaagagaagcaguggaagauucgcguuuuugggaauuaguugauaaagaaaggaauuuacacuuggaaggcaaaugcgaaaccuguguauacaacaugaugggaaaaagagagaagaaauugggggaguucgggaaggcaaaaggcucacgugcaauuugguauaugugguuaggagcaagguuccuggaguucgaggcuuugggguuucuuaaugaagaccauugguucucgcgugaaaauucccuaucagguguagaaggagaagggcuacauaaguuaggauauauacuacgagauguaaguaagaaagagggcggagcgauguaugcugaugacacagcagguugggauacaagaauaacauuagaagaucuuaagaaugaggaaaugguuacgaaucacauggaaggagaacacaagaaacuagcugaagcuauauucaagcuaacauaucaaaauaaagucgucagaguacaaaggccgacucccagaggaacuguuauggauauaaucagucguagagaucaaagaggguccggccaaguagguacauacggucugaauacuuuuacgaacauggaagcacaauuaauacgccaaauggaaggagaaggagucuucaaaaacauacaacaucuaacggcuacggaggagauagcaguacaaaauugguuagcacgaguugggagggaacgccuuagucggauggcaaucucaggcgacgacugugucgucaaaccacuagacgauagauucgcaucugcccugaccgcuuugaacgacaugggaaaggugcgaaaagacauacaacaaugggaacccagcagaggauggaaugacuggacucaagucccuuuuugcucucaucacuuucaugagcuaauaaugaaggaugguagaguccuagugguaccaugcagaaaucaagaugagcugauagguagagcaaggauaagucaaggagcuggauggucguuaagagaaacggcaugucucgggaaaaguuacgcacaaauguggucucuaauguacuuccauagaagggauuuacgacuagcugcaaacgccauuugcagugcugucccuucacauuggguucccacgaguaggacaacauggucaauucaugcaaaacacgaguggaugacuacagaagacaugcugaccguuuggaacagggucuggauacaagaaaauccuuggauggaagauaaaacaccgguagagucaugggaggaaauacccuaccuuggaaaaagggaagaucaauggugugguagccuaaucggguuaaccagccgugcuacuugggcuaaaaauauccaagcagcaauaaaucaaguacggaguuuaauaggcaacgaggaauacacagacuauaugccaagcaugaaacguuucagaagagaagaagaagaagcaggaguucuaugguga

SEQ ID NO: 22974 - RNA, 9876 nt, Artificial Sequence
  derived and/or modified CDS sequence (opt6) from DENV-2__AF169682__SS-prME
agcgccgggaugauuauuaugcucauaccaacaguaauggcuuuucauuugacgacucgaaauggagaaccacauaugauugucagcauccaggagaaaggcaaaagcuugcuuuucaaaacugaagacggugucaacauguguacauugauggcaauggauuuaggagaacuaugcgaagacacaauuacauauaaaugcccucuacuacgccaaaacgaaccggaggauauagauuguugguguaauucaacgaguacaugggucacuuacggaaccuguacaaccacaggagagcaccguagagaaaaacggaguguggcucucgugccacauguugguaugggguuagagacuaggacagaaacauggaugucaucagagggugcuuggaaacacgcucaaaggaucgagacauggauuuuaaggcauccaggauucacaauaauggcagcuauacuggcuuauacuaucggaacaacacacuuucaaagggcacuuaucuucauauuacucacggccgucgccccuucgaugacuaugagauguauaggaauuucaaacagagauuuuguggaggggguuagcggagguaguuggguugauauaguacucgagcaugguucuuguguaacuacuauggcaaaaaacaaaccaacacuugauuuugaacugauaaagacggaagcaaaacaaccggccacacuaaggaaauauuguauugaagcaaaauuaacuaacacaacgaccgagucccgaugcccgacacaaggagaaccaucacuuaaagaagagcaggauaagagauuugucuguaagcauucuaugguggacagaggauggggaaauggaugugggcucuuuggaaaaggaggcauaguuacaugcgcaauguucacauguaaaaaaaauauggaagggaaaauaguacaacccgaaaacuuagaauauacuauagugguuaccccgcauucaggugaagaacacgcuguugggaacgauacaggaaaacacgggaaagagauaaagguaacuccucaaucaaguauuaccgaagcugaacuaacggguuauggaacgguaacaauggaauguaguccuagaaccggcuuagauuuuaaugaaaugguuuugcuccagauggaaaauaaggcaugguugguacaucgacaaugguuccuugaccuuccauuaccauggcuuccuggggcagauacacaggggaguaauuggauccaaaaagaaacuuuaguuacguuuaaaaacccacaugccaaaaaacaagauguuguugugcuagguagucaagaaggugcuaugcauacugcuuuaacaggcgcaacagaaauucagaugaguucaggcaacuuacuguuuaccggacaucuaaagugccguuuacgaauggacaaauugcaauuaaaagggaugucguacucgauguguacuggaaaauucaaaguagugaaagaaaucgcggagacucaacaugggacaauagucauccgcgugcaauaugaaggagauggaucaccaugucguauccccuuugaaauaauggauuuagaaaaacgguacguccuuggacgucuaauaaccgucaauccaauuguuaccgaaaaagacuccccaguaaacauagaagcagaaccaccguuuggugauucguacauaauuaucggcguagaacccgggcaguuaaaacucaauugguucaaaaaaggauccucaaucggucaaauguucgaaacgacaaugcggggagccaaacggauggcaauccuaggugauacagcgugggacuuuggaucacuugguggaguauuuacaaguauaggaaaagcacuucaucaagucuuuggcgcaauauauggggccgcauucagcgggguaucguggacgaugaaaauauuaauuggagugauuauaacauggauugguaugaacucccgcagcacgagccuuucaguuucuuuggucuuaguggguauaguaacucuuuaccucggagugauggugcaagcggacuccggauguguagugucauggaagaauaaggaguuaaagugcggaucggguauuuuuaucacugauaaugugcauacuuggacugaacaauauaaguuucaaccggaaaguccaaguaaacuugcuagugccauucaaaaggcacaagaagagggaauaugcgguauucguucuguuacucgacuugagaauuuaauguggaaacaaauaacacccgaauuaaaucauauccuugcggaaaacgaaguuaaauuaacuauuaugacgggagauauaaaagguaucaugcaagccggaaaacgcucauuaagaccacaacccacagaacuaaaguacucguggaaaacguggggaaaagcaaagaugcucucaacugaaucucauaaucaaacuuucuuaaucgauggacccgaaaccgcagagugccccaacacgaauagagcauggaauaguuuggaaguugaggacuauggcuuuggaguguuuacaacuaauaucugguuaaaacuuaaagaaaaacaagaugcauuuugugauucaaaacuaaugagugcagccauaaaagauaaucgugcgguccaugcagauauggguuauuggauagaaagugcuuugaaugacacuuggaaaauagaaaaagcuuccuuuauagaaguaaaaaauugccacuggccuaagucucauacacuguggucgaacggaguacucgaauccgagaugauaauaccaaaaaaccuugcuggucccguaucacaacauaacuacagaccggguuaucauacucagaucgcagggccauggcacuuggguaaguuagaaauggacuuugacuuuugcgauggaaccaccguaguaguaacagaagauugcggaaacaggggucccuccuuacgaacaacaacagccagcggaaaacucauuacggaauggugcugucguucauguacacugccacccuugagauaccgaggagaggauggaugcugguaugggauggaaaucagaccccuuaaggaaaaagaagaaaauuuaguuaauucccuaguaacugcgggacacggacaaguugauaacuucagucuggguguuuuggggauggccuuauuccuagaagaaauguuacgcacacgugugggaacaaagcacgcgauucuacucguagcagugucuuuuguuaccuuaauaacaggaaacaugucauuuaaggaccuaggcagagucgugguaaugguaggggcgacaaugacggacgauauaggaaugggagucacauauuuagcucucuuagcggcauucaaaguuaggccaacuuuugcugcuggucuccuccuaagaaaacuuacuucaaaagaacuuaugaugacuacaaucggaauuguuuuacuaucucaaucaacgauucccgaaaccauccuagagcuaacagaugccuuagcgcuggguaugaugguacugaaaauaguacguaauauggagaaguaccaacuagcagucaccaucauggccaucuuauguguaccgaaugcgguaauucuucaaaaugcuuggaaagucagcuguacaauacuugcaguagucagcgugaguccauugauacuaaccucaucacaacaaaagaccgacuggauaccguuagcauuaacuauaaaaggacuuaauccaacugcuauauuucuaacuacacuaucaagaacuaacaaaaagaggucauggccacuaaaugaagccauaauggcggugggaaugguaagcauucuagcgucuucacuguuaaaaaaugacauaccaaugacugguccacuaguggcaggugguuuacucaccguuugcuauguauuaacuggucgauccgcagauuuagaguuagagcgagccaccgaugugaaaugggaagaucaagcagaaaucucuggcucuaguccuucccugaguauaacaauaucugaagauggaucaaugucaaucaaaaaugaggaagaagaacaaacacuaaccauauuaauaagaacaggauuacuuguaauaucaggacuuuuucccguuaguauuccuauuacagcagcugcuugguaucuuugggaaguaaaaaaacaaagggccggcguauugugggacguccccucaccaccaccaauggggaaagcugaauuagaagauggagcuuaccgaauaaagcaaaagggaauauugggauacucacaaauaggagcgggaguauacaaggaagguacauuccauacaauguggcauguaacaagaggagcuguacuaaugcauaaaggcaaaaggauagaaccuagcugggcagauguaaagaaggacuuaauuucauacggaggagguuggaaauuagaaggggaguggaaagagggagaagagguucagguguuggcguuagaaccaggaaagaauccuagagcuguacaaaccaagccgggacuguuuaaaacuaauacaggaacuauaggagcugucagcuuagacuuuuccccggguaccucugguucaccuaucauugacaaaaaaggcaaaguagucgguuuguauggaaauggcguaguuaccagaaguggcgcuuacguauccgccaucgcacaaacugaaaaaaguauugaagauaauccugaaauagaagaugauauuuucagaaaaagacgacuaacuauaauggauuuacacccaggugcuggcaaaacuaaacguuauuuaccugcuauuguaagagaagccauuaagagaggucuucgaaccuuaauauuagcgccuacacgagugguggcagccgaaauggaagaagcguuacgaggguuaccuauccguuaccagacuccagccaucagagcagagcacaccggucgugaaauuguagaucuuaugugccaugccaccuuuacaaugagacuauugaguccaguacgaguccccaauuauaaucucauuauuauggacgaagcacauuucacagacccagcgagcauagcagcuaggggguauauaucaaccagagucgaaaugggagaggcagcgggaauauuuaugacagcuacuccgccuggaagcagagacccauuuccgcagaguaacgcuccaauaauagaugaggaacgugaaauaccagagaggagcuggaauucaggucacgaauggguuaccgauuuuaaaggaaaaacgguuugguucgucccaucaauaaaggccgggaaugacauugcagcgugucuaaggaagaaugggaaaaaagucauccaacuaucgagaaaaacguucgauucugaauacgucaaaacgcggacgaacgacugggacuuuguaguaacuacagacaucagcgaaaugggcgccaauuucaaagcggaacgaguaauagacccaaggcgauguaugaaaccugugauacugacagauggagaagaacggguaauucuagccggaccaaugccaguaacgcacucaagugccgcacaaaggagaggaaggauaggcaggaacccgaagaaugaaaacgaucaauacauauacaugggugagccuuuggaaaacgacgaagacugcgcacauuggaaagaggccaaaaugcucuuagauaacaucaauaccccagagggaaucauaccaucgauguucgaaccugaacgagagaaagucgaugcgaucgauggugaauauaggcucagaggcgaagcucguaaaacuuuuguugacuuaaugcggcgcggagacuuaccagucuggcuagcguauaaaguagcggcagaagguauaaacuaugcagaucgcagauggugcuucgauggaauaaaaaauaaccagauauuagaagaaaacgucgagguagagauauggaccaaggaaggagagagaaaaaaacuuaagccuagguggcuggacgcacgaauauauucagacccucuggcguuaaaagaauuuaaggaauuugccgcggggaggaaaucucuggcauugaaccuaauaacagaaaugggacgacuaccaacauucaugacucagaaaacaagagacgcacuagacaauuuggcaguuuugcacaccgcggaagcaggggguagagcauauaaucaugcauugucugaauuaccagaaacacuagaaacacucuuauuguugacacuauuagcaacugugacuggcggcauauuuuuauuuuuaaugucagggcgagguaucgggaagaugacccuuggaaugugcugcauaauaacagcgucgauacugcuaugguacgcccaaauacaaccucauuggaucgcugcgagcauuauuuugguauuuuuucucaucgugcuauuaauuccagagccagagaaacaaaggacaccacaagacaaucaauuaacauaugucguuauagcuauauuaacgguaguagcugcuacuauggcuaaugagaugggcuucuuggaaaaaacaaaaaaagacuuaggguucgggaguauugcuacucaacaaccugaaucuaauauuuuggauauagaucucagaccagccucagcuuggacuuuauaugccguugccacaaccuucguaacccccaugcuaagacauucaauagaaaauucgucaguaaacguaucauuaaccgccauugcuaaccaagcaacaguacuaaugggacuagguaaagguuggccccugagcaaaauggauauaggcgucccuuuacuugcaauugguugcuacagucaggucaauccuaucacacucacagcugcucuucuuuuacuaguagcacacuacgcgauaauaggacccggacuucaggcuaaagccacuagagaagcccagaaaagagccgcagcuggaaucaugaagaacccgacagucgauggaauaaccguuaucgaucuugacccuauuccuuacgauccuaaauucgaaaaacaauugggacaaguuaugcuacuaguacuguguguaacacaaguguuaaugaugagaacuaccugggcccuaugcgaagccuugacguuggcaacaggcccgauuaguacuuuaugggaagggaaucccgggcgcuucuggaacaccacgauugccguuucuauggcaaauauuuuucggggaucguaccuugcaggggccggacuauuguuuucgaucaugaaaaacacgacgaauacaaggagaggaacagguaacauaggugaaacauugggugagaaguggaagaguagauuaaacgcacuugguaagucagaguuucaaaucuauaaaaaaucugggauccaggaaguggaucggacauuggcgaaagaaggcauaaaaaggggugaaaccgaucaccacgcgguaucacguggaagcgcgaaauuacggugguuuguggagcgaaauaugguaacuccagaagguaaaguagucgaccuuggaugugggaggggugguuggaguuacuauugugggggauuaaaaaacguccgagaaguaaaggggcuuacaaaggguggacccggucacgaggaaccuauaccgaugucaacauauggguggaaucugguacguuuacaaucgggaguugauguguuuuuuaccccuccugaaaaaugugauacguuacuaugugacauaggagagucaaguccaaacccuacuguugaagccggaaggacucuaagaguacuuaauuuaguggagaacugguugaacaauaacacucaauuuugcauuaagguacuaaaccccuauaugccaucaguaauagagaagauggaagccuugcaaaggaaguaugguggugcauuaguaagaaauccccuaucgcgcaacagcacacaugaaauguacuggguaucgaacgccagugguaacauagugaguucuguaaacaugauauccagaauguuaauaaacagauuuacgaugaaacacaaaaaagccaccuaugaaccagacguugauuuggguagugguacaagaaauauaggaauugaaagcgagguaccgaacuuggauauaauagggaagcguauagaaaagaucaaacaagaacacgagacgucauggcauuaugaccaagaccaucccuacaagaccugggcguaccaugggagcuaugaaacaaaacaaacuggaagugcuucuucgaugguuaauggaguuguacgguugcucacuaaaccaugggaugugcuuccuacugugacucaaauggcuaugacagauaccacucccuucggacaacagagaguguuuaaagaaaaagucgauacuagaacucaagaaccuaaggaagguacgaaaaaguugaugaaaauaacagcagaguggcuguggaaagaacuagguaagaagaaaacaccacggaugugcacaagagaggaauucacgcgcaaagugcgaucaaacgccgcauuaggggcaauuuucaccgacgaaaauaaauggaaguccgcuagggaagcagucgaagacucaagauuuugggaauuaguugacaaagagagaaacuuacaccuagaagggaagugugaaacauguguuuauaauaugaugggaaaacgugaaaaaaaauuaggugaauuuggaaaagcaaaagguucacgagcaauaugguacaugugguuaggugcaagauuuuuagaauuugaagcccucggauuuuuaaacgaagaucauugguuuagcagggagaacagucucaguggaguagagggagagggcuuacauaaacuaggguauauauuacgagacguaucaaaaaaagagggaggugcaauguaugcugaugacacagcaggcugggauacucgcauaaccuuagaagaccuaaagaaugaagaaaugguuaccaaucacauggaaggcgagcacaaaaaauuggcagaagcaauauuuaaacuaacauaccagaacaaaguuguaagggugcaacgccccacgccucgaggaacugucauggauauuauaagccgaagagaccaaagaggaagcggacaaguaggaacguauggccuuaauacauuuaccaacauggaggcgcaacuaauucggcagauggaaggagaaggaguguuuaagaauauacaacacuuaacugcuaccgaagaaauagcaguucaaaauugccuugccagauuaggaagagaaagacuuucccggauggcgauuucgggugaugauugcguaguuaagccgcucgaugauagauucgcaagugcauuaacagcuuuaaaugacauggguaaaaucaggaaggacauacaacagugggaacccucaagagguuggaaugauuggacacaagucccauuuugcucacaccauuuccaugaauuaaucaugaaagaugggagaguauuaguuguuccauguagaaaccaagacgaauuaaucggaagggcaaggauuagccagggcgccggguggucccuuagggaaacugcuugucuagguaaaaguuacgcacagauguggucucucauguauuuccauagaagagauuugagacuugcggcgaacgccauaugcagugccguuccaagucauuggguaccuacaagucgaaccacguggucgauucaugcaaaacaugaguggaugacaacugaggauaugcugacaguauggaauagagucuggauacaagaaaauccuuggauggaagacaagacaccuguagagucuugggaagaaauaccuuauuuagguaaacgagaagaucaauggugugggucauuaauaggacuaacuucgcgagccacaugggcuaaaaacauacaggcugcaauaaaccaagucagaagccuuauaggaaaugaggaauauacugauuauaugccuagcaugaaaagauucagacgggaagaagaggaagccgguguucuaugguga

SEQ ID NO: 22975 - RNA, 9876 nt, Artificial Sequence
  derived and/or modified CDS sequence (opt6) from DENV-2__AF169681__SS-prME
uccgcgggaaugauaauuaugcuuauacccacgguuauggcuuuucacuuaacaacacguaacggugaaccccacaugauaguaucaauacaagaaaaaggaaaaucucuucuguuuaaaacugaggacggaguuaauauguguacacuaauggcaauggaccuaggagaauuaugcgaagauacaauaacuuauaaauguccucuucugagacaaaacgaaccagaggauauagacuguugguguaacucaacgucuacauggguaacauacggaacuuguaccacuacuggagaacauagaagagagaaaagaagcguagcacuuguaccacauguuggaaugggcuuagaaacgagaacggaaaccuggaugucaucugagggggcguggaaacaugcucaaagaaucgaaacauggauacuaaggcaccccggcuuuacgauuauggcagcaauccuagcauauacuaucggcacgacccacuuccaaagagcacuaaucuuuauacuccugacggcaguugcuccgaguaugaccaugaggugcauugguauaucuaacagggacuucguugagggaguauccggcggauccuggguagacauuguucuugaacacggaaguugcgugacuacaauggccaaaaauaaacccacacuugacuucgaacugauaaaaacugaagcgaaacaaccagcuacgcuaaggaaauacuguaucgaagcaaaacucacuaacacaacuacggagucacgguguccaacccagggugaaccuucuuuaaaagaagaacaagacaaacgauucguguguaaacauagcaugguagaccgagguuggggaaacgggugcgguuuguuuggaaaagggggaauaguaaccugugcgauguuuaccuguaagaaaaacauggaagggaaaauuguucaaccggaaaacuuggaauacacgauaguagucacuccgcacucaggagaagaacaugcgguaggaaaugacacaggaaaacaugguaaagagauaaaagugacgccacagaguaguauaacagaagcggaauuaaccgguuaugguaccguaacaauggaauguucgcccagaacgggauuagauuuuaacgagaugguucuauuacagauggaaaacaaagcauggcuaguucauaggcaaugguucuuagauuuaccucuaccuuggcuucccggagcugauacccagggaucuaauuggauacaaaaagaaacgcuaguaacguucaaaaauccacacgcgaagaaacaagacguaguaguauugggaagccaagaaggagcaaugcauacagcccuaacaggugcaacugaaauacaaaugagcucggguaaucuguuauuuacagggcauuuaaaaugcagauuaagaauggauaaauugcaauuaaaaggaaugaguuauagcauguguacgggaaaauucaaaguugucaaggaaauugcugagacgcaacacggcacgauagugauccgaguacaguacgaaggagauggaucaccuuguaggauuccauucgaaauaauggacuuggaaaagcgguauguacuuggucgacuaaucacaguuaacccaauagucacagagaaagacucgccaguaaacauugaggcagaaccuccauucggggacuccuauauuauaauagguguagaaccuggacaauugaaauuaaauugguuuaagaaagguagcucgauaggccaaauguucgaaaccaccaugagaggugcuaaaagaauggcaauuuugggagacacggcuugggauuuuggaucacuagggggagucuuuacaucaauaggaaaggcacuacaucagguuuuuggugccauauauggggcagcuuuuagcggcgugucuuggacaaugaaaauauuaaucggugugauuaucacauggaucggaaugaacucgaggucaacaagucuauccguuucucucguucucguuggaauugucacguuauauuuagguguuaugguacaggcugauucggguugcguagugaguuggaaaaauaaagaacucaaaugcggcaguggaauuuuuauaacugauaauguucacacauggacugagcaauauaaguuucaaccggaaucacccucaaaauuagcuucagcaauucagaaagcacaagaagaagguaucuguggcauuaggaguguaacuagauuggagaaucuuauguggaaacaaauaacuccugaacucaaucacauacucgcggaaaacgagguaaaacugacaauuaugaccggagauauuaaaggaauaaugcaagcggggaaacguaguuugaggccgcaaccgaccgaauugaaauacuccuggaagacguggggaaaagcuaaaaugcuaaguaccgaaagucacaaccaaacguucuuaaucgaugggccgaagacagcugaauguccuaacaccaaucgugcauggaauagcuuggagguagaggacuacggcuuuggaguguuuacaacaaauauuuggcucaaacuaaaggaaaaacaggaugcuuuaugugauucgaaacugaugucagcugccaucaaagacaacagagcgguccaugcggauaugggauauuggauugaaucagcauuaaaugauaccuggaaaauagaaaaggccaguuuuaucgaagucaaaaacugucauuggccuaaaucccauacccuauggucaaauggcgucuuagagucagagaugauuauuccuaaaaacuuagccggcccagucucacaacauaacuacagacccgguuaucauacacaaauagcgggaccauggcaucuagggaaauuagaaauggauuuugacuuuugcgauggaacaacgguuguagucacugaagauuguggcaauagagguccaucucuacggacaacaacggcuagugguaagcuaauaacagaauggugcuguagaucguguacacuucccccacugagauaccgaggagaagacggcuguugguacgguauggaaauaaggccguuaaaagaaaaggaagaaaaucucguaaauagccuaguuaccgcaggacacgggcaaguggacaacuucucuuuggguguacucgggauggcacuuuuucuugaggaaaugcuucggacucgaguuggcacgaaacacgcgauccuauugguugccguuucauuugugacacuuauuacuggaaacauguccuuuaaagaccuaggcagggugguaguaaugguaggagcaacaaugacggacgacauagggauggguguuacuuaucuugccuuauuagcagcuuuuaaaguacgaccgaccuucgcagcugguuuauuacuaagaaaauuaacaaguaaagaacucaugaugacuacaauugguauuguacuacucucucaaaguacgauuccagaaacaauacuagaacuuacagaugcauuagccuuagggaugaugguacugaaaaucguucgcaauauggagaaauaucaguuagcgguaacuauaauggcaaucuugugcguaccuaaugcggucauuuuacaaaaugcauggaaaguuaguuguacaauacucgcgguugucagcgugagcccuuuaauacugacgagcucucagcaaaagacagauuggauuccacuagcacugacaauaaaaggauuaaauccgacugccauauuuuuaacaacauuaagucguaccaacaaaaagagaucguggccacuaaacgaagcaauaauggcaguagguaugguaucaaucuuggcaaguagcuuacucaaaaaugauauaccuaugacugguccccugguugcuggcgggcuauugacgguuuguuacguacucacagguagaucagcugaccuggagcuagagagggcuacagacguaaaaugggagaaccaggccgaaaucucagggaguuccccgauuuuaucuaucacuauaagcgaggaugguucuaugaguaucaaaaaugaagaagaagaacaaaccuuaacuauauuaauucggacuggucuuuuagucauaucugggcuauuccccguuucaauuccuauaacagccgcagcuugguaccuaugggaagucaagaaacaaagagcugggguacuaugggauguaccaucaccgcccccaauggguaaggcagaacucgaggauggugcguauagaauaaaacaaaagggcaucuuagguuauucucaaaucggugcugguguguacaaggaggguacauuucauacaauguggcacguaacaagaggagcaguccuaaugcacaagggaaaacggaucgaaccguccugggcugauguaaagaaagauuuaauaaguuacggagguggauggaaacuggaaggagaguggaaagaaggugaagagguacaaguguuggcacuggaaccggggaaaaauccacgggccguucagacuaagccaggacucuuuaagacaaacaccggaaccauaggugccgucagucuagauuucucccccgggaccaguggauccccaaucauugacaagaaagguaaaguaguagguuuauaugggaacggaguugucacccgaagcggggcauaugugagcgcaauagcgcagaccgagaaaucaauugaagacaacccagaaauugaagacgauauauuuaggaaaagaagauugaccaucauggaucuucacccuggggcagguaaaacaaagcgauaucucccugcgauuguucgugaagcgauaaaaagagguuugcgaacuuuaauccuagcaccaacacgcguugucgcagcugaaauggaggaagcgcucagaggcuuaccgauacgguaucaaaccccugcaaucagagcagagcacacuggucgagaaauaguagaccuaaugugucaugcaaccuuuacaaugcgcuuacucuccccagucaggguuccaaacuauaaccuuauaauaauggacgaagcucacuuuaccgaccccgcgaguauagcagcaaggggauauauuagcacacgagucgaaaugggggaagcagcaggcauuuucaugacagcaacgccgccaggaucccgggauccauuuccacaaucaaaugcaccaaucauagacgaagaaagagagauuccagaaagaaguuggaacuccggacaugaaugggucacagacuuuaaaggaaaaacuguaugguucgugcccaguauaaaagccggaaaugacauagcagcuugcuuaaggaaaaacggcaagaaaguaauacagcuaaguaggaaaacuuucgauucggaguauguuaaaacgcgaacaaaugauugggauuuugucguaacuacagacauuucagaaaugggagccaauuuuaaagcagagagagucaucgauccacgaagauguaugaaaccugucauauuaacugacggggaagaacgaguuauuuuagccggcccaaugcccguuacucacucaagugccgcgcaaaggcgcggaaggauagguagaaacccuaagaaugaaaaugaccaauacauuuauaugggugaaccauuggaaaaugacgaagacugugcucauuggaaagaagcaaaaauguuauuggauaauaucaacacacccgaagguauaauaccaucgauguuugagccagaaagagaaaaagucgacgcaauagauggugaauacagacuacgaggcgaggccagaaaaacauuuguagaucuaaugcgaagaggagauuugccaguauggcuugcuuacaaaguggccgcugaaggaauuaauuaugcggauaggcguuggugcuucgaugguaucaaaaauaaccaaauucuagaagagaaugucgaaguagaaauauggacuaaagagggugagaggaagaaacuaaagccaagauggcuugaugcgaggaucuacagugauccuuuggcauugaaagaguucaaagaguuugcugcuggacguaaaucacucgcucucaaccuaauuacagaaaugggaagacuaccaacauuuaugacacagaaaacgcgcgacgcacucgacaaccuugcaguccuccauacugcagaagcugguggacgcgccuauaaccaugcauuaucagaauugccugagaccuuagaaacuuuauuacuacucaccuuauuagcaacuguaacaggagguauuuuccuauucuuaaugucggguagaggaauaggcaaaaugacacucggaauguguuguauaauuacugcaagcauacucuugugguacgcccaaauccaaccucauuggaucgcagcuucaauaauccuaguauucuuuuuaaucguguuacucaucccagaacccgagaaacaaagaacgccacaggauaaccaacuuacuuacgucguuaucgcaauacugacugugguagcugcaacaauggcuaacgaaaugggguuuuuggagaaaacuaagaaagacuuaggauuugguucuaucgcuacacagcaaccugaaagcaauauuuuagacauagaucuucgccccgcuagugccuggacgcuguacgcaguagcaacuacuuuugucaccccuaugcuaagacauaguauugaaaauaguucgguuaaugugucauuaaccgcaaucgcuaaucaggcuaccguauuaaugggacuaggaaaaggguggccuuuaaguaaaauggacaucggggugccuuugcucgcaauagguuguuacucucaagugaauccuauaacauuaacggcagcgcuauuauuacucguugcucacuaugcuauaauaggucccggauugcaagcaaaggcaacuagagaggcacagaaacgagcggcagcugggaucaugaaaaauccuacgguugaugguauuaccgugauagauuuagauccaauacccuaugauccaaaauuugagaagcaauugggucaagugaugcuauuaguacuuugugucacucaagugcuaaugaugagaacaacgugggcucuuugugaagcccugacccuagcgaccgggccgauaucaacucuuugggaaggaaauccuggacgcuuuuggaacacuacgauagccguaucgauggcgaauaucuuucgggggagcuacuuggccggugcaggacuuuuguuuucaauaaugaaaaauacgacaaacacaaggagaggaacaggaaacauaggagagacacugggggaaaaauggaaaagccgucucaaugccuuaggcaagagugaauuucaaauauacaagaaaaguggaauacaagagguagauaggacgcuggcgaaagaaggaauaaagcgcggugaaacagaucaccacgcggugucaagagguagugcaaaguuacgcugguucguugagagaaauauggucacaccagaaggaaaaguaguagaccuagguugcgggagggguggcuggucuuauuacugugguggccuuaaaaaugucagagaaguaaaaggguuaacgaaagguggaccugggcaugaagaaccaauaccaaugaguaccuauggauggaaucuagucaggcuccaaagcgggguagacguauucuucaucccgccagaaaagugugacacucuucuaugcgacauaggagagucaagcccaaaucccacagucgaagcaggaagaacucucagaguccuaaaucugguugagaauuggcuaaacaauaacacgcaauuuuguauuaagguccuaaauccuuacaugccaucaguaaucgagaaaauggaagcauugcaaagaaaguacgggggugccuuaguaagaaacccauuaucuagaaauucaacgcacgaaauguacuggguuucuaaugcuaguggaaauauuguuucaaguguuaauaugaucucgcgaauguuaauaaacagguuuacaaugcgacacaagaaagcaacauaugaaccggaugucgauuuaggaagcggaacacgcaauaucgggaucgagagcgaaauacccaaccucgacauaauaggaaaaagaauagagaaaaucaaacaggagcaugaaacaaguuggcauuacgaucaggaucacccauauaaaacuugggcuuaccauggaucguaugaaacaaagcaaacaggaagcgccaguucaaugguaaauggggucguacgauuacuaacaaaaccgugggacguucucccgaccguaacacagauggcaaugacugacaccacaccauucggacaacagagagucuuuaaggaaaagguagacacaagaacgcaagaaccgaaagaaggcacaaagaaacuaaugaaaauuacugccgaaugguuauggaaagaguuagguaaaaagaaaaccccgaggaugugcacuagagaagaauuuacgaggaaaguuaggagcaacgcagcucucggagcaauauucacugaugaaaauaaauggaagucagcaagagaagcaguagaagauucccgcuucugggagcugguugacaaagagcgaaaccuucacuuagaaggaaagugcgagacgugcgucuacaauaugauggguaaaagagagaagaaacugggugaauuuggaaaagccaaaggcaguagagcgaucugguacauguggcugggagcccgcuucuuagaauuugaggcguuggguuucuugaacgaggaccauugguuuaguagggaaaauucuuuaucuggaguagagggggaagggcuacacaagcuccgcuacauccucagagacguaucuaagaaagaagguggugcaauguaugcugaugauacagcuggaugggacacacgaauaacacuugaagacuuaaagaacgaagaaauggucacaaaucacauggaaggcgaacacaagaaacucgcagaagccauauuuaaacuuacauaucaaaauaaaguuguucgcguucagagaccuacacccagagguacagugauggacauaaucucgagacgugaccaacgagguucaggucaaguaggaacuuauggucuaaacacuuucaccaacauggaagcucaauuaaucaggcagauggaaggcgagggaguguuuaaaaauauacagcaucuaacagcaacagaggagaucgcuguccagaacuggcuugcgagaguuggacgagagcgucuuagucgaauggcgauaucuggggacgacuguguaguaaaaccauuagacgauagauucgcuagugccuuaacggcauugaaugauaugggcaaaaucagaaaagauauacaacaaugggaaccaaguagaggauggaacgauuggacucaagugccuuucugcucacaccauuuucacgaacuaauaaugaaagauggacgaguacuuguugucccauguagaaaccaagacgaacuaauaggucgcgcaaggauaucacagggggccgguuggucacuucgugaaacagcuugccugggaaagucuuaugcacaaauguggucuuuaauguauuuucauagaagggauuugcgacucgcugcgaacgcaauuuguucagcaguuccaagccauuggguuccaacuagcagaacaacaugguccauccacgccaaacacgaauggaugacuacagaagacaugcuuacaguauggaacagaguguggauccaagaaaaccccuggauggaagacaaaacgccaguagaaucgugggaagagauacccuauuuagguaaacgagaagaucaauggugcgggucuuuaaucggucuaacaucacgagccacuugggccaagaacauacaggccgcaauaaaccaaguaaggagcuuaauaggcaaugaagaauacaccgauuacaugcccucaaugaaaagauuucggcgagaagaagaagaagcugguguucuaugguga

SEQ ID NO: 22976 - RNA, 9876 nt, Artificial Sequence
  derived and/or modified CDS sequence (opt6) from DENV-2__AF169683__SS-prME
agugccggaaugauaauuaugcucaucccaacuguuauggcguuccaccuaacuacacgaaauggugaaccacauaugauaguaaguauacaagaaaaaggcaaaucguuguuauuuaaaaccgaagacgguguaaacaugugcacacucauggcuauggauuugggugaauuaugcgaagauacuauaacuuauaaguguccacuauuacgucaaaacgaaccagaagauaucgacugcuggugcaauucgacuagcaccuggguaacuuauggaacauguacuacaacaggggaacauagaagggaaaagcguucaguagcucuugucccucacguuggaaugggcuuagaaacaagaacggagacauggaugagcuccgaaggggccuggaagcaugcgcaacgaauagaaaccuggauucuaaggcauccuggauucacuauaauggcggcuauacuagcguauacaauagguacaacgcacuuucaacgggcccuaauauucauccuccuaacagcuguagccccaucuaugacaaugcgauguauagguauaagcaauagagacuuuguugaagguguaucugguggaucuuggguagacaucguuuuagaacauggaucaugcguaacaacuauggcgaaaaauaaacccacgcucgauuucgaauuaauuaaaacugaagcgaaacaaccggcgacauuacgcaaauauuguauugaggcuaagcugacaaacacgacaacagaaucacgauguccgacacagggggagccaucccuaaaggaagagcaagauaagcgauucguuuguaaacauuccaugguugaccguggauggggaaacggaugcgggcuguucggcaaaggcggcaucguaacaugugcaauguuuacuugcaaaaaaaauauggaaggaaagauaguucaaccagaaaaucucgaauauacaauaguugugaccccucauucaggugaagagcaugccguuggaaaugacacuggaaagcauggcaaagagaucaagguaacgccucaaaguagcauaacagaagcugagcuuacuggauacggaacaguaacuauggaaugcuccccccgcacaggauuagauuuuaaugaaaugguacuuuuacaaauggaaaauaaagcguggcuaguucauagacaaugguucuuagacuugccccuaccuuggcuuccaggcgcagacacacagggauccaauuggauccaaaaagaaacgcuugugacuuuuaaaaauccacaugcuaaaaaacaagacguaguaguacuagguucacaagaaggagcaaugcacacugcacuuacgggggcuacagaaauacaaaugucuagugguaaucucuuauuuacugggcaucuaaaaugccgguuaagaauggauaaacuucaauuaaaagguaugucauauucgaugugcacaggaaaauuuaaggugguaaaggaaaucgcggaaacacaacacggaacuaucguuauacgaguucaguaugaaggugauggaucucccugccguauaccauucgagauuauggauuuagaaaagagauauguauuaggacgucuuaucacaguaaacccaauaguaaccgaaaaggacagcccagucaacaucgaagccgagccucccuucggugauuccuacauuauaauaggggucgaaccugggcaacucaaacuaaauugguuuaaaaaagggucuucuauagggcaaauguuugaaacaacuaugagaggggcuaaacggauggcgauauuaggggacacagcaugggacuuuggcaguuuagguggaguauuuacaaguauaggcaaggcacuacaucaaguuuuuggggccauauacggugccgccuucaguggugucucuuggaccaugaaaauuuuaauaggugugauuaucacauggauaggaaugaacagccguuccacaaguuuaagcguaucguuaguauugguuggaauuguuacgcuuuaucucgguguaaugguacaggcagauaguggaugugugguuucguggaaaaacaaagaacuuaaauguggcuccggcauuuucauaacugauaauguucauacuuggacugagcaauauaaauuccaacccgaaucaccaucgaaacucgcaucggcaauccagaaggcccaagaagaaggaauaugcgguauuagaaguguaacccgacuugaaaacuuaauguggaagcaaauaaccccugaacucaaucacauccuagcagagaacgaggucaaauuaacgaucaugacaggugauauaaaaggaauaaugcaugcggguaaaagaucauugaggccgcaacccaccgaacuaaaauauagcuggaagacauggggcaaggcgaaaauguugucuacagaaucgcacaaucaaaccuucuuaauagacgguccggaaacugcagaaugcccaaauaccaaucgagcuuggaacagucuagagguugaggauuauggcuuuggaguauuuacgacgaauauauggcuuaaguugaaagaaaagcaagacgccuuuugugauagcaaauugaugagugcagccauuaaggauaaucgugcaguacaugcagacaugggauacuggauagaaagcgcucugaaugauacguggaaaauugaaaaagcaaguuuuauagaagugaaaaauugucauuggcccaagucacauacgcuuuggucuaauggaguccuggaaucagaaaugauuauaccgaaaaaucuagcaggaccuguaagucagcacaacuauagaccggguuaccauacgcagauagcgggcccuuggcauuuaggaaaacuugaaauggacuucgauuucugugacggaacaacaguaguaguuacagaagacuguggaaaccguggaccgaguuugagaacaacuacggcuagugguaaacuaauaacagaaugguguuguaggucuugcacauuaccaccacuccguuaucgaggagaagacgguugcugguaugggauggaaauaagacccuugaaggaaaaagaagagaacuuaguaaacaguuuaguaacggcuggacaugggcagguugauaauuucagucugggcgugcuaggaauggcauuauuuuuagaggagaugcuuagaacucgcguaggaacaaaacaugcuauucugcuggucgccguaaguuucguaacccuaaucacaggaaacaugucauucaaagauuuagguaggguggucgugaugguaggagcaaccaugacagacgauauuggaaugggaguuacuuaccuagcccuacuagcggcauucaaaguucguccuacauucgcugcagguuuacugcuacgaaaauuaacaucgaaagaauugaugaugacaaccauaggaauaguccuucuuagccaauccacaauaccagaaacgaucuuagaacuaacagacgcucuugcauuaggcaugaugguacucaagauugucagaaauauggagaaguaccaacuagcaguaacaauaauggcgauuuuaugcguaccgaacgcagugauacuacaaaaugcuuggaagguuucauguacaauacuagcaguaguuucgguuaguccccuuauccuuaccagcagccagcaaaaaacugauuggauaccgcuagcuuugaccaucaaaggcuuaaauccuacagcaauauuucuuaccacauuaucccgaacaaacaaaaaaaggagcuggccauugaaugaagccaucauggcgguugguaugguuucaauucucgccuccagccuguuaaaaaacgauaucccuaugacuggaccccuaguugcgggugguuuacuuacgguguguuauguauuaacugggagaagcgcagacuuggaacuagaaagagcaacagauguuaaaugggaagaccaagcggaaauuucaggcaguaguccuauucuaaguauuacgauaucugaagacggaucgaugucgauaaaaaaugaagaagaagagcagacacuuacuauuuugauacggacaggacuccuuguaauaucgggacuauuuccaguaagcauccccauaacagcagcagcuugguaccuaugggaaguaaaaaaacaaagggcgggagucuuaugggauguaccaucaccgccgccaauggguaaagcugaguuagaggacggcgccuaucguauaaagcaaaaagggauccugggcuacucgcagauuggagcaggugucuauaaagagggaacuuuucauacuauguggcauguaacgagaggagcaguucuuaugcacaagggaaaacgaauugagccgucaugggccgaugugaagaaggauuuaauuucuuacggaggaggguggaaguuagaaggugaauggaaagaaggagaagaggugcaaguauuggcacuugaaccaggcaaaaauccuagagccguacaaacgaaaccaggucuauuuaagacaaauacagguaccauaggagcugugucauuagacuuuucaccugguacgucagggucaccaauaaucgacaaaaaagggaagguaguuggcuuauauggaaauggcguagucacgagaagcggugcguauguuagugcaauagcacaaacagaaaaguccauugaagauaacccagagauagaggaugauauuuuuagaaaacgcagacugacaauaauggauuuacaucccggcgcgggaaaaacuaaaagauaucuucccgccaucgugcgugaggccauaaaaagaggacuuagaacacugauacuugcaccaacccgugucgucgcagcagaaauggaggaggcacuuagggggcuaccaauaagauaucaaacaccugcgauucgagcagagcacacaggaagagaaauaguugaucuuaugugucaugcaacuuuuacaaugcggcuccuaucuccaguaagggugccgaacuauaaucugauuauuauggaugaggcacauuuuacagaccccgcuucaaucgccgcacguggauauauaagcacaagaguugaaaugggagaagcagccgggauauuuaugacggcuacuccaccaggcucgagagauccguucccucaaucgaaugcaccgaucauugaugaggaacgagagauaccugaacguagcuggaauucuggucaugaguggguuacugacuucaaagggaaaacugugugguuuguuccuagcauuaaagcaggaaacgacauugcagcaugucuacgaaagaacggcaaaaaaguuauucaauugaguagaaaaacuuucgauucggaauacguaaaaacuagaacaaaugauugggacuuugucguuacgacugauauuagcgaaaugggagcgaauuuuaaagcagaaaggguuaucgauccaagacgcugcaugaagccaguaauacuuacggauggagaagaaaggguaauuuuagcugggccaaugccgguaacacacuuuagcgccgcccagcgaagaggccgaauuggcaggaauccaaaaaacgagaacgaccaauauauuuauaugggagagccacucgagaaugaugaggacugcgcucauuggaaagaggcaaagauguuacuagacaacauaaauacaccggagggaauaaucccuucaauguuugaaccggaaagagaaaaaguggacgcgauagacggcgaguaucguuuaagaggugaagcacgaaagaccuucguagaucuuaugagaagaggcgauuuacccguuugguuggcuuacaaaguagcggcugaaggaauaaauuacgcagauaggagauggugcuuugauggcaucaaaaauaaucagauauuagaagaaaauguugaaguugagauauggacgaaagaaggugaaaggaagaaacuaaagccaagauggcuagaugcacgcauauauucugauccauuagcucuaaaagaauuuaaagaauucgcagccggacgaaaaucucuggcccuuaauuugauuaccgaaaugggaagacuaccgacuuucaugacucaaaaaacgcgggacgcccuagauaaucuagcuguacuacacacagcggaagcgggcgguagagcuuauaaccacgcccuaagugaauuaccggagacauuggaaacacuacuacuuuuaacauuacuagcgacuguaacgggagguauauuccucuuucuaaugucaggucgagguauugguaagaugacacuaggaaugugcugcauuauaacugcaaguauauuacuaugguaugcacaaauacagccucauuggauagcggcuucaaucauauuaguguuuuuuuuaauaguacuccuaauaccagaaccugaaaaacagcgcacaccacaggacaaucagcuaaccuauguuguuauagcaauauugacggucguagcagcaaccauggcaaacgaaaugggauuuuuagaaaagacaaagaaagaucuaggauucgguagcaucgcaacacaacagccagaaagcaauauauuagauauagacuuaagaccugccucagcuuggacucuauaugccgucgcuacaacguucguaacaccuaugcuccgccacucaauagagaacuccaguguuaauguaucacuaacagccauugcaaaccaagcaacaguacuuaugggauugggaaaagguuggccucuaaguaaaauggauauuggugugccacuauuggcuauuggcuguuacagucagguuaauccaauaacuuuaacagcugcauuauuacucuuggucgcucauuacgcuauaauuggaccaggacuacaagcgaaagccacaagagaagcucaaaagagagcggcggcaggaauuaugaaaaacccaacagucgauggaaucacagugaucgacuuagauccgaucccauaugauccaaaauuugagaaacaacugggucaaguuauguugcucguacuaugugugacacagguguuaaugaugcgaacaaccugggcacuaugugaggcacuaacacuugccacaggaccgauauccacauuaugggaaggaaauccaggucgauucuggaauacuaccauugcaguuucaauggccaauauauucagaggcaguuaucuagcaggagcuggcuuacuauuuuccauaaugaagaacacaacuaacacacgucgagguacuggcaacaucggagaaacauuaggugaaaaauggaagagucgacucaaugcauugggcaaaucugaaagccaaaucuacaaaaaaucagggauacaggaaguugaucggaccuuagcuaaagaagggauaaaacguggggaaacagaucaucacgcaguaagucgcggcagugccaaauugagaugguucgucgaaaggaauaugguuaccccugaagggaaaguuguagaucuagguugcggaagaggugguugguccuacuauugugguggaaucaagaauguaagggaggugaaaggauuaaccaaagggggcccgggucaugaagagccaauaccgaugucuacauacgguuggaacuugguacgcuugcagucagguguggacguuuucuuuauuccccccgaaaaaugcgauacacuccuuugugacauaggagagaguaguccaaauccaacaguagaagccggucgaaccuuaagaguacugaacuuaguagaaaacugguuaaauaacaauacacaguuuuguauaaaaguauuaaacccguauaugccaagcgugaucgaaaaaauggaagcauugcaaagaaaauauggaggcgcguuggucagaaauccacuuagccgcaauaguacacacgaaauguauugggugagcaaugcgaguggaaauaucgugagcagcgugaauaugauaagucguaugcuaaucaauagauucacaaugaggcacaaaaaggcaacuuacgagccggacguagaucuuggaucgggcacuaggaacauaggaaucgaaucagaaaucccuaacuuggacauaauagguaaacgcauugagaaaauaaagcaggaacaugaaacgucauggcauuacgaucaagaucauccuuauaagacaugggcuuaucacggauccuaugaaacgaagcaaacaggcagcgcaucgagcaugguaaaugguguaguucgacuacugacuaaaccaugggacguucuaccaaccgugacucagauggcuaugacagauacgacucccuuuggacagcaaagaguauuuaaagaaaaggucgauacaagaacccaggaaccuaaagaaggaaccaaaaaauuaaugaagauaacggccgaauggcuuuggaaagaacuuggcaaaaagaaaacaccacguauguguacccgcgaggaauuuacuagaaaagugcgaagcaacgcagcauuaggcgcaauauuuacagacgaaaacaaauggaagucugcuagggaggcaguagaagauagcagauucugggaacuuguugauaaagaaagaaaccugcaucuggaaggaaaaugcgaaacguguguguauaauaugaugggaaaacgugagaaaaaauuaggggaauuuggcaaggcaaaaggcagccgagcaauaugguauauguggcugggagcgcguuucuuagaauucgaggcuuuaggauucuuaaaugaagaucauugguucuccagagaaaacucccuaagcggccuagagggggaaggcuuacauaaauuaggauauauacuaagagauguuucaaagaaggaaggaggagcaauguacgcagaugauacugcgggaugggacacgagaauaacacucgaggacuuaaaaaaugaagaaaugguaacaaaucauauggaaggugagcacaagaaacuagcagaggcaauauuuaaauuaacuuaccaaaauaaagugguaaggguacaaagaccaacaccacguggcaccguuauggacauaaucagcagacgagaucaacguggaucuggucagguggguaccuacggauuaaacacguucaccaauauggaggcacaacucauacgacaaauggaaggggaagguguguucaaaaacauccaacauuuaaccgcuacugaagagauugcuguucaaaauugguuagcaaggguugggagggaaaggcugagucgaauggcgauaucaggggacgacugcguuguaaaaccuuuagacgaccgauuugcuucagccuuaacagcauugaaugacaugggaaaaauacgaaaagauauacagcaaugggaacccagucgaggauggaacgacuggacacagguacccuucuguucccaucauuuucaugaacuaauuaugaaggauggcagaguucugguagucccuuguaggaaucaagaugagcuuauaggcagggcaaggaucucgcagggagcuggcuggucauuaagagaaacagccugcuugggaaaaucauaugcacaaauguggucauuaauguacuuccaucgacgggaucuaagauuagcggcgaacgccauaugcagugcaguaccgagccauuggguuccgacaagccgaaccacauggucuauucaugccaaacaugaauggaugacaacagaggacaugcuaaccguuuggaaccgugucuggauacaagaaaauccauggauggaagauaagacaccaguagaaucaugggaagaaaucccuuaccucggaaaaagggaagaucaauggugcggcagucuaauaggucuuacaucuagagccaccugggcaaaaaauauacaagcagcaauuaaucaggugagaucgcuuauuggaaaugaggaauacacagacuauaugcccaguaugaaaagauuccggcgggaggaagaagaagcugguguccuaugguga

SEQ ID NO: 22977 - RNA, 9876 nt, Artificial Sequence
  derived and/or modified CDS sequence (opt6) from DENV-2__AF169684__SS-prME
agugcugguaugauaauaauguugauuccaacaguaauggcguuucaucuuacaacgagaaacggagaaccucauaugauagucagcauacaagaaaaaggaaaaucuuuauuauuuaaaacagaagacgguguuaacaugugcacauuaauggcaauggacuuaggggaacuuugcgaagauacaauuacuuauaaauguccgcuacuuaggcaaaacgaaccggaagacauugacuguugguguaauuccacuagcacauggguaaccuauggaacauguaccacaacuggcgaacaucggagagagaaaaggagcguggcucuagugccacauguuggcaugggucuggaaaccagaacagagacauggaugagcucggaaggagcauggaaacacgcucagcguauugaaaccuggauacuuaggcacccagguuuuaccaucauggcagcuauccuugcauacacuaucggcacaacacauuuucaaagagcauuaauauucauucuguugacggcugucgcaccuuccaugacaaugagguguauaggaaucagcaacagagauuucguagaggggguaagcggugguaguuggguagacauaguacuugaacacggcucguguguaacaacgauggcuaaaaauaaaccaacuuuggauuuugaacuaauaaaaaccgaagcgaaacagccagcuacuuuacgaaaauauugcaucgaggcuaaacuuacaaauacaacuacugaaucacguuguccgacucaaggagaacccagcuugaaagaagaacaagauaaaagauuuguaugcaaacacaguaugguagauagaggcugggggaacggcuguggcuuauucggaaaaggggguauaguuacaugugccauguucacauguaagaaaaacauggaaggcaaaauugugcaaccagaaaaccuagaauacacgauaguaguaacaccucacuccggagaagaacaugcuguggggaacgacacugggaaacauggaaaagaaauuaaaguuaccccacaaucauccaucacagaagcggaacuuacagguuaugguacuguaaccauggaaugcucaccaaggacaggucuggacuucaacgaaaugguuuuguugcaaauggagaacaaagccugguugguucacagacaaugguuccuagaucuaccuuuaccuugguugccaggcgcugauacacaagguuccaacuggauacaaaaagaaacguuagugacuuucaaaaacccacaugccaaaaagcaagacgugguuguguuaggcucacaggaaggagcaaugcauacugcgcucacaggagcgacugagauacaaaugucaucugggaacuuguuauucacagggcaucugaaaugucgacugcggauggauaaacuacagcuaaaaggcaugucuuauaguauguguacaggaaaguucaaagucguaaaagaaaucgccgagacacagcauggaacaauuguaauucgcguacaguacgaaggugauggauccccaugccguauaccauucgaaauuauggauuuagaaaagagauauguacuggggagguuaauaacagugaacccaauagucacagagaaggacucacccgugaauauagaagcggagcccccuuuuggugacucguauauuauaaucgguguagaaccugggcaacuuaaacuuaacugguucaagaaagggucaaguaucgggcaaauguucgaaaccacuaugcgaggggccaagagaauggccauacuaggagacacagcaugggauuucggaucccuagggggugucuuuacaagcauaggaaaagcacuacaccaagucuuuggagcgauuuauggagcagccuuuucaggaguaaguuggaccaugaaaauccuaauuggcguaauuauaacuuggaucgguaugaacaguagaucuaccucccucucuguaaguuuaguacucguaggcaucgucaccuuauaccucggaguaaugguccaagcagauucagguugcguuguaaguuggaaaaauaaagaauugaaauguggaucaggcauauucauaacugacaauguacacacuuggacagaacaauauaaauuccaaccagagucaccaucaaaacuagcaucagcgauucagaaagcccaagaagagggaaucugugguauaagaagcgucacgcgucuagaaaauuuaauguggaaacaaauaaccccugaauugaaucauauacucgcugaaaaugaaguuaaauuaacaauaaugacgggugacauaaagggaaucaugcaagcugguaagcguucacuccggccacaaccgacagaacuaaaauauucuuggaaaacuuggggaaaggcaaaaaugcuaagcacugaaucacauaaccaaacauuccuaauugacggaccagaaacagcagaaugucccaacaccaacagagcuuggaacuccuuagaaguugaagacuaugguuucggaguauucacaaccaacaucugguugaaauuaaaagaaaaacaagaugcauuuugcgacucaaaauuaaugucggcagccauaaaagauaauagagcgguucacgcagauauggguuauuggauugaaagugcacugaacgauacauggaaaaucgaaaaagcaaguuuuauagaagucaaaaacugucacuggccuaaaucacauacauuauggucgaacggaguuuuagagagugaaaugauaauacccaaaaaccucgcgggaccaguaucacaacauaacuaccgucccgguuaucauacccaaauagcgggacccuggcauuuaggaaaacucgaaauggacuuugauuuuugugacgggacgacagucgugguuaccgaagauugcggcaaucgugguccaucucugcgaacuacaacagcaagugguaaacuaauaacagaaugguguuguagauccuguacguuaccuccucuucgauacagaggagaagacggguguugguauggaauggagauuagaccacuaaaagaaaaagaggaaaacuuagugaacucuuuaguaaccgcugggcauggccaaguagauaauuuuagucuagguguauuaggcauggccuuguuccuagaagagauguugagaacgaggguagggacgaaacacgcgauucuuuuggucgcaguuucauuuguaacgcugauuacggggaacaugagcuuuaaagauuugggccgcguagucguaauggucggcgcaacaaugacagaugacauagguauggguguaacauaucuagcuuugcuugcggcguucaaaguaagacccacuuucgcagcuggcuuacuuuugagaaaacugacauccaaagaacucaugaugacaacaauagggauuguacuguuaucgcaaagcacgaucccugaaacaauuuuggaauugacagacgcgcuugcccucggcaugaugguauuaaaaaucgucagaaauauggaaaaauaucaauuagcaguuacuauaauggcgauacuguguguuccaaaugcaguaauacugcagaaugcauggaaaguuucuugcacaauccuagccguggugaguguuucaccucuuauauuaacaaguucccaacagaagacagauuggauaccacuagccuuaacuaucaaaggucuaaauccuacugcaaucuuccuaacaaccuuaucaagaaccaauaaaaagcggucuuggccguuaaacgaagcaaucauggcuguaggaauggucucaauucuugccucaucacuccuaaagaaugacauacccaugaccggaccucuagucgccgguggccuccuuacaguauguuauguacuaacgggacgcucagcugaucucgaacuugaacgggcaacugaugucaaaugggaagaucaagccgaaauaagcagaaguucaccaauacuuagcaucacaauaucggaagacgguucaaugucgaucaaaaaugaagaggaagaacaaacucuaacaauccugauaagaaccggauugcuaguuauaagugguuuauucccagugucgauaccaauuacggccgcagccugguauuuaugggaagucaagaaacaaagagcggguguauuaugggacgugccgucaccaccacccauggguaaagcagaacuugaagacggugcauaccgcauaaaacagaaaggaauccuaggauauucgcagauuggugcugguguuuauaaagagggaacuuuucauacaauguggcacgugacucguggagcuguuuugaugcauaaagggaaaagaaucgaaccaucaugggcagacgucaagaaagauuuaauaucguauggugggggauggaaguuagaaggugaauggaaggaaggggaagaaguucaaguacuagcacuugaaccaggaaagaauccaagagcaguacagacgaaacccggcuuguuuaaaacuaauacuggcacuauaggggcaguaucacuagacuuuucaccgggcacaagugggucaccaaucauagauaagaaaggaaaagugguagggcucuacgguaauggaguagugacaaggucaggggccuaugugucagcgauagcacaaacggaaaaaucaauugaagauaauccggaaauagaggacgauaucuuuaggaaacgccgcuuaacuauuauggaucuacauccaggggcuggaaagacuaagaaauacuugccugccauaguucgugaagcgaucaaaagaggacuaagaacccugauacuggcaccgacacgagugguagcagcugagauggaagaagcauuacgggguuuaccuaucagguaucaaacaccagcuauaagagcugaacacacugguagggaaauugucgauuuaaugugccacgcaacguuuacgaugagauuacuauccccagucagaguccccaacuacaaucuaauaauaauggaugaagcacauuucacggauccugcuucgauagcggcacgaggauauauuucgacucgcguugagaugggagaagcugcuggaauauuuaugacagcuaccccacccggcucgagagacccauucccucaaaguaaugcccccauuauagaugaggagagagaaauaccggaaagaaguuggaacagcggacacgaauggguuacagacuucaaaggaaaaacagucugguucgucccaucaauuaaggcagguaaugauaucgcggcuugccucaggaaaaauggaaagaaaguaauacaauuaucucgcaaaacauuugacucagaguacguaaaaacgaggacaaaugacugggauuuuguagugacaacugauauuucugaaaugggagcgaauuucaaagcugaaagagucauagauccacgacguuguaugaagccgguuauccugacggauggagaagaacguguaauccucgcuggacccaugccuguuacacauuucuccgccgcccaaaggagaggucgaauaggcagaaaucccaaaaaugaaaaugaucaguacauuuacaugggggaaccuuuagaaaaugaugaagauugugcacauuggaaggaagcuaaaauguugcuugacaauauuaauacacccgaaggaauaauacccagcauguucgaaccggaaagagaaaaaguugacgcaauagauggagaauaccguuuaagaggagaagcacgaaaaacuuuuguagaccuaaugcgacgaggugaccucccggucugguuagcauauaagguugcggcagaagguauaaauuaugccgauagacgcugguguuucgacggaaucaaaaacaaccaaauauuagaagaaaacguugaaguggagaucuggaccaaagagggcgagcguaagaaacuuaaaccucgauggcucgaugcuagaauuuacucagacccccuggcuuugaaagaguucaaagaauuugcagcggguagaaaaucacuagcguugaauuugauaacugaaaugggccgacuucccacauucaugacacagaaaacacgcgaugcacuagacaaccucgcaguguuacauacugcugaagcgggaggcagagcauauaaucaugccuugagugaauuaccagaaacucuugaaacauuacuauuguuaacguugcuagcaacaguuaccggagguauauuucucuuccugaugucagguagaggaauuggaaaaaugacauuagggauguguuguauaauaaccgcaagcauccuccuaugguacgcccagauacagccacauuggaucgcagccucuauaaucuuagaguucuuccugauuuuucuauuaauacccgaacccgaaaaacaaagaacaccccaggacaaucaacuaacuuauguaguaaucgccauuuuaacggucguagcagcgaccauggcaaaugaaaugggauuuuuggaaaagacgaagaaggauuuaggauuugggaguauagcuacccaacaaccagaaucgaauauauuggauauagaucugagacccgcuagugcguggacacuuuacgcgguagcaacaacuuuuguaacaccaaugcuaagacacagcauagaaaauucaagugugaaugucagccugaccgcaauagcuaaucaagcaacaguacucaugggacuugguaaggguuggccucuaucaaaaauggacauaggcguaccuuugcuagcgauugguuguuauagccaagugaauccgauaacucucacagcagcguuauuacucuugguugcacacuacgcuauaaucgguccuggucuacaagcgaaagcaacgcgggaagcccaaaagcgagcagcagcaggcauaaugaaaaauccaacuguagauggaaucacgguaauagauuuagacccaauuccauacgacccgaaauucgaaaagcaauuagggcaagucauguuguuaguucuaugcgucacacagguucuuaugaugaggaccacaugggcucuuugugaagcccuuacauuagccacgggaccaauauccacacugugggaagggaauccaggacgauuuuggaacacaacaauagcuguuuccauggccaacauauuuaggggcaguuaucuagcgggagccggauuacuauucucuauuaugaagaacacaacaaauacuagaagaggcacuggaaauauaggagagacgcugggagagaaauggaaaagucgucucaacgcauuagggaaaagcgaguuccaaauuuauaagaagucugggauacaagaaguagacagaacguuagccaaagaggggaucaaacgcggagaaacggaucaccacgcagugaguagagggagugccaaacuuagaugguuuguugaacguaauaugguaacgcccgaagguaaaguaguggaccuaggguguggucguggaggcuggaguuauuacugugguggucuaaagaaugucagagagguaaaagggcuuacgaaaggaggaccuggacacgaagaaccgauucccaugucaacauacgguuggaacuuaguacgacuucaaucagggguggacguauucuuuauaccacccgagaaaugugauacacuauuaugugauauaggagaauccaguccgaauccaacaguagaagcuggaaggacuuugaggguuuuaaauuuagucgagaacugguuaaauaauaacacacaauuuuguauuaaggugcuuaauccguauaugccaucagugauagagaaaauggaggcgcuucaaagacgauacgguggugcauuagucaggaacccucucagucgaaauucuacccacgagauguauuggguuaguaaugcuucggguaauauuguaaguuccgucaacaugaucucgagaauguugauaaauagguuuacgaugaaacauaagaaagccacuuaugaaccugacguggaucuuggauccggaacacgcaauauaggaauugaauccgaagugccgaauuuggauauuauugggaaaagaauagaaaagauuaaacaagaacacgagacaagcuggcauuaugaccaagaccaccccuauaaaacaugggcguaccauggauccuaugaaacaaaacaaacaggaucagcguccuccaugguuaacggaguaguacgauugcuaacaaaaccuugggauguacuaccuaccguaacgcaaauggcaaugacggacacaacccccuucggacaacaacggguauuuaaagaaaaaguagauaccagaacgcaggaaccaaaagaagguacuaagaaauugaugaaaauuacugcggaaugguuauggaaggaauuaggcaagaagaaaacuccacgaaugugcacucgugaagaauuuacaaggaaaguuagaaguaaugcggcuuuaggggcuauauuuacugaugaaaacaaguggaaauccgcuagagaagcggucgaagacagcagauucugggaguuaguagacaaggagcgaaauuugcauuuagaagggaaaugugaaacuuguguauauaauaugaugggaaaaagagagaagaaacuaggagaguucgguaaagcaaaaggauccagggcaauuugguauaugugguuaggagcccgauucuuagaguucgaagcacuagguuuccuaaacgaagaucauugguuuucuagagaaaauucucugucagguguugaaggagaaggucugcacaaacuaggauacauauuacgcgauguguccaagaaagagggcggcgcaauguaugcagacgacacagcaggaugggacacucguaucacguuagaagauuugaaaaaugaggaaaugguuaccaaccauauggaaggugaacauaagaaauuagcugaagccaucuucaaauuaacguaccaaaauaaaguuguacguguacaacggccgacacccagaggcacgguuauggauauaaucucgcgaagagaccaacgagguucaggucaagucggaacauacggauuaaacacauuuacgaacauggaagcacaauugauacgacaaauggagggugaaggcgucuucaaaaacauccaacaccuaacggcaacugaagaaauagcugugcaaaauuggcuugcuagaguuggaagggaacgacucucaagaauggcuauuucuggagaugauuguguaguaaagccccucgacgaucgguuugcaagugcccuaacugcccuaaaugauaugggaaagauucgaaaggauauucaacaaugggaaccauccaggggauggaacgacuggacucaaguaccuuuuugcucacaucacuuucaugaauuaauaaugaaggaugguagagucuuaguaguaccaugucggaaucaagacgaguugauugguagggcucguauaagccagggugcuggauggucgcuccgagaaacagcaugccuaggaaaaaguuacgcacagaugugguccuuaauguauuuucacagaagagacuuacgauuagcagcuaaugcuauaugcucugccguuccaucacauuggguuccaacaagccgaacaacgugguccauucacgcaaaacaugaguggaugacgacugaagauauguuaacgguauggaaccgcguuuggauccaagaaaauccuuggauggaggauaaaacuccgguagagaguugggaagaaauacccuacuugggaaagcgcgaggaucaauggugcggaucauuaauaggucuuacaucgagagcuacgugggccaaaaauauccaagcggccauuaaucaaguacgaucguuaauugggaaugaagaauauacugacuacaugccaucaaugaaaagguuucgucgugaagaagaagaagccggugucuugugguaa

SEQ ID NO: 22978 - RNA, 9876 nt, Artificial Sequence
  derived and/or modified CDS sequence (opt6) from DENV-2__AF169685__SS-prME
ucugcgggaaugauaauaauguugauaccuacuguaauggcguuccauuuaacuacgcggaauggugaaccgcauaugauugugagcauacaagaaaaagguaaaucacuacuuuucaaaaccgaagauggaguaaacauguguacccugauggcuauggacuugggugaauuaugcgaagacacuaucacguacaaaugcccacuauuaagacaaaaugaaccagaagacauugacuguuggugcaacucuacaucuacauggguaacauauggaacauguaccacgacaggggaacauagaagagaaaaacguaguguagcuuuaguaccucauguagguaugggacuugaaacacggacagaaacauggaugagcucugagggcgcuuggaaacaugcacaacguauagaaacuuggauccuuagacauccuggguuuaccauaauggcggcaauacuagcauauacaauaggaaccacccacuuccaacgugcuuuaaucuucauucuucucaccgcaguagcgccaagcaugacuaugagauguauaggcaucucuaauagagauuuuguagagggugucuccgguggcucaugggucgauauugugcuagaacacggcaguugcguaacaacaauggcuaaaaauaaaccaacuuuagauuuugaauugaucaaaacagaagcuaaacaacccgcuacacuuagaaaauauuguauugaggcaaaacuaacgaauaccaccaccgaaucucgguguccaacucagggagagcccagcuuaaaagaagaacaagacaaacgcuucguauguaaacauucuauggucgacagaggaugggguaaugguugcggccuauuuggaaaaggaggaauaguaacaugcgcuauguuuacguguaagaaaaauauggaggguaaaauagugcaaccagaaaaucucgaauauacaauaguagucacaccccacucaggugaggagcaugcaguuggaaacgacacugggaaacacgguaaagaaaucaaaguaaccccucagagcucgauaacagaagcagaguugaccggauauggaacugucacuauggaauguucaccuagaacuggacuagauuucaaugaaaugguucuacuucaaauggaaaauaaagcaugguuaguccauagacagugguuccuggauuuaccucugccauggcugccaggugcagauacacaaggaagcaacuggauccaaaaagaaacucuaguuaccuucaaaaauccucacgccaagaaacaagaugugguuguauuagguucucaagagggagcaaugcacacagcauuaacaggagcaacagaaauacaaaugucuagcggaaauuuauuauuuacaggccacuuaaaaugucgauuacgaauggauaaacuucaacuaaagggcaugucuuauuccauguguacagguaaauucaagguuguaaaagaaauagcugagacucagcauggaacgauuguaauaaggguucaauaugaaggugauggaucgccguguagaauaccauuugagauaauggauuuggagaaaagauauguuuuggggcgauuaauaacagucaacccuaucguaaccgaaaaagacaguccaguaaauauagaagcagaaccaccuuuuggugauuccuauauaauaauaggggucgagccaggacaacucaaauuaaacugguucaagaaaggaucaucuaucggccaaauguuugaaacaacaaugcguggagcgaaaagaauggcgauccuaggagauacagcgugggacuucggcagcuuaggugguguuuuuacuucuauagguaaggcacuucaucaaguguuuggcgcaauauauggugcugcuuucuccggagugucguggacaaugaaaauauuaaucgguguaauuaucacauggauugggaugaacuccaggaguacaucucugucgguaagccuaguacugguuggaauuguaacacucuauuuaggagugaugguacaagcagacucaggcugcguggucucuuggaaaaacaaagaacugaaauguggguccgggauauucauuaccgacaacguacacacuuggaccgaacaguacaaguuccaaccagaguccccuucaaagcucgcuuccgcaauccaaaaagcacaggaagaggguauauguggaaucagaucaguaacaagguuggagaaucuaauguggaaacaaauaacucccgaauugaaccacauacuugcagagaaugagguaaaacuaacaaucaugacaggugauauaaaaggaauaaugcaggcaggaaaaagaucucuacgaccucaaccuacagaguuaaaauacagcuggaagacauggggaaaagcaaaaauguuaaguacugagucacauaaucaaaccuuuuuaaucgaugguccggagacagcagaauguccaaauacgaaccgggcuuggaauaguuuagaaguugaagauuauggauucggcguuuuuacaacuaacaucuggcuaaaauugaaggagaaacaagaugcuuuuugugauuccaaauugaugucagcagccauuaaggauaaucgugcaguucaugcggacaugggauauuggaucgagucugccuuaaacgauacuuggaaaauagaaaaagcaucauuuauugaagucaagaacugucacuggccaaagucacauacccuguggucaaauggaguccuugaguccgaaaugauuauaccgaagaaucuagcugggccuguuagucagcauaauuauagaccaggauaccauacacaaauagccggaccuuggcaccugggaaaauuggaaauggacuucgauuuuugugacgggaccacuguuguaguaaccgaagacuguggaaaucgcggaccaucucucaggaccacuacagcuagugguaaauuaauuacagaauggugcuguaggucauguacccuuccucccuuacgguaccgaggagaggacgguuguugguauggaauggaaauacguccacugaaagaaaaggaagaaaaucuuguuaauagcuuaguuacugcaggacauggacaaguugacaauuuuucauuaggcguguuagguauggcauuauuccucgaagaaauguugcguacaagagucgggacaaaacaugcgauucucuuaguagcuguaucuuuuguaacguuaauaacgggaaacaugaguuuuaaggauuugggaagaguaguugucaugguaggugcaacuaugaccgaugauauaggaaugggggucaccuauuuggcgcuauuagcggcguuuaaggucagacccacauucgcugcgggucuacuauugcgaaaauuaacaaguaaagaauuaaugaugacaacaaucggcaucguauuacuuucgcagaguacgaucccggaaacaauacuagaacuuacagaugcguuggcauuaggaaugaugguacuuaaaauaguacggaauauggagaaguaccaacuagcuguaaccauuauggcaauacuauguguuccuaaugcuguaauacuacaaaacgcuuggaaaguuagcugcacuauauuggccguaguuucuguuucaccacucauccuuacaaguucacaacagaaaaccgauuggauaccauuagcuuuaacuaucaagggauugaauccaacugcaauauuucuaacuacacuuaguaggaccaacaagaaacgaucuuggcccuuaaacgaagcaauaauggcuguagguauggucaguauucuugcuucaagucuacucaaaaaugauauaccaaugacuggacccuuaguagccggaggcuuacugaccguaugcuauguucuaacaggacguucugcugauuuggaguuagaacgagcuacagacgucaaaugggaggaucaagccgaaauaagcgguucaucaccuauacuaucaauuaccauuagcgaggaugguagcaugaguaucaaaaaugaggaagaagaacaaacuuuaacuauauugauaaggacaggacuucuaguaauaucaggucuauuuccugucucaauaccaauaacggcagcggcgugguaccuaugggaagucaagaaacagagagcggguguacuuugggaugucccaaguccaccuccuaugggaaaggcugaacuggaagauggugcuuacagaauaaaacaaaagggaauuuuggguuauucucaaauaggugcgggcgucuauaaagaaggaacauuucauacaauguggcaugugacccgcggagcggucuugaugcacaaagggaagaggaucgaacccuccugggcugaugugaagaaagaucugauaaguuacggcgguggcuggaaacucgagggagaauggaaggaaggagaagaagugcaaguacuagcccuugagccugggaaaaaucccagagcgguccaaacgaaaccuggucuauucaaaacaaauaccggaaccauaggcgcaguaagucuagacuuuaguccaggaaccucaggaagcccaauaauugauaagaaagguaaaguagucggauuauauggaaaugguguaguaacacgcuccggcgcuuacguaagugcuauugcacaaacagaaaaaucuauugaggacaaucccgagauugaagaugauauauuucggaaaagacgguugacuauaauggaucuacauccaggggcgggcaagacaaagagauaucuaccagcaaucguaagggaagcaauaaaacgaggacugcguacucuuaucuuagcgccaacacggguaguugcugcggaaauggaagaagcacuccggggcuuaccaauuagguaccaaacgcccgcaauucgagcggaacacacggggagagaaauaguugauuugaugugucacgcaacuuuuacuaugcggcuauugucaccaguacgugucccuaacuauaaucugauaauaauggacgaagcacauuucacagauccagcgaguauagccgcuagagguuauauuaguacacguguagaaaugggagaagcagcagggauauuuaugacugcaacuccuccgggaucacgagauccauuuccacaaucuaacgcaccgauaauagacgaagaaagagaaaucccagagcgaucauggaacucaggucaugagugggucaccgacuucaagggcaaaacugucugguuuguacccaguaucaaagcggguaaugauauugcugcuugcuuacggaaaaauggaaagaaaguaauacaacuaucaagaaaaacauucgauagugaauaugugaaaacacgcacaaacgacugggauuuuguaguaacaacggacauaagugagaugggugcaaauuuuaaagcagaacgaguuaucgauccacguagaugcaugaaacccgucauuuuaacagauggugaagagaggguaauauuggcagguccuaugccaguaacccacuucagugcagcucagcggcgaggacggauaggucgaaacccuaaaaacgaaaacgaucaguauauauacaugggcgaacccuuagagaaugacgaagauugcgcucacuggaaagaggcgaaaaugcuacuagauaauauaaacacuccugaaggcauuauuccaaguauguuugagccagaacgagagaagguagaugcuauugauggcgaauaccggcugcgaggcgaagcucgaaaaacguuuguugaccuaaugagaaggggcgaucuaccaguuugguuggcuuacaaagucgcugcugaaggaauaaacuacgcagacagaagaugguguuuugaugguauuaaaaauaaucaaauccuggaagagaacguggaaguagaaauauggaccaaagaaggagagaggaagaaauuaaaaccuaggugguuagaugcucgaaucuacuccgacccauuggcauugaaagaguucaaagaauuugcugccgggagaaagucacuagcguuaaaucuaauaacagagauggggcgucuaccuaccuuuaugacccagaaaacuagagacgcacuugauaaccuagcugugcuacacacggccgaagcaggcggucgagcauacaaucaugcucuauccgaguugccagaaacccuagagacacuccuauuauuaacacuauuagcaacagucacaggcggaauauuccuauuuuuaaugaguggacgcgguauaggaaaaaugacauuaggaauguguugcaucauaacagcuagcauacuauuaugguacgcacaaauacagccacacuggauagccgcaagcauuaucuuaguguucuuucucauaguucuauugauucccgaacccgaaaaacagcgaacgccucaggauaaccagcucacuuauguagugauagccauucugacaguaguggcugcuacuauggcaaaugaaauggguuuccuagagaaaacgaaaaaggaccuaggguuugguaguaucgcgacacagcaaccagaaucaaauauucuggauaucgacuuaagaccagccagcgccuggacacuguaugcaguagcgacgacguucguuacucccauguuaagacacucaauugaaaacuccucuguaaacgucucguuaacagcgauugcgaaucaggcaacggucuugaugggacuaggcaaaggauggccacuuucuaaaauggacauaggcgucccauuauuagcaauaggauguuacucgcaagucaacccgauaacucuaacagcugcgcucuuacuccugguagcacacuaugcaaucaucggaccaggguuacaagcaaaagcuacacgugaagcacagaaaagagcugccgccggaaucaugaaaaauccgacaguagacgggaucacaguuauagaccuagauccaauuccauaugauccuaaauuugaaaaacaacucggccaaguuaugcucuuaguccuauguguaacccaaguguuaaugaugaggacaacgugggcacugugugaagcacugacacuagcuacaggcccgauuucaacacuaugggaaggaaauccgggcagauuuuggaauaccaccauugcuguaucgauggcgaauaucuuccgugguucuuaucuagcuggugcagguuuauuauucucuauuaugaaaaauacuacuaacacaaggcgagguacagguaauauaggcgaaacguuaggugaaaaauggaaaucacgauuaaaugcauuaggaaaaucugaauuucaaauauauaagaaaucagggauccaagaaguggaucgcacgcucgcaaaagaagggauaaaacgaggugagacagaccaucacgcaguaucaagaggcagugccaaguuacguugguuuguggagcgaaacaugguaacaccugaagguaaaguuguggaucucgguugcggccgcggaggguggagcuauuacuguggugggcugaaaaauguucgugaaguaaaaggguuaacaaaaggugggccgggucacgaagaaccgauaccuaugagcacauaugguuggaacuuggucagauuacagucuggcgucgauguauuuuucauaccuccagagaaaugcgacacccuacuaugcgacauuggcgaaagcagccccaaucccacaguagaagcagggcgaacuuuaagaguauuaaauuuggucgagaauuggcuaaacaauaauacacaauucugcaucaaaguacuuaauccuuacaugccaucaguaauugagaaaauggaggcuuuacaaagaagauaugguggagcauuaguucgaaauccuuuaaguagaaauuccacgcaugagauguauugggugucaaaugcaagugggaauauagugagcuccgucaauaugauaucacgcaugcuaaucaauagauucacgaugaggcauaagaaagcaacauaugagccugauguggaucucgggucggguacgcgcaacauaggaauagagucagaaguuccaaaccuagacauaauugguaaacguauagagaaaauuaaacaggaacacgagacaaguuggcacuaugaucaggaucauccguauaaaacuugggccuaccaugguucauacgaaacaaaacaaacuggaucagcgucauccauggucaacgguguuguccgacuccucacaaaaccuugggaugugcugccuacuguuacucaaauggcuaugacggacacgacgccuuucggacagcaaagaguauucaaagagaaaguagauacaagaacacaagagccaaaggaaggaacgaagaaacuuaugaagauuacagcggaaugguuauggaaagaauugggcaagaagaaaacaccaagaauguguacacgcgaggaauuuacuaggaaaguaaggucaaaugcagcucuuggagccauauucacagaugaaaauaaguggaaaucagcuagggaggcuguggaagauagcagauucugggaauuaguagauaaagagagaaaucuccaucuagaagggaagugcgaaacauguguauacaauaugaugggaaaacgugagaagaaauuaggagaauuugguaaagcaaaaggaucaagagcgauaugguauaugugguuaggugcccgcuucuuggaguucgaagcucugggguuccuaaacgaagaccacugguuuucgagagaaaauucucuaucaggaguugagggggaaggauuacacaaacuagguuacauucuaagggauguaucgaagaaagaggguggugccauguaugcagacgauacugcagggugggacacacggauaacuuuagaagaucugaaaaacgaggaaauggucaccaaccauauggaaggggaacauaagaaacuggccgaagcuauauuuaaauugaccuaccagaauaaagugguaagaguucaacguccaacaccaagagguacuguaauggacauaauaucccgacgugaucaacgaggaaguggacagguugggacauauggucugaacacauuuacuaauauggaagcacaacuaauucgacaaauggagggggagggaguauuuaaaaacauacaacaccuuaccgcuacagaagaaaucgcuguccaaaauugguuggcuaggguuggccgugagcggcuaaguaggauggcaauuucgggagaugauugcguggucaaaccucuagacgauagguuugcaagcgcacuuacugcguuaaacgacaugggcaagauuagaaaagacauucagcagugggaaccgucuagaggguggaacgauuggacacagguaccguuuugcucccaucauuuccaugagcucauaaugaaggauggcagggugcuaguagucccgugucgaaaccaagaugagcuaauagggcgagcgcgaauaucacaaggcgcuggcuggucucuaagagaaacagcaugucuggggaaaaguuaugcacaaauguggagccuaauguauuuucaccgaagagacuuaagguuagcagcaaaugccauauguagcgcagucccaagucauugggugccuacuucucgcacaaccuggucaauacacgcaaaacaugaauggaugacaacugaagacauguuaacuguguggaaccguguauggauucaggaaaauccuuggauggaggauaaaacuccaguggaauccugggaagagauuccauaucucggcaaaagagaagaccaauggugugggagucugauaggacuaacaucacgagcaacuugggccaaaaauauccaagcggcuauaaaccaagugaggagcuuaauuggcaaugaggaguauacugauuauaugcccucuaugaaacguuuccgucgagaagaagaagaagccgguguacuaugguga

SEQ ID NO: 22979 - RNA, 9876 nt, Artificial Sequence
  derived and/or modified CDS sequence (opt6) from DENV-2__AF169686__SS-prME
ucagcuggaaugauaauuauguuaauaccaacugugauggcauuucauuugacaacaagaaauggagaaccucauaugauaguuuccauacaagaaaaagguaaaagucuucuuuuuaaaaccgaagacgguguaaacaugugcacucuaauggcuauggaccuuggugaauuaugcgaagauacgauaaccuauaaaugcccauuauuaagacaaaaugaaccugaagauauagacugcugguguaauuccacaaguacauggguaacauacggcacauguacaacaacaggagaacaccgucgugagaaaagaucaguagcauugguaccacacgugggcaugggauuagaaacgcgaaccgaaacguggaugagcucagaaggcgcauggaaacaugcgcaaagaauagaaaccuggauacuaagacacccgggauuuacaauaauggcagcaauauuagcguacacuauagggacuacucauuuucagcgagcacucauauuuauucucuuaacagcuguugcgccaagcaugacuaugaggugcaucgggaucagcaacagagacuuugucgaaggggugucagggggcucuuggguggacauaguauuggaacacgguucaugcguuacuacaauggcuaaaaacaaaccaacacuagacuuugaguuaauuaagacggaagcaaaacaacccgcuaccuugagaaaauauuguaucgaagcuaaacuuacgaauaccacaaccgaaucacgauguccaacgcagggagaaccaucucuuaaagaagaacaggauaaaagauuuguuugcaaacacaguaugguggauagaggauggggcaaugguugcggacuuuucggaaaaggaggaaucgugacaugugcaauguucacauguaagaaaaacauggaaggaaaaauagugcagccagaaaacuuggaauacaccauaguaguuacaccacauaguggcgaagaacaugccguuggcaaugacacuggaaaacauggaaaagagauaaaggugacuccacagaguucuauuacugaagcugaacugacagguuaugggacagucacaauggaauguucaccaaggacagggcuugacuuuaacgaaaugguuuuguuacaaauggaaaacaaagcguggcuuguacauaggcaaugguucuuggaucuaccguugccaugguuaccaggagcagauacacaagggucuaauuggauccaaaaggaaaccuuagugacuuucaagaauccacaugcaaagaaacaagauguuguuguucuugguucucaagaaggggccaugcacacugcucuaacuggggccacggagauacaaaugagcagugggaacuuguuauucacaggacaucugaaaugcagacuccgaauggacaaacuacaauuaaagggaaugaguuacucuauguguacggggaaauuuaaagucgugaaagaaauagcagaaacgcaacacggaacuaucguuauacguguucaguacgagggagaugguucgccuuguagaauaccauuugaaauaauggauuuagagaaaagauacguuuuagguagacuaauaacugugaauccaauaguaacggagaaagauucaccagucaauauagaagcggaaccaccauuuggugacaguuacaucauaaucgguguggagcccggacaauuaaaauuaaacugguuuaagaaagggucgagcaucggacaaauguucgagacuacaaugaggggagcaaaacgaauggcgauuuuaggggacaccgcaugggacuucggaucauuaggagggguauuuacaucaauaggcaaggccuuacaucaagucuucggugccauauacggugccgcauucucaggaguuagcuggacuaugaaaauauucauagggguaauuauaacguggauaggcaugaacagcagaucgacaucauuaucagugucucuaguucuuguagguauuguaacgcuuuaccuagguguuaugguccaggccgacucgggaugugucguaucuuggaagaauaaagaauuaaaaugcgggaguggaauauuuauaacagacaauguacauacuuggacagagcaauauaaguuccaaccggaaucgcccaguaaacuagccucagccauccaaaaagcccaagaagaagguaucuguggcauaagaucgguuacaagauuagagaaccuuauguggaaacagaucacacccgaacuaaaucauaucuuagcggagaaugaaguaaaacuaacuauaaugacaggugacauaaaaggcauaaugcaagccggaaaaagguccuugaggccacaaccuacugaguugaaguacucguggaaaacauggggaaaagcuaagaugcuuagcacagagucgcauaaccagacauucuugauugauggaccggaaacagcagaaugccccaauacuaauagagcguggaacucccucgaaguggaagauuauggcuucgguguauuuacgacaaauauuuggcucaaguugaaagaaaagcaagacgcuuucugcgauucaaaacuuaugucugcagcuauaaaggauaaccgugccguacaugccgacaugggauauuggauagagucagcauugaacgacaccuggaaaauagaaaaagcauccuuuauagaagugaaaaauugccauuggccuaaaagucacacacuuuggucaaauggaguucuagagucagagaugauaauucccaaaaaccuggcugguccgguaucccaacacaauuaccgaccuggguaucauacucaaauugcgggaccguggcaccuugguaaauuagaaauggacuuugauuuuugugacgguaccaccguugucgucaccgaagacugcgguaaucgagguccaagucuacgaacaaccacagcuucagggaaauuaauaacggaauggugcugucgaucauguacucuucccccgcugagguauagaggagaagacgguuguugguacggaauggaaauaagaccccuuaaagaaaaggaggaaaaccuaguaaacagcuuaguuacggcagggcacggacagguggacaauuuuucauugggaguccuggguauggcacuauuccuagaagagaugcuuagaacaagaguagguaccaaacaugcaauacuacuggucgcaguuaguuuuguaacacuuauuaccgguaacaugaguuuuaaagaucuaggaagaguaguaguaauggugggagccacgaugacugacgauauagggaugggugucacuuacuuagcacuccuagcugcauuuaaaguacggccuacguucgcagcuggucuguuacuucgaaaauuaacuucaaaagaauugaugaugacuacaauaggcaucguuuuacuaagucaaagcacgauucccgagacgaucuuagaauugacagaugcacucgcacuggguaugaugguccuuaaaauaguucgcaauauggaaaaauaccaacuggcuguuacaauaauggcaauuuuauguguuccaaaugcuguaauacuucaaaacgccuggaaagucucguguacgauacuugcaguuguaucugucuccccucuuauauuaacauccucacaacagaaaacugauuggaucccauuagcuuuaacgaucaaaggauuaaauccuacggccauauuccuaacaacauuaucaaggacaaacaagaaaaggaguuggcccguaaacgaggcaauaauggcaguagggaugguuagcauacuugcgaguucauuacuuaaaaacgacauacccaugacugggccauuaguggccggaggguugcucacaguaugcuacguacugacugggcgcucagcagaucuagaacuggagcgagcgacagacguaaaaugggaggaucaagcggagauauccggaucaagcccuauauugaguauaaccauaagugaagacggcucuaugaguaucaaaaaugaggaagaagaacaaacuuuaacuauacuuauacgaacaggacuuuuggucauaucaggauuauuuccaguaucaauccccauuacagcagcugccugguaucugugggaagucaagaaacaacgagccgguguuuuaugggauguuccuagucccccuccaauggggaaagcagaguuagaagauggagcuuaucguaucaaacaaaagggaauccugggauacagucaaaucggugcggggguuuauaaagaagguaccuuucauacgauguggcaugucaccagaggggcaguucuuaugcacaaaggaaaacgcauagaaccuucgugggcugauguuaaaaaggaccuaauuagcuacggaggaggauggaaacuagagggagaguggaaagagggagaagagguucaaguacuugcgcuugaaccaggaaagaauccuagagcaguccagacaaaaccagguuuauucaaaacuaauacgggaacuaucggagccgucucacuagauuuuucaccgggcaccaguggcucgccaauaauagacaagaaaggaaagguaguagggcuguacggaaacggcguugugacacgcagcggggcguauguaucugccauagcacaaacggaaaaaucaauagaagauaauccugagauugaggaugacauuuuucgcaaacgccgucuaacuauaauggauuuacauccaggcgcgggcaaaacaaagaaguaucugccggcuauaguucgagaagcuauaaagcgcggauugagaacucucauacuagcaccaaccaggguuguagcggccgaaauggaagaggcccuacggggauugccaauuagguaccaaacaccggcaauucgggcggaacauacaggcagggaaaucguugaccucaugugucaugccacauuuacaaugcgucuuuuaucaccaguucggguaccuaacuacaaucugauaaucauggacgaagcucauuuuacagauccggcuucaauagcagcacgaggauauauuaguacacggguggagaugggcgaagcagcagguauauuuaugacugcaacuccaccagguucgagggacccuuuuccacaauccaaugcaccgaucauugacgaggaaagagaaauacccgagaggucauggaacagcggucaugaaugggucacagauuucaaagguaagacaguuugguucgugcccucuauaaaagcagguaacgacaucgcagcaugcuuacggaaaaaugggaagaaaguaauucaauuaagucggaaaaccuucgacucugaauauguaaagacuaggaccaaugauugggauuucgucgugaccaccgauauaagugaaaugggugccaacuuuaaagcugaaagaguaaucgauccuagacgguguaugaagccgguaauucuaacugacggcgaagaaagaguuauacuagcagguccaaugccaguuacucauuuuucagcagcucaaagacgcgggagaauaggaagaaauccgaagaacgagaaugaucaauauaucuauaugggagagccacuggaaaaugaugaagauugugcgcauuggaaggaagcaaaaaugcucuuggacaauauuaauacaccugaaggaaucauccccucuauguucgaaccugagagagagaagguugaugcaauugauggcgaguauagguuaagaggagaagcaagaaaaacauuuguagaccugaugcggcgaggagaccuaccaguaugguuagcauacaaaguugcugcagaaggaaucaauuacgccgaucgaagaugguguuuugaugguaucaagaacaaucagaucuuggaagaaaauguugaagucgaaauauggacgaaagaaggggaacggaaaaaguuaaaaccaagguggcucgacgccaggauuuacucugauccgcuagcccuuaaagaauuuaaagaauuugcagccggccgaaagagcuuggcuuugaauuuaaucacggagauggguagacugccuacuuuuaugacacagaaaacgagggaugccuuggauaauuuagcuguucuccauacagcggaggcgggaggccgagcauauaaucaugcguuaagcgaauugccugaaacucucgagacauuacuucuauuaacauuauuagcaacgguuacaggagggauuuuucucuuucuuaugucgggaagagggauaggaaagaugacacugggaauguguugcauuaucacagccucgauauuacuuugguacgcgcaaauacaaccucauuggauagcagcaucaauaauuuuaguauucuuuuuaauuguucuauuaauucccgaaccagaaaagcaaaggacuccgcaggacaaucaacuaacauauguuguuauagcaauuuuaacaguaguagcagcuacaauggcaaacgaaaugggguuccuugagaaaacaaagaaagaucuaggauucgggucaauugcaacucagcaaccugaaaguaauauauuggacauugacuuaaggccagcgucugcuuggacccuguacgcaguggcuacaacauucgucacaccaauguuaagacauucaauagaaaacucaagcgucaacgugaguuuaacggcuaucgccaaccaagcaacagucuuaaugggacucggcaaaggauggccacuuucuaaaauggauauugguguuccguugcuagccauagguuguuacagucaaguaaauccaauuacauugacggcagccuuauuauuauuaguagcacauuacgcuauuauugguccaggauuacaggcgaaggcuacuagggaggcacagaaaagagcagcggcugguauuaugaaaaacccuaccguagauggaauaacaguuauugaccuugauccaauaccauacgacccgaaauucgaaaaacaauuaggucaaguuauguuacucgugcuaugcguaacgcaaguucuaaugaugcgaaccacaugggcauuaugugaagcacuaaccuuagcuaccggaccaaucagcacauuaugggagggaaaucccggacgguuuuggaauacaacaauugcugugucgauggcaaauauauuuagagggucauauuuggcaggggcaggauuauuauuuucaauuaugaaaaauacuaccaacacgcggagaggaaccgguaauauaggcgagacacugggagagaaauggaaaucccgauuaaaugccuuaggaaagagugaguuucagauuuauaagaaaagcgguauacaagaaguagacagaacccuagcaaaagaagguauuaaaagaggggagacagaucaucacgcaguaucccgagguagcgcgaaacuaaggugguucguggagaggaauaugguaaccccagaaggaaaagugguugauuugggauguggaagaggcggauggucauauuauuguggaggccuuaaaaauguaagagaaguaaaaggacuaaccaaaggugggccgggccacgaggaacccauaccaaugucgaccuacggauggaacuuaguuagguugcaaucagguguggaugucuucuuuaccccaccagagaaaugcgauacguuauuaugugauauaggggaaucuucaccaaacccaacuguugaggccgggcguacgcuacgcgucuuaaaucugguagaaaauuggcuaaauaauaauacucaguuuugcauaaaagugcuuaacccuuauaugccaucaguaauugagaaaauggaggcucuacaaagaagauauggaggagcgcucguuaggaauccucuaaguaggaauaguacccaugaaauguacuggguuaguaacgcaucagggaacaucguaagcucaguuaauaugauuucaaggaugcuuauaaauagauuuacgaugaagcauaaaaaggcgacuuaugagccggauguugauuuagguagcggaacucgaaauauuggcauagaaagugaaguaccgaaccucgacaucauuggaaaaagaauagaaaagauaaagcaagagcaugagacaaguuggcacuacgaucaagaucauccauacaaaaccugggcguaucacggaucauaugaaacaaaacagacugguagcgcuaguaguaugguuaauggcguuguccgcuuacuaacaaaaccaugggacgugcucccaacagugacucaaauggccaugaccgauacaacgcccuuuggacagcaaagaguauuuaaagagaaggucgacacaagaacucaagagccgaaggaagguacgaagaaauugaugaagauaaccgccgaaugguuauggaaggaacucggcaaaaagaaaacuccacguauguguacaagagaggaauuuacacguaaggugagaaguaaugcagcacucggagcaauuuuuaccgaugaaaacaaguggaaauccgcacgcgaagcuguugaagacagucguuucugggaacuuguggauaaggaacgcaaucuucauuuggaagguaaaugugagacgugugucuauaacaugauggguaaacgggaaaagaaauuaggagaguuuggaaaggcuaaagggucucgugcuauaugguacauguggcuuggcgcuagguuccuggaauuugaaacucuaggauucuugaaugaagaccauugguuuucgagagagaacagucuuagugguguagaaggagaagguuuacauaaacuuggauauauucuaagagauguaaguaagaaggaggguggggcuauguacgcggacgauacagcuggaugggacacuagaaucacacuugaggaccuuaaaaaugaagaaaugguaacaaaccacauggaaggugaacauaagaaacuagcggaagcuauauucaaauuaacuuaccagaauaaaguaguacgaguccaacggcccacaccgagaggaacaguuauggacaucauaucucgucgggaucaaagaggaucuggucaaguagguacauacggauugaacacauucacuaacauggaagcacaacuaauaaggcaaauggaaggagaaggugucuucaaaaauauucaacaccuaacggcuaccgaagaaauugcaguccaaaauugguuagccagaguugguagagaacgauuaagucgcauggcgauauccggagaugauugcguuguaaagccguuagaugauagguucgcgagcgcucucacagcccuaaaugauaugggaaaaauaagaaaagauauacaacaaugggagccaucacgcggauggaacgacuggacccagguaccauuuuguucacaucauuuucaugagcucauuaugaaagauggcaggguacuuguaguaccuugccguaaucaagaugaauuaaucggccgagcucgcauaagccaaggcgcuggauggucgcuacgagaaacugcaugucucggaaaaaguuacgcacaaaugugguccuuaauguauuuccaccggcgggaccuuagauuagcggccaaugcuaucugcucugcugugccuucgcauuggguaccaacuagccggacgacguggaguauccaugcaaaacaugaauggaugacaacugaggacauguuagcaguuuggaauagaguauggauacaagaaaauccguggauggaagauaagacgccgguagagucaugggaagaaaucccauaccuagguaaaagagaagaccaauggugugguucuuugauaggcuugacgagucgugccacaugggccaaaaauauucaagcugcaauaaaucaaguacgaaguuugauagguaaugaagaauacaccgacuauaugccuucaaugaaacgauuucggcgagaagaagaagaagcaggagugcuuugguag

SEQ ID NO: 22980 - RNA, 9876 nt, Artificial Sequence
  derived and/or modified CDS sequence (opt6) from DENV-2__AF169687__SS-prME
agugcugggaugauaaucaugcuaauuccaacagugauggcauuccaccuaacgacgagaaauggcgaaccacacaugaucguuucaauccaagaaaaaggaaaaagucuucucuuuaaaacagaagacggugugaauaugugcacccuaauggcaauggaccucggugaauuaugcgaagacacuauuaccuauaaauguccacuauuaagacaaaaugaaccagaagauauagacugcuggugcaacucaaccucuacuuggguaacuuauggaacuugcacgacaacuggugaacauagaagggaaaaacgaagcguugcucuaguaccacacguugggauggguuuagaaacgagaacagaaaccuggaugagcucugaaggcgcauggaaacacgcacaaagaauugagaccuggaucuuaagacauccuggguuuacuaucauggcugcgauucuagcauacaccauaggaacaacccacuuucagagagcauuaauuuuuauacuucuuaccgcaguagccccgagcaugacuaugcgauguauuggaauaucuaaucgagacuuuguagaagguguuaguggagggucauggguugacaucguauuagaacacgguaguuguguaacaacaauggccaaaaauaaaccgacgcuagacuuugaacuuauaaaaacagaagcuaaacaaccggcaacgcuucggaaauauuguauagaggcuaaacucacgaauacaaccaccgaaucccgauguccaacgcagggagagccaagccuaaaagaagaacaagauaaaagauuuguuuguaaacauagcauggucgacagaggcugggguaaugggugcggauuguuuggaaaaggagggauaguuacuugcgcaauguuuacaugcaagaaaaauauggaagguaaaauuguacaaccagagaaccuagaauacacuaucguaguaacuccgcacucuggcgaagaacacgcagucggaaaugacaccggcaaacacggaaaagaaauaaaagugacaccucaaucaagcauuacggaagcggaacucacaggauacggaacuguaaccauggaauguucuccacgcaccggauuagauuuuaacgaaaugguacucuuacaaauggaaaauaaagcguggcuaguacaucgucaaugguuuuuagauuuaccguuacccuggcuaccaggggcggauacacaagguucgaacuggauucagaaagaaacuuuagucacauuuaaaaacccccacgcuaagaaacaggacguagugguccuaggaagucaagaaggcgccaugcauacugcauuaacuggagccaccgaaauacaaaugucgaguggaaauuuguuauucacagggcaccuaaaaugcagacuacgaauggauaaacuacaguuaaaaggcaugucauauucaauguguacuggaaaauuuaaaguuguuaaagaaauagcagaaacccagcacggaacaauuguuaucagaguacaguaugaaggugaugguagcccuugucgcauuccguucgaaauuauggaccuagagaaaagauauguguuagguagauuaauaaccguaaacccaauaguaacagagaaagauucaccaguuaauauagaagcagaacccccguucggugacaguuacauuauuauuggaguggagcccggccaacuaaaacuaaacugguuuaagaaaggaucuucaaucggccaaauguucgaaacaacuaugagaggggcuaaaagaauggcuauucucggagacacagcuugggacuuuggaucccuuggaggugucuuuacuucuauaggaaaagcacuccaucaaguauucggggccauauacggagcagcguuuagcggagucagcuggacgaugaaaauacuaaucggaguuauaauaacauggaucggaaugaacagcagaaguacaagucuuaguguuucuuuagucuuaguugggaucgucacauuguauuugggaguuaugguacaagcugauucuggaugcguggucucauggaaaaauaaagaacuaaaaugcggaaguggaauuuucauuaccgauaauguucauaccuggaccgagcaguacaaauuccagcccgaaucuccgaguaaauuagcaucugcaauucaaaaagcacaggaagaagguauuugcgguaucaggucgguaacacgucucgagaaccucauguggaaacaaauaacaccagaauugaaccauauucugagugaaaaugaaguaaaguuaacaauaaugaccggugauauuaagggaauuaugcacgcugguaaaagaucccuaagaccccaacccaccgaacuuaaauacuccuggaaaacguggggaaucgcuaaaaugcuaucuacagagucgcacaaucaaacauuccuuauagacggacccgagacagcggaguguccgaauacgaaucgagcauggaacucccuugagguagaagauuaugguuuuggaguauuuacuacaaauauauggcucaaguugaaagaaaaacaagacgcauucugugacucgaaguugaugagugcugcaauaaaagauaauagggcaguucaugcggauaugggcuauuggauagaauccgcauuaaacgauacauggaaaauagagaaagcaaguuuuauugaggucaaaaauugucacuggccaaaaucucacacuuuaugguccaacgguguacuggaaagcgaaaugauaauacccaaaaauuuagcagguccugugucgcaacacaacuacagaccagguuaucauacacaaaucgcgggaccguggcauuuagggaagcuggaaauggacuuugacuucugcgaugggacaacugucgugguaacagaagacugugggaacagaggucccucucuacgaaccaccaccgcaucaggcaagcugauuacagaaugguguugcagaucauguacauuaccaccgcuucgcuaucguggugaagauggcuguugguacggcauggaaauacguccacuuaaagaaaaagaagagaaccugguaaacucacucguuacagcagggcauggccagguugacaacuucucacuuggcguacucgggauggcccuauuuuuagaagaaaugcuacguacccguguaggaaccaaacaugcaauccuacugguugcuguuucauucgugacuuuaauaacaggaaacaugucauucaaggaccuuggaagaguaguugucacagucggugccacuaugacagacgauauaggaaugggugugacauaucucgcuuuauuagccgcuuuuaaaguccguccuacauuugcugcaggauuauuguugcgaaaauugacuucuaaggaauuaaugaugacgaccauaggaauuguucuguuaucccaaucaacaaucccagaaacaauucuggaacuuacggaugcauuagcucuagggaugaugguauuaaaaauaguccgaaauauggagaaauaccagcuagcaguuacuauaauggcgaucuuaugugugccgaaugcaguaauuuuacaaaacgcguggaagguaucaugcacaauauuggccguaguuucaguaucuccuuuaauacuaacaagcagucagcagaaaacugauuggauaccuuuagcucuuacgauaaaaggacuuaaucccacagcuauuuuccuaacaacuuugucaagaacaaacaagaaaagaaguuggccguuaaaugaagcgaucauggccguagguauggugagcaucuuagccucaucacuccucaaaaaugacauuccgaugaccggaccccuaguagcugggggauuacuaacugugugcuacguccuuacaggacgcagugccgauuuagaacuagagagagcaacagacguuaaaugggaagaccaagcugaaauaucugguaguucuccaauacuaagcauaaccauaagugaagacggaagcaugagcaucaaaaaugaagaggaagaacagacgcucaccauacuaauacgcacaggucuauuaguuauaucaggccuuuuuccaguauccauaccuauaacagcagcugcaugguaccuaugggaaguuaagaaacagagagcaggcgucuuaugggauguaccuucuccuccuccuauggggaaagccgaauuggaggauggcgcauaucgaaucaaacaaaaaggaauacucgguuauucccaaauuggagcuggaguauauaaggaagggacauuucacacuauguggcauguaacuagaggugcaguucuaaugcacaaagguaaaagaauagagccaucuugggcugacgugaagaaagaucuuauuucuuacggaggcgguuggaaauuagaaggagaauggaaagaaggugaggaaguucaggugcucgcauuagaaccugguaagaauccgagggcuguccagacuaagccaggacucuucaaaacgaauaccgggacaaucggagcaguaucacuugauuuuucgccugguacuuccggaucccccaucaucgauaagaaaggaaaggugguuggauuguauggaaaugguguuguaacccgaucaggagcauauguaagugcaauugcgcaaacugagaagucgauugaggauaacccagaaauagaagaugacauauuuagaaaaaggaggcuaacaauaauggacuuacauccuggagcagguaaaacaaaaagguaucugccagcaaucgucagagaagccauaaagcgcggucuuagaacuuuaaucuuggcgccaacaagggucguagcggcugaaauggaggaggcauuaagaggauuacccauaagauaucaaacacccgcaaucagagcagaacauacugggagagaaauugucgaccugaugugucacgccacauuuacgaugagacuccuaucaccuguucgugugccaaauuauaaccuaauaauuauggaugaagcacacuucacggaccccgcaucuauagcggccagaggauauauuagcacccgaguugagaugggagaagcagcuggaauauucaugacugcuacucccccaggaagucgagacccauucccacagaguaaugcaccaauaauagaugaagaaagagagaucccagaaagaucuuggaacucuggucaugaauggguuacugauuuuaaggguaagacaguuugguuuguacccucaauuaaggcaggaaaugauauugcagcaugccuucguaagaauggcaagaaaguaauucaacugaguagaaaaacguuugauagcgaguacgucaagacuagaacaaaugauugggauuuuguggucacuaccgauauuucggaaaugggagcaaauuucaaagcagaacggguaauagauccuagaagguguaugaaacccgucauacuaaccgauggagaagaacgcguuaucuuggcaggaccaaugccgguaacacacuucagcgccgcccaaagaagaggcagaauaggacgcaaccccaaaaacgaaaaugaucaauacauuuacaugggagaaccgcuagagaacgacgaagacugcgcacacuggaaagaagcaaagaugcuacuugauaacauaaacacaccagaggguauaauaccaaguauguucgaaccagaaagagagaaaguugaugcuauagacggugaguauagguugcgaggagaagcaagaaagacuuuuguggauuuaaugcguagaggggacuugcccguauggcucgccuauaaaguugcugcugagggaauaaauuaugcagauaggagaugguguuucgaugguauaaagaauaaccagauccuggaagaaaacguggaaguagaaauuuggaccaaggaaggugagaggaagaaauugaagccaagauggcucgaugcaaggauuuacagugauccacuagcacuuaaagaguucaaagaauuugcugcugguaggaaaucucucgcacucaaccugauaacagaaaugggacgacugccaaccuucaugacucagaaaacuagagaugcacuagauaacuuagccguauugcauacagcugaggcugggggccgcgcuuacaaucacgcacuaucagaguuaccagagacccuugaaacccuauugcuuuugacacuauuagcaaccguuacaggugguauuuucuuauuucuaaugagugggcgagggauaggaaaaaugacgcucgggauguguuguaucauuacagcuucaauccugcuaugguaugcgcaaauccaaccccauuggauugcagcaucaauaauauuaguauuuuuccuaauuguucugcuaauaccagaacccgaaaaacaaaggacgccacaagauaaccaauuaacguacguuguuauugcaauccuaacaguagucgcggcaacaauggcuaaugaaaugggauucuuggagaaaaccaagaaagaucuuggguuuggcaguauagcaacacaacagccagaaaguaauauccuugauauugauuuaagaccugcgucggcguggacucuuuacgccguugcuacaaccuuugugacaccuaugcuacgacauaguaucgaaaauaguaguguuaauguuagucuaacugccauagcuaaccaagcgacaguauuaauggguuuggguaaaggguggccacuaaguaaaauggauauugguguuccacuucuugccauugguugcuauucucaaguaaacccaauaacucuuacagcagcuuuauuacugcucgucgcacacuacgcaauuaucggacccgggcuacaagcaaaagcgacacgagaagcacagaaaagggcugcggcagggauaaugaaaaaucccacaguugauggaaucacaguaauagaucuugauccuauaccuuaugacccuaaauucgagaaacaacucggccaagucaugcuucuaguacuuugugugacacaaguacuuaugaugagaaccacaugggcguugugugaagcauuaacacuggcgacagggccaauaucaacuuuaugggaaggaaauccaggucgauucuggaauacaacaaucgcuguaucgauggcuaauauauuucggggaucuuaccuugccggagcuggacuacuuuuuaguauuaugaaaaacacuacaaacaccagacgugggacuggaaacauaggugagacucuuggugaaaaauggaagucuaggcuaaacgcacuagguaaaucugaauuucaaauuuacaagaaaucggggauucaagaaguagaucgcacacuagcuaaagaagguauaaagcgaggagaaacggaucaccaugccgucaguagagguucagcaaaacucagaugguucguugaacguaacaugguuacgccggaaggaaaagucguagaccugggaucaggccguggggguuggaguuacuacugugguggguugaagaacguacgagaggucaaaggauuaacaaaagguggcccuggacacgaagaacccauaccuauguccacguauggauggaacuuagugcggcuacagucagguguugauguauucuuuauaccgcccgaaaaaugugauaccuugcuaugcgauaucggagaaagcucaccaaacccuacaguagaagcgggaagaacccuaagaguguuaaaucuaguagagaauuggcuaaauaacaacacgcaauuuuguauaaagguacugaacccuuauaugccuucagucauagagaaaauggaggcacuacaaagaaaguauggaggagcgcugguaaggaaucccuuaaguagaaauaguacgcacgaaauguacuggguuucgaacgcuucuggaaauauaguaaguagcgucaauaugauaucacgaauguuaauaaauagauuuacaaugagacauaaaaaggcaaccuacgagccugauguggaccuagguucgggaacucguaacaucggaauagaaagugagauaccuaaucucgacauaauugggaaaagaauagagaagauaaagcaggaacacgaaacaucauggcauuaugaccaggaucauccauauaaaaccugggcuuaucaugggucguaugaaacgaaacaaacgggaagugccucaaguauggugaacggaguaguucgguugcuaacuaaacccugggacguccucccgaccguaacucaaauggcuaugacugauacuacacccuucggucaacaaagaguauuuaaggaaaaggucgacacuaggacacaagagccaaaagaagggacgaagaaacuaaugaaaauaaccgcagaaugguuauggaaagaauuggguaaaaagaaaacgccgcgaaugugcacgagggaggaguuuacccgaaaagucaggaguaaugcugcccuaggagcaaucuuuacagacgaaaauaaauggaaaagugcccgagaagcggucgaagacucgcgauucugggaauuaguagauaaagagagaaaccuccaccuugaaggaaaaugugagacguguguauacaacaugaugggaaaaagggagaagaaacuaggggaguucggaaaagcaaaaggaaguagagcuaucugguacauguggcugggggcuagguuccuagaguuugaagcauuaggcuuucuuaaugaggaccauugguuuucuagagagaauaguuuaucaggcguagaaggugaggguucacauaaacuaggauauauucuaagagaugugagcaagaaagaaggaggugcuauguaugcugaugacacagccggaugggacacgaggauaacucuagaagaucucaaaaacgaggaaauggugacuaaucauauggaaggagaacacaaaaagcuagcugaagcgauuuucaaauuaacuuaccaaaauaaaguuguucgugugcaacgacccacacccagaggaacaguaauggauauuauuucccgacgugaucaaagagggucuggacaaguaggaacguauggacuaaacaccuucacuaauauggaagcacaguuaauccgacaaauggaaggcgaaggaguuuucaaaaacauccaacaccucacggcaacugaggaaauagcaguacaaaauuggcuugccaggguagggcgcgaaagacuuucacgaauggcaauuucaggagaugacuguguugugaaaccacucgacgauagauucgcaucugcacuaacggcgcuuaaugauauggguaagauaaggaaggacauacagcaaugggaaccuaguaggggcuggaaugauuggacucagguacccuuuugcucacaucacuuucaugaacuaauaaugaaggauggcaggguccuaguaguuccgugccgcaaucaagaugagcugauagggcgugcccggauaucacaaggagcagguuggagucucagagaaacggcaugccuaggaaaaagcuacgcucaaauguggagccuaauguauuuucaccggagagacuuacgccucgcagcaaaugcgauaugcucagcaguaccaagucacuggguaccaacgagccggaccacuuggucaauccacgcaaaacacgaguggaugacaacagaagauauguuaacaguauggaauagaguuuggauacaggaaaauccauggauggaagacaaaacgccuguagaaaguugggaagaaauuccauaccucgggaaaagagaagaucaaugguguggaagucucauaggucugacuucuagggcaacaugggcgaaaaauauacaagcagcaauuaaccaaguacguucauuaauaggaaacgaagaauauacagauuacaugccaucgaugaagagguuuagaagagaagaggaagaagccgguguauuaugguga

SEQ ID NO: 22981 - RNA, 9876 nt, Artificial Sequence
  derived and/or modified CDS sequence (opt6) from DENV-2__AF169688__SS-prME
ucggcagggaugauuauaauguuaauaccaaccguaauggcguuucaccugaccacacgaaauggggaaccgcacaugauugugaguauacaagaaaaagggaaaucauuguuauuuaaaacggaagacggaguaaacauguguacguuaauggcaauggauuugggugaauuaugcgaagauacuauaacauacaaauguccucuacucagacaaaacgaaccugaagauauugacugcuggugcaauuccacgagcacuuggguuacauauggaacauguacgaccacaggagaacaucguagagagaaaagaagcgucgcucuggugccacacguuggaaugggacuugaaacaagaacggaaacauggaugaguucugaaggggcauggaaacaugcucaacggauagaaacguggauacuacgacauccaggauucacgaucauggcagccauuuuggcauacacuauaggcaccacacacuuucaaagagcacucaucuucaucuuauugacagccguagcaccgucgaugacaaugagguguauugguauuagcaaucgcgacuucguggaaggcguauccggaggaaguuggguagauauaguguuagaacacgguagcugugugacgaccauggccaaaaauaaaccaacuuuagacuuugaauuaauaaaaaccgaagcaaaacaaccagcgaccuugagaaaauauuguauagaagcuaaacugacaaacacuacaacugaaucaagauguccaacacaaggcgaaccgucauuaaaagaagaacaggauaaaagguuuguuuguaaacauucaaugguugacagaggguggggaaauggauguggcuuauuuggaaaaggggguauaguaacuugugcaauguucacuugcaagaaaaauauggaaggcaaaaucgugcaacccgaaaauuuagaauacaccauaguuguaacuccucacagcggagaggagcaugccguagggaaugauacagggaagcaugguaaagaaauuaaaguaacuccucaaucaucuauuacugaggcagaauugaccggguaugguacagugacuauggaguguucaccacgaacaggcuuggacuuuaaugaaaugguuuugcuccaaauggagaauaaagcaugguuaguucauagacagugguucuuagaucucccucuuccuuggcuucccggagcugacacacagggaucaaacuggauacaaaaagaaacgcugguaacguucaagaacccacacgcaaagaaacaagacgucguuguacuaggaagucaagaaggcgcuaugcauacugcacugacaggagcaacagagauacaaaccucuucugguaacuuacuuuucacaggacaucuaaaauguagacuucgaauggacaaacugcaacuaaaagggaugucguauaguaugugcaccggaaaguucaaaguaguuaaagaaauagcggaaacucaacauggcacaaucguuauaaggguccaguaugaaggggauggauccccaugcagaauaccguuugaaauaauggaccuggagaaaagguauguuuugggacgccuaauuacuguuaacccgaucguaaccgaaaaggauucgccaguaaacauagaagcagaaccgcccuucggagauuccuacauaauuaucgggguugagccuggccaauuaaaauugaauugguuuaagaaaggaucuucuauaggucaaauguuugagaccacgaugagaggcgcgaaaagaauggcaauauuaggggacacagcaugggauuucgguagcuuaggcgguguguucaccuccaucgguaaagcucugcaucaaguuuuuggagcaauauauggggcggcuuucucagguguuagcuggacgaugaaaauuuuaauuggagugauaauuaccuggauagggaugaauagcagaagcacaucauuaaguguaaguuuggugcuaguagguauuguuacuuuauaccucggugucauggugcaagcagauucagguugcgucgugagcuggaaaaauaaagaacuaaagugcggaaguggaauauuuauuaccgauaacguucacacuuggaccgaacaauauaaauuccaaccggaaagccccucgaaauuagcuuccgccauacaaaaggcacaggaggaagguauuugugggauccgcagcguaacaagacuagaaaaucuuauguggaaacaaauuacuccugagcugaaccacauucuggccgagaaugaggucaaacuuacaauaaugaccggagacauaaaaggcauaaugcaugcugguaagaggagcuuacguccacagcccacggaguuaaaauacucauggaagacuuggggaaaagccaaaaugcuuucaacagaaagucauaaccaaacuuuccuuaucgacggaccugaaacugcugaauguccaaacacaaacagagcguggaauagccuagagguagaggauuacggcuuugggguauucacaacaaauauaugguugaaauuaaaagaaaaacaagacgccuuuugugauucaaaacugaugucggcggcuauaaaagauaacagagcgguacaugcagacaugggauacuggauagaaucugcacucaaugauacuuggaaaauugaaaaggcaucauuuauagaagugaaaaauugccauuggccgaaaucacacaccuuaugguccaacggagugcuugaaucggaaaugauuauaccaaagaaccuugcaggucccgucagccaacacaauuauagaccaggguaccacacgcaaauagccggaccauggcauuuagggaaauuggagauggauuuugauuucugugacggaaccacaguuguugucacagaagacugugggaaccgaggaccaucuuuaagaaccacuacugcuucaggaaaauuaaucacagaguggugcugucgauccuguaccuugcccccacuacgauauagaggcgaagauggcugcugguauggaauggaaauuaggccguugaaggaaaaagaagaaaaucuuguaaauucccuuguaacagcgggucauggacaagucgacaauuucagucuagggguacuaggaauggcucucuucuuagaagaaaugcuaagaaccagaguuggcacuaagcaugcaauauuauuaguggcuguaaguuuuguaacauugauuaccggaaacaugucauuuaaggauuuagggcgaguuguaguaauggugggagcaaccaugacggaugauaucggaaugggcguuacauaccuagcauuguuagcagcauucaaagucagaccuaccuuugcugccggguuauugcuaagaaaauuaacuagcaaagaauuaaugaugacuacuauaggaauaguacuuuugagucaaucuacaaucccagaaacgauccuugaauuaacagacgcacuagcacucggaaugaugguauugaaaauaguacguaacauggagaaauaucaacuugccguuacaauaauggcaauccuaugcguacccaaugcaguuauucuucaaaacgcuuggaaaguuaguugcacaauauuagcaguagugucgguuagucccuugauuuuaacaucgagccagcaaaagacugacuggaucccccuggcucugacuauaaagggguuaaaccccacagcuauuuucuuaacaacguuaucaagaacaaauaaaaagagaaguuggccccuuaaugaggcaaucauggccguugggaugguuaguauacuugcgagcagcuuauugaaaaacgauaucccuaugaccgguccauuaguagcaggaggccucuuaacaguauguuacgucuuaacaggacgaucggccgaucucgaguuggagcgagcgacagauguaaaaugggaggaucaagcagaaaucucuggaaguucaccaauuuugucaaucacaauaagcgaggacgguucuaugucaaucaaaaacgaagaagaagaacaaacccuuaccauuuuaauaaggaccggacuauugguaaucucaggacuuuuucccguaucuauucccauaacugccgcagcuugguauuugugggaggucaagaaacagagagcaggaguucuuugggacguaccgaguccuccaccaaugggaaaagcagaacuugaagauggggcuuauaggauuaaacaaaaggguauuuuaggcuauagccagauaggagcgggaguuuauaaagaaggcacguuucauacaauguggcacgugacuagaggugcugugcuuaugcauaaagguaagagaauagaacccucgugggcugaugucaagaaagaccugauuagcuauggagguggauggaaguuagaaggagaauggaaagagggagaggaagugcaaguucuagccuuggaaccuggcaagaauccgcgcgccguacaaacuaaaccgggucuuuuuaaaacuaauacggggacaauuggcgcaguaaguuuagacuuuagcccaggaacgagugggucaccaaucauugacaagaaaggaaaaguuguaggacuguacgguaaugguguugugacaagauccggagcuuacguuagcgccauagcacaaacagaaaaaucuaucgaggauaacccagaaauagaagaugauaucuuuaggaagaggcgacuuacuauaauggaccuucacccaggugcugguaaaacaaaacgcuaucuacccgcaauuguaagggaagcuauaaaacgaggacuucgaacuuuaauauuagcgccaacccgcguugucgccgccgaaauggaggaagcucuaaggggauuaccuauucguuaucaaacaccagcaauaagggcagaacacacggggcgagaaaucguagacuuaaugugucacgcaacguucacuaugcgauuacucucaccgguacguguaccaaacuauaauuugauuauuauggaugaggcacauuuuaccgauccagcaaguauugcggcgcgagguuauaucucaacaagaguagaaaugggugaagcagcaggcauuuucaugacugcgacaccuccaggcaguagagacccguucccucaaagcaacgcgccgaucaucgaugaggaaagggagaucccagaaagaucauggaacaguggucaugagugggucacugauuucaaaggcaagacagucugguucguuccuucgauuaaggcagggaacgauauugcagcaugucucagaaagaauggcaagaaagucauacagcucuccaggaaaacauuugauagcgaguacgucaagacgagaacaaacgauugggacuucguaguaacuacugacauuuccgaaaugggagcaaacuucaaagcugagagagucauagaccccagaagauguaugaaacccguaauacuaacugauggagaagaacgagugauauuagcuggaccaaugccaguaacucauuucucagcagcgcaaaggagaggaagaauuggaagaaaucccaaaaaugagaacgaucaauauauauacaugggugagccacuugaaaaugaugaagauugugcacauuggaaagaagccaagauguuacucgauaauaucaacacccccgagggaauaauacccucaauguucgaaccagaacgugaaaaaguagacgcaauagauggcgaauauagguugagaggagaagcacgaaaaaccuuuguagacuuaaugagaaggggugaucucccgguauggcuggcguauaaagucgcagcagaggggauaaauuacgcugauaggaggugguguuuugaugguauuaaaaauaaucaaauacucgaagaaaacguagaaguagagauauggacaaaagaaggcgaaaggaagaaacuuaaaccuaggugguuagacgcacgaaucuauagcgacccucuugcauuaaaagaauuuaaagaguuugcggcggggaggaaaagccuagcucuaaacuuaaucacggaaaugggcaggcuucccacguuuaugacccagaaaacucgagacgcuuuggacaaucuggcuguuuuacauacagcagaagcgggagggcgcgcauauaaucaugcauuaagugaacuaccggaaacccuagaaaccuuacuccuguuaacacuacuagcaaccgugacuggugguauauuucuguuuuuaauguccggccgaggcauaggcaaaaugacauugggcauguguugcauaauuaccgcaagcauccuauuaugguacgcacaaauacaaccccauuggauagcugcauccauaauacucguauucuuucuaaucguacuauugauaccugaacccgaaaaacagagaacuccucaagacaaucaauuaacauacguaguuaucgccauauuaacaguggucgcugcgacaauggcgaacgagaugggguuuuuggagaaaaccaagaaagaucuugguuuuggcagcauugccacacaacaaccugagucuaacauacuggauaucgaccuacgaccagcgucagcauggacacucuacgcgguagcaacgacguucguaacaccaaugcuaagacauucgauagaaaauucuucaguuaauguauccuugaccgcgauagcaaaucaagcgaccguauuaauggguuuaggaaagggauggccucuuucgaaaauggauauaggaguuccucuuuuggcaaucggauguuacucccaagugaacccaaucacucucacagcugcuuuauuacuauuaguagcacacuaugcuaucaucggaccaggacuacaagcgaaagcuacucgggaggcucagaaaagagcagcugccggcauuaugaaaaauccuacuguugacggaauaacgguaauugaucuggauccuauaccuuacgauccaaaauucgagaagcaauuaggacagguuauguuguuaguacugugugugacccaggugcuaaugaugcgaacuacuugggcucucugugaggcauugacuuuagcaacuggaccaauaucaacgcuuugggaaggcaacccugggagauucuggaauacuacuauugcugugucuauggcuaauauuuucagaggaucauaccucgccggagccggauugcucuuuucaaucaugaaaaauacaacuaauacaagacgcggaacaggcaacauugguaaaacacucggggagaaauggaagucacgucucaacgcgcugggaaaaaucgaauuucagauauacaagaaaagcggcauucaagaagucgaccgaacuuuggcaaaagaaggaaucaagaggggagaaaccgaucaucacgcggucucuagagguucagcaaaauuaagaugguucguagaacgaaauauggucacaccagaaggaaaaguuguggaucucggguguggcagagguggauggaguuacuauuguggaggacuaaagaacguacgagaaguaaaaggauuaacaaaagguggcccugggcaugaagaacccaucccuaugucaacauauggauggaaucuaguaagacuacaaucaggcguagacguuuucuuuauucccccggagaaaugcgauacucuauuaugugacauaggcgaaucaagcccgaaucccacaguggaagcuggaaggaccuugagaguuuuaaaucuuguugaaaauugguuaaauaauaacacucaauucugcauaaaagucuugaacccguauaugccaagcguaauagagaaaauggaagcccuacagagaaaguauggaggcgccuuagugagaaauccacuaaguaggaauaguacccaugaaauguauuggguaucaaacgcauccggaaacaucgugaguucgguaaacaugauaucacguauguuaauaaauagguuuacaaugcgacacaagaaagccacguaugagccugacgucgaucuaggaagugguacacgcaauauaggcauagaaucagaaauaccaaauuuggacauuaucggaaaaagaauagagaaaauaaagcaggaacaugaaacaucauggcauuaugaccaggaucacccuuauaaaacuugggccuaccacggaucuuacgaaacuaaacaaacaggaucagcaucuucuauggucaacgggguuguaaggcuuuugaccaaacccugggacguauuaccaacaguuacacaaauggccaugaccgauacaacuccauucggacaacaaaggguauucaaagaaaaaguggauaccagaacacaggaacccaaggaagguacaaagaaacuuaugaaaauaacagcagaauggcuuuggaaggaacucggcaagaagaaaacaccaagaaugugcacaagggaagaguucacaagaaaagugcggaguaaugcagcacugggugcaauauuuacagaugaaaauaaauggaaguccgcgagagaagcaguggaagacuccagauucugggagcuaguggacaaagaaagaaauuuacaucuagaggggaaaugcgagacauguguguauaauaugaugggcaaaagagaaaagaaacuaggagaguucggaaaagcuaaagguaguagggcaaucugguacauguggcuaggagcucgauucuuggaauuugaagcgcuaggcuuucucaaugaagaucauugguuuagcagggaaaauucacuuucaggagucgagggugaaggauuacauaaacuggguuauauuuuacgugauguguccaagaaagaaggcggugcuauguacgccgacgacacugccggaugggauacacgcauaacacuagaagauuugaaaaaugaggaaaugguaacuaaucauauggaaggcgaacacaagaaacuagcggaagcaauauuuaaauuaacuuaucagaauaaaguagugcgugugcaacgucccacacccagaggaacaguaauggauaucauaucaagaagagaucaaagaggaucaggacaaguugggacauacggacuaaauacuuuuacaaacauggaagcgcaauuaauuagacaaauggaaggugaggggguuuucaagaauauucaacaccuaacagcuaccgaagaaauugcaguacaaaacuggcuggcacgaguuggaagggaaagauuaucaagaauggccauuucaggagacgacuguguggucaagccauuagaugaucgauuugcgucagcucuaacugcucugaaugauauggguaaaauuagaaaagauauacagcaaugggaaccuucccgcggauggaacgacuggacacaaguuccguucugcagucaucauuuccacgaguugauuaugaaggauggcagaguauuagucguaccuuguagaaaucaagaugaacugauaggcagagcgcggauuagucaaggagcgggauggaguuugcgcgagaccgcauguuuaggaaaaaguuaugcacaaauguggagccuaauguacuuccacagacgagaucuuagguuggccgccaacgcaauuuguagcgcgguaccaucucacuggguaccuaccucucgaacaacguggagcauucaugcaaaacaugaauggaugacgacagaggauauguuaaccguauggaauagaguauggauacaagaaaacccauggauggaagacaaaacaccaguugaaucaugggaagagauaccuuacuuaggcaagcgggaggaccaaugguguggcagcuugaucgguuuaacuuccagagcaaccugggcgaaaaauauucaggcggcaauaaaucaaguaagaucauuaauuggaaaugaagaauauacagauuauaugccuuccaugaaacgguuucggagagaagaagaagaggcaggaguguuaugguaa

SEQ ID NO: 22982 - RNA, 9873 nt, Artificial Sequence
  derived and/or modified CDS sequence (opt6) from DENV-3__AB189125__SS-prME
acaucuuuaugcuuaaugaugauguuaccugcaacucucgcauuucauuugacaucacgggauggugaaccaagaaugaucguggguaaaaaugaaagaggaaaaucuuuguuauucaaaacagcaagugggauuaacaugugcacauuaauugcaauggaucuaggugaaaugugcgaugauacagucacguauaaauguccuuuaauaaccgaaguagaaccagaagacauagacugcugguguaaccugacguccacuugggugacauauggcacaugcaaucaagccggugaacaccgccgggauaaaaggucgguggcuuuggcaccgcacguugggauggggcuugauacaagagcacaaaccuggaugucggcggaaggggcuuggagacaaguggaaaaaguagaaacgugggccuucaggcacccgggcuucaccauacuagcuuuguuuuuagcgcauuauauuggaaccagcuuaacgcagaaaguuguuauuuucaucuugcucaugcucgugacaccuucaaugacgaugcgcuguguagggguaggcaacagagacuuugucgaaggcuuauccggagccaccuggguugaugugguauuagaacauggaggguguguaacaacaauggcuaaaaauaaaccaacccuugauaucgaauugcagaaaacugaagcaacucaauuagcaacucugcgaaaacuuugcauagaagggaaaauaacuaacguaacgacagacucuagauguccaacucaaggagaagcaaucuuaccagaggaacaagaucaaaacuacguuuguaaacauaccuacguggaucgugguuggggaaacggguguggacucuucggcaagggaagucuaguaaccugugcaaaauuucaguguuuagagcuaauagaagguaaagucguacaacacgaaaauuugaaauauacuguaauaauuacaguacacacaggugaucagcaccagguaggcaacgagacgcagggaguuacagccgaaauaaccccacaagccucaacugucgaagcaauacuaccggaguaugguacacuaggauuggaauguucaccaaggacaggccuagacuuuaacgaaaugauuuugcuaacuaugaaaaacaaagcauggaugguccacaggcagugguuuuucgauuuaccacucccuuggacuuccggcgcuacuacugaaacuccgacauggaauaagaaagaacuucuaguuacuuucaaaaaugcucaugcaaagaaacaagaaguagugguacuagguagccaggaaggugcuaugcacaccgcacucacaggagcaacggagauacaaacaaguggcggcacaaguaucuuugccggacauuugaaaugucgacugaaaauggauaaacuugaguugaaaggcaugucauacgcaauguguucgaaugcauuuguguuaaagaaagaaguaucagaaacacaacacggcacgauacuuauuaaagucgaguauaaaggagaagacgccccauguaagauuccuuuuaguacugaggacggucaagggaaagcccacaauggcagguugaucacagcaaauccaguaguaaccaagaaagaagaacccguaaacauagaagcugaaccaccguucggggagaguaauauuaucauagguauaggggauaaagcgcuuaaaauuaacugguacaaaaagggcagcaguauagguaagauguucgaggccaccgcgcguggagcgcgaagaauggccauauuaggagauacagcaugggauuuugguucgguaggaggggucuugaacucacuuggaaagaugguucaucaaauauucggaucagcuuacacugcgcuauuuucgggcgugucauggaucaugaaaauagggauagggguacuccuaacauggauaggguuaaacaguaaaaacaccucgaugagcuuuucguguauagugauagggauuauaacucuuuacuuaggugcgguaguacaagcugacaugggaugcgucauaaauuggaaaggaaaggaguuaaaaugcggauccggaaucuucgucacuaaugaaguccauaccuggacagagcaguauaaguuccaagcagauuccccaaagagauuagcuacagcaauagcaggggcaugggaaaauggaguuugugguauacguaguacaacgagaauggaaaacuuacucuggaaacaaauugcaaacgaacuuaacuacauauugugggaaaauaacauaaaguuaacgguuguuguaggggauauaauugguauuuuagaacaggggaaaaggaccuugacuccgcagccuauggaacuaaaauacucguggaaaaccuggggaaaagcaaagauaguaacagcugaaauucaaaauucaucuuuuauaauugauggcccaaauacgccggaauguccaaacgccucgcgagcauggaacguaugggagguugaggauuauggauuugggguauucacaacuaacauuuggcuaaaauuacgagaaauguauacacaacuaugcgaccaucgccuaaugagugccgcaguaaaagaugagagggcaguacacgcagacaugggauacuggauagagagccaaaagaacggaucauggaagcucgaaaaagcaucacucauagaaguuaaaacgugcaccuggccaaaaagccacacauuauggaguaauggaguauuagaaagcgauaugauaauaccgaaaagucuagcagggcccaucucacaacacaauuauaggccaggcuaccauacucaaaccgcaggaccauggcauuuggggaaauuggaguuagacuuuaauuauugugaaggcacuacaguuguuauaacagaaaauugugguacgcgaggucccaguuuaagaacuacaacagucagugguaaauuaauacacgaauggugcuguaggucauguacacuaccgccauugagauauaugggugaagacggaugcugguacgguauggaaaucagaccuauaaaugaaaaagaggaaaauaugguaaaaucccuaguaucugccgguuccggaaaaguggauaacuuuacgauggggguacuuugccuagcuauauuauuugaagaagucaugagaggcaaauucgggaagaagcacaugaucgcaggcguccuguucacauuuguauuauuauuaucuggucagaucacauggcgggauauggcgcgcaccuugauaaugaucggaagcaacgccucagaucgaauggguaugggagucacauaucuggcauuaauagcgaccuucaagauucaaccauucuuagcucucggguucuuccucagaaaguuaacaucgagagaaaaucuucuauuagggguaggcuuagcaauggcuacaacucugcaguuacccgaggauauagaacaaauggccaacgggauugccuugggauuaauggcucuaaaacuaauaacacaauuugaaacauaccaauuguggacagccuugguuaguuuaauguguaguaauacaaucuucacccuaacaguggcuuggcgaacagcaacucuaauuuuagcuggaaucucauuacucccagucugucagucuaguucuaugagaaagacugacugguuaccgaugaccguugcugcaauggguguacccccauuaccucucuuuauauuuucacuaaaagacacacucaaacggaggucauggccccuaaacgaagguguuauggccguagguuuagugagcauucuagcuuccucauuguuacgcaacgauguaccaauggcaggaccacuuguagcugguggacuacuuauugcaugcuauguaauuacugguacuucugccgauuugacaguggaaaaagcugcggaugugacgugggaggaggaagcugaacaaaccgggguaagucacaaucuuaugaucacaguagaugaugaugguaccaugagaauaaaggacgacgaaacugaaaauauccugacagugcuuuuaaaaacagcgcucuuaauuguuagcggaauauucccuuauucaauacccgcaacgcuuuuaguauggcauacguggcaaaaacagacacaacguaguggagugcuaugggacguucccagcccaccagaaacucagaaagcugaacuagaagaaggaguuuaucgcaucaagcagcaaggaauuuuugguaagacacaaguugguguaggaguucaaaaagagggaguguuucauaccauguggcauguaacuagaggagcuguccucacauauaacggaaagcgacuugaaccaagcugggcaucagucaagaaagaucucauuaguuauggcggaggauggcgucuuuccgcgcaguggcaaaaaggugaagaaguucaagugauugcgguagaaccuggcaaaaaucccaaaaauuuccaaacaaugccaggaauauuccaaaccacaacgggcgaaaucggagccauugcccuagacuucaaaccaggaacaaguggaaguccuauaauuaacagagaaggcaaaguagucggacuguauggaaaugggguugucaccaagaacgguggcuauguaucaggaauugcacaaacuaaugcugaacccgauggucccacaccagaauuggaagaagaaauguuuaagaaacguaaccugacgauaauggaucuccauccagggucugguaaaaccaggaaauauuuaccagccauuguaagagaagcuaucaaaaggcgccugagaacucuuauucucgcaccaacgagaguuguugcugccgaaauggaggaggcguuaaaagggcucccuauaagauaccagacaacagcaacgaaaagcgaacacaccggcaaggaaauaguagauuugaugugccaugcgacauucacaaugcgucuacucucgccggugcgaguaccgaacuauaaccugaucauaauggaugaagcgcauuuuacagacccagcgaguauagcggcgcguggauacauaaguacuagggucggaaugggagaagcugccgcuaucuuuaugacugccacaccucccgggacagcagacgcauuuccucaaaguaacgcaccuauacaagacgaggagagagauauuccagaacguagcuggaacucugguaacgauuggauaacugauuucgccgguaaaacugugugguucgugccaucaauaaaggcagggaacgauauagcaaacugccuaaggaaaaauggcaagaaaguaauccaauugucacggaaaacauuugauacugaauaucagaagaccaaacuuaacgauugggauuucguugucacaacugauaucucugagaugggggcgaacuuuaaagcggauagagugauagacccacgccguugcuuaaagccaguaauauuaaccgauggcccggaacgggucauauuagcuggaccaaugcccgucacaguagcaagugcugcucagagacgcggaaggguuggacgcaauccacaaaaagagaacgaucaguacauuuucacaggccaaccacuuaacaaugaugaagaccaugcacauuggacggaggcaaaaaugcuucuugauaauauaaauacacccgaaggcaucauacccgcacuguuugaaccagaaagagagaaaagcgcagccauugauggugaauauaggcucaaaggagaaucgagaaaaacauuuguugaacuaaugagaagaggcgauuuaccagucuggcuagcacacaaaguggcguccgaaggaaucaaauauacagacagaaaaugguguuucgauggggaaagaaacaaccaaauacuagaggaaaauguagauguggaaaucuggacuaaagaaggcgagaagaagaaacugcguccaagauggcuagacgcccgcacuuacagugacccguuagcgcucaaagaauuuaaagauuucgcagccggccguaaauccauagcuuuagaucugguuacggaaauaggacgcgucccuucccauuuagcacacagaaccagaaaugcacuugacaaucuugugaugcuacauacaucugaacauggggguagagcuuaccgacaugcaguugaagaacugccugaaaccauggagacucuacuucuuuuaggcuuaaugaucuuacuaaccggcggaguaaugcuauuccugauaaguggaaaaggaguaggaaagacaucaauaggacugauauguguaguggcaaguucugguauguuguggauggcagauauaccauuacaauggauagcuucggcgauuguguuggaguucuuuaugaugguucuguuaauaccggaacccgaaaagcagcgaacuccacaagacaaccaauuagcuuacguggugauugggauucucacacuggcagcuauuguagcagcaaacgaaaugggauuauuagagaccacaaaaagggaucugggaaugucgaaagaaccugggguuguaucacccacgucauaccuagauguagaucuccauccugcaucugcguggacucucuaugcuguggcaacuacagugauuacacccaugcuacggcacacaauagaaaauucaacggcaaaugucucacuagcggcgauugcgaaccaagccgucguucuaaugggacuagacaaaggguggccaauaucaaagauggaccuaggagucccuuuacuugcacucgguugcuauucacagguaaacccauugacauugacugcugcgguauuacuucuaguaacacacuaugcuauaauaggaccggggcuacaagcaaaagcaacaagagaagcucagaaaagaacagcagcaggaauuaugaaaaaucccacagucgauggcauaaugacaauagaucucgacccuguaauuuacgauaguaaauuugagaaacaauuaggacaggugaugcuauuaguauuaugcgcuguacaacuacuucuaaugcguacuuccugggcguucugcgaagcacuuacucuagcaacugggccaauuacuacuuugugggaagggaguccugguaaguucuggaauacaacgauagcggugaguauggcuaauauuuucagggguucguacuuagcuggagccggguuagcauucucgauaaugaaaagugucgguacaggaaagcgagguacugguagucaaggcgaaacucuaggugaaaaauggaaaaagaaacuuaaucaguuaaguagaaaagaguucgaucuauauaagaaauccgguauaacagaaguugacagaacagaggcaaaagaagguuuaaaacgaggcgagaucacacaccaugcggucagucgcggaucugcaaaauuacagugguucguagaaagaaacaugguaauccccgagggaagaguaauugaccucgguugcggacgaggugggugguccuacuauugugcgggacuaaagaaaguaacugaagugagaggauauacuaaaggagggccaggucacgaagaaccaguucccauguccacauauggauggaacauaguuaaacuuaugaguggcaaagauguguucuaucuaccgccugagaaaugcgacacauuauugugcgauauaggagaaucgagucccaguccaacuguagaggaaucacggacgauuagggucuugaaaaugguagagccauggcuuaaaaacaaccaguuuugcauuaaaguauugaacccguauaugcccgcuguuauagaacaucuagaacgacuacaaagaaaacacggagguauguuaguaagaaacccccugucucgaaauagcacacaugaaauguacuggauuucaaaugguacagggaacauaguaaguaguguuaauaugguaucaagacugcuacuaaacagauuuacuaugacuuaccgaagacccacgauagaaaaagauguagacuugggcgcuggaacaagacauguaaacgcagagccagaaaccccuaacauggacguaauaggagaaagaauaagacggauaaaagaggagcacucaagcacuuggcacuacgaugacgagaauccauacaagacgugggcuuaccacggaaguuaugaaguaaaagccacuggaagugccucaucaaugauuaacggagucgucaaacuauuaacgaaaccaugggauguuguacccacgguuacgcaaauggcuaugacggacacuacuccuuucgggcaacagcgaguauucaaggaaaagguagauacgagaacaccaaaaccaaugccuggaacgcgaaaaguaauggagaucaccgcggaguggcuauggcgcacacuggguagaaacaagaggccaagacuuugcacacgugaagaguucaccaagaaagugagaacaaacgcugcuaugggugccguuuuuacugaggaaaaccaaugggacuccgcucgugcagcagucgaagacgaggaauuuuggaaauugguagaucgcgaaagagaauugcauaaacuuggaaagugcggaaguugcgucuacaauaugaugggaaaaagggagaagaaacuaggugaguuugguaaggcaaaaggaucacgagcaaucugguacaugugguugggugcuagguaucuagaguuugaagcccuaggauuuuuaaaugaagaccauugguuuucaagagaaaauuccuauuccggugucgaaggagaaggucuacacaaauuaggauacauacucagagauauaucaaaaauaccugggggagcgauguacgcagacgacacagcgggaugggauacucgaauaacagaagaugaucuccacaacgaggagaagauaacacaacaaauggauccagaacaucgucaacuggcaaaugcgaucuucaaauuaacauaccaaaauaagguagucaaaguccaaagacccacacccaagggcacagucauggacauaauaucccgcaaagaucagcgagggucagggcaagucgguacauacggacugaacacuuuuacaaauauggaagcccaacugauaaggcaaauggagggcgaagguguauuaucaaagacggacuuggaaaacccucacuuauuagagaagaaaaucacccaauggcuagaaacaaaaggaguugaacgucuuaagagaauggcaaucucuggugaugacugcguaguaaaaccaauugacgauagauucgccaacgcccuucuugcacuuaacgauauggggaaaguacgaaaagauauuccacaauggcaaccaagcaaaggauggcaugacuggcagcaaguuccuuuuuguucacaucacuuucaugaauuaauaaugaaagauggucgaaaguuaguaguaccauguagaagccaagaugaauugaucgggagagcgcguaucagucaaggugcgggcuggucucuaaaggagacagcaugucucgguaaagcauacgcacaaaugugggcauuaauguacuuccacagaagagauuugagauuagccuccaacgcgauauguucagcggucccuguacauuggguaccuacaucucgaacgacuuggagcauucacgcacaccaccaauggaugaccacagaagacauguuaaccguauggaaucgaguuuggauagaggacaauccuuggauggaggacaaaacgccggugacuacuugggaggauguuccauaucucgggaaaagggaagaucagugguguggcaguuuaauagguuuaaccagucgcgcgaccugggcgcagaacauuuuaacagccauacagcaaguacguucguuaauaggaaaugaggaguuccuugauuauaugcccucuaugaaaagguuuagaaaggaagaagaaagugaaggugcaauuugguaa

SEQ ID NO: 22983 - RNA, 9873 nt, Artificial Sequence
  derived and/or modified CDS sequence (opt6) from DENV-3__AB189126__SS-prME
acuagccucuguuuaaugaugauguuaccugcaacucuugcguuucauuuaacaaguagagauggagaaccuagaaugauaguagguaaaaacgaaagaggaaaauccuuacuguuuaaaacagcaucaggcauaaacaugugcacuuugauagcgauggaucugggagaaaugugugaugauacagugacauauaaaugcccccucauaacggaagucgaacccgaagauauugauugcuggugcaauuuaacaucaacauggguaacauacggaacuugcaaucaagccggggaacacagacgagauaaaagaagcguugcauuagcaccgcacguugguaugggauuagacacacgugcgcaaacauggaugucggcggaaggagcuuggcgucaaguagaaaaaguugaaacuugggcauuucgucauccgggauucaccauacuugcgcuguucuuagcacauuauauugguaccagucuaacucaaaaaguaguuauauuuauucuuuugaugcuaguaacaccguccaugacgaugagguguguagguguugguaacagagauuuuguagaaggauugucuggagcaaccuggguugaugugguguuggaacacgggggaugcguaacuaccauggccaaaaacaaaccgacccuagauaucgagcuacagaaaacugaagccacgcaacuagcaacgcuccggaaauuauguaucgaaggaaaaauuacaaauguaacgaccgauucucgcuguccaacacaaggugaagccauacuaccggaagaacaagaccaaaacuauguguguaaacauacauauguagauaggggcuggggaaauggcugcggguuguucgggaaaggaucguuggugacgugugccaaauuccaauguuuagaguuaauagaggggaaaguaguacaacacgagaauuugaaauauacuguaaucauaacaguacacacaggagaucagcaucaaguugggaacgaaacacaaggcgugacugcagagauaacaccccaggcuagcacuguggaggcgauacuaccugaguacggcacucuuggccuagaguguucaccuagaacaggauuagacuucaaugaaaugauuuuguuaacaaugaaaaauaaagcauggaugguacauagacaaugguuuuucgaccuacccuuaccauggacaucaggggccacuacggagacaccaacguggaacaagaaggagcuacucguaacguucaaaaacgcccacgccaagaaacaagaagugguuguacuagguucucaagaaggagcaaugcauaccgcacuaaccggagccacugagauucaaacaagcggaggaaccaguauuuucgcuggacaucugaaaugcagguugaaaauggauaaacucgaacucaaaggaaugucauaugcaaugugcucaaaugcauuuguccuuaaaaaggaagugagcgaaacucaacacggaacuaucuuaauaaaagucgaauacaagggcgaagacgcaccauguaaaaucccauucucuacagaggacggacaggguaaagcacauaauggcagguuaaucacagcaaaucccguaguaacuaaaaaggaggaacccguaaauauagaagccgaaccaccguuuggugaaaguaauauaauuauuggcauuggagauaaagcacuaaaaauuaauugguauaaaaagggcuccaguauaggcaaaauguuugaggccacugcccggggugcgagaaggauggcgauccuaggagacacugcuugggauuuuggaagcguagguggaguucuaaauucacuagggaagaugguccaucaaauuuuuggaucggcauauaccgcucuauuuuccgggguuucuuggauaaugaagauaggcauugguguccuauugacuuggaucggguuaaauaguaaaaauacaucaaugucauucaguugcauuguaauaggaauuauaacacuuuauuuaggugccgugguacaagcagauaugggauguguaaucaacuggaagggaaaagaacuaaaauguggaucuggaauauucgucaccaacgagguucauacguggacagaacaguauaaauuccaagcggauucuccaaagcgcuuagcaacagcaauagccggagcaugggaaaauggggucugcgggauaaggaguacaacucgaauggaaaacuuacuuuggaagcaaauugccaaugaacucaacuauauacuaugggaaaacaacauaaaacuaacagugguggucggugacauaauuggaguuuuagaacaaggaaaacguacccuuacgccacaaccuauggagcugaaauauagcuggaaaacgugggguaaagcaaagguuguaacugccgaaauacaaaauagcuccuuuauuaucgauggaccaaauacuccagaaugucccaaugcaaguagggccuggaaugugugggaaguggaagacuacggguucggaguuuuuacuacuaauauauggcuuaaacuacgugaaauguauacucaacuaugugaucacagacuaaugagcgcugcaguaaaggaugagagagccguacacgcugauaugggauacuggauagagagucaaaagaauggaucuuggaaauuagaaaaggcuucauugauagaaguaaagacaugcacauggccuaagucacauacauuauggucaaauggaguacucgaaucugauaugauuauuccaaaaucauuggcagguccaauuucacagcacaauuaucgaccagguuaucauacucaaacagcagguccauggcaccuaggaaaauuagaacuagauuuuaacuauugcgaaggaacuacugugguaauaacugaaaacuguggaaccagaggacccucacuccguacaacgaccguaucagguaaacuuauccaugaaugguguugucgaucauguacacuaccgccucuccguuacaugggagaagacggaugcugguauggaauggaaauacggccuauaaaugaaaaagaagagaacaugguuaaaucuuuaguauccgcaggaucgggaaagguagacaacuucaccaugggcguuuuaugccuugcaauauuauuugaagagguaaugagagguaaauuugggaagaaacauaugauagcaggaauccuauuuauauuuguacuauuauugaguggacaaaucacguggagagauauggcaagaaccuuaauaaugauaggaucaaacgcuagcgacagaaugggaaugggcguuacauaucuugcacuaaucgcuacguuuaagauucaaccuuuucuagcucucgguuucuucuugaggaaauuaacaucacgagaaaauuuauuacuaggcguuggguuagcuauggcuacgacauuacaacucccggaagauaucgaacagauggcgaacggaauugcguugggacuuauggcgcuuaaauugauaacccaguuugaaacauaccaauuauggacugcacuugugagccucacaugcagcaacacaauuuuuacccuuacaguggcauggcgaacggcgaccuugauucuugcgggcauaaguuugcucccuguaugccaaaguucaucaaugaggaagacugauuggcuaccaaugacaguugcugcaaugggcguaccuccacucccguuauuuauauucucucuaaaggacacauuaaaaagacgaaguuggccauugaacgaaggaguaauggccguagggcuugucuccauauuagcauccucacuguuaagaaaugauguacccauggcaggaccauuaguggcaggcggauugcuaauagcauguuacguaaucacagguacuucagcagauuugaccguagaaaaggccgcggacgucaccugggaggaagaagcagagcaaacagguguuucccacaaccucaugauaaccguagaugacgauggaacuaugcgcauaaaagaugacgaaacugagaacauucuuacaguacuacuaaaaacagccuugcuaauagucaguggaauauuuccauacaguauaccagcuacucuauugguauggcacacuuggcaaaaacagacgcaaagaucuggaguacugugggauguaccaaguccaccagaaacucaaaaagcugagcuggaagaaggaguauaccggaucaagcaacaaggaauauucggcaaaacucaaguuggaguuggaguacaaaaagaagguguauuucacacuauguggcacguaacucgaggugccguacuuacauacaauggcaagcgacuagagcccaacugggccucggucaagaaagaucucaucucauauggagguggcuggcgacuuagcgcgcaguggcaaaaaggagaggaaguacaggucauagcaguagagccugggaagaaucccaaaaauuuucaaacgaugcccgguauuuuccaaacaacgacaggagagauaggagcgauugcccuagacuucaaaccuggaacaucuggaaguccaaucauaaacagagagggaaaaguggucggucuauaugguaauggcguaguaacuaaaaacggaggauacguaucuggaauagcucaaacuaaugcagagccagacggacccacgcccgaacuugaggaagagauguucaaaaagaggaaccucacaaucauggacuugcauccagguucugggaagacucguaaauauuuaccagcgauagugcgugaagccauuaaaagaagauugcgcacuuuaauauuagcuccaacacguguaguagcugccgaaauggaagaagcacuaaaaggguugccuauuagauaucaaacuacagcuacaaagagugaacacacugggaaagaaauagucgauuuaaugugucaugcaacauucacaaugcgccuauugucaccuguuagagucccaaauuauaauuuaaucauaauggacgaagcccacuuuacggauccagcgagcauagcugcaagaggauauaucucgacucguguagguaugggugaagcugcugcuauauucaugacugcaacuccuccugguacagcugacgcuuuuccacaaucaaaugcaccaauacaagacgaggagcgggauauuccagagaggagcuggaauagcggaaacgacuggauaacagauuuugcggggaaaacuguuugguuuguuccauccauaaaagcuggaaacgauauagcaaacugccucaggaaaaacggaaagaaagugauacaguuaaguaggaaaacauucgauacagaauaucagaaaacgaaacuaaaugacugggauuucguuguaacaacagacauuucugaaaugggagccaacuuuaaagcagaucggguaauugauccuagaagaugccuaaagccuguuauucucacugauggccccgaaagaguuauacuggcagguccuaugccagugaccguugcgucagcagcacaacgacggggccguguugggcguaauccacagaaagagaacgaccaauacauauuuacgggacaaccucuuaauaacgaugaggaucaugcccauuggacagaagcaaaaaugcuuuuagauaauauaaauaccccagaggggauaauuccagcacuauuugagccagaacgugaaaaaucagcugccauugauggagaauacagauuaaaaggggaaaguaggaaaaccuuugucgaacuuaugcggcgcggugacuuaccaguauggcucgcccauaaaguugcgagugaagggauaaaauacacugaucggaaauggugcuuugacggggaacguaacaaucaaauucucgaagaaaauauggauguugagauuuggacgaaagaaggagaaaagaagaaacuucgaccaagaugguuagacgcucguacuuauagugacccgcuugccuugaaagaguuuaaagacuuugcugcugguagaaaaucuauagcacuggaccuggucacagagauuggaagagugcccagccaccucgcucauaggaccagaaaugcuuuagacaauuuaguaaugcuucauacaagugaacaugguggccgcgcuuaucgccaugcuguugaagaacuaccugaaacaauggagacucuuuuauuguugggucuaaugauauuauugacaggaggagccauguuauucuugauuagcggaaaaggugucgguaaaacuagcauugguuugauaugugucguagcuagcuccggaaugcuauggauggcagacauacccuuacaauggaucgcaagugcuaucguccuugaguucuuuaugaugguauuacuaauaccugaacccgaaaaacaaagaacaccucaagauaaucaguuagcauauguuguaauaggcauauuaacuuuagcagcaauugucgcagccaaugagauggggcuauuagaaacuacaaaaagagauuuggguaugagcaaagagcccggggugguaccacccacgaguuauuuggauguugaucuucacccagccagcgcauggacauuauacgcugucgcaacgacagugauuaccccaaugcuccggcauacuaucgaaaauucaacugcaaauguaagccuugcggccauagcaaaccaagcuguaguauugaugggacuugauaaaggauggccuauaagcaaaauggaccuagggguaccacuuuuggcgcuuggcugcuauucacaaguuaacccuuuaacauuaacugcggcaguccugcuguugguaacacauuacgccauaaucggacccggacuccaagcaaaagcgacaagagaggcacagaaaagaaccgcugcagggauaaugaaaaauccaacaguugacgggauuaugacaauagauuuggaccccguaauuuaugauaguaaguucgagaaacaguugggccaaguaaugcuauuaguucucugcgcaguacaacucuugcucaugcgaacaucuugggcauucugcgaggcacugacccuugcgacugguccgaucacuacucugugggagggcucgccugguaaguuuuggaauaccaccauagccgucucaauggcgaauauuuuccggggaucauaucuugcaggagccggucuagcauuuucaaucaugaaaaguguugguacuggaaagagagggacuggcagccaaggugagacacucggcgaaaaguggaagaagaaacuuaaucaacuaucuagaaaagaauuugaucuuuauaagaaaucagggaucacggaaguugauagaacugaagccaaagaaggacuaaaacgaggcgagaucacccaucacgcgguuucacgagguucagcaaaacuacagugguuuguugaacgcaacaugguaaucccugaaggacgcgucauugaccuaggaugcggucgcgguggguggaguuacuauugcgcagggcuaaagaaaguuacagagguccguggauauaccaaagggggaccuggacaugaagaaccgguaccuaugucgacauacggauggaauauaguuaaacuaaugaguggaaaagacguauuuuaucuaccaccggaaaaaugugauacucuauugugcgauauuggcgaaucaagucccucgccgaccguagaagaaucgagaacgauaagaguucuaaaaaugguagaaccaugguugaagaacaaucaguuuugcaucaagguuuugaauccuuauaugccuaccguaauugagcaccuagaacgucuacaaagaaaacacgguggcaugcuagucaggaacccguuaucaagaaacuccacacaugagauguacuggaucagcaaugggacuggaaauauaguaagcaguguaaauaugguuucucggcuuuuguuaaaccgauuuaccaugacacacaggagaccaacaauagaaaaagauguggaccucggugcgggaacccgucaugucaacgcugagccagaaacucccaacauggauguuauaggagagagaauccgccguauaaaagaagaacacagcuccacauggcacuaugaugaugaaaacccauacaaaacaugggcauaccauggaaguuaugaagugaaggcgacagguucagcuucuucaaugauaaacggagugguaaaacucuuaacuaaaccaugggauguugucccaacaguaacucaaauggcaaugacggauacuacaccguuuggacagcagagaguauucaaagaaaaaguagauaccaggacuccuaaaccgaugccgggcacacggaaaguaauggaaauaacagcugaguggcucuggaggaccuuaggaaggaacaaacguccacgauuaugcacacgagaagaauuuaccaagaagguaagaacaaaugcagcaaugggagcaguauuuacugaagaaaaucaaugggauucagcgagggccgcaguugaagaugaagaauuuuggaaauuggucgauagagaacgagaguuacauaaacuaggaaaauguggaagcugcgucuauaacaugaugggaaaaagagaaaagaaauugggagaauuugggaaagcuaagggcaguagggcgaucugguauaugugguugggugcaagauaucuagaauuugaagccuuggguuuucuuaacgaagaucauugguuuucaagagaaaacuccuauucaggaguagaaggagaaggauuacauaaauuaggauacauacuaagagauauuucuaaaauuccagggggagcaauguaugcggaugauacagcgggaugggauaccagaauuacugaagaugauuuacacaacgaggagaaaauaacacaacaaauggacccggaacauaggcaguuggcaaaugcaauauucaaacuaacauaccaaaauaaaguugucaaaguacaaaggccaacuccuaaaggaacagugauggauauaaucagucguaaagaccagcguggaaguggccaagugggcaccuacgggcuaaauacuuucacaaauauggaagcccaauuaauacgacaaauggaaggcgaaggagugcuaucaaaaacagaccuagaaaacccgcaucugcuggagaagaaaauuacucaguggcuggaaacgaaggguguggaacgauuaaagagaauggcaauaagcggagaugauugcguagugaagccaauugacgaccgguucgcaaaugcucuacuagcgcugaaugauaugggaaagguaagaaaagacauuccucaauggcagccgaguaaagguuggcaugauuggcagcaaguuccauuuugcagucaucacuuucacgaacuuauaaugaaggauggucguaaguuaguagucccauguagaccacaagaugaacuuaucggacgagcgcgaauaucucaaggcgcaggguggucacuaaaagagaccgcaugccugggaaaagcauaugcgcaaaugugggcccucauguacuuccaucgaagggacuuaagacuugcaucaaacgcuauaugcucagcggucccaguucacuggguaccaacuucucguacaacauggucaauacaugcccaucaucaauggaugacaacggaagacaugcuaaccguuuggaaccgugucuggauugaagauaauccauggauggaggauaaaacuccaguuacaacaugggaggauguuccauaucucggaaagcgggaggaucaauggugugggagcuugaucggguuaacuucuagagcaaccugggcucaaaauauccuaacugcaauacaacagguucguucacugauaggcaaugaagaguuuuuagauuacaugccauccaugaaacguuuccgaaaagaagaagaauuggaaggagcaaucugguga

SEQ ID NO: 22984 - RNA, 9873 nt, Artificial Sequence
  derived and/or modified CDS sequence (opt6) from DENV-3__AB189127__SS-prME
acauccuuaugcuuaaugaugaugcuaccagcaacacuagcguuucaucuaacgucaagagacggagaaccccggaugauuguagggaaaaaugaacgcggaaaaaguuuacuauucaaaacagcaucaggcauuaauauguguacgcuaauugcaauggauuugggagaaaugugugacgauacaguaacauauaaaugcccuuugauaaccgaagucgaaccagaagacaucgauugcuggugcaauuugacaagcaccuggguaacauaugggaccuguaaucaagcaggagaacaucguagagauaaacgaaguguagcauuagcuccucauguagggaugggacuagauacuagagcucaaacauggauguccgccgaaggagccuggaggcaaguugaaaaaguagaaacaugggcuuuuaggcauccagguuucacuaucuuagcgcuauucuuggcacauuauauaggaacgucucuaacccaaaaagugguaauauuuauucuuuuaaugcucguuacuccaucaaugacuaugcgaugugucggaguugguaaucgagacuuuguagagggucugucgggugcaacauggguagacguaguuuuagaacauggcggcugugucacuacaauggcgaaaaauaaaccgaccuuggauauagaauuacagaaaacugaggccacccaauuagcaacacugaggaaacuuugcaucgaagguaaaauaacgaaugucacgacagacaguagaugcccgacacaaggggaggccauacuaccggaagaacaagaccaaaauuacguauguaaacacacauacguggaucgaggcuggggaaacggaugcggcuuauuuggaaaaggaagucuagugacuugcgcgaaauuucaaugucuagagcuuauugaagguaaaguuguucaacacgagaaccuaaaauauaccguaauaauaacggugcauacgggcgaccagcaucaaguaggaaacgagacacaaggugucacugcugagauuaccccucaagcgucgaccguugaagcaauccuaccagaauacggaaccuuaggucucgaauguaguccgcguacaggucuugauuuuaaugaaaugauacuucugacuaugaaaaauaaagcguggaugguucacaggcagugguucuuugauuuaccacuuccuuggacaaguggcgcuacaacagaaaccccuacuuggaauaagaaagaacuauuggugacguucaaaaaugcacacgccaagaaacaagaagucgucgucuuaggaagucaagaaggcgcaaugcacacagcacuuacaggagcaacggaaauacaaacaucaggagggaccaguauauuugcaggacaucuaaaaugucggcuuaaaauggauaaauuggaacuaaaaggaaugaguuacgcgaugugcucaaaugcauuuguacuaaagaaagaaguaucggaaacacaacacgggaccauuuuaauaaaaguugaauauaaaggagaagaugcuccuugcaaaaucccauuuucaacagaagauggucaaggaaaagcacauaaugggcguuuaauuacagcaaauccaguugugacuaaaaaggaggaaccaguaaauauagaagcagaaccaccuuucggugaaaguaacauaauaauuggaauuggcgacaaggcccuaaagauaaauugguauaagaaaggauccucgauaggaaagauguuugaggcgacagcucgaggugcuagacgaauggccauucuuggcgauacagcuugggauuuuggaagcgucggaggaguuuuaaauucauuagguaagauggugcaucaaauauucgggucagcauauacggcgcuauuuuccggagucucuuggaucaugaaaaucggaauuggagucuuacuuacuuggauaggauuaaacagcaaaaauacaaguaugucuuuuucauguauaguaauaggcauaauaaccuuauaccuuggcgcaguaguccaagcagacauggggugcguaauaaauuggaaagggaaagaauuaaaaugcgguaguggaauauuugucacuaaugaaguucauacguggacugaacaauacaaauuccaagcagacucgccuaaacgauuagcaacugcgauugccggugcaugggaaaauggagucugcggaauuagaaguacuacuagaauggagaaccugcucuggaaacaaauagcuaaugaacuuaacuauauucuaugggagaacaauauuaaacucacaguugucguaggcgauauuauugggguccuagagcaaggaaaaagaacucuaacgccacaaccuauggaacuaaaauacuccuggaagacuuggggaaaggcaaagguuguaacagcagagauacaaaauucaucguuuaucauagacgggccaaauaccccggaauguccaaacgcaucacgagcauggaacguaugggaaguagaagauuacggauucggaguauuuacuacaaacauaugguuaaaauuacgggagauguacacucaacuuugugaccaucgacucauguccgcugcuguaaaagacgagcgcgccauacaugcggauaugggcuauuggaucgaaagucagaaaaacgguaguuggaaauuagaaaaagccucacuuaucgagguaaagacuuguacuuggccaaagucacacacacuguggaguaacggaguucuggagucagacaugauuauuccaaaaucacuagcaggcccuauuagccaacacaauuacagaccgggauaucauacgcaaacggcaggaccuuggcaucuaggcaaacuggaacuugacuucaauuauugcgaggguaccacagucguaauaacagaaaacugcggcacaagaggaccuuccuuacguacgacaacuguaucuggaaaacugauacaugaauggugcuguaggucguguacacuaccaccauugagauauaugggagaggacgguuguugguacgguauggaaauuaggccuauuaacgaaaaagaggaaaauaugguaaagucuuuaguuagcgcagguaguggcaaaguagacaauuucaccaugggugucuuaugucucgcuauacuuuuugaggagguaaugcguggcaaauucgggaagaaacauaugauugccggaauuuuguuuauguuuguccuuuuacuaucaggacaaauuacuuggcgagauauggcucguacacuuauaaugauagguucaaaugcgagugauagaauggguaugggaguaacguaccuugcgcuuauagcaacauuuaaaauccaaccauuccuagcacugggauuuuuccuaaggaaacucaccagucgagagaaccuucuccuagggguaggucucgcuauggcaacaaccuuacaacugccagaagacaucgaacaaauggcuaaugguauugcgcucggacuuauggcguuaaaacuuaucacccaguuugaaacguaucaacucuggacggcccuaguaucccuaacgugcuccaauacaaucuucaccuuaacaguggcauggagaacugcgacuuugauauuagcaggaauaagucuauuaccggugugucaaucaucaucaaugcgaaagaccgacugguuaccaaugacaguagccgcaauggggguaccgccgcuucccuuguucaucuuuucccugaaagacacuuuaaaaagaagaucguggccccugaaugaaggaguuauggccguuggcuuaguaagcauuuuagcaucaaguuuauugagaaaugauguaccaauggcaggaccccuaguagcuggugggcuacucauagcauguuauguuaucacaggcacuucggcugaucuuacaguagaaaaagcugcugauguaacuugggaggaagaagcagagcagaccggugugucacauaaccucaugaucaccguagacgacgacggaacuaugagaauaaaggaugaugagaccgaaaacauuuuaacugucuugcuaaaaacggcgcuccucauugucucagggauauuucccuauucgauaccugcuacccuccuaguauggcacaccuggcaaaaacaaacucaaaggagugggguacucugggacguaccuucaccaccagaaacgcaaaaagcugaguuagaagaagguguguauagaauuaaacagcaagguauauuuggaaaaacgcaaguuggaguaggaguccaaaaagagggaguauuucauaccauguggcauguuacacgaggggcugucuugaccuauaacggaaagaggcuggaaccuucuugggcuagcgucaagaaggaccuaauaagcuacggugggggauggcgccuauccgcgcaauggcaaaagggagaagaaguccagguaauugcaguagaaccgggaaagaauccaaagaauuuucaaacgaugccuggaaucuuccaaaccaccacgggagaaauuggugccaucgcauuggacuuuaaaccuggaacgagugggucgcccauaauuaaccgggaggguaaaguagugggauuauaugguaaugguguaguaacuaagaacggagguuaugucucagguauagcccagacaaaugcugaaccggauggcccaacaccugagcuggaagaagaaauguuuaagaaacgaaacuuaacgaucauggacuugcauccgggaucagguaaaacuagaaaauauuugcccgccauaguaagggaagcaauaaaaagacguuuacggacgcuaauuuuggcgccaaccagggugguugcagcugaaauggaagaagccuuaaaaggucuaccaauccgguaucaaacuacagcuacaaaaucggaacauacugguaaagaaauuguugaccuaaugugucaugcaacguuuaccaugagacuacucucgcccguacguguuccgaauuacaaccucauuauaauggacgaagcacauuuuacagacccggcaucuauagcagcacgaggcuauauaagcacgcgagucggcaugggagaggccgcagcaauuuucaugaccgcaacuccaccagguacugcggaugcguucccucagaguaacgcuccuauacaagacgaggagagagauauaccggaaaggucuuggaauagcggaaaugacuggaucacugacuucgcagggaagacagugugguuuguuccaucgaucaaagcuggaaacgacaucgcuaauugccuuagaaagaacggcaagaaagugauacaauuaagccguaagacauuugauacugaauaucagaagaccaaauuaaaugacugggacuuuguaguaacaaccgauaucucugagaugggugcuaauuuuaaagcagauagagucauugauccaaggcggugucuuaaacccgucauucuaacagacggccccgaacgaguaauacuggcuggaccaaugccuguaacgguagcuucggcagcacaacguaggggacgaguuggacguaauccucaaaaagaaaaugaucaauauaucuucacuggucagcccuuaaauaaugacgaggaucaugcccacuggacagaagccaaaaugcuacuggauaacauaaacacaccggaaggcauuaucccugcucuauuugaaccugaaagagaaaaaucggcugcuauugacggggaguaucgcuuaaaaggagaaaguagaaagacguucguagaacuaaugcgaagaggagaucugccggucugguuagcacacaagguagcgagugaaggaauuaaauacacugacagaaaaugguguuuugauggggaacgaaauaaucagauacuagaagagaauauggauguagaaauauggaccaaagaaggagagaagaagaaauuaagaccaagauggcucgaugcgcgaacuuauucugauccguuagcauuaaaagaauuuaaagacuuugcagcaggaagaaaaucgauagcccuggaucuuguuacggaaaucgggagagucccuucacaucucgcgcaucgcaccaggaacgcacuagacaaucuaguuauguugcauacuuccgaacacggaggccgagcauauagacaugcugucgaagaacucccagaaacaauggagacauuacucuuacuaggauugaugauauugcuuacaggaggcgcgauguuauuccuuauuucugggaagggagucgguaagacaaguauaggucucauaugcguuguagcaucaucggguaugcucuggauggcggauaucccucuacaauggauagcaucugcuaucguccuugaguucuuuaugaugguccuucugauaccagaacccgagaaacaaagaacgccgcaagacaaccaguuggcguauguagugauaggcauucucacccuggcggcuauuguagcggcaaacgaaauggguuuacuagagacaacuaaaagagauuugggaaugucaaaggagccuggcgugguuccaccgacaucuuacuuagacguagacuuacauccggcaucagcuuggacucuguaugcggucgcuacuacaguuauaacuccgaugcuuaggcauacaauagaaaauagcacggcuaaugucucauuggcugccauagcgaaucaagcaguaguccuaauggggcuugauaaagguuggcccaucagcaaaauggaucuaggaguaccccuauuggcuuugggguguuauagucaagugaacccucugacacuaacugcagcaguuuuacuacugguaacacauuaugcaauuauagguccuggacuacaggcuaaagcuaccagggaagcucagaagagaacagcagcugguauaaugaaaaacccgacgguugaugguauuaugaccauagauuuagauccgguaauauaugauaguaaauucgaaaagcagcuaggucagguaaugcucuuaguacugugugccguccagcuacuauuaaugagaaccaguugggcuuuuugcgaagcauuaacucuggcuacaggaccuaucacaacauuaugggaagguucaccgggcaaauuuuggaauacuacgauugcagucaguauggcuaauauauuccgaggcucuuaucuagcgggagcaggacuagcguucuccauaaugaaaucaguuggaacuggaaaacguggcacagggucccaaggugagacuuuaggggaaaaauggaagaagaaacucaaccaacugagucguaaggaguucgacuuguauaagaaauccggaaucacagaaguggacagaacagaggcuaaagagggacuuaagcgaggugagauuacacaccaugcugugaguagaggaagcgcuaaauuacagugguucguggaaagaaauauggugauaccagaagggcgcguuauugauuuagguugcggacggggaggguggaguuauuacugugccgguuugaagaaaguaacggaaguuaggggauauacaaaaggagguccgggacaugaagaacccguaccaaugucaacguacggcuggaauauagugaaacuuaugucuggcaaagauguauuuuacuuaccaccagaaaaaugcgacacuuuauugugcgauaucggugaaucuucuccuucaccaaccguugaggagaguagaaccauucgaguacucaaaaugguggaacccuggcuuaaaaacaaucaguuuuguauaaaaguucuaaacccauacaugccaacuguaauagaacaccuagaaaggcuacagagaaaacauggcggaauguuaguuagaaacccuuugucgagaaacagcacgcacgaaauguauuggauaagcaacggcacuggaaauaucgugaguagugucaacauggugaguagacucuuacuaaauagauucacaaugacucauaggcguccuacaauagaaaaagauguggauuuaggagcgggaacaagacauguuaaugcagaaccagagacgccaaacauggacguaaucggagagagaauaaggcgaauaaaagaagaacacucaucuaccuggcauuacgacgaugaaaacccuuauaagaccugggcguaucauggcucauacgaaguaaaagcuacaggcagugcaucuagcaugauaaacggaguuguuaaacuacuaacuaaaccuugggauguaguuccaacaguuacucaaauggcaaugaccgauacuaccccauucggacaacaacggguauucaaagaaaagguggacacuagaacaccaaagcccaugccaggaacgagaaaaguuauggaaauaacagcugaaugguuauggcggacauugggccguaauaaaaggccgaggcuaugcacacgagaagaguucaccaagaaaguuagaacgaacgcagcuaugggcgcuguguuuacagaagaaaaucaaugggauagcgcacgugcugcuguagaagaugaagaauuuuggaaguuagucgauagagagcgagaacuacacaaacuaggaaagugugggucguguguuuauaacaugauggguaagagagaaaagaaauuaggcgaguucggcaaagcaaaggguagcagagcuauaugguauaugugguuaggugcucgauaucuagaauuugaagcucucggguucuuaaaugaggaucacugguuuaguagagaaaauucguauucugguguugaaggggaaggguuacacaaacuugguuauauucuaagagauauaucgaaaauaccagguggugcaauguacgcagaugauacagccggaugggauacgcgcauaacugaggaugauuuacacaacgaggagaaaaucacucaacagauggauccugaacaucgccagcucgccaaugccauauuuaaauugacauaucaaaauaaagucguaaaaguacagcgacccacaccuaaaggaaccguaauggacaucauuucaaggaaagaccaaagagggaguggacaggugggcacauacggucuaaauacguuuacaaauauggaagcacaacucauucgucagauggaaggagagggcgucuugaguaagacagaccuggaaaauccccauuuacuagagaagaaaaucacacaguggcuagagacuaaaggagucgaaaggcuaaaaaggauggcuauaucuggugacgauuguguuguuaaaccuauugaugaucguuucgcuaaugcucuccuagcauugaaugacauggguaaagugaggaaagacaucccucaguggcaaccaaguaaagguuggcaugauuggcaacaaguucccuucuguucacaccauuuccacgagcuuaucaugaaagauggacgaaaauugguggugccuuguagaccccaagaugagcucauuggacgagcucguauaucacaaggugcgggguggagcuugaaggaaacugcuuguuuaggaaaggccuacgcgcaaaugugggcguuaauguauuuucaucguagggaucuaagauuggccucaaaugcaauauguagcgcuguacccgugcauuggguaccaacuucgagaacuacauggucaauccaugcucaucaccaauggaugacaacugaagauauguugaccguuuggaauaggguuuggauagaagauaaccccuggauggaagacaagaccccaguuacaacuugggaagauguaccauacuugggaaaacgugaagaccaauggugcgguucucuaaucggucuaacuagcagagcaacaugggcccagaacauuuugacugcaauacaacaaguacgaucgcuaaucggaaacgaggaauuucuugauuauaugcccaguaugaaaagguucagaaaagaagaagaauuagaaggcgcgauuugguga

SEQ ID NO: 22985 - RNA, 9873 nt, Artificial Sequence
  derived and/or modified CDS sequence (opt6) from DENV-3__AB189128__SS-prME
acuagcuuauguuuaaugaugauccuaccggcgacauuggcauuccaucuaacaagcagagauggagaaccuagaaugauagucggcaaaaaugaaagagguaaaucuuuauuauucaaaacagcgagugggauuaauaugugcacauuaauagcuauggacuuaggggaaaugugcgacgauaccgucacuuauaaauguccacuaaucaccgaagucgaaccagaagacaucgacuguugguguaaucuaacaaguacguggguuacauacggaacguguaaucaagcaggagagcaccguagggacaaaaggucaguugcauuagcaccacacguaggaaugggauuagauacccgcacacaaacauggaugagugcagaaggagcguggagacaaguugagaaaguagaaacgugggcauucagacauccgggauuuaccguccuagcauuauuuuuagcacauuucaucgggacaucauuaacacaaaaaguaguaauauuuauccuccugauguuagugacacccucaaugacaaugcguugugucgggguaggaaauagagacuuuguagaaggacuuucaggagcaacauggguugacguuguacuggaacacggugggugcguaacaacuauggcuaaaaacaaaccgacauuagauauugaauugcagaaaacugaggcaacgcaacuugcaacgcuaagaaaauuauguaucgaaggcaaaauaacuaacgucacaacugauucaagauguccuacgcaaggagaagcgauuuuaccggaggaacaagaucaaaacuauguauguaaacauacguauguggacagggguuggggcaauggaugugggcuguucggaaaagguagcuuaguaacaugugcgaaauuucaaugucuugaaagcauugaggggaaagugguccaacaugagaaccuaaaauauacgguuauaaucaccguucacacgggagaucagcaucaagucgguaaugaaacacaaggggugacugcagaaauuacgccgcaagcaaguacuguggaagcaauuuuaccagaguaugguacguuaggucuagaaugcucgccccgaacuggacuugauuuuaacgagaugauccuauuaacaaugaaaaauaaagccuggauggugcaucgccaaugguucuuugacuuaccacugccguggacauccggugcaacaacggagacgccgaccuggaacaagaaagaacuguuagucacuuuuaaaaaugcccacgccaagaaacaagaaguaguagucuuaggaucccaagagggcgcaaugcauaccgcuuuaaccggugcaacggaaauacaaacgucaggagguacuagcauuuucgcaggccauuuaaaauguagauuaaaaauggacaaacuagaguuaaaaggcaugucauaugcuauguguuugaaugcauuuguccuuaagaaagagguuucugagacucaacauggaacuauacuaaucaaaguagaguacaaaggugaagaugcaccguguaaaauaccauucucaacugaagauggacaagguaaagcucauaacggacgacuuauaacugcuaauccaguuguaacuaagaaagaagaaccgguaaauauagaagcagaaccgccauuuggcgaaaguaacauagugaucggaauuggugauaaagcauuaaaaauuaauugguacaagaaaggcucgaguaucggaaaaauguuugaggcaacggcucgaggagcacguagaauggcgauuuugggagacacagcaugggauuuuggaucuguuggagggguccuaaauagucuuggaaaaaugguucaucaaauuuuugggucagccuauacugcucucuuuaguggcguaucuuggauaaugaaaaucgguaucggcguuuuauugacauggauaggauuaaauaguaaaaauacaaguaugagcuuuagcuguauaguaauuggcaucauaacacucuaccuuggagccguaguacaagcagacacaggguguguaauaaacuggaaggguaaagaacuuaaguguggcucaggaaucuucgugacuaaugaaguccacacuuggacugaacaauacaaauuccaagcagacucgccgaaaagacucgcuaccgccauugcaggagccugggagaauggaguuugcggaauacgaaguacgaccagaauggaaaauuuguuauggaaacaaaucgcaaacgaacuuaauuauauccucugggaaaauaauauuaaauuaacaguuguaguaggggacauaauuggcguuuuagaacaaggaaaaagaacccuuacaccucaaccaacagaauugaaguauuccuggaaaacauggggcaaggcgaagauuguaaccgcggagacacaaaauucauccuucauuauagauggcccaaauacuccagaaugccccagcgcgaguagggcauggaauguaugggaaguagaagaauacggauuuggaguauucacuacaaacauuuggcuaaaacuccgagaaauguauacacaauuaugcgaccaucgauuaaugagugccgcaguaaaggaugaaagagcuguacaugccgauaugggauauuggauagaaucacagaaaaauggcaguuggaaauuggaaaaagcgagccuaauagagguuaaaacauguaccuggccaaaaucacauacuuuauggagcaauggaguucuagagucugauaugauaauaccuaaauccuuggcuggcccuauaucgcagcauaauuaccguccaggcuaucauacgcagacagcaggaccguggcaccucggaaagcucgaauuagauuuuaacuauugcgaaggcacaacaguagucauaacagaaaacuguggaacucgugggccuagccuaagaacgacgacaguuucuggaaaauugauacaugaaugguguugcagaucgugcacccugccacccuugcgcuauaugggagaagauggaugcugguacgggauggaaauaagacccauaaaugagaaagaagaaaauauggugaaaucgcugguuagcgcggggaguggcaaagucgauaauuucacgaugggaguccuaugccuagcgauauuauuugaagaaguaaugagagggaaauuuggcaagaaacauaugauagcgggagucuuguucacguuuguuuuguuguuaucuggucaaaucaccuggcgagauauggccagaacacuuauaaugauuggaucaaaugcuagcgaucguaugggcaugggugugacuuaccuagcguuaaucgcuaccuucaaaauacagccguuccuagcguugggcuucuuucuacgaaaauugacaucacgagaaaauuuacuauuggggguaggcuuagcaauggcuacgacgcuacaacugccagaagauaucgaacaaauggcaaauggaauagcucuagggcugauggcguuaaaauugauuacucaauucgaaacauaucaacucuggacggcucuaguaagccuuaugugcagcaauacuauuuuuacacuaacaguggcauggagaacagcuacuuugauacuggcuggaauaucucugcuuccagucugccaaagcaguagcaugcgaaaaaccgacuggcuaccuaugacgguggcagcaaugggagucccgccccugccacuuuuuauauuuagccuaaaggauaccuuaaaaaggagauccuggccucuaaaugaaggugugauggccgugggucuuguauccauucuugcaagcucauugcuuagaaaugauguacccauggcugguccauuggucgcuggaggcuuacuuaucgcgugcuaugucaucacugggacgucggcugaucugacugucgagaaagcugcaaaugucacaugggaagaggaagccgaacagacggggguaagccacaacuuaaugauuaccguugaugacgacggaacaaugcgaaucaaagacgaugaaacagaaaacauauuaaccguuuuacuuaagacagcacuauuaauaguaagugguaucuucccuuauucuauacccgccacucucuuaguguggcacacauggcaaaagcaaacacaaagaucaggcguccuuugggacguaccuaguccaccggaaacacaaaaagcugaguuagaagauggaguauacaggauaaagcaacaggguaucuucggaaaaacucaaguaggaguugggguacagaaagaaggaguguuccauacgauguggcacguaacaagaggcgcgguauuaacacacaacggaaaaagauuagaacccaauugggcgucaguaaagaaagauuuaauaucuuauggagguggguggaggcucagugcucaguggcaaaaaggagaagaaguucaaguuauugcgguugaaccaggaaagaauccgaaaaauuuccaaacaaugccugggaucuuccaaacaacgacuggagaaauuggggcuauugccuuggacuucaaaccagguacauccggcagccccauaauaaaucgagaaggcaagguagugggacuuuaugguaauggaguuguaaccaagaauggugguuauguaucaggaaucgcgcaaacuaaugcggaaccagauggccccacucccgagcucgaagaggaaauguuuaagaaaagaaaucucacaauaauggauuugcacccaggaucaggaaaaacgagaaaguauuuaccagcuauugugagggaagcuauaaaaagacgauugcguacacuaauucuggcuccaacaagagucguugcugcagaaauggaagaagcgcuaaaaggacuaccaauacgcuaucagacuacugcuacgaaaucggaacauaccggcaaagagaucguugaucuaaugugucacgcuacguuuacuaugagacuauuguccccaguacguguaccgaacuauaaucuaauaauaauggaugaagcgcacuuuacggacccggcuuccauugcugcacggggauauauaucaacucgcgucgguaugggagaagcagcggcgaucuuuaugacggcaacuccgccaggaacagcagaugcauucccucaaucaaaugccccaauacaagacgaagaacgugauauaccugagcgaagcuggaauagcgggaaugaauggauuacggacuuugcgggaaaaaccguuugguuuguuccuucaaucaaggcgggaaaugauauagcaaauugccuccguaagaauggcaagaaagucauucaacuuucuagaaaaaccuucgacaccgaauaccagaaaacaaaacuuaacgacugggauuuuguugugacaaccgacauaucugaaaugggcgccaauuuuaaggcagaccggguaauagacccccgucggugcuuaaagccggugauacuuaccgacggacccgagagagucauacuagccgguccaaugccggugacugucgcauccgcggcccagcggagagggcgcgucgggagaaauccucaaaaggaaaaugaucaauauauauuuacgggccaaccucuaaacaaugacgaggaucacgcccauuggacggaagccaaaaugcuauuagauaacaucaacacgccagaaggaaucauucccgcacuuuucgagccagaaagagaaaagucagcagcaauagauggugaauaucgguuaaagggagaaucucgaaaaacauucguagagcuuaugcgacgaggggaucuaccagucuggcuagcacauaaaguggccagcgagggcauaaaauauacagacaggaaaugguguuuugauggugagagaaauaaucaaaucuuagaagaaaacauggaugucgagauuuggacaaaagaaggugaaaagaagaaauuaaggccucgcuggcuugacgcuagaaccuacucagacccacuugcuuugaaggaguucaaagauuuugcugcgggaaggaaaucgauugcccuagaccuaguaacagaaaucggccggguaccaucacaucuagcccaccgaacccggaaugcucucgacaacuugguaaugcuucauacaucagagcacggaggaagggcuuaccgacacgcaguagaagaguugccagaaaccauggagacauuacuacuguuaggacugaugauucucuuaacugguggugcgaugcuguuucucauaucugguaaagguaucggaaaaacgucaauaggcuuaaucugugucguggcaagcucagguaugcucuggauggcagacguuccauuacaguggauagcaucugcgaucguguuagaauuuuucaugaugguguuauugauuccugaaccggaaaaacagagaacuccacaagauaaucaauuagcauauguggucaucggcauacuaacauuagcggcaauaguagccgcgaacgaaaugggcuuacuagaaacuacuaaaagagauuuaggaaugaguaaggagccagguguggugucuccaauaucuuaucuagacgucgaucugcauccugcaagugcuuggacuuuauacgcuguagcuacgacaguuaucacgccuaugcuaagacauacgaucgaaaauucgacagcuaauguaucccucgcagcaauagcaaaucaagcagucguccucaugggcuuggauaaaggauggccaauaucaaaaauggaccuugguguaccgcuucuagcgcucggauguuacucacagguuaauccauugacacuaacugcugcaguuuuacuucugguuacacauuaugcaauuauaggacccggcuuacaagcuaaagcgacuagggaggcgcaaaagagaacagcagcagguaucaugaaaaacccaacuguggacggaaucaugacaauagauuuggacccgguaauauaugauucaaaguuugaaaaacaguuaggacaaguuauguuauuaauuuuaugugccguacaacuacuacuuaugagaacgaguugggccuuuugugaagcccucacauuagcaacugggcccaucacuacuuuaugggagggcucaccagggaaauuuuggaauacaacaaucgcuguuucaauggccaacaucuuuaggggaagcuacuuagcgggcgcuggacuggccuuuucgauaaugaaaucaguggguacagguaaacgaggaaccgguagucaaggagaaacacugggcgagaaauggaagaagaaacugaaucagcuaucaagaaaggaauuugacuuauauaaaaagucagguauaacagaaguagauagaacugaggccaaagaaggucugaaaagaggagaaauaacucaucaugcaguuucccgaggaagugccaaacuacaaugguucguagaaagaaauaugguaauaccagaaggucgcguaauagacuugggaugcggcaggggaggguggucauauuauugugcugggcuaaagaaaguaacggaaguacgggguuauacaaaaggagguccgggucaugaggaaccugucccgauguccaccuauggcuggaacaucguaaaauuaaugagugggaaagacguauuuuaucugccgccagaaaaaugugauacacugcuaugcgacaucggugaaucuaguccgucuccgacgguugaagagucccgaacuauacgugugcucaaaaugguagaaccauggcugaaaaacaaucaauuuuguaucaaaguccuaaacccauacaugccaacggucauagaacaucuagagagacuacaaagaaaacacggggguauguugguuagaaauccucucuccagaaauucaacacacgaaauguauuggauaucuaaugggaccgguaauauaguaucgagcguaaacaugguauccagacuauuacuaaacagauuuacaaugacacacagacguccuacuauugaaaaggauguugacuugggggcuggaacuagacauguuaacgcagaaccagaaacacccaacauggacgucauaggagagcgaauuaggagaauaaaagaagaacauucuucaacauggcauuaugacgaugaaaauccauauaagacaugggcuuaucacggaaguuaugaggucaaagcaacagguucagcuagcagcaugauaaauggagucguaaaacuauuaacgaaaccuugggaugucguaccaaccguuacacagauggccaugacugauacgacuccauuuggacagcagaggguguucaaagagaaaguugauacaagaacuccgaggccaaugccaggcacacgcaagguaauggaaauaacugcagaguggcuauggaggacacuagggcgaaauaaacggccacgucuguguacaagagaagaguucaccaagaaaguucgaacuaaugcugcaaugggugcuguuuucacggaagaaaaccagugggacagcgcucgugcugcuguagaggacgaagaauuuuggaaguugguagacagagagcgugagcuccacaaauuaggcaagugugguucgugcguauauaacaugaugggcaaaagagagaagaaacuuggugaguucggcaaagcuaaggggucaagagcgauaugguacaugugguuaggcgcacgguauuuagaauuugaggcauuaggguuucuuaaugaagaucacugguuuaguagggaaaauucauacucugguguugaaggagaggguuuacacaagcucgguuauauacucagggauauaagcaaaauaccgggaggugcgauguacgcugacgauacagcuggaugggauaccagaauaacagaagacgacuuacauaacgaggaaaagaucacacaacaaauggauccagaacaucgucaauuagcgaacgccaucuucaaacuaacguaucaaaacaaaguagucaaaguucaaaggccaacaccuaaggguacggucauggauauuauaucacgcaaagaccaaagagggucaggacaaguagggaccuacgggcucaauacauuuacgaauauggaagcucaauuaauucgacaaauggagggggagggcgugcugucgaaagcagacuuagaaaauccccauuuguuagagaagaaaauaacacaauggcuggaagcggagggaguggagcgauuaaaaagaauggcaauaaguggggacgauuguguuguaaaaccuauagacgaccgauucgcaaaugcauuauuagcauugaacgauaugggaaaaguuagaaaagacauuccucaauggcagccuagcaaaggauggcaugacuggcagcagguccccuuuugcucucaucacuuccaugaauuaauuaugaaagauggccgaaaacucguaguuccaugucguccacaagacgaauuaauugggagggcccguauaucacaaggagcaggauggucauuaaaagaaacugcaugucuugguaaagcauacgcacaaaugugggccuuaauguauuuccacagacgagaucuucgacuagcuucaaaugccauauguucugcagucccuguucauuggguucccacuucucgcacaacauggaguauacacgcucaucaucaauggaugacuaccgaggacaugcugacaguguggaauagagucuggauagaagauaacccuuggauggaagauaaaacucccguaacaaccugggaagacguaccauacuugggaaagcgggaggaucaaugguguggaucucuaauuggacacacaucucgagccacuugggcucaaaauauuuuaacagcaauacaacaagucagaucacucauaggaaaugaagaauuucuagauuauaugcccuccaugaagcgguuuaggaaagaggaagagagugagggagcaaucugguaa

SEQ ID NO: 22986 - RNA, 9873 nt, Artificial Sequence
  derived and/or modified CDS sequence (opt6) from DENV-3__AB214879__SS-prME
acaucccuaugccuaaugaugaugcucccugcaacauuagcauuucacuuaacaucacgugauggagaaccuagaaugauuguaggaaagaacgaacgaggaaaaucguuacuguuuaaaacugcaucaggcauaaauauguguacuuuaauagcuauggauuugggagaaaugugcgaugauacgguaacuuauaaguguccacuaauuacugaaguagaacccgaagacauagauugcugguguaaccuaacaagcacguggguaacguauggaacgugcaaccaagcaggggaacauagaagagauaaacgaagcgucgcauuggcaccucauguagggaugggacuugacacucggacucaaacguggauguccgcugaaggagcuuggcgccaaguagaaaaaguagaaacgugggcguuucgacaccccggguucacgauccuagcuuuguucuuagcucauuacaucggaacaucuuuaacacagaaaguaguaauauucauuuuguuaaugcuaguaacccccucaaugaccaugagaugcguugguguaggaaaucgugauuucguugaaggauugucaggggccacauggguugacguuguucuugaacacggcggaugugugacgacaauggcuaaaaacaaaccaacacuagauauagaacugcagaagacggaagccacacaacuggccacacuaaggaagcugugcauugaagguaaaaucacaaauguaacaacugacucgagaugcccuacacaaggagaagcaauucuaccagaagaacaagaucagaauuauguuuguaagcacacauacguggaccgggguuggggaaauggauguggauuauucggaaaaggaucacucgucacuugcgcuaaguuucagugcuuagaaucuaucgaaggaaaaguaguucaacacgaaaacuugaaguauacggucaucauaaccguccauacgggugaucaacaucaagucggaaaugaaacacaaggaguuaccgcagaaauaacaccacaagcuagcaccguagaagcgguguuaccagaauaugguacgcucggucucgaauguucaccacgaacuggauuggacuuuaacgaaaugauacuucuuacaaugaaaaacaaagcguggauggugcaucggcaaugguucuuugacuuaccacucccauggacgaguggagcaacaacugaaacgccaacguggaauaagaaagaauuauuaguuacauuuaaaaaugcacaugcuaagaaacaggaaguugucguauuggggucacaggaaggagcuaugcacaccgcccuaacgggagcuacugaaauacaaacaucaggcggaacguccguuuucgcaggccauuugaagugccggcuuaaaauggauaagcucgaacucaagggaaugaguuaugcuauguguuccaaugcuuucguacuaaagaaagaagucucagaaacacaacacggaacgauauuaauaaagguagaauacaagggagaggacgcucccugcaaaauaccauucagcacagaggauggacagggcaaagcccacaauggccgccugaucacggcaaauccggucguaacuaagaaagaagaaccagucaacauugaagcugaaccacccuucggugaaagcaauaucauuauaggaauuggagauaaggcucuuaaaauaaauugguacaagaaagggucuagcauuggaaaaauguuugaagcgacagcacguggagcccgaagaauggcgauauuaggggacaccgcuugggauuucggaagcguaggaggagucuuaaauucauuaggaaagaugguucaccaaauuuuugggagugcauauaccgcacucuucaguggagucucauggauaaugaaaauugguauuggaguacuauuaacauggauuggacuuaauucgaaaaauaccuccaugagcuuuucuuguauuguaaucggcauaauaacacuuuauuuaggugccguaguccaggcggacaugggaugcguuauaaacuggaaaggaaaggaacucaaaugcggaagcggcauauucgucacgaaugaaguacacacuuggacggagcaauauaaauuucaagcagauagcccuaaaagauuagcaacggcuauugcuggagcaugggaaaaugguguaugcggaauaaggucgacaacaagaauggaaaaucuacucuggaagcaaauagcgaaugaauugaacuacauacugugggaaaauaauauuaaauugacgguuguagugggugacauaauagggguacuagaacaagguaaaaggacucugacaccccagccgauggagcuaaaauauucauggaagacgugggguaaagcaaaaauagugaccgcagaaacgcaaaacucgucuuuuauaauugauggaccgaauaccccagaaugcccguccgcaagccgagccuggaauguaugggaaguagaggacuaugguuuuggaguuuuuacgaccaauauuugguuaaaauuaagggagauguauacacaacucugugaucauagacuaaugucagcggccguaaaagacgaaagagcaguucaugcugauaugggguauuggaucgaaucgcaaaagaauggaaguuggaaacuagaaaaagcaucguugauagaaguuaaaaccugcaccuggcccaagucucacacacuaugguccaaugggguucuugaaagcgacaugauaauaccgaaaucauuagcggguccgauuagucaacacaauuacagaccaggguaucacacacaaaccgcaggucccuggcaucuagguaaauuagaacuagauuuuaacuauugcgaagggacuaccgugguuauaacugagaauugugggacccggggaccaagccuuagaacaacgacaguuaguggaaaauuaauccacgagugguguugcagauccugcaccuuaccuccucucagguauaugggcgaagacggauguugguacggaauggaaauaagaccuauaaaugagaaggaggaaaacaugguaaaaucucuaguaucugcaggcagcggaaaaguugauaauuuuacaauggguguacuauguuuagccauucuuuuugaagaggugaugcguggaaaauuugguaagaaacauaugauagcuggcguucuguuuaccuuuguacuccuacugagcggucaaauuacauggcgagacauggccagaaccuugauaaugauaggaucuaaugccuccgauaggaugggaaugggcguuacuuauuuagcguuaauagcuacguucaaaauucaaccguuucuugcauuaggcuucuuucuccggaaacugacuucucgagaaaaucuacuuuuaggaguaggguuggcaauggccacaacacuacagcuacccgaagauauugagcaaauggcaaacggaaucgcauuaggauugauggcuuugaaacuuauuacucaauucgaaacguaccaguuguggaccgcucuaacuucauuaauguguucuaauacgauuuuuacguugacaguagcuuggcgaacugcgacacucauucuagcugggauuucacuguuaccggugugucaaucaucaucuaugagaaaaacagauuggcucccuaugaccguagcugcuaugggaguuccuccguuaccccuguuuauauucucacuuaaagauacacuaaagcgacggagcuggccacugaacgaagggguaauggcaguuggguuaguaagcauacucgcaaguucauuauugcgaaaugacgucccaauggcuggaccuuuaguugcaggagguuuguuaauugcuugcuaugucauuacaggaacaagugccgaucugacgguggaaaaagcagcugacguaacaugggaagaagaggcggaacaaaccggagugagucacaauuuaaugauaaccguggaugacgauggaacuaugcggauaaaagacgaugaaaccgaaaacauacuuacuguacuacuaaagacggcacuccuuauuguuagcgggauauuucccuauucgauuccagccacguuauuaguauggcacacauggcaaaagcaaacgcaaagaucaggaguacugugggauguuccuucacccccagaaacacaaaaggccgaauuggaagaaggcguuuauagaaucaaacaacagggaauauuugguaagacucaagugggagucggaguacagaaagaaggaguuuuccauacuauguggcacguaacgcgcggagcagugcuaacacacaauggcaaacgucucgaacccaacugggcgucugucaagaaagauuuaauuagcuacgguggagguuggcgccucagugcacaauggcaaaaaggcgaagaagugcaagucauugccgucgaaccaggaaagaaccccaaaaauuuucaaacuaugccagggauauuucaaacaacuacuggagagauuggugccauugcacuggacuuuaaaccugggacauccgguucuccaaucaucaauagagaagggaagguugucggacuuuaugggaaugguguugugacuaaaaguggaggcuauguaucuggaauagcgcaaacaaaugcagagccagacgguccuacaccugaacucgaagaagagauguucaaaaagagaaacuuaacgauuauggaccugcaucccggaagcgguaagacgcggaaguaccuuccggcaauuguuagagaagcaauaaagagaagacuaaggacacuaauuuuagcuccaacacgaguaguagcugcagaaauggaggaggcacucaaaggccucccgauucgcuaccagacaacugcgacaaaaucugagcauacagggaaagaaaucguagaucuaaugugccaugcgaccuuuacgaugagguuacuaaguccuguacgcguaccuaacuauaaccuaaucauaauggacgaggcccauuucacagaucccgcgagcauagcagcuagggguuauauaucaacucgaguaggaaugggagaagcagccgcuauuuuuaugacagcaacaccgccuggaacugcagacgcguucccacaaucaaacgccccaauccaagacgaagaaagagauauuccugaacgcuccuggaacucagggaacgauuggauuacugauuuugccggaaagacuguaugguuuguaccaucuauaaaggcugguaacgauauagcaaauugcuugcgcaaaaacggcaagaaaguuauacaacuauccagaaaaacauuugauacagaguaucagaaaacaaaacuaaaugauugggauuuuguaguuacuacagacauuucagaaaugggcgcuaauuucaaagcugaucgaguuauagacccacgaagaugccuaaaaccaguuauccucacggaugggccggaacggguaauauuagcaggcccaaugccggucacuguggcaucagcugcccaaaggagaggaagaguaggucgcaacccucaaaaggaaaaugaucaguacauauuuaccggacaaccacucaauaacgacgaggaccaugcucacuggacggaagcuaagaugcuauuagacaauauaaacacuccagaagggauaauuccugcacuauuugaaccagagcgagaaaaauccgcugcaauugacggugaauacagguugaagggugaaucacguaaaaccuucguugagcugaugcguagaggcgauuugccggucugguuagcgcauaaaguugcgucagagggaauaaaguauaccgaccgaaaauggugcuucgacggagaacgaaauaaucaaauucuggaggagaauauggaugucgaaauauggacuaaagaaggagagaaaaagaaacuaagaccccgcuggcuagaugcccguaccuacagugauccuuuagcacuaaaagaauuuaaagacuuugccgcgggucgaaagagcaucgcauucgauuugguaacagaaauaggacgaguaccaucacaccuugcucaccgaaccagaaaugcacuugauaaccuaguaauguugcauacaucagagcacggaggccgugccuacaggcacgcaguagaagaauuacccgaaacuauggaaacacuucuacuauuggguuugaugauccuccugacgggaggcgcaaugcuauucuugauuagcggcaaagggauaggaaagacaaguauuggauugauuuguguagucgcaaguucuggcaugcuauggauggcugacauaccguuacaauggauugcguccgccaucguccuagaauuuuucaugaugguacucuugaucccagaaccugaaaaacaaagaacuccacaagacaaccagcuagcguacguugugauaggaauccuaacguuagcagcgauuguugcugccaaugagaugggacuucuggagacaacuaaaagagauuugggcaugagcaaggagcccggaguaguaucccccacaagcuaucucgauguggaccuucauccugcaagcgcauggacguuauaugcggucgcuacuacaguaauaacaccaauguuaagacauaccauagaaaauucaacggcaaacgugaguuuagcggccauugcuaaucaggcugugguauuaaugggacuagauaaagguuggcccauuagcaaaauggaucuaggcguuccccuucuagcacuagggugcuauagucaaguaaauccacuuacgcuuaccgcagccguacugcuauuagucacacauuacgcgauaauugguccaggacuacaagccaaagccaccagagaggcacagaaaagaaccgccgcugggauuaugaagaauccgaccgucgauggaauaaugacuaucgauuuagauccaguaauuuacgauuccaaauuugagaaacagcuugggcaaguaaugcuccuaguguuaugugcaguacaacuacuuuuaaugagaacuagcugggccuuuugugaggcacuaacacuugcaacaggccccauaacaacccuaugggaaggguccccaggaaaauuuuggaauacaacaaucgcaguaagcauggcuaacauuuuuagggguucguacuuagccggggccggguuagcauuuaguauuaugaaaagcguaggcacaggcaagagaggaacuggcagucaaggggagacacuaggggaaaaauggaaaaagaaacugaaucagcuaucucguaaagaauuugaucuauauaagaaguccggaauuaccgaaguagauaggacugaagcgaaggaaggucucaagcgaggcgagauaacacaucacgcaguuucacgagguuccgcaaaacuacaaugguuuguugaaagaaauaugguaaucccagaaggaaggguuauagacuuaggauguggcagaggugguuggucuuauuauugugcaggacuuaaaaagguuacugaagucagaggguauacaaaaggugguccagggcacgaagaaccuguaccuaugaguaccuacggauggaacaucguuaaacuaaugucggguaaagaugucuucuauuuaccgccagaaaaaugcgauacuuuacuaugcgauauuggagaaagcucgccgucgccuaccguagaagaaucacgaacaauccgaguacugaaaaugguugaaccguggcucaagaauaaucaauuuuguaucaagguauuaaaccccuauaugccgacagucauugagcaccuagagagauuacagcggaaacauggugggaugcuaguuagaaacccauugagucguaauucaacacaugagauguauuggauaucuaauggaacggguaauauaguauccucaguuaauaugguaagucgacuacuucuaaaccguuuuacaaugacuuauaggagaccaaccauugaaaaagacgucgauuuaggagccgguacaaggcauguuaaugcagaaccagagacuccuaauauggacguuauaggggagagaauacgaagaauaaaggaagaacacaguucgacguggcauuacgaugaugagaauccauauaagaccugggcauaccacggaucauaugaaguaaaagcaacuggaucagccucuuccaugauaaacggaguagucaaguuauugacaaaaccaugggacguagucccuacuguaacacagauggcgaugacagauacuacgccauuuggccaacaaaggguuuuuaaagagaagguagacacaagaacgccuaaaccuaugccgggaacgagaaaggugauggaaauaacugcagaguggcuauggagaacuuugggacgaaacaagagaccaagguuauguacuagagaagaguucacuaaaaagguacgaacaaacgcagcaaugggugcuguguucacugaagaaaaccagugggauagugccagagcugcagucgaagacgaagaguucuggaaauuaguagaccgagaacgugaauugcauaaguuaggaaaauguggcaguuguguuuauaauaugauggggaagagggagaagaaacucggggaauuugggaaagcgaaaggaucaagggcaauaugguauaugugguuaggagcuagguaucuagaguucgaagccuuaggauuuuuaaacgaagaccacugguuuucacgggaaaauucauauaguggaguagaaggcgagggucuacauaaacuuggguauauucuaagggauauaaguaaaauaccaggcggugcuauguacgcagacgauaccgcgggaugggauacgcgaauaacugaggaugaucuacauaaugaagagaaaauaacacaacaaauggacccggaacaucgacaacuggcuaaugcuaucuuuaaacuaacauaccaaaauaaaguagucaaaguacaaaggccgacgccgaaagguaccgucauggauaucauuaguagaaaagaucagagaggcagcggucagguaggcacuuacggacugaauacuuucacuaacauggaagcacaauuaauaagacaaauggaaggagaaggagucuugucaaaaacagauuuggaaaauccucaucugcuugaaaaacgcauuacacagugguuagaaaccaagggaguugaaagacucaagcguauggccauuaguggugacgacuguguuguuaagccgauagacgauagauuugcaaaugccuuacuugcgcuaaacgauauggguaagguaagaaaagauauaccgcaauggcagccaucaaagggauggcaugauuggcagcaaguacccuuuuguagccaccacuuucacgaguuaauaaugaaggacggacgaaaauuaguaguaccuuguaggccucaagaugaacucauuggccgagcccgcauuagucaaggagccggcuggucauuaaaagagacagccugcuuaggaaaggcuuacgcacagaugugggcuuuaauguauuuccauagaagagaucuuagacuugccaguaacgcuauauguagugcaguuccugugcacugggucccaacaucgcguacaacuugguccauccaugcccaccaccaauggaugacgacagaggauaugcuuacaguguggaauagaguauggauugaggacaauccauggauggaggacaaaacaccaguaacaacaugggaagacgugccguaucuaggaaaaagagaggaccaguggugugggucuuugauuggcuugacaaguagagcaacaugggcucagaacauacuaacggcuauucaacaaguucguagucuuaucggaaacgaggaauuuuuagacuacaugccaucuaugaaacgcuuccguaaagaagaggaaucugaaggcgcaauuugguag

SEQ ID NO: 22987 - RNA, 9873 nt, Artificial Sequence
  derived and/or modified CDS sequence (opt6) from DENV-3__AB214880__SS-prME
accaguuuaugcuuaaugaugauguugccagcaaccuuggcauuccauuuaacaaguagagauggugaaccccgaaugaucguaggcaaaaaugaacgagguaagagcuuacuuuuuaaaacagcaucaggaauaaacauguguaccuuaauagccauggauuugggagaaaugugugaugauacugucacuuacaaaugcccucuaaucacugaaguugaaccagaggacauagauuguuggugcaaucuuacaucaacuuggguuacuuauggcacauguaaucaagcaggggaacacagacgagauaagagauccguugcucuagcaccucacgucgggaugggacuggauaccagaacacagacauggaugucagccgaaggagcauggagacagguugagaaaguugaaaccugggcguuuagacacccuggauuuaccauuuuagcacucuuuuuagcucauuauauaggaacgaguuuaacgcaaaaagucguuauauuuauacuacuuauguuaguaacuccuagcaugacaaugcggugugucggaguuggaaaucgugauuuuguagaagguuugaguggagcuacuuggguggauguuguacuagagcacggaggcugcgugacuaccauggcuaaaaacaaaccaacccuugauauugaacuccagaaaacagaggcaacacagcuagcaaccuugagaaaauuaugcaucgaaggaaaaauuaccaaugucacuacggacagccgauguccaacccagggugaggcgauucuuccagaagaacaagaucaaaacuauguauguaaacauacauauguggaucgcggaugggggaacgguuguggauuauuuggcaaaggaucacuggucacaugcgcaaaauuucaaugcuuagaauccauugagggaaaaguaguucaacacgagaaucuaaaauauacuguaauuauuacagugcacaccggggaucaacaccaggucgguaaugaaacacaaggcguaacggcggaaauaacaccacaagcaucuaccguugaagcuguacuaccagaauacggaacauugggauuagaguguuccccacgaacaggucuugauuuuaacgaaaugauacugcuaaccaugaaaaauaaagcauggaugguacaccgacaaugguucuuugaucuaccccuaccguggacauccggugcgacuaccgaaacaccaacuuggaauaagaaagaacuacugguuaccuuuaagaacgcgcacgcuaagaaacaagaaguugucguauuagguucucaagaaggagccaugcauacugcacuuacaggagcgacugaaauucaaaccagugguggaacuuccaucuucgcugggcaccuaaagugucgccuuaaaauggauaagcuagagcucaaaggaaugaguuacgcuauguguucuaaugcuuuuguacuuaagaaagaagugagcgaaacacagcauggaacaauucugauaaaaguugaauauaagggagaggaugcaccuuguaaaauuccauuuaguacggaagacggccaaggaaaagcccauaauggacguuuaauaacagcuaaccccguaguaacaaagaaagaagaaccaguaaauauagaagcggagccgccuuuuggagaaaguaauauaaucauaggaaucggugauaaggcuuuaaaaauaaacugguacaagaaggguagcucaauaggaaaaauguuugaggcuacagcaagaggggcgagaagaauggcuauucucggagacaccgcaugggauuuuggaucaguuggaggcgucuuaaacucauuaggaaaaaugguucaccaaauuuucggaagcgcauauaccgcucucuuuucaggaguuucuuggaucaugaaaauagguauagguguacuauuaacauggaucggccuuaauucuaaaaauacaucaaugucauucucuuguauaguaauugggauuauaacacuauacuuaggagcagucguacaggcugauaugggaugugucauuaauuggaaagggaaagaacuaaagugugggucuggaauauucgugacaaaugaaguucacacguggacagaacaauauaaauuucaagcagacagucccaagcgucuagcaacugcuauagcuggagcgugggaaaauggagucugcgguaucagaaguacgacuagaauggagaaucuacuauggaaacaaauugccaaugaacuaaacuauauucuaugggagaauaauaucaaauuaacgguaguuguuggugacauaauaggaguccuggaacaagguaagagaacacuaacuccacagccgauggaacuaaaauauucauggaaaaccugggguaaggcaaaaauagucacggcugaaacacaaaauagcaguuucaucaucgaugggcccaacacuccugaaugcccuucugcgagucgugcauggaacguuugggaaguugaagauuacggauuuggcguauucacgacgaacauauggcuaaaauuacgcgagauguacacacaacuaugcgaucaccgccuaauguccgcagcuguaaaagaugaacgcgcuguucaugccgauaugggcuacuggauagaaucgcagaagaacgguucauggaaauuagaaaaagcauccuugauugaaguaaaaacaugcacauggccaaaaucccacacgcucuggagcaauggaguacuggaaagugacaugauaauuccaaaaucacuugcagggcccauaucccaacauaacuacagaccuggauaucauacacaaacagcgggaccguggcaucucgguaaacucgaauuagacuucaacuacugugaagggaccacuguaguaauaacugaaaauuguggcacaagagguccaucucuuaggacaacuacggugagugguaaacuuauacacgaaugguguugucguucuuguacauugccgccauuaagauacaugggagaagauggcuguugguacgguauggagauacgaccgauuaacgaaaaagaagaaaauaugguaaagucccuuguaucugcagguucugguaaagucgauaacuucacaaugggaguuuuguguuuagcuauauuguucgaagaagugaugagagguaaguuuggcaagaaacacaugauagcugguguauuauuuacauuuguccuucugcuuucaggacagaucacauggcgugauauggcacgcacauuaaucaugaucgguucuaacgcauccgacagaauggggaugggagugaccuaucucgccuugauugccacguucaaaauucagccauuuuuagcauuaggguucuuucugagaaaguugacuucucgugaaaaccuuuuacuaggaguagguuuagcuauggcaaccacccuacaauuaccggaagauaucgaacagauggcgaauggaauagcccuggggcugauggcacuaaaguugauuacccaauuugaaacguaucaauuauggaccgcauuggcguccuuaauguguucgaacaccauauuuacacuaaccguggcuuggcgaacagcaacccuuauacuggcggggaucucacuuuugccaguaugucaaagcuccucaaugcgaaaaacugauuggcuaccaaugacuguagcugccaugggaguuccaccauuaccucuuuucauauucucccuaaaagauacguugaagcggcggaguuggcccuuaaaugaaggcgugauggcuguuggccugguuaguauuuuagcaucgagccuacugagaaacgauguacccauggcugguccgcuggucgccggaggacuauuaauagcauguuaugugaucacggguaccucagcugaucugacaguggaaaaagcugcugacguaaccugggaagaagaagccgaacagacuggcguaagucauaaccuuaugauaaccguagaugacgacgggaccaugagaauaaaagaugaugaaacugaaaauaucuuaaccguacuauuaaaaaccgcgcuacuuauagucucagguauuuuuccauacucgauuccugcuacacuacucguauggcauaccuggcaaaaacaaacacaaagaaguggcguucucugggauguaccaucgcccccugaaacacaaaaggcagaacuugaggaagggguauacagaauaaagcaacaagggauauuuggcaagacccaagugggcguagguguucaaaaggaaggagucuuucacacaauguggcacguaacgagaggagcaguucugacgcauaacggaaaacgcuuagaaccaaacugggccaguguuaagaaagacuuaauaagcuauggaggaggauggcgucuaagugcucaauggcaaaaaggcgaagaaguucaagucauugcuguagaaccaggcaagaaccccaaaaauuuccaaacuaugccgggaauuuuucaaacgaccacaggagagauaggagcuaucgcucuagauuucaaaccuggcacaagcgggucacccauaaucaacagagaaggaaagguagugggcuuauaugguaauggcguugucacuaaaagcgguggguaugucucaggaaucgcgcagacaaaugcagagccugaugggccgacuccugaauuggaagaagagauguucaaaaagcgaaacuuaacuauaauggauuuacauccggggucuggcaaaacgcguaaauaucuaccugcaauaguccgugaagcaauaaagagacgacuaagaacauuaauauuagcaccaacccguguaguugcugcggaaauggaagaagccuugaagggacugccaauacguuaccaaacaacugcuacaaaauccgagcacaccggaaaagaaauaguagaccucaugugccaugcaacguuuacaaugagauuacuuucuccaguaagggucccgaauuacaacuuaaucauaauggaugaagcccacuuuacagaccccgcuaguauagcagcucgcggauacauuagcacaagaguugggaugggggaagcugcagcuauauucaugaccgcaacgccuccuggaacugccgacgcuuuuccacaguccaaugcgccaauacaggaugaagaacgagauaucccugagcguuccuggaacuccggaaaugacuggauuacugauuuugcugguaaaacggucugguucguaccgucgauuaaagcaggcaaugacauugccaacugccuucguaaaaauggcaagaaagucauacaacuuucgagaaaaacauucgauacagaauaccagaaaacaaaacuaaaugauugggacuuuguaguuaccacagacauaagugaaaugggagcaaauuuuaaagcugaccgaguaaucgaucccaggcgaugccuaaaaccaguaauuuugacagacggaccagaaagaguuauccuagcaggaccaaugccuguaacaguagcuuccgcagcucaacgacgggguagaguaggaagaaacccacaaaaagagaaugaccaauauauuuucacuggucaaccucuaaauaacgaugaagaucaugcucauuggaccgaagcaaagauguuauuagauaacauaaauacuccagaagguauaauaccugcauuauuugaaccugaacgagagaagagugcggcgauagacggggaauaccgucuuaagggggaaaguaggaaaacguucguagaauuaaugcgccggggugaccucccgguauggcuagcacauaaaguugcgucugaaggaaucaaauauacggacaggaaauggugcuucgauggagagcguaacaaccaaauacucgaggaaaacauggauguagaaaucuggacaaaggaaggcgagaagaagaagcuccguccuagauggcucgaugcaagaacguauucugacccucucgcucuaaaagaauuuaaagauuuugcugcagggcgaaagagcauagcuuucgaucuaguuacagaaauuggaagaguuccaucucauuuagcucacaggacacgaaaugcauuagauaauuuaguuaugcugcauacaucagaacauggaggaagggcuuauagacaugcaguggaagaacuuccagagacgauggagacacuauuacuucugggccucaugauccucuuaaccggaggcgcaauguuguuucucauuagcgguaagggaauuggaaaaacuucgauaggucuuauuugugugguugcaucaagcgguauguuguggauggcagauauuccccuacaauggauagcaucagcuaucgucuuagaguucuuuaugaugguacuacuaauccccgaaccagaaaagcagcgaacaccacaggacaaucaacuagcguacguaguaauuggaauacuuacacuagcagcgaucguugcagcaaaugaaauggguuuacuugaaacaacaaagcgcgaucuaggcaugucaaaggaaccagggguagugucuccgacgagcuauuuagacguggaucuccacccggcuuccgcauggacuuuauacgcaguggccacgacagugaucacccccaugcuaaggcauacaauagaaaauucaacagcaaacgucucucuggcagcuauagcaaaucaagcaguaguauuaaugggcuuggacaaaggauggccuauaaguaaaauggaucucggcgugccauuauuagcgcucggaugcuauagucaaguaaauccauuaacuuugacugcggccgucuuauuacuugucacucauuaugccauaaucgggccagguuugcaggcgaaagcuacgagagaagcucaaaagaggacugcugcggguauuaugaaaaauccgacgguagaugguauaaugacaauugaucuagacccagugauuuacgauucgaaauucgaaaaacaauugggucaaguuaugcuauuaguucuaugugcaguccaauuguuacucaugagaacuuccugggcuuuuugugaagccuuaacacuagcaacugguccuauaacgacuuugugggagggaucaccuggaaaguucuggaacacuacuauagccguaaguauggcgaauauauucaggggcaguuaucuugccggugcaggccucgcguuuucaauaaugaaaucaguuggcaccgggaagcgaggaacaggaucacagggugaaacucuaggagaaaaauggaaaaagaaacuuaaccaauuaucccgcaaagaauuugacuuguauaaaaagucaggaauaacugaaguugaucguacggaagcaaaagaagggcuaaaaagaggcgaaauaacacaccaugcugucucuagaggaucugcgaaacuucaaugguucguagaacguaauaugguuauuccugaagguagagucauugaccuagguugcgggcgaggugguuggagcuauuauugcgcuggccuaaagaaaguuacugaaguaagagguuacacaaagggagguccgggucaugaggaaccuguaccaaugaguacauauggguggaauauagucaaacuaauguccggaaaagauguguuuuauuuaccuccagaaaaaugcgacacucuccuaugcgauaucggugagucgagcccaaguccuacgguugaggagagucgaacgauucgaguguuaaagaugguugagccaugguugaaaaacaaccaauuuuguauaaagguacuaaacccauauaugccaacgguaauagaacaucuugagaggcuacaacgaaaacaugggggaauguuaguaagaaacccuuugucgaggaacucgacucacgaaauguauuggauuagcaacgguacugguaacauaguaaguagcguaaauauggucucgcgguuauugcuuaauagauucacuaugacauacagacgccccaccauagaaaaagacguagauuuaggggcaggcacuagacaugucaaugcagaacccgaaacgccaaacauggauguuauaggagaacgaauaagacguauaaaagaagaacacucaaguacauggcauuacgaugaugaaaauccauacaaaacaugggcauaccaugggucuuacgaaguuaaagcaacuggcucagcauccuccaugauaaaugguguaguaaaacuacuuacaaagcccugggaugugguaccaacaguuacucaaauggcaaugacugauacaacacccuucggacaacaaagaguuuuuaaagaaaagguugauacacgaaccccaaaacccaugccuggcacuagaaagguaauggaaauuacagcagaauggcuauggcguacacucggaagaaacaaaagaccaagacuauguacucgagaggaguucacaaagaaaguaagaaccaacgcggcuaugggagcaguauucaccgaagaaaaucaaugggacucugcaagggcggcagucgaagacgaggaguuuuggaaauuaguagauagagaacgcgaguugcauaaacuuggaaaaugugguuccuguguuuauaacaugauggguaaaagagagaagaaacucggagaauuuggaaaagccaaaggcagucgggcgauaugguacauguggcuaggagcucgauaucucgaauuugaagcacuaggauuccucaaugaggaccauugguuuucaagagagaacaguuacuccggaguugagggugaaggucugcacaaacuuggauacauauuacgugauauaucuaaaauaccaggaggcgcgauguaugcagacgacaccgcagguugggauacaagaauaaccgaggaugaccuucacaaugaagagaaaauaacgcagcaaauggaccccgaacaccgacagcuggcaaacgcaauuuucaaacuuacauaucaaaacaaaguuguaaaaguccaacggccaacgccaaaggggacaguaauggacaucauuucccguaaagaucaacgaggcucaggacaaguuggaacauaugguuuaaacacauucacaaauauggaagcacaacuuauuaggcaaauggaaggugaaggaguccuaaguaaaacagauuuggagaacccgcauuuguuggaaaaacguauaacacagugguuggaaacaaagggcguagaacgacuaaaacgcauggccauaaguggggacgauugcgucgucaagccaauugaugacagauucgcgaaugccuuguuggccuuaaaugauaugggcaagguaagaaaagacauuccucaauggcaaccauccaaggguuggcaugacuggcaacaaguaccguucuguucacaucacuuucaugaguuaaucaugaaagacggaaggaaguuaguuguaccuugucgaccucaagacgaacuaauagguagagcaagaauaagucagggugcaggcugguccuugaaagagacagcaugucuugggaaagccuacgcacaaaugugggcguuaauguacuuucauaggcgagaucucaggcuugcaucuaacgcuauaugcucggcgguaccgguacacuggguaccuacgagucgaacaacuuggaguauucaugcgcaucaucaauggaugacaacugaggauaugcucacaguauggaauagaguuuggauagaggauaacccauggauggaggauaaaacaccaguaacaacaugggaagauguaccauaccuagguaaaagagaagaucaauggugcggaaguuuaauuggucucacaucaagggcuacgugggcucaaaauauauuaacagcgauacaacaagugagauccuugauuggaaacgaggaguucuuagacuacaugccuaguaugaaacgauucagaaaggaagaagaaucggaaggagcaauaugguag

SEQ ID NO: 22988 - RNA, 9873 nt, Artificial Sequence
  derived and/or modified CDS sequence (opt6) from DENV-3__AB214881__SS-prME
acaucccuguguuugaugaugauguuaccggcuaccuuagcuuuucaccuaacaagucgagauggggaaccucgcaugauuguagguaaaaaugaaagagguaaaucauuauuauucaaaaccgccucaggcauuaacauguguacacuuauagcgauggacuuaggagaaaugugcgaugacacuguuacuuauaaauguccgcuaauaacugaaguggaaccagaagauauugauugcuggugcaauuuaaccucuacauggguuacuuauggaaccuguaaccaagcaggggaacaucgcagagacaaaagaucgguggccuuagcuccgcaugucggcaugggacuagauacgcgaacacagacauggaugucagcugaaggagcauggcgacaaguugagaaaguggaaacaugggccuuccgacauccaggauucacaauauuggcuuuauucuuggcacauuauauuggcaccagccuuacacaaaaaguggugauauuuauuuugcugauguuagugacuccuucaaugacuaugagaugcguugguguuggcaaucgggauuuuguagagggauuauccggggcgacuuggguagaugugguuuuagagcacgguggaugcgugacaacgauggcgaaaaauaaaccaacacuagauaucgagcuucagaaaacggaagccacacaacuagcaacuuuaaggaaauugugcaucgagggcaaaauaacgaacguuacaacagauucuagaugucccacucagggagaagcuauauuacccgaggaacaagaccagaauuauguauguaaacacacauauguggauagggguugggggaacggcugugguuuauucggaaaaggcagucugguaaccugugcuaaauuccagugccuagaaaguauugaaggaaaaguaguacagcaugaaaauuuaaaauacacaguaauaauaaccguucacacaggggaucagcaucaagugggcaacgaaacccaaggaguuacggcugagauaacaccccaggcguccacaguagaagcuguucuuccugaauauggaacgcuuggccuagaauguaguccgcgaacgggccucgauuucaaugagaugauacuauuaacaaugaaaaauaaagcauggauggugcacagacagugguucuuugaucugccuuuaccuuggacauccggcgcaacaaccgaaacaccaacauggaauaagaaagaauuauuagucacauucaaaaacgcgcaugccaagaaacaagaaguggugguccucgggucgcaagaaggugccaugcauaccgcacugaccggagcaacggagauacaaacuuccggaggaacuucaauauucgccgggcaucugaaauguagauuaaaaauggacaaauuagaacuuaaaggaaugucauacgcgauguguaguaacgccuucguauuaaagaaggaagugagcgaaacccagcauggaacgaucuuaaucaagguagaauauaagggagaagacgcacccugcaagauuccauuuucaacugaagaugggcaaggaaaagcucauaauggaagguuaauaacggcaaaucccgucguuacgaagaaagaagaaccaguuaacauugaagcugaaccaccuuuuggugaaucaaauauuauaauaggaauuggugacaaagcauuaaaaauaaacugguauaagaaaggaucgucuaucgguaagauguuugaggcaacagcucgaggggcucguaggauggcaauacuuggagauacagcaugggauuucgguagugugggcgggguauuaaauaguuuagggaaaaugguucaucaaauauuuggaagugcguauacugcucuauuuuccggaguaucuuggauuaugaagaucggaauaggaguucuuuuaacguggauaggcuuaaauaguaaaaacacaagcaugagcuuuucauguauaguuauagggauaauaacauuauauuugggcgcagucgugcaggcagauauggggugugucauaaacuggaaaggaaaggaacuuaaaugugguagugguauauucgucacuaaugaaguccauacauggacagagcaauauaaguuccaggcagauucgccaaagagguuagcaacugccaucgcaggagccugggaaaauggaguaugcgggauucguaguacgacacgaauggaaaaccuguuauggaaacaaauagcaaaugaauuaaauuauauuuugugggaaaauaauauuaaauuaacggucguaguuggagauauuauagguauauuggaacaagggaaacgcacccucacuccgcagccgauggaacuuaaguacagcuggaagacauggggcaaagcuaagauuguaacagcugaaacgcaaaauaguaguuuuauaauagaugggccaaauacuccugaguguccaagugccagucgcgcuuggaauguuugggaaguagaagauuaugguuucgggguauuuacaacaaacauaugguugaaacuuagagagauguauacccaacuuugugaucacagacucaugucagcagcuguuaaggaugaacgagcuguacacgcagauauggguuauuggaucgaaucacagaaaaaugguagcuggaaacuugagaaagcgucacuaauagaagucaaaacauguacuuggcccaaaucacauacuuuauggaguaauggaguauuagaaagugacaugauuaucccuaagucuuuagcaggcccaaucagccagcauaauuacaggcccggauaccauacucagacagcuggaccuuggcauuugggaaaauuggaauuagauuuuaauuacugugaaggaacgacaguggucauaacagaaaauugcgggacucgaggacccucacugagaaccacaacuguaagugguaaauuaauucaugagugguguugucgcaguuguaccuuaccuccacucagguacaugggagaggaugguuguugguacgguauggaaauacggccaauaaaugagaaagaagaaaacaugguuaaaucccuaguuucagcaggauccgguaagguggacaacuuuacaaugggaguacuaugccuugccauccuguuugaagaaguaaugagaggaaaauucggcaagaaacauaugauugccggagugcucuuuacauuuguauuguuacugucaggacaaauuacuuggagagauauggcacguacccuaauuaugauagguaguaaugcaucagaccggaugggaaugggaguaacuuaccuagcauuaauagcuacauuuaaaauccaaccuuuucuggcuuuaggauucuuuuugcgcaaacuaacaucgagagaaaacuugcuuuuaggaguuggacuagccauggcuacaacacuccaguuaccugaggacaucgaacaaauggcaaacgggauagccuuaggauugauggcguugaaacucauaacgcaauuugaaacuuaccaacuuuggacugcgcuugcaagucucauguguaguaacacgaucuucacgcugacuguagcuuggaggaccgcgacguugauacuggcuggaauaucauuauuaccaguaugucaaucgucaucaaugagaaaaacagauuggcugccaaugacuguugcagccaugggcgugcccccuuugccucuauuuaucuuuuccuuaaaagacacauuaaagagaagaagcuggccccugaaugaagggguaauggcuguugguuuaguaucaauuuuagcgucaaguuuacuuagaaaugacgugccaauggcagggccccugguagcgggcggguugcuaaucgcgugcuaugugaucacggguacaucagcugaccucacuguagaaaaagccgcugacguaacaugggaagaagaagccgaacaaacugguguuagccacaacuuaaugauuaccguggaugacgaugggacaaugcguauuaaggaugaugaaacagagaauauacugacuguauugcugaaaacagcgcuucugauaguuagcggaaucuucccuuacaguauuccggcgaccuuauugguuuggcacaccuggcaaaaacagacacaaagauccggaguguuaugggacguuccaaguccaccggaaacacagaaagcugagcuagaagaagggguuuaucggauuaaacaacaagguauauucgguaaaacacaagucggagucggagugcaaaaagaaggaguauuucacacgauguggcacguuacuaggggcgcuguucuaacccauaauggcaagagacuugaaccaaauugggcuagcguuaagaaagacuuaauaaguuauggcggaggguggagauuaucggcacaauggcaaaagggagaggaaguacaaguuauugcggucgaacccggaaagaauccaaagaacuuucaaacaaugccgggcauuuuccaaacuacuacaggggaaauuggagccauagcucuagacuuuaaaccugggacuagcggaagcccuauaauaaauagagaggguaaaguaguagggcuuuauggcaauggcguuguuacuaaaaguggaggauacgugucugggauagcucagacaaacgcagaaccagacggcccaacuccagaauuagaagaagaaauguuuaagaaacgaaaucuuacgauaauggaccuacacccaggcuccgguaaaacucgcaaauauuugccugcaauuguaagagaagcgauuaaaaggagauuacguacguuaauacuugcuccaacaagaguuguagcagcagaaauggaggaggcccucaaaggguugccuauaagauaucaaacaacagcaaccaaaucugaacacacaggaaaagaaauugucgaccuaaugugccaugcaaccuuuacuaugcgucugcuuaguccuguuagaguuccuaauuauaaccucaucauuauggaugaagcacauuucaccgauccggcaagcaucgcagcgagaggguacauaaguaccaggguaggaaugggagaagcagcagccaucuucaugacagcgacacccccagggacugccgacgcauuuccucaaucaaaugcuccgauacaggaugaggaaagggacauaccugaacggaguuggaacucugggaacgauuggaucacagauuucgccgguaaaacaguaugguuuguaccgucaauaaaagcggguaaugauauagcaaauugcuuaagaaagaacgguaagaaagucauacaacuaucucgaaaaacauuugauacugaauaccagaaaacuaagcugaacgauugggauuuugucguuacuacagauauaucugaaaugggagcgaauuucaaggcugaucgcgucauagauccaaggagaugccuaaaaccgguaauauuaacggacgguccagaaagaguaauauuggcuggccccaugccuguaacgguugcuucagcugcacaaagaagggguagaguuggccguaacccacaaaaagaaaaugaucaauacauauuuacgggucaaccguuaaauaaugaugaagaucaugcccacuggacugaggcaaaaauguuauuagauaacauaaauacgccagagggaauaauaccggcacuauucgaaccggaacgagagaaaagugcagcaauagacggcgaauauagauuaaaaggggaaagucgaaagacuuuuguagaacuaaugcgaagaggcgauuugccaguuugguuagcucacaaaguagcaucagaaggcauaaaauauacggaucgaaaaugguguuuugauggagagcgaaacaaucaaauauuagaagaaaacauggauguggaaauauggacuaaagaaggagaaaagaagaagcuaagaccaaggugguuagaugcgagaaccuacagugauccacuagcucucaaagaguucaaagauuuugcggcgggcagaaaaucgauagcuuucgaccucguaacugaaauagguagagucccaagccaucuugcacauagaacgagaaaugcuuuagacaauuugguaauguugcauacgucugaacaugguggccgugcuuaccgacaugcagucgaagaacuucccgagacgauggaaacguuacugcuacuuggcuugaugauacuauuaaccggaggggcuaugcuauuucuaauuucaggaaaggggauuggcaaaacaucuauuggauuaaucuguguaguagcuaguuccgguaugcuauggauggcagauaucccguuacaauggauagcaucggcuaucguauuggaguucuucaugaugguucuccuuauaccugaaccagaaaagcaaagaacgccacaagauaaccaacuugcguauguagugauagguauuuuaacguuagcagccauaguagcagcaaaugagaugggacuacuugaaacaacuaaacgagaccuaggcaugucaaaggaaccuggaguaguuucaccaacuagcuaccuugaugucgacuuacaucccgccagugcuuggacacucuaugcuguugccacaacaguuauaacaccaaugcuucggcacacuauagaaaauucaacagcaaacguauccuuagcggcaauugccaaucaagcgguggucuuaauggggcuagauaaaggguggccaauaucaaaaauggaucugggggugccucuauuagccuugggaugcuauagccaaguaaacccuuuaacuuugacugcugcgguacugcugcuuguaacacacuaugcaauuauagggccaggccuacaagcuaaagcuacuagagaagcccaaaaacgcacagcagcggggauuaugaagaauccgacaguagauggaaucaugacaauugaccuggaucccgucauauaugacagcaaauucgaaaaacaacucggccaaguuaugcuacuggucuugugugccgugcaguuacuacuuaugcgcacuucaugggccuuuugcgaagcgcuaacauuagcuacaggcccgauaacaacacuaugggaaggcucuccggguaaguuuuggaauacaacaauagcaguaaguauggcaaacaucuuucgaggaaguuaucuugccggggccggcuuagcauuuucgauaaugaagucugugggaacaggcaaaagaggaacugggucucaaggagagacgcuuggcgaaaaguggaagaagaaauugaaucaauuaagccgaaaagaauuugaccuguauaaaaagucagguaucaccgaaguugaccgaacagaagcaaaagaagggcucaaaaggggugagauaacgcaccaugcagugucacgcggcucggcuaaacuacaaugguuuguggaacgaaacaugguuauucccgagggucgaguaauugaucucggcugcggccgggguggcuggucauacuauugugcuggacuaaagaaaguaacagaaguaagggguuauacuaaggguggaccaggacaugaagaaccugucccgaugucaacuuauggcuggaauauaguaaaauugauguccggaaaagacguguucuaucuaccaccagaaaaaugcgauacacuuuuaugugacauaggcgaaucaagcccaucaccaacaguagaggaaagccguacaauaaggguauuaaaaaugguggaaccguggcuaaagaauaaccaauuuuguauaaaaguccuaaauccauauaugccaacgguaaucgaacacuuagagcgucuccagaggaaacauggagguaugcuaguaagaaauccucucaguaggaauaguacacacgaaauguauuggauuuccaauggaacagguaacauaguuucuaguguaaacaugguaagccggcuacuguuaaauagauuuacaaugaccuaccguaggccaacuauagaaaaagacguugacuugggagccggcacacgacaugugaaugcagaaccagaaacuccgaacauggaugucauuggagaacgcauaagacguauaaaagaagaacauucgucaacguggcacuaugaugacgaaaauccuuauaaaacgugggcguaccacgguaguuaugaaguaaaagcaacugggucugcuucaucaaugauuaauggcguggucaaauuauuaacaaaaccuugggaugucguaccuaccguaacccaaauggcaaugacggauacaacgccauuugggcaacaaagaguauuuaaagagaaaguugauaccagaacacccaaaccaaugccagguacuaggaaaguuauggaaauuacugcggaauggcucuggagaacacucgggcggaauaaacguccuagacuaugcacuagagaggaauuuacuaagaagguacguacaaacgcagcaaugggagcaguguucacagaagaaaaucaaugggauagcgcgcgagcagcaguagaagaugaggaauuuuggaaauuagucgauagggaaagagaacuccauaaacuaggcaaaugcggcagcuguguguauaauaugaugggcaagcgggagaagaaacuaggcgaguuuggcaaagcaaaagguagccgcgcaauuugguacauguggcuaggugcuagauauuuggaauuugaagcacugggcuucuuaaaugaagaccauugguuuagcagggaaaacucguauaguggcguugaaggagaaggacuacauaaacuuggauauauacuucgcgauauuagcaaaauaccaggcggugcaauguaugcggacgacaccgcagguugggacacgcguauaacagaagaugaccuacacaaugaggaaaagauaacucaacagauggacccagaacaccgacagcuagcuaaugccauauuuaaauugaccuaucaaaacaaaguagugaaaguacaaaggccaaccccuaaaggaacugugauggacauuauaucacgcaaagaucaacguggauccggccaaguaggaaccuauggacuuaauacauucacgaacauggaggcgcaacucauaagacaaauggagggcgagggagugcuuucuaaaacagaccuugagaacccccauuuacuugaaaaacgaauuacacaauggcuggaaacgaaaggaguagaacguuuaaagcgcauggcgaucaguggagacgacuguguaguaaaaccaauagaugaccgauuugcuaaugccuuacuagcacugaacgauauggguaaaguacguaaggacauuccccaauggcagcccagcaaagguuggcaugauuggcaacaagugccguucugcucacaucacuuucaugaacuaauuaugaaagacgggaggaaacuuguuguuccgugcagaccucaagaugaguuaauugguagagcacgaauaucgcagggagcugguuggagccucaaagagacagcuuguuugggaaaagcauaugcccaaaugugggcgcuuauguacuuucauaggcgcgacuuaagacucgcaagcaacgcaaucuguuccgccguuccuguacauugggucccaacaucgagaacuacuuggucuauacaugcccaucaucaauggaugacaacagaggauauguugacaguauggaauagagucuggauagaagauaacccauggauggaagauaagacaccggucaccaccugggaagacguaccuuaccuaggaaaaagagaagaccaaugguguggcucucucauagggcuaacaucaagggcaaccugggcacagaacauacuaacagcgauccagcagguuagaaguuuaauaggaaaugaggaauuuuuggauuauaugccaagcaugaagcgguuucguaaagaggaagaguuagaaggagccauaugguaa

SEQ ID NO: 22989 - RNA, 9873 nt, Artificial Sequence
  derived and/or modified CDS sequence (opt6) from DENV-3__AB214882__SS-prME
acaagucuuugccuuaugaugaugcucccagcaacauuagcuuuccaucucaccuccagagauggagaaccaagaaugauuguagggaaaaaugaaagaggcaaauccuuauuauucaaaaccgcaagugguauaaauaugugcacuuuaauagcaauggaucuaggggaaaugugugaugacacuguaacauacaaauguccuuuaauaaccgaaguggaaccggaagacauagauuguuggugcaauuuaacaagcacaugggucacuuaugguacgugcaaucaagcaggcgagcaucgucgagauaaacguagcguugcacuggccccucacguugguaugggauuagacacgagaacgcaaacguggaugucugcagagggagcauggagacaaguagaaaaaguagagacaugggcauuccggcauccgggauuuaccauacuggcucuuuuucuggcccauuauauuggcaccucuuugacucaaaaaguuguaaucuuuauucuacuuaugcuagugaccccgagcaugacuaugagaugcguugggguaggcaauagagauuuuguagagggacuaucaggagcaacauggguagauguaguauuagaacacggaggaugugucacaacaauggcgaaaaacaaaccgacucuagacauagaacuucagaaaacugaagcaacucaauuggcaacauuaagaaaauuaugcaucgaagggaaaauaacaaacguaacuacagauaguagauguccuacucaaggcgaggcaauucuuccagaagaacaagaucaaaacuaugucuguaaacauacguacgucgaucgggguuggggaaauggaugugguuuauucgguaaaggaucucuaguaacaugugcaaaauuucaauguuuggaaucgaucgaaggcaaagucguccaacaugaaaaucucaaguauacgguuauuauaacuguacacacgggagaccaacaccaagucgguaacgaaacucaggguguaaccgcugaaauuacgccucaggcgagcacugucgaagcuguacuaccagaguacgguacuuuaggacucgaauguucuccgaggacaggguuggauuuuaacgagaugauccuauuaacuaugaaaaauaaggccuggaugguccaucgucaaugguucuuugauuuaccacuaccuuggacuuccggagccacaacugagacccccacauggaacaagaaagaauuauuaguaaccuuuaagaacgcacacgcgaagaaacaggaggucgucgugcucgguucccaagaaggggcaaugcacacagcauuaacaggagcaacagaaauacaaacgucagguggaacaaguauauuugccggacaucugaaaugucggcuuaagauggauaaauuggaauuaaaaggaaugagcuacgcaauguguucaaaugcauucguuuugaagaaggaggugucugaaacccagcacgguaccauucuaauaaaaguagaguauaaaggugaggacgcgccuuguaaaaucccauucagcacagaagauggucaaggaaaagcgcacaauggucgacuuauaacagcaaacccgguuguuacuaagaaagaagaaccagugaacaucgaagccgaaccaccuuuuggagagucaaacauaauaauaggaauaggugauaaagcucuaaaaaucaacugguauaagaaagggucuaguaucgggaaaauguuugaagcgacagcuagaggagcuagaagaauggcaauauuaggugacacugcaugggacuuuggaagugucggcggaguuuuaaauucgcuugggaaaaugguacaucaaauauucggaagugcauauacugcauuauuuagugguguuuccuggauuaugaaaauagggauaggagucuuacuaacauggauaggccuaaacaguaagaacacaucuaugucuuucaguuguauaguaauaggaauuauuacacuuuauuuaggagcaguaguucaagccgauaugggguguguuauaaacuggaaaggcaaagaacuuaaauguggaagcggaauuuuuguaacuaacgaaguccauacauggacugaacaguauaaauuucaagcagacucgccaaaacgccuggcgaccgccauagcuggcgcuugggagaauggaguauguggaaucagaaguacuacaagaauggaaaaccuucuauggaaacagauagcaaaugaacucaacuauaucuugugggaaaacaacauuaaauugacugucguggucggggacauaacaggcauucucgagcaaggaaagaggacauuaacaccucagccaauggaacucaaauacucuuggaaaacaugggguaaagcgaaaauaguaacugcagagacacaaaauaguucauucauuauugauggaccaaauacccccgaguguccuucugcuagcagagcguggaacguaugggaagucgaagacuaugguuucggagucuucaccaccaauauaugguuaaaacugcgugaaauguauacucagcucugcgaccauaggcucaugagugcagcgguuaaagaugaacgagccgugcaugcagauaugggcuacuggauugaaagucaaaagaaugguaguuggaaacuggaaaaagcaagucugauugaaguuaaaacuuguacguggcccaaaagucacacucuauggagcaacggaguauuagaaucugauaugauuaucccuaaaucacuagccggccccauaucucaacauaauuauagaccagguuaucacacacaaacugcaggcccauggcauuuaggcaaacuagaacuagauuucaauuacugcgaaggaacaacaguaguuaucacugagaauuguggcacuagaggucccucucuaagaacuacaaccguuucaggcaagcucauccaugaaugguguuguagaagcuguacauugccaccauuacguuauaugggagaagauggcugcugguacggaauggagauaagaccuauuaaugaaaaagaggagaauauggugaaaaguuuaguuucagccgguaguggaaagguugacaacuuuacaaugggaguacuguguuuggcuauucuuuuugaagagguaaugcgugggaaauuuggaaagaaacacaugauagcugguguauuguuuacuuuuguacuauuacuaucaggucaaauuacauggagagauauggcgcguaccuuaauuaugauaggaaguaacgccuccgaucgcaugggcaugggcgucacauaucucgcgcugauugccacauuuaagauucaacccuuuuuagcucuaggguucuuucuaagaaagcugacaucuagagaaaacuugcuauuggguguugguuuggcuauggccacaacucuacagcuaccugaagauauagaacagauggccaacggcauugcuuugggauuaauggcauuaaaacugaucacucaauuugaaaccuaucagcuauggacugcuuuagcaagucucaugugcucgaauacaauuuuuacucuuacaguagcauggcgaaccgcaaccuuaauauuggcagguauaucauugcuuccaguaugucaaagcaguucuaugaggaagacggauugguuaccuaugacaguugcugcaaugggggucccacccuuaccuuuauuuauauucucucuaaaagacacauugaagagaaggucguggccauugaacgaagguguaauggcaguaggcuuaguuaguauauuagcaagcucuuuacuacguaacgacgugccuauggcagggccucucguggcaggggguuuacugaucgcauguuauguaauuacgggaacuuccgcagauuuaacaguggaaaaagcagcggauguaacaugggaagaagaagcugagcagaccgguguaagucauaaccuaaugauuacaguagacgaugacggaacuaugcguauuaaggacgaugaaacugaaaauauacucacggugcuguuaaagacggccuugcuuaucguuuccggaauauuuccuuacagcaucccagcaacucuccuugucuggcauacuuggcaaaagcagacucaaaggucaggaguacuuugggacguaccuucaccaccugagacgcagaaagcagaacuagaggaaggaguguacagaauuaaacaacagggaauauuuggcaaaacccaaguaggcguagguguacaaaaggaaggagucuuccacacuauguggcauguuaccagaggcgcagugcuaacccacaaugguaaaagauuagaaccuaauugggcaucagucaagaaagaccuaaucaguuauggcgggggauggcgccucagcgcacaguggcaaaaaggugaagagguacaaguaaucgcaguugaaccugggaaaaacccuaaaaacuuucagacaaugccugguauuuuccaaaccacaacaggcgaaauaggagcuauagcccuggacuuuaagccuggaacgucugggucuccuauuauaaaucgagaggggaagguaguugggcuauauggaaacggagucguaacaaaaaguggcggauauguaaguggcauugcucaaacuaacgcugagccagacggaccaacaccagagcuagaagaagaaauguuuaagaaacgaaaccuaaccauaauggauuuacauccaggguccggcaaaacacgaaaauaucuuccugcaauaguucgcgaagcuauaaagcggcgguuacgcacauugauuuuagcgccgacccgaguaguugcggcugaaauggaagaagcauuaaaaggcuugccuauccgauaucaaacgacagcaaccaaaagugaacacacaggaaaagagaucguagaucuaaugugccacgcaacauucacaaugcgucuacuaagcccaguaagagucccaaauuacaaucugaucauaauggacgaagcgcauuuuacugauccagccaguauagcugcaagaggauacauaagcacaagaguagguaugggggaagccgcagcaauauuuaugacggcaacuccgccugggacagcggaugccuucccacagucaaaugccccaauucaagaugaagaacgagauauaccagagaggucauggaauagcgggaacgauuggauuaccgacuucgcuggaaagacagucugguucguuccgucgauaaaagcaggaaaugacauagcaaacugcuugaggaaaaacggcaaaaagguaauccaacuuucgagaaagacguucgacacagaauaucagaaaacaaaacuaaaugauugggauuucgucguaacaacugauaucagugagaugggcgccaauuuuaaagcagaucguguuaucgacccgagaagaugucuaaagccgguaauacucacagaugggcccgagagggugauacuagccggaccgaugccuguaacgguugccagugcggcacagcggagagguagaguaggacgcaauccgcaaaaagagaaugaucaauacaucuuuacuggccaaccucuuaacaacgacgaagaucaugcacacuggaccgaagccaaaaugcuuuuagacaauauaaauacuccagaaggcauaauaccugccuuguucgaaccggaaagagaaaaaucugcagcaauagacggugaguaucggcuuaagggcgaaagcaggaaaaccuuuguugaacuaaugagaagaggcgaucuucccguaugguuggcgcauaaaguggcuagugaaggcauaaaauauacagacagaaaaugguguuucgauggagaaaggaauaaucagauauuagaggagaauauggacguagaaaucuggacaaaagaaggagagaagaagaaauuacgaccgcggugguuagaugcccguaccuauucagacccauuggcacucaaagaauuuaaggauuucgcugcaggacgcaaaagcauagcguucgaccuuguaacggaaauaggaaggguccccucacaccuugcucauagaacgcgaaaugcucuugauaauuuaguaaugcuccauacgagugaacacggaggucgugccuauaggcaugcgguagaagaguuaccagaaacuauggagacacuacuacugcuuggccuaaugaucuuacuaacuggaggagcuaugcuguuccuuauaucaggaaagggaauagguaaaacaucgauuggauugauaugcguuguagccucuuccggaauguuauggauggcugacauuccucuucaauggauugcaagugcgauaguccuugaauuuuucaugaugguacuauuaauucccgagccagaaaaacaacgaacuccacaggacaaccaacuagcuuaugugguuauugggauacuaacccuugcagcgauuguagcugcgaaugaaaugggauuauuagagaccacuaaacgugaucucgguaugagcaaagaaccuggcguggucucuccuacaucauauuuagaugucgaucuucauccugccucagcuuggacuuuauaugcuguagcuacaaccguaauuaccccaaugcuaagacacacuaucgaaaacaguacugcaaacgugagccuggcugcuaucgccaaccaagcggucguuuuaauggguuuggacaaagguuggccuauuucaaaaauggaccucggcguucccuuguuagcgcuuggauguuauagucaggugaauccuuugacacuaacugcagcuguauuacuccugguuacacauuaugccaucauaggaccagguuuacaagcuaaagcuacaagagaagcucaaaaacguacagcagcagguaucaugaaaaauccaaccguggacggaauaaugacaaucgauuuagacccugugaucuacgacucuaaauuugagaagcaauugggucaagucauguuacucguucuaugugcuguacaauuauuacugaugagaacgucaugggcguuuugcgaagcacugaccuuggcuacugguccgaucaccacgcuaugggagggguccccuggcaaauuuuggaauacaacuauagcugucagcauggcaaacaucuuuagaggaucuuaucuagccggugcaggguuagccuucucaauuaugaaauccgugggaacagggaaaagaggaacaggaucccagggggaaacuuugggcgaaaaauggaagaagaaacugaaucaauuaagccgaaaggaguuugaucucuacaagaaauccgggauaaccgaaguagaucgcacggaagcuaaagaaggcuuaaagcgaggugaaauaacacaucaugcugucucacgaggcucugcuaaacuacaaugguuugucgagcgaaacaugguuauuccggaaggucggguaauagauuuaggaugcggucgagggggauggaguuauuacugcgcagggcuaaagaaagugacggaaguuaggggcuacacaaaaggagguccuggucacgaagaacccguaccuaugaguaccuacggauggaauauaguuaaacuaaugaguggaaaagauguuuucuauuuaccucccgaaaaaugcgacacacuuuuaugcgauauuggcgaaucuucgccaaguccaacuguugaagaaagucguacaauacguguauuaaaaaugguggaaccuugguugaaaaacaaccaauucugcauuaagguacuaaacccauacaugccgaccgucauugaacauuuagaacgucuacaacgcaaacacggaggaauguuagucagaaauccacugucacguaacaguacacaugagauguauuggauuucaaauggaaccgggaauaucguaaguaguguaaacauggucucuagauuacuauuaaauagauuuacgaugacauacaggaggccaacuaucgaaaaagauguagaccuaggcgcuggaacucgacauguaaaugccgaaccugagacacccaauauggaugugauaggggaacguauuaggcguauaaaagaagaacauucuaguacauggcacuaugaugacgaaaacccuuauaaaacaugggcuuaucacggaucuuacgaaguuaaagcgacgggcucagcaagcaguaugaucaacggcguaguaaaacugcuuacaaagccaugggauguaguaccuacuguaacccaaauggccaugacagacacuacuccauuuggacaacaaaggguuuucaaagaaaaaguagauacaagaacaccaaaaccaaugccugguacuagaaaaguaauggagaucacugccgaaugguuauggcgaacgcucggaaggaacaaaagaccaaggcuauguacacgagaagaguucacgaagaaaguacgcacuaaugcggcuaugggagcggucuucacagaggaaaaccaaugggauuccgcaagagcggcuguugaagaugaagaguucuggaaguuaguagaccgcgagagggaacuccacaaauuaggcaaaugcgggucaugcguuuauaauaugaugggaaaacgggagaagaaauugggugaauuugguaaggcaaaggggucaagagcaauuugguacauguggcucggagcacgauaucuugaauuugaagcguuagguuucuugaacgaagaucacugguucucaagagaaaauagcuacucagggguugaaggagaaggacuucauaaacuuggcuacauauuacgugauauuucaaagauaccggguggagcuauguacgcugacgauaccgcugggugggacacgagaauaacagaagaugauuuacauaaugaagagaaaauaacacagcaaauggauccggaacacagacaguuagcaaaugccauauucaaguuaaccuaucaaaauaaagugguaaaaguucaacggcccacgccgaaagggacgguaauggauauaaucucccguaaagaccagcgggguaguggccagguagguacuuaugggcuaaacacauucacuaauauggaagcucaacuaauaagacaaauggaaggcgaaggcguuuugucaaaaacagauuuagaaaacccccaccuauuagaaaaacgaaucacccaauggcuagaaacaaagggcguagaacgguuaaaacguauggccauauccggcgaugacuguguaguaaagccaaucgacgaucguuuugcgaaugcacucuuggcuuuaaaugacaugggaaagguaagaaaggauauaccccaauggcaaccaagcaaaggcuggcacgacuggcaacaaguaccuuucuguagucaccacuuccaugaacuaauaaugaaggacggccggaaauuagugguuccauguaggccucaggaugaacuuaucggcagagcaaggauaucccagggggccggauggucauugaaagagacugccugccuuggaaaggcguacgcacaaaugugggcuuuaauguauuuccaccguagggauuuacgacucgcaaguaacgcaauaugcucagcugucccaguucacuggguaccaacaagucguacuacuugguccauucaugcacaccaccaauggaugacaaccgaagauauguuaacaguuuggaacagaguauggauugaggauaacccuuggauggaagauaaaacccccguaacaacuugggaggacguuccauaucuagggaaaagggaagaccaauggugugguagccuaauaggacugaccuccagagcaacaugggcucaaaauauccuaacagcaauccaacaagugcgcaguuuaaucggaaacgaagaguuucuagauuauaugccgaguaugaaacgauuuaggaaggaagaagaaucagaaggggcaauaugguag

SEQ ID NO: 22990 - RNA, 9873 nt, Artificial Sequence
  derived and/or modified CDS sequence (opt6) from DENV-3__JX669489__SS-prME
acaagucuaugucuaaugaugauucuaccugcagcgcuagcuuuucacuuaacaaguagagauggggaaccuaggaugauuguaggcaaaaaugaaagagggaaaucauuacuauuuaaaaccgccaguggaauaaauauguguacucucaucgccauggaccuaggagagaugugugacgacaccguuacguauaaaugcccucacauaacagaaguagaaccagaagauauagauugcugguguaauuuaacuagcacauggguuacuuauggcacuuguaaccaagcuggagagcgcaggagagauaaacguucagucgcuuuggcaccccacguagggaugggucuagauaccagaacgcaaacauggaugucggcagaaggagcauggcgccaaguugaaaaagucgagacuugggcucuaaggcauccaggauuuaccauauuagcauuguuuuuagcacacuacauagguacgucucuaacacaaaaagucguuauauuuauacuucuaaugcuaguaacacccagcaugaccaugcgauguguuggaguagguaacagagauuucgucgagggucuaaguggggcgacauggguugauguaguuuuggaacaugguggaugcguaacaacgauggccaaaaacaaaccaacacuagauauagaauugcagaaaacugaagcuacacaacuagccacccuacguaaauugugcauagaagguaaaauaacuaauauuacaacggauaguagaugcccaacgcaaggagaagcgguacuuccagaagaacaggaucaaaacuacguaugcaaacacacuuacguagacagagggugggguaaugguuguggguuauuugggaaaggaucucuaguaaccugugccaaauuucaaugccuggagccaauagaagguaaagucgugcaauaugaaaaucuaaaauauacaguaauuauaaccguacacaccggugaccaacaccaaguagggaaugagacucaaggggucacagcagaaaucacuccacaagcaucgacuacggaagccauauuaccagaauauggcacgcuuggucuagaaugcucgcccagaacgggccucgauuuuaaugagaugaucuuacuaaccaugaaaaauaaggcuuggaugguucauaggcaaugguuuuucgacuuaccguuaccuuggacuucaggggccacaaccgaaacgcccaccuggaacagaaaagaacuccuugucacauucaaaaacgcacaugcgaagaaacaagaaguuguaguacuuggcucccaagaaggugcgaugcacaccgcuuuaacgggugcuaccgaaauccagaauaguggagguacaucuaucuucgccggccaccuaaaaugcagauuaaaaauggauaaacucgagcuaaaagggaugucuuacgcaauguguacaaauacauuugugcucaagaaagaaguaagugaaacccaacacggaacuauauuaauuaaaguggaauauagaggggaagaugcucccuguaaaauaccauuuagcacugaagacggccagggaaaagcacacaauggaaggcuaaucacggcaaauccgguuguuacgaagaaagaagaaccuguuaacaucgaagccgaaccgcccuuuggagaaaguaacaucguuaucgguaucggagauaacgcuuuaaaaauaaauugguacaagaaaggaagcagcauugggaaaauguucgaagcaaccgcuaggggcgcaagaaggauggcgauauuaggagauaccgcaugggacuucggcagcguaggcggaguacuaaauucgcugggaaaaaugguacaccaaauauuuggaucggcuuauacagcucuauuuucaggagucucaugggugaugaaaauugggauagggguauuacucacuuggaucggauuaaauaguaaaaauaccucgaugagcuucucgugcauagcaauuggaauuauaacucucuaucucggcgcaguaguacaggccgacaugggaugugugauuaauuggaaaggaaaagaacugaaaugcggaaguggaauauuuguuacaaacgaggugcacacauggacagagcaguacaaauuccaagcagauagcccuaaaagauuggcaacggcaauagcaggcgccugggaaaauggcguuugugggauucgaucaacaacgagaauggaaaauuuacuguggaaacaaauugcaaaugagcucaauuauauccuuugggaaaauaacaucaaacuaaccguaguuguuggggacauuauaggcguucuggaacaaggaaaacgaacuuugacgccucaaccgauggagcuuaaauacagcuggaaaacauggggaaaagcuaaaauuguaacugcugaaacucaaaacaguagcuucauaauagacgguccuaacacgccggaaugucccucagcaucuagggcuuggaacgugugggaaguagaggauuaugguuucggaguguucacaacgaauauauggcuaaaauugagggaaguuuauacacaauuaugcgaucaucgauuaaugucagcugccgugaaagacgaaagggccguucacgcugauaugggauacuggaucgaaagccagaaaaauggguccuggaaacuggagaaggcuagucucaucgaaguuaaaacgugcacuuggccaaaaucgcauacacuguggucgaacggagugcucgaaucagauaugauuauaccaaaaagucucgccgguccgauuucacaacauaaccacaggccgggauaucauacucagacagccgggccuuggcacuugggcaaacuugaacuagauuuuaauuauugcgaaggcacuacaguaguaauaacagaaaauugcgguacacguggucccucucuucgaacaacaacuguauccggcaaauuaauucaugaguggugcugccgcuccugcacucuaccucccuugagauacaugggcgaagauggauguugguauggaauggaaauacgacccauuucugaaaaagaggaaaacauggugaaaucgcuugucagcgcgggaagcggaaaggucgauaacuucacgauggggguacuauguuuagcaauuuuguucgaagaagugaugcgcggcaaauucggcaagaaacauaugauagcggggguguuguuuacauuugugcuacuucuaucaggucaaauaaccuggagagauauggcucacacucuaauuaugauaggaucgaacgcgagugaccggaugggaaugggaguaacuuaucucgcucucaucgccacuuuuaaaauccaacccuuuuuggcguugggauucuucuuacguaaauuaaccaguagggaaaaucuacucuuagguguaggccucgcgauggcuacaacucugcaacuaccggaagauauagaacagauagcuaauggaauugcguuaggauuaauggcccucaaacuuauaacacaauuugaaacauaccaauuguggacugcauuaauuucacucacuugcucaaauacgauguucacuuugacuguugcauggcgaacagcaacacuuauuuuggcuggaguguccuuauuaccggucugccaaaguucuucaaugagaaaaacggacugguuaccuauggcaguugccgcuauggggguaccaccauuaccauuauuuauauuuagcuugaaagacacauuaaaacggagaucauggccacucaacgagggaguaauggcgguaggccuaguuucgauacuugcgagcucauuacuaagaaaugauguuccaauggcgggaccccuaguagcugguggauuacuaaucgcauguuaugugauuacaggaacuuccgcagaucugacagucgaaaaagcggcggauauaacuugggaggaagaagcugagcagacaggaguuagucauaaccuaaugauuacggucgaugaugacggaacuaugcgaauaaaagacgacgaaacagaaaacauuuuaacaguuuuguuaaaaaccgcacuucuaauaguuagcggcguauucccguauucaauaccagccacgcucuuaguguggcauacuuggcaaaaacaaacgcagaggagcggaguuuuaugggacguaccaaguccaccugaaacacaaaaggcugaauuagaggaaggaguauaucgaauaaaacaacaaggaauauuugguaaaacccagguagguguaggaguacagaaggaaggagucuuccacacaauguggcauguuacuagaggugcuguucuuacguacaaugguaaacgucuugagccgaacugggcgucuguaaagaaagaucuuauuucauauggugguggauggagauuaagcgcucaauggcaaaaaggagaagaaguacagguaauugcaguggaaccagggaaaaacccgaaaaacuuucagaccaugcccggaacauuucagacuacgacaggagagaucggagcaaucgcguuagauuuuaagccaggcacgucagguucgccuauaauaaaucgcgaaggaaaagugguaggacuguauggaaaugggguaguaacaaagaauggaggauacguaagugggauagcgcagacuaacgcagaaccggauggaccaacuccggaacuagaggaagaaauguucaaaaagagaaaucuaacaaucauggaucugcaucccggaucaggaaaaacaagaaaauaucuacccgccaucguccgugaagcuauaaaacgaaggcuaaggacacuaauucuagcucccaccagagucguagccgcugaaauggaagaagcucuaaaaggucugccuauaagauaccaaacuacugcaacaaaaagugaacauacuggacgggaaauagucgauuuaaugugucacgcgacguucacuaugcgguuacuuucacccguucgaguaccaaauuauaaucuaauaaucauggaugaggcacauuuuacggauccagcuucgauagcagcaagaggauauauuagcacacgaguaggaaugggagaagcagcagcaauauucaugacagcaacgccgcccggaacggcagaugcguucccccagaguaaugccccaauacaagacgaagaaagggacauuccagagaggaguuggaacuccggaaaugaauggaucacugauuucgcggguaaaacaguaugguucguacccucaauuaaagcaggaaaugacauagcaaauugcuugcgaaagaacgggaagaaaguuauacaacuaagcaggaaaacuuuugacacggaauaccagaaaacaaaacucaaugacugggauuucgugguaacaacagauauaagugaaaugggagcaaacuuuaaagcggauagagugaucgauccccgacgaugcuuaaagcccguuauauugacggacgggccugagaggguuauccuugcugggccuaugccgguaacggcagcaucugcugcacaacgaaggggaagaguaggucgaaauccgcagaaggagaaugaccaauacauauuuacuggucaaccacuuaauaaugacgaagaccacgcgcacuggacugaagcuaaaaugcuucuggacaauauaaacacaccggaagguaucauccccgcccuauuugaaccagaacgggagaaaucugcagccauagacggggaguacaggcuaaagggggagucgaggaaaacuuucguggagcucaugagacggggugaucuacccguuugguuagcucacaaaguagcguccgaggguauuaaauauacagaucgaaaauggugcuucgaugggcaaagaaauaaucaaauacuagaggaaaauauggacguggaaauauggacaaaagaaggcgagaagaagaaacugagaccgagauggcuugaugcgcgaacuuauagcgauccacuagcucuaaaagaauuuaaagacuuugcagcagggagaaaaagcauagcgcuugaccuaguaacagagauaggcagaguaccaucccacuuggcccaccguacaagaaaugcuuuagacaaucuaguaaugcuacauacaagcgaacauggaggacgagcauacagacacgcgguugaagaacuaccagaaacaauggaaacauuacuauugcuagggcuuaugauacuauugacaggaggagcaaugcucuuucuaauaucugguaaagguauaggcaaaacgucaauuggccuaauauguguuauagcgagcucaggaauguuauggauggcagagauuccccuucaauggauagcaagugcgauuguacucgaauuuuucaugaugguacuauuaauaccggagccagagaaacaacgaacgccacaggacaaccaguuagcuuauguagucauugguauauugacgcuggcagccauaauagcugcgaacgaaaugggccuacuugaaacaacuaaaagggauuuaggaaugucuaaagagccggguguagucucgcccacuucguaccucgauguggaucuacacccagcaucagcauggacccuuuaugccguugcaacaaccguuauaacaccgauguuaagacauaccaucgaaaauucaacagcaaauguaucgcuugccgcuauagcaaaccaggcagugguuuuaaugggguuggauaaaggauggccaauuucuaaaauggauuuggguguuccacuguuagcgcuaggauguuauagccaaguuaacccauugacuuuaacugccgcuguguugcuauuaauaacccacuaugcaauaauuggaccaggguuacaagcgaaagcuacacgagaagcucaaaagcgcacagcagcggguaucaugaaaaauccgacaguugaugguauaaugacaauagauuuggauccagucaucuaugauaguaaauucgaaaagcagcuaggacaaguaauguuauuaguacuaugcgcgguacagcuacuucuuaugaggacgucuugggcuuuaugcgaagcucucacacuugcgacagggccgauaaccacgcuaugggaaggcucuccuggaaaauucuggaauacuacgauagcuguguccauggcuaacaucuuuagaggaucauaucuagcaggggccggucucgccuucagcauaaugaaaaguguuggaaccggaaagagaggaacuggcagccaaggagaaacuuuaggagaaaaauggaagaagaaauuaaaucagcuaucuaggaaagaguucgaucucuauaagaaaucugguaucacggaaguugacagaacggaagcaaaagaaggcuuaaaacguggggaaauaacacaccaugcuguuagcagagguagcgccaaauuacagugguuuguagagcggaauauggugauacccgaaggacggguaauagaucucgguugcggacgaggagguuggucguauuacugugcaggguugaagaaaguaacggaaguucgcgguuacacaaaaggagggccaggacaugaagaaccgguaccuaugucuacguacggguggaacaucguaaaacucaugagugguaaggacguauuuuaucucccaccugaaaaaugugacacauuauuaugugauaucggagaaucgagcccuaguccgacaguagaagaaucgagaacaauacgaguacuaaaaauggucgaaccguggcucaaaaacaaccaauucuguauaaagguccuaaacccuuacaugccuacggugauugaacauuuagaaagacuucaaagaaaacaugguggaaugcuuguacgcaacccauuaagucgaaacucgacccaugaaauguacuggauuagcaacgguacagguaauaucgucgcguccguaaauaugguuucuagacuuuugcucaaucgauuuacaaugacucauagaagacccacaauagaaaaagauguagaccuuggagcugggacacggcauguaaacgccgaaccagagacgccuaauauggauguaauuggggaaagaauaaagagaauuaaagaggaacacaauaguacauggcacuaugacgaugaaaacccauacaaaacaugggcauaccacggcagcuaugaaguuaaagcuacgggcagcgcaagcagcaugaucaacgggguaguaaaacuauuaacaaaaccuugggauguaguuccuaugguaacgcaaauggcuaugacggauacuacuccuuucggacaacaacggguauuuaaagaaaagguggauacaagaacaccacguucaaugccugguacuagaagaguaaugggaauuacggcugaguggcuguggcgaacacuaggucguaacaagaaacccagacuauguacaagggaggaauuuacuaagaaaguuagaacaaacgcagcaaugggcgcaguauucacagaagaaaaccaaugggauagcgcuaaagcggcaguugaagaugaggauuucuggaagcuaguagacagagaacgugaacuacauaaacuaggaaaaugcggcagcuguguauacaauaugaugggaaagcgagagaagaagcuaggagaauuuggcaaggcaaaaggaagucgagcaauuugguacaugugguuaggggcgagauaucuggaguuugaagcgcuaggcuuucuaaacgaagaucacugguucagucgagaaaauucauauucuggaguagaaggugaaggccuacacaaguuaggauacauucuacgagacaucagcaaaauuccagguggagcuauguaugcagaugauacugccggaugggacacaagaaucacagaagaugaccuucacaaugaagaaaagauaacucaacaaauggauccagaacaccgacaauuagcuaaugccauuuuuaaacugacauaccaaaauaagguuguaaaaguucaacgcccaacuccaacugguacuguaauggacauuauaaguagaaaggaccaaagggguucuggucaggucggcacauauggccuaaacacuuuuacaaacauggaagcucaauugauuagacaaauggaaggggagggaguccucucaaaagcugauuuggagaauccacaucuuccggagaagaaaaucacgcaauggcuagaaacuaaagguguagaaagauuaaagcguauggcaauuucgggagaugauugcguaguaaagccaauugaugauagguuugcgaaugcauuguuagcuuuaaacgauaugggaaaagugagaaaagauauaccgcaauggcaacccucaaaaggauggcaugauuggcaacaaguacccuucugcagccaccauuuucacgaguuaauaaugaaggacggccgaaaauugguaguaccuuguagaccccaggacgaacuaauuggucgggcaaggauuucacaaggugccggguggaguuuaagggaaacagcaugccuaggcaaagccuaugcucaaauguggucauugauguauuuucauagacgagaccucagacuugcguccaacgcaauaugcucugcagucccuguacauugggugccaacaucaagaacaacauggagcauucacgcucaucaccaauggaugaccaccgaagauaugcuaacgguauggaaucggguauggaucgaagacaacccauggauggaggauaaaaccccgguuacaaccugggaaaaugugcccuauuuaggcaaaagagaagaucaauggugcggaucguugauagggcuuacaucaagagcgacaugggcccaaaauauaccuacagcaauucaacagguccgcagcuuaaucggaaacgaggaguuuuuagauuacaugccuaguaugaagcgauucagaaaagaagaggaguccgaaggugcaauuugguga

SEQ ID NO: 22991 - RNA, 9873 nt, Artificial Sequence
  derived and/or modified CDS sequence (opt6) from DENV-3__JX669498__SS-prME
acaucgcuaugccuaaugaugauacuaccagcagcauuagcguuucacuugacuucaagagauggugaaccaagaaugauagugggcaaaaaugaacgcggaaaaucccuacucuucaaaaccgcaucaggaauaaauaugugcacacuaauagcuauggaccuuggcgagaugugcgaugauacagucacuuauaaauguccacacaucacagaaguggaacccgaagauauugauuguuggugcaaucucacgucuaccuggguaacauaugguaccugcaaucaagcgggggagcguagacgcgacaaacguucuguggcuuuagcaccacauguagguaugggccuagauacaagaacgcaaacguggaugagugcagaaggagcauggcggcaaguagagaaaguagaaacaugggcuuuaagacaccccgguuuuacaauuuuggcucuauuucuugcccacuacauuggcacaaguuuaacccaaaaagucguaauuuuuauacuauuaauguugguaacuccgaguaugacaaugaggugcguagguguagguaaccgggacuuugucgaaggccucucuggggccaccuggguugauguuguauuagaacacggagguuguguuaccacaauggcuaaaaauaaaccaacauuggauauugaauuacagaaaacggaggcuacacaauuagcgacgcuaaggaaauuauguauagaaggaaaaaucaccaauauaacaacagacucacgauguccaacacaaggugaagccguacugccagaagaacaagaccaaaacuaugucugcaaacauaccuacguugaucguggauggggaaacggauguggucuguuuggcaaaggcagcuuaguaacaugugcaaaauuucagugcuuagaaucgauagaaggaaaagugguacaauaugagaacuugaaauauacuguaauuauuaccguacacacaggugaccaacaccaaguugguaacgaaacgcaaggcguaacugcagagauaacaccacaagcgucgacuacugaagcaauucucccagaauacgguacauuaggauuagaguguagcccaagaacaggauuggauuuuaacgaaaugauucuuuuaacgaugaaaaacaaagccuggaugguucauaggcagugguucuuugaccuuccacuuccauggaccaguggcgcaacaacagaaacaccuaccuggaauagaaaagaacuucuugucacguucaaaaaugcucacgccaagaaacaagaggucgugguccuggguucgcaagaaggagccaugcacacggcauugaccggugccacagagauucaaaacaguggagggacaucgaucuuugcaggccacuuaaaaugccgacuaaaaauggauaaacuugaguuaaagggcaugagcuaugcuaugugcacuaauacauuuguacucaagaaagaaguaagcgaaacucaacacggcacaauucugauaaaaguugaauacaaaggugaagaugcuccauguaaaauaccauuuucaacagaagauggccaaggaaaagcgcauaacggaagguugauaacagcuaauccuguaguuacuaagaaagaagaaccagugaacauagaagcagaacccccauuuggcgaaucaaauauugugauagguacaggagauaacgcccuuaaaauuaauugguauaagaaaggcagcucaauaggcaaaauguucgaagcuacggcaagaggagcccgaagaauggcuauuuugggagacacagcuugggacuuugggaguguuggaggaguucuuaauucguuaggaaaaaugguacaucaaauauucggcucggccuacacagcacuauucaguggaguaaguuggguaaugaaaauaggaauaggaguauuguugacuuggauaggacuaaacagcaaaaauacuucuaugucauucucauguauagccauagggauuauaacgcuuuacuugggugcuguuguacaagcagacaugggaugcgucauuaauuggaaagguaaagaacugaaaugcggaucgggaaucuuuguuaccaaugaagugcauacauggaccgagcaguauaaauuccaagcugauucucccaaacgccuugcaacugcuauugcaggagcgugggaaaauggcguaugugguauaagaagcaccacccgaauggaaaacuuguuguggaaacagauugcaaacgaacuaaauuacauacuuugggaaaauaacauaaaauuaacagucguuguaggugauaucauaggcguauuagaacaaggaaaacgcacauugacgccacagccgauggaacucaaauacucguggaaaacguggggaaaagcuaagauagucacugccgagacacaaaauuccagcuucauaauagacggaccaaacacaccagaguguccaucagcuagucgugcuuggaaugucugggaaguagaagauuauggauucgggguguuuaccacgaauauauggcugaaauugagagaaguguacacacaauuaugugaucacaggcuuaugucugcagccgucaaagaugaacgagcuguccaugcugacauggguuacuggaucgagagccagaagaaugggucauggaaacuggaaaaggcaucucuuauagagguaaaaacuugcacguggccuaagucacauacgcucuggaguaaugggguuuuagaaagcgacaugauuauaccuaagagucuagcugggccuauaucccaacacaaucacagaccuggguaccauacacagacugcagggccauggcauuuggguaaacuagaauuagauuuuaauuauugugaaggaacaacgguaguaauaacagaaaauugugguacaaggggcccaucauugagaacgaccacagugucuggaaaacuuauacaugaaugguguugucgaucauguacacuaccgccacuaagguacaugggcgaagacggguguugguaugggauggaaauacgaccuauaagugaaaaagaggaaaacaugguaaaaucccuuguauccgcugguuccgguaagguggauaauuucacaaugggaguacuuuguuuagccauuuuauuugaggagguaaugagggggaaguucggaaagaaacauaugauugcaggaguguuuuucaccuuuguucuuuuguuaucaggucaaaucacauggagagacauggcgcacacucuuauaaugauaggaucuaaugcaucagaucgaaugggaaugggcgugaccuauuuagcccuuauagcuacauucaaaauacagccauuccuugcucugggguucuuucuaagaaaacuaaccucuagagaaaaucuucuauuaggagucggacuugcaauggcgacaacauuacaauuaccugaagauauagaacaaauggccaauggaaucgccuuaggccugauggcauugaaacuaauaacacaauucgaaacauaucaauuauggacggccuuaauaucacuuacauguaguaacaccauguuuacacuaacaguagcauggcgaaccgcgacuuuaauccuagcgggcguaucguuauugccugucugucaaucaucgucuaugcggaagacagacugguuacccauggcaguggcagcaaugggggugccacccuuaccguuauuuauauuuucauugaaggauacucuaaaacgaaggucuuggccccuuaaugagggaguaauggcgguagggcugguuucaauucuggcaucgagcuuguuaagaaaugauguuccaauggccgggccauugguagcaggcgguuuauuaauagcauguuaugugauuacgggaaccucggcggaucucacaguagaaaaagcagcagacauuacaugggaagaagaggcagaacagacggguguaagucacaauuuaaugauaacgguagaugacgacgggacgaugcgaaucaaagacgaugaaaccgaaaacauacucacaguucuucuuaagacagcgcugcuaauugucaguggcguauuuccuuacaguauaccugcaacauugcuaguguggcauacauggcaaaaacaaacgcaacgauccggcguguuaugggauguuccuagcccuccagaaacucaaaaagcagaacuggaagagggaguguaccgaauaaaacaacagggcaucuuuggaaaaacccaagucgguguggggguucagaaagaggguguguuucacacaauguggcauguaacaagaggagcaguucuaacguacaaugguaaaagacuagagcccaauugggcguccgugaagaaggaccuuauuaguuaugggggcggauggagguuauccgcacaauggcaaaaaggagaagaagugcaaguuauugcagucgaaccuggcaagaaccccaaaaauuuucaaacgaugccuggcacauuccaaacaacaacgggagaaauuggugcaauagcauuggauuucaagccaggaacguccgguagcccuauaauuaacagagaagguaaaguggucggccucuauggaaacggaguaguuaccaaaaacggcgguuauguaucuggcauagcacaaacaaaugcugaaccagacggaccgacgccggaguuagaggaagaaauguuuaagaaaagaaaucuaacaauuauggaucuucaucccggauccggcaagacccguaaauaucuuccggcaauaguaagagaggcaauuaaacgcagauuaaggacuuugaucuuagcccccacaaggguaguugcagcagaaauggaagaagcccucaaagggcuucccaucagauaucagacgacagcgacaaaaagcgaacauacugguagggagauuguugaccugaugugucacgcgacuuucacaaugcgcuuauugaguccggugcgugucccuaauuauaaccuuauaauuauggaugaagcacacuucacggacccagcgaguauagcugcacgaggauauauuucuacuagaguuggaaugggagaagcagcagcgauuuucaugacagcaaccccaccagggacagcugacgcuuucccacaaucaaaugcacccauccaagaugaagaacgugauaucccagaaagaucauggaacuccggaaacgaauggauaaccgauuuugccggaaaaacaguaugguucguucccuccauuaaggcgggaaaugauauagcaaacugccuacguaaaaacggaaagaaagucauacaauuaucgcgaaaaaccuuugauacggaauaucagaaaacaaaacuuaaugauugggauuucgugguaacuacagauauuuccgagaugggagcaaauuuuaaagcagaucgagugauagacccaagaagaugucuaaaaccuguaauacucacugacggaccugaacgcguuauccuagcaggaccaaugccaguaacugcugcuagugcagcacaaagaagagggagggucgggaggaacccacaaaaggaaaacgaucaauacauuuucacuggccaaccgcuuaacaaugaugaagaucaugcgcacuggaccgaagcaaaaauguuacuagacaauaucaacacacccgagggaauuauuccagcgcuauuugaaccagaaagagaaaaaucggcagccauagauggcgaauauagacuaaaaggagaaagccguaagacauucguggagcuaaugagaagaggcgacuuaccuguguggcuagcacauaaagucgcgagugaaggaauuaaguauaccgaccgaaaguggugcuucgauggccagcgaaauaaucagauacuugaggaaaacauggacguugagaucuggacaaaggaaggggagaagaagaaauuacguccgagaugguuggacgccaggaccuacucugacccccucgcauuaaaagaauuuaaagacuucgcugcaggacgaaaaaguauugcucuagaccuagucacugaaauuggccguguacccucucaccuugcacauagaacacgcaacgcuuuagauaaucuaguuauguuacauacaagugaacauggaggcagggcuuauagacacgcgguagaagaauugccugaaacuauggaaaccuuacuccuauuaggauugaugauauuacugacgggaggagcuaugcuauuucucaucucagguaaaggcauaggaaaaacuagcauaggcuuaauaugugucauagcuaguuccgguauguuauggauggcugaaauuccuuuacaauggauagcaucugcaauuguauuagaauuuuucaugaugguacuguuaaucccugaacccgaaaagcagagaacgccacaagacaaccagcuggcauauguuguaauuggcauauuaacacuggcggccaucauugcugcuaacgaaaugggccucuuagagacaacgaaaagagauuuggguaugucaaaagagccugggguuguaagcccuacgucauacuuggauguugaucuucaucccgccucagcauggacacuauaugcaguagcgaccacgguaauaacaccaaugcuccgucauaccauagaaaauagcacagcuaauguaaguuuagcugcaauagccaaucaagcagugguacuaaugggcuuagacaagggcuggccgauuucaaagauggaucucggaguaccuuuacuagcauuagggugcuauucacagguaaacccauuaacauuaacagcggcaguacucuuauuaauuacacacuaugcgauaaucggaccugguuuacaagcaaaagcaacacgagaggcccagaaaaggacagcggccggaauuaugaaaaauccaacaguugauggaaucaugaccauagaucucgaccccguaauuuaugauucaaaguuugaaaagcaauuaggccaaguaauguugcuagugcuaugugcaguccagcugcuauuaaugcguacauccugggcauugugugaggccuuaacacuugcuacaggcccuaucaccacauugugggaaggaagcccgggaaaauucuggaauacaacaauugcaguaagcauggcaaauaucuuuagaggcucauacuuagcgggcgccgggcuagcauuuucaaucaugaaaucaguagggaccgguaagagaggaacaggcucacaaggugagacacuaggagaaaaauggaagaagaaauugaaucaacugucaaggaaagaguuugaccucuauaagaaauccgguauaacugagguugacaggacggaagcuaaagagggucuaaaacguggugaaauaacgcaucaugcaguuucacgggggucugccaaguuacagugguuugucgaaagaaauaugguaauacccgagggaaggguuauagaucucggcuguggccguggaggauggagcuauuacugugccgguuuaaagaagguaacagagguccgugguuacacaaaaggaggacccggccaugaggaaccgguuccaaugucaacuuacggauggaacauuguuaaacugauguccggaaaagacguuuucuauuuaccaccggagaaaugugauacacuccuaugugauaucggcgaaaguucaccaucaccaacugucgaggaaucccgaacaauucgcguuuuaaagaugguugagccauggcugaaaaacaaccaauuuuguauuaaaguucucaacccuuauaugccgacgguaauagaacacuuggaaagauugcaacgaaaacauggcgggauguuaguaagaaauccgcuuagcagaaacucuacgcacgaaauguacuggauaucuaacggcacaggcaauauaguugcaaguguaaauauggucagcagauuacuguugaauagguucacgaugacgcaucgacgccccacgauugaaaaagauguagacuuaggagcagggacaagacacguaaaugccgaaccagaaacgccaaacauggauguuauuggagaaagaauuaaacgaauaaaggaagaacauaacucaacauggcacuacgaugacgagaauccauacaagacaugggccuaucauggaaguuaugaaguaaaagcgacagggagugccucaucaaugauuaauggaguaguuaaacuccucacgaaaccaugggauguaguaccaauggucacccaaauggcaaugacagauaccacaccuuucggacaacaacguguauuuaaagaaaaaguugauaccagaaccccaagaaguaugccgggcacacgaagagucaugggcaucacugcagaaugguuguggcguacguuaggucgaaauaagaaaccucgucuaugcacccgagaggaauuuaccaagaaagucagaacaaacgcugcgaugggggcagucuucacagaggaaaaucaaugggauagcgcuaaagcggcaguggaagaugaggauuucuggaaacuuguagaucgagaaagagaauuacauaagcugggaaaguguggaaguuguguauauaauaugaugggaaagcgggaaaagaaguugggugaauuuggaaaggccaaaggaucaagagcaauaugguacauguggcuuggcgcacgauacuuggaauuugaagcacuaggauuucugaacgaagaucauugguuuucucgagaaaacucguauucuggagucgagggugaaggucugcauaaauuaggauacauacuccgcgauaucaguaagauuccgggcggugcgauguacgcagaugauacagcugggugggacacccggaucacagaagacgacuuacacaaugaagagaaaaucacccaacaaauggacccagagcacagacagcuggcgaacgcgauauuuaaauuaaccuaucaaaauaaaguuguuaaaguacaacgcccgacgccuacuggaacaguuauggauauaauaucuaggaaagaucagagagggucaggacagguugguaccuacgggcucaacacauuuaccaacauggaagcacaacucaucagacagauggagggagagggcguuuuaaguaaagccgaucuagaaaacccccaccuuccagaaaagaaaaucacacaauggcuugaaacaaaaggugucgaacgacuaaaacggauggcaauuucgggugacgacuguguggucaaaccuauagaugauagauuuggaaaugcacugcucgcacucaacgauauggguaaaguucgcaaagacauaccucaauggcaaccaagcaaaggcuggcacgacuggcaacaaguaccguucuguagccaucauuuccaugaacuaauaaugaaagacggacgaaagcuaguugucccaugccgcccacaagaugaauuaauugggagggcacggauaagucaaggagcagguuggagcuugcgugaaacagccugccuaggaaaagcauaugcucaaauguggucuuuaauguacuuucaccgaagagaccugagauuggcaucaaaugcgauuuguagugcaguaccaguacauuggguaccgacaaguaggacaaccuggucuauacaugcucaucaucaauggaugacuacagaagauauguugaccgucuggaauagaguauggaucgaggacaacccauggauggaagacaaaacaccggucacaaccugggaaaacguaccauaccucggaaaaagggaagaucagugguguggaucauugauuggucucaccucucgagcaaccugggcacaaaauauaccgacagccauacagcaaguacgcuccuuaauuggaaaugaagaguucuuggauuauaugccuucaaugaagcgauuuaggaaagaagaggaaagugaaggggcgauuugguaa

SEQ ID NO: 22992 - RNA, 9873 nt, Artificial Sequence
  derived and/or modified CDS sequence (opt6) from DENV-3__KF954946__SS-prME
accagcuuauguuuaaugaugauucuaccagcagccuuggcauuucacuuaacaucaagggacggagaaccgcgaaugauaguagguaaaaaugaaagggguaaaucauuacuuuuuaaaacugccagcgguauaaauauguguacauuaauugcaauggauuuaggagaaaugugugaugacacuguuacuuauaaauguccucacauuacugaaguagaaccagaagacauagacugcuggugcaauuuaacaucgacaugggugacauauggaacguguaaccaagcaggagaacauagaagggacaaaaggaguguugcguuagccccacacguuggcaugggccuugacacacgcacgcaaaccuggaugucugccgaaggagcguggaggcaaguagaaaaaguagaaacuugggcgcugagacacccuggguuuaccauauuagcgcucuuucuagcacauuauaucggaacuagcuuaacgcaaaaaguaguaauauuuauuuuguugauguuggugacaccaaguaugacuaugagauguguaggaguuggaaaucgagacuucguagaaggcuuaaguggugccacauggguugauguaguacuggaacaugggggaugcguaacuacuauggccaaaaauaaaccaacuuuggacauagaacuucagaaaaccgaagcuacgcaacuugcgauauugagaaaauuaugcauagaaggcaaaauaacuaacauaacgacugauucuaggugcccgacacaaggcgaagcgguucuaccugaggaacaagaucaaaauuacgucugcaaacacacauauguagauagagguugggguaaugguugugggcuguuugggaaagggucuuuggugacaugugcaaaauuucaaugccuugagccaauugaaggaaaaguaguacaauaugagaaucuaaaauauaccguuaucauaacaguccacaccggagaucaacaucaaguugggaacgaaacucaaggaauaacagcugagauuacgccgcaagccuccacuacagaagcaauacugccggaauauggcacacugggguuagaauguucaccaaggacugguuuagauuuuaaugagaugauucuucucacaaugaaaaauaaagccuggauggugcauagacaaugguucuuugauuugccacuucccuggacaucuggagcaacuacagagacaccuacuuggaauaggaaagagcuauugguaaccuuuaaaaaugcucaugccaagaaacaagaaguugugguacuuggaagucaagaaggagcuaugcacacagcccucacgggcgcaacugaaauccaaaacuccggcggaacuucgaucuuugcugggcauuuaaaauguagauuaaaaauggacaaguuagaacucaaagguaugaguuacgcaauguguacaaacaccuuuguucuaaagaaagaaguuagugaaacucaacauggaacuauucuaauaaaaguagaauacaaaggggaagacgcccccuguaaaauaccuuuuuccacugaggauggucaaggaaaagcacauaacgguagacugauaacagccaacccagugguuacuaagaaagaagaaccugucaauaucgaagcagaaccuccguuuggagaauccaauaucgucauaggaauuggugacaacgcuuugaaaaucaauugguauaaaaagggaagcucaauaggcaaaauguucgaagcuaccgcucgaggugcccggcgaauggcaauucuaggcgacacagcuugggauuuuggaucagugggcgggguauuaaacucacugggaaaaaugguacaucagauuuuuggaagugccuauacagcauuguuuucugggguaucauggguuaugaagauaggaaucggcguuuuauuaaccuggauuggacuaaacucuaaaaauacauccauguccuucagcugcauugccauaggaauuauuaccuuauacuuaggugccguuguucaagcugacaugggcuguguaauaaauuggaaagggaaagaauugaaaugcggaaguggaauuuuuguaacaaacgaaguucauacuuggaccgagcaauauaaauuucaagccgacucuccaaaacgucuagcuacugcaauagucggugcgugggaaaauggaguguguggaauacgaaguacaaccagaauggaaaauuuacuuuggaaacaaauagcgaacgaauuaaacuauaucuuaugggaaaacaacauuaaauuaacaguaguaguaggagauacaauugguguauuagaacaaggaaagagaacacucacaccccaaccaauggagcugaaguauuccuggaaaacuuggggaaaagcaaaaauaguaacggcagaaacucaaaacaguuccuucauuauugauggaccuaauacuccagaaugcccuuccgcuagcagggcuuggaacgucugggaaguagaagauuauggcuucgggguauucacaacuaauauaugguugaaguugagagagguauacacgcaaaugugcgaucauagauugaugagugcugcugucaaagaugaacgagcaguucacgcagauaugggcuacuggaucgaaagccagaaaaacggaucguggaaacuagagaaggcgagccuuauagaaguaaagaccuguacguggccaaagucgcacacccuuuggucgaacggcgugcuagaaucagauaugauaauaccaaaaucauuggcagguccaauuagccaacacaacuacagaccaggauaucauacccagacagcugguccuuggcaucuuggaaagcuagaacuagauuucaauuauugugaggggacaacagucguuauuacagagaauugcggaacucgcggaccaagucuaaggacuaccacgguaucuggaaagcucauacaugaaugguguugcagauccugcacuuugccaccacuucgauacaugggagaagauggauguugguauggcauggagaucaggccuaucagugagaaagaggaaaauaugguuaagucuuuggugagugcagguucugguaaaguagacaauuuuaccaugggcguucuaugucucgccauucuuuuugaagaaguaaugagggggaaauuugguaagaaacauaugauagcaggaguauucuucacuuuuguucuacuccuaucgggacaaauuacauggcgggauauggcacacacuuuaauuaugauugguaguaaugcaucggauagaauggguaugggagugaccuacuuagcucuaaucgcgacguuuaaaauucaaccuuuucuugcccuuggcuucuuucuaagaaaacuuaccucuagggaaaauuuauuacucgguguagguuuggcgauggccacgaccuuacaacuaccagaagacauagagcaaauggcaaauggaauagcucuaggucuaauggcacuuaaacucaucacacaauucgagacauaccaguuauggaccgcacuuauuuccuugacauguaguaauacuauuuucacacuaaccguggcguggaggacugcaaccuuaauccuagccggaguuucucucuuaccuguaugucaaucuaguaguaugcguaagaccgauuggcugccuaugacaguggcagcgaugggaguuccaccacuaccguuauuuauauuuaguuugaaggacacucucaaaaggagauccuggccauuaaacgaaggcguaauggcuguaggucuuguaucaaugcuugcgucaucuuuauuaaggaaugacgugcccauggccggacccuuaguagcgggaggcuuacuuauagcauguuacguaauaacuggcaccagugcagaucuaacaguagaaaaggcagcugauguaacgugggaagaggaagccgaacaaaccggagugucccauaaucuuaugauaacuguugacgaugacgggacaaugcguauaaaagaugacgaaacagaaaauauauuaaccguuuugcucaaaacugcacugcuaauugugaguggaaucuucccuuacaguauccccgccacgcuucuaguauggcacacauggcaaaaacaaacucaacguucaggaguuuuaugggauguaccuagcccuccugaaacccaaaaagcagaauuagaggagggcguauacaggauuaaacaacaagguauauuaggaaaaacacaaguaggcguaggagugcaaaaagacgguguauuucauaccauguggcaugucacucgaggcgccguauuaacgcacaauggaaaacgucuugagccgaauugggcgucagucaagaaagaucuaauaagcuauggaggaggcuggagguugucugcucaguggcaaaaaggugaagaaguccaagucauagcuguagaaccugggaagaaccccaaaaauuuccaaaccaugcccggaacuuuucaaacgaccacuggugaaauaggugcaauagcauuagacuucaaaccaggaacgagugguucuccgauuauuaauagagaagggaaagucguaggauuauauggcaauggaguaguaacuaaaaauggcggcuacguaucaggaauagcacaaacaaacgcagagccagaugggccaacaccagaauuggaagaagagauguuuaagaaaaggaaucuuacaaucauggauuuacauccaggaagcgggaaaacuaggaaguauuuacccgcaauaguucgggaagcaauaaagaggagguugcguacguuaauuuuagcccccacucgaguaguugcugcagaaauggaggaagcauugaaaggauugccgauucgguaucagacuacagcaacuaaaucagaacauacuggucgcgagauagucgacuuaaugugucacgcgacauuuaccaugagacuauuaagcccaguuagggucccaaauuauaauuugauuaucauggaugaagcucauuuuacugauccugcuuccauugccgcaagagguuacauaagcacgaggguuggaaugggagaagccgccgccaucuuuaugacagccacgccuccagggacugcggacgcauuuccacaaucuaaugccccaauacaggaugaagaacgugauauacccgagagauccuggaacagcggaaacgaguggauaacagauuucgcaggaaaaacaguaugguuuguuccaucgauuaaagcugguaacgauauagccaacugccuucggaagaacggaaagaaaguaauucaauuaagccgaaagacauuugacacagaauaccagaaaacaaaacuaaacgauugggauuucgugguaacaaccgacauuucagaaaugggagccaacuucaaagcggacagagucauugacccucgccgauguuuaaaaccaguaauucucaccgacggucccgaaagagucauacucgccgguccgaugccggucacagcagcaucagcggcccaaaggaggggacgugugggccgaaacccgcaaaaggaaaacgaccaauacaucuuuacaggucaaccccuaaauaacgaugaagaucacgcccauuggaccgaagccaaaauguuacuugauaacauuaauacaccugaaggcauuauacccgcauuauucgaaccugaacgcgaaaagucugcugcuauagacggagaguaccgcuuaaagggggaaagccggaaaacuuuuguagaacucaugagaagaggggacuugccagugugguuagcacauaaaguagcgagcgagggcauaaaauauacagaucguaaauggugcuucgacggucaacggaauaaucagauauuggaagaaaauauggacguggaaauuuggacaaaagaaggugagaagaagaaacuucguccuagaugguuagaugcuagaacauauucagacccacucgccuuaaaagaauuuaaagacuucgcagccggccgcaaauccaucgcucuagaccugguuacagaaauaggucgcguaccuucgcaucucgcucaccguacgagaaaugcgcuggauaauuuaguaaugcuucauacaagcgaacaugggggacgugcuuauagacaugcaguagaagaacuaccggaaacgauggaaacacuucuacucuugggcuuaaugaucuuacugacaggcggugcaauguuauuucucauuagugggaaaggaauagggaaaacaaguauuggccugauuuguguuauagcauccucuggaauguuauggauggcagaaauucccuuacaauggauagcaagcgccauagucuuagaguucuucaugaugguacuuuuaauuccagaacccgaaaaacaaaggacuccgcaagauaaccaacuagccuauguugugauagguauuuuaacuauggcagcaaucauugcugcaaaugagaugggucuacuagaaacaacuaaaagagauuuaggaaugagcaaggaaccuggagucgucucaccgacuucauaccuggauguagaucuucauccagcuuccgccuggacauuguacgcggucgccacgacggucauaacaccuauguuaaggcauacaauagaaaacucuaccgccaacgucucgcuggcugcuauagcgaaucaagcaguuguuuuacuugggcuggauaaagguuggccgauaucuaagauggacuuaggcgugccacuguuagcucuugguuguuacucccaaguuaacccguuaacauuaacagcugcuguucuauuacugguaacucacuaugcuauaauuggucccggccuccaggcgaaggcaacgcgggaagcgcaaaaacgcacagcggcaggaauuaugaagaaucccaccguugacgggauuauaacuauagauuuagaucccguaaucuaugacagcaaauucgaaaagcaacuagggcagguaaugcuacuuguccuaugugccguccaacuauuacucaugagaacaagcugggcacucugcgaggcauuaacuuuagccaccgguccaaucaccacacuuugggaaggaucgccagguaaguucuggaauacgacuauugcagucucaauggcaaauauauuucgaggcaguuaucucgcgggggcuggucuagcauucaguauaaugaaaucaguugguacagguaaacggggcacaggaagccaaggagaaacacuaggugaaaaauggaaaaagaaauugaaucaauuaaguagaaaagaguucgaccuauacaagaaaaguggaauaacugagguugacagaaccgaagcgaaagagggcuugaaaagaggggaaacaacucaccaugcgguaagucgggguagcgcaaaguugcaaugguucguggagcgcaauaugguaauccccgaaggccgaguaaucgauuugggauguggucggggaggcugguccuauuauugugcaggccugaagaaagugacagaaguuagaggcuauacaaaaggaggcccuggccaugaagaaccagugccuaugagcaccuacggcuggaauauaguaaaacugaugucaggcaaagauguauucuauuuaccaccggaaaaaugugauacgcuauuaugugacauuggugaaucuagcccuagucccacaguagaggagucacgaacuauucgaguccuuaagaugguagaaccauggcuuaaaaauaaucaguuuuguauuaaaguauuaaacccauauaugccagcaguuauugaacacuuagagcgacugcaacgaaagcauggaggaaugcuggucagaaauccacuaagcagaaauucuacccaugagauguauuggauuucgaaugggacggggaacauaguuucuagcgucaacaugguaaguagguuauuguuaaauagauuuacgaugacacauagaagaccgacaauugaaaaagauguagaccucggagccggaacaagacauguaaaugccgaaccugaaacaccuaauauggauguuauuggugaacgaauaaaaagaauaaaggaagaacauaauucaacauggcauuaugaugaugaaaauccauacaaaacaugggcuuaccacggaagcuacgaaguuaaggcuacaggcucagccucguccaugauaaaugguguaguaaaauuauuaaccaagcccugggauguagucccaaugguuacccaaauggccaugacagacacaacaccauuugggcagcaacgaguauucaaggagaaggucgauacaagaacaccaaggccaaugccaggaacaagaaaaguuauggaaauaacugcagaaugguuguggaggacccugggacgaaacaagagaccucguuuauguacacgggaagaguuuacuaaaaagguucguacaaaugcugcaaugggagcaguauucacggaagagaaccagugggacagugcaaaagcagcgguagaggacgaagaguucuggaaacugguggaccgcgaaagggagcuacauaaacuagguaaauguggaucaugcguauauaauaugauggguaagagagagaagaaacucggugaguucggaaaggcaaaaggaucgagagcuauuugguacaugugguuaggggcacgauaucuagaauuugaagcccuaggauuuuuaaaugaggaucauugguuuagucgcgaaaauagcuacucugggguagaaggcgaaggucuucauaaauuaggguauauauuaagagacauuaguaaaauaccuggaggugccauguaugcugacgauacagcuggcugggauacaagaauaacggaagaugauuuacacaacgaggagaaaauaacacaacaaauggauccggaacaucgucuucucgcaaacgcaauauucaagcuaacuuaucagaauaaggugguuaaaguacaaagaccgacgccaacaggaacuguaauggauauaauaucaaggaaagaucaaagggggucuggacaaguagggacuuacggacugaauaccuucacaaauauggaagcacagcuaguacgacaaauggagggagaaggaguucugaguaaaaccgauuuggaaaacccacaucugcccgagaagaaaauuacacaguggcuugaaacgaagggaguggaacgacugaaaagaauggcaauaucuggugacgacuguguggugaaaccaauagaugauagguucgcuaaugcucugcuagcccuuaaugauauggggaagguucgaaaggauauuccacaauggcagccauccaaaggauggcaugauuggcaacaaguaccauucugcucacaucauuuccacgaacuaaucaugaaggauggaaggaaauuaguggugccuugcaggccacaagaugaacuaaucggacgagcgcgaauaagucaaggcgccggauggucucuaagagaaaccgccugccuuggaaaagccuacgcccaaauguggagcuuaauguauuuucaucggcgcgaucuaagauuagcaucaaacgcuauuuguuccgcuauuccgguacacuggguaccgacuucacgcacuacuuggagcauacaugcacaucaccaguggaugacaacagaagauauguuaacuguguggaacagaguguggauagaggauaauccuuggauggaggacaagacaccuauaacaacaugggaaaaugugccuuauuuaggaaaaagagaagaucaauggugcggcuccuuaauaggauuaacgaguagagcgaccugggcucaaaacauaccaacugccauacaacaaguacguaguuugauagguaacgaggaguuccuagauuauaugccauccaugaaacgcuuccgaaaagaagaagaaucagaaggugcaauuugguag

SEQ ID NO: 22993 - RNA, 9873 nt, Artificial Sequence
  derived and/or modified CDS sequence (opt6) from DENV-3__KF954947__SS-prME
acaaguuuaugccuaaugaugauacuaccagcagccuuggcuuuucaucuaacuucucgagacggagaacccaggaugauaguagguaaaaaugagagaggaaaaucucuauuauuuaaaacagccucgggaaucaacaugugcacucuaauugcaauggauuuaggagaaaugugugacgauacaguaacuuauaaguguccacauauuacggaggucgaaccagaggauauagauuguugguguaaucuaacaaguacaugggugacguacggaacauguaaccaagcgggugaacaucggcgggacaaacgaaguguugcucuugcaccucauguaggaaugggauuagauacaagaacacaaacauggaugucagcagaaggugcuuggcgacaaguagagaaaguugaaacaugggcucucagacauccuggauucacaauuuuagcauuauucuuagcacauuacauugguacgucuuuaacacagaaaguggucaucuuuauucucuuaauguugguuacgccaucgaugacuaugaggugugucggagucggcaauagagauuucguagaaggauuaucuggagcaacauggguagaugugguccucgaacaugguggaugugucacaacuauggccaagaacaaaccgacucucgauauagaguuacaaaagacggaagcaacacaauuggcaacccuucgaaaacuaugcaucgagggaaaaauaaccaacaucacgaccgauucucgcuguccaacucaaggcgaggcagucuuaccugaggaacaagaucaaaauuauguauguaagcauacauauguagacagaggaugggguaauggaugcggguuauucgggaaagguagucucguuacaugugcaaaguuccaaugcuuagaaccuauagaaggaaaagugguccaguacgaaaacuugaaauauacaguuaucaucacuguucacacaggggaucaacaccaaguagguaaugaaacacaaggcauuacugcggaaaucaccccucaagccagcacgacugaggcuauucuaccugaauacggaacauuagggcucgaauguagcccgagaacgggauuggauuucaaugaaaugauuuuauuaacgaugaagaacaaggcuuggauggugcaucgccaaugguucuucgaucuaccucucccuuggacaucaggcgcaacaacugaaacaccgaccuggaauagaaaagaauuauugguuacauuuaagaacgcacacgccaagaagcaagaaguaguagucuuaggcucacaagaaggggcaaugcauacagcguuaacgggugcaacagaaauacaaaacagcggaggaacauccauuuuugcaggccaucugaagugcagauuaaaaauggauaaguuggaguuaaaggguaugaguuaugccauguguacgaauacauucguccuaaagaaagaagucucugagacucaacacgguacgaucuuaauuaaaguggaauauaaaggugaggacgcucccuguaaaauucccuucucaaccgaagacggacaagggaaagcacacaacgggagacugaucacggcuaacccaguagugacuaagaaagaagaacccguaaauauagaagccgaaccuccauuuggggaauccaauauagugauuggaaucggagauaacgcucucaaaaucaacugguacaagaaagggaguagcauuggaaagauguucgaagcaacagcuagaggagccagacguauggcgauacugggcgacacugcuugggacuucggaaguguagguggcguauuaaauucacuuggaaaaaugguacaucaaauauucgguagcgcauauacagcucuauuuuccggaguuagcuggguaaugaagauuggcaucggugucuuguuaacuuggauaggcuuaaauagcaaaaauaccucaauguccuucucuuguaucgcaauaggaauaauaacccuauaucuaggcgccguuguucaagccgauaugggcugugucauuaauuggaaggguaaggaacuaaaaugugguaguggcauauuuguaacuaaugagguacacacauggaccgagcaguauaaauuccaagccgauucgccuaagcgauuagcaacagcaaucgugggagcaugggaaaauggugugugugguauucgcucaacuacccguauggaaaacuuguuguggaaacaaaucgcuaaugaguuaaauuauauucuaugggaaaacaacauaaaauuaacgguaguugucggagauaccaucggcguccucgagcaaggcaaaaggacuuuaacuccgcagccaauggaauuaaaguauagcuggaagacuuggggaaaagcgaaaauuguuacugcggaaacgcaaaauucuucuuucauuauagaugggccgaauaccccugaguguccuagugccucaagggccuggaaugugugggagguggaagacuacgguuucgguguuuucacaaccaauaucuggcugaaacuaagagagguuuauacucagaugugcgaccauaggcuuaugucugcagcuguaaaggacgaaagagcuguacaugccgauaugggauacuggaucgaaucacagaaaaaugguucauggaaacuagaaaaggcuagucucauugaagucaaaacguguacauggccaaaaucacacacacuauggaguaauggagugcuugaaagcgauaugauuauucccaagagucucgcagggccgauuucucaacauaauuaccgaccaggguaccacacccaaacugcaggcccuuggcaucucgggaaacuugaacuugacuuuaauuauugcgagggaaccaccguagugauuacagaaaauugcggaacgcguggcccaaguuuacgaacaacgacagugaguggcaaauuaauccacgaauggugcugucgcuccuguacacugccaccucuccgcuauaugggagaggauggcuguugguacgggauggaaauucgucccauauccgaaaaagaagaaaauauggucaaaucucuggucucagcaggcucaggcaagguagacaauuuuaccaugggaguauuaugcuuagcaauccuauuugaagaaguaaugaggggaaaauucggcaagaaacauaugauugcggguguguucuuuacuuuuguacuauuacuaucuggucagauaacauggagggacauggcccauacccuaauaaugauaggaucaaaugcaucggaccgcaugggcauggguguaacguaccuugcguuaauugcgacguuuaaaauucaaccuuuucuugcacuuggauuuuucuuaagaaaacucacaucccgcgaaaauuuauuauuaggaguugggcuugcuauggcuacuacauuacaacuuccagaagauaucgagcaaauggcgaacggaauagcccuaggacuaauggcacugaagcuaaucacucaauucgaaacuuaucagcucuggacggcacuaauaucgcuaacauguucuaacaccauuuucacacuaacaguugcauggagaaccgcaacacugauucuagcugguguaaguuuacuaccuguaugucaaagcucguccaugcguaaaacagauuggcuuccaaugaccguggcagcaaugggaguaccuccucuaccacuuuucauauucaguuuaaaagauacauuaaaacgacguucauggccgcucaaugaaggaguaauggcugucggguuaguaaguaugcucgcuucuucucucuuacggaaugacguuccaauggcaggaccucucgucgcaggaggcuuacuaauugcguguuacgucauaacagggacaagcgcagaucuuaccguagaaaaagcggcugacguaacuugggaagaagaggcugaacagaccgguguuagccauaaucuaaugauaacaguagacgacgacggaaccaugagaauaaaagaugaugagaccgaaaauauuuugacuguauugcuaaaaaccgcgcuuuugauugugucaggcauauucccauauuccauaccagcuacuuuacuuguauggcauacauggcaaaagcaaacgcaaagaucuggaguuuugugggacguaccaucuccuccugaaacacaaaaagcagaguuagaggaaggcguauaucgaauaaaacagcaggggauacugggaaaaacacaaguuggaguuggaguacaaaaagauggaguauuucacacaauguggcauguuacucgaggugcggucuuaacacauaacggcaaaagacuugaaccuaacugggcaucugucaagaaagacuuaauuucuuacggagggggauggagguuaucagcccaauggcaaaaaggagaggaaguacaaguaauugcaguugaaccaggcaaaaauccuaaaaacuuccagacaaugccgggcacauuucaaacaaccaccggugagaucggugcuauugcucuagacuucaagccagguacaucaggaucaccaauaauaaacagggagggcaagguaguuggacuauauggaaacggggucguuaccaaaaauggcggguaugucucaggaauugcgcaaacaaacgcugaaccugacggcccgacaccugaacuagaggaagaaauguuuaagaaaagaaaccucacuauaauggauuuacaucccgggucgggaaaaacuagaaaauaucuacccgcaauuguaagggaagcaaucaaaaggaggcuuaggacgcucauuuuagcaccaacacgcguuguagcagccgaaauggaagaagcccuuaagggcuugcccauaagguaucagacaaccgcaacaaagagugaacauacuggccgggagauagucgacuuaaugugccaugccacauuuacuaugagguuacugagcccagugcgaguaccuaauuauaauuugauuauaauggacgaggcacacuucacggacccugcuucuauugcagcaagaggauauauuaguacucgcguaggaaugggugaggcagcagcuauuuuuaugacugcuacaccacccggaacagcugacgcuuuuccucaaucuaaugcuccuauucaggaugaagaaagagauauacccgaaaggucuuggaacucugguaacgaguggauaacggacuucgcaggcaaaacgguuugguuuguaccaucaauaaaagcgggcaacgauauagccaauugcuuaaggaaaaauggcaagaaaguuauucaacuaagcagaaagaccuuugauacagaauaccaaaagacaaaacuaaacgauugggauuuuguuguaacaacggauaucagugaaaugggggcaaacuuuaaagcagaccguguaauagaccccagaagaugucugaaaccgguaauucuaacggacggcccggaaagagugauacuagcaggaccuaugcccguaacugcagcgucugccgcucaaagaagagguagggucggaagaaauccacaaaaagaaaacgaucaauauauuuuuacaggccagccacuuaacaaugaugaagaucaugcgcauuggacagaagccaagaugcuacuugauaauauuaauacaccugagggaauaaucccugcgcuuuuugaaccugaacgcgaaaaaucggcagcgauugauggagaauaccgacuaaaaggggagucaagaaaaacuuuuguagaacuuaugagaaggggagacuuaccaguguggcuagcacacaaaguggcuagugaaggcaucaaauauaccgaccgaaaaugguguuuugauggacaacggaauaaucagauauuagaagagaacauggauguugaaaucuggaccaaagaaggagagaaaaagaaacuuagaccaagaugguuagacgcaagaaccuauucagacccacuagcccuaaaagaauuuaaagauuuugccgccggcagaaaaagcaucgcauuagaccuagugacagagauuggaaggguuccgagucaccucgcacaucgaacuagaaaugcgcucgauaaccuagucaugcuacauaccucggagcauggcggacgagcauaucgucacgcggucgaagaacuuccugagacaauggaaacguuauuacuauuaggguuaaugauucucuuaacaggaggugcaauguuauuucucaucucaggcaaggggauagguaaaaccucgauaggucuaauaugugucauagcguccagugguauguuauggauggcugaaauucccuuacaauggauagccagcgcuauuguacucgaguucuuuaugaugguacuacugaucccagaaccugaaaaacaaaggaccccucaagacaaccagcuagcauaugucguuauagguauucuuaccauggcagcuauuaucgcagcuaacgaaaugggucuauuagagacgacaaaacgggaucuagggaugucaaaagaaccgggcguaguuucccccacuucguacuuagacguagaccuacacccagcuucagccuggacuuuauaugcaguugcaacaacuguuauaacaccaauguugaggcacacuauagaaaacucaacugcaaacgucagccuagcagcaaucgcaaaucaagccguaguccuaaugggauuagacaaaggcuggccuauaaguaaaauggaccuuggagugccucuauuagcacuaggauguuauagccaagugaacccgcugacucuuacggcugcaguccuauuacucguuacucauuaugcgauuauuggcccgggguugcaagcuaaggcaacucgagaagcccagaaaagaaccgcagccggcauuaugaagaauccuacuguagaugguauuaucacuauugaucuagaccccguuauauaugacucaaaauuugaaaaacagcuaggacaaguuauguugcucguuuuaugcgcgguccaauuacuacucaugcgaacgucaugggcgcucugugaggcguuaacccuagcgacagggccuauaacaacccuaugggaaggaucaccagguaaauucuggaauacuaccauugccguaucaauggcaaacauuuuccgaggaaguuaccuagccggugccggacuagccuucagcauaaugaaaucuguagggacaggaaaaagggguacagguucucaaggugagacucuuggagaaaaguggaaaaagaaauuaaaucaguugucuagaaaagaauuugauuuauauaagaaaucgggaauuacugaaguugauaggacagaggcgaaagaaggacugaaaaggggagaaacuacacaucacgcuguaucacguggaagcgcaaagcuccaaugguuugucgagagaaauaugguaauuccagaaggaagagugauugacuuaggaugugguagaggaggguggucuuauuauugcgcaggguugaagaaaguaacugagguacgcgguuauacuaaaggagguccaggucaugaggaaccaguaccaaugucgacauacggauggaauauaguaaaacuuaugaguggaaaagauguauuuuauuugccaccggaaaaaugugauacucuacucugcgauauuggugaaucaucuccaaguccuacaguugaagaaucacguacaauacgcguacuuaaaaugguagaacccugguuaaagaauaaccaauuuuguauaaagguauugaaucccuauaugccagcagugauagaacaucuggaaagguugcagcgaaagcauggugguauguuaguucguaauccauugaguagaaauucgacucaugaaauguauuggaucagcaauggaaccgggaauaucguaucaucgguuaauauggucagucgucuacuacucaauagauuuacuaugacucaucgccgaccaaccaucgaaaaagacguggaucugggggcgggcacaagacauguaaaugcugaaccugaaacuccaaacauggacguaauaggcgaacgcauuaagaggauuaaagaagaacacaauagcacuuggcacuacgaugaugaaaauccauauaaaacaugggccuaccacggaaguuaugaggucaaggcaacaggcagugcuucaucaaugauaaacggaguaguaaaacuucuaacaaaaccaugggauguagugccgauggugacucaaauggcuaugacagacacaacuccuuuuggacaacagcgggucuucaaggaaaaaguugauacuagaacuccaagaccuaugcccggaacccggaaaguaauggagauaaccgcugaauggcuuuggcgaacacugggaagaaacaaaaggccgcguuuguguacucgggaggaauuuaccaagaaagucaggacaaaugcagccaugggugcuguauuuacagaagagaaccaaugggauucagcgaaagcagcagucgaggaugaggaauuuuggaaacuuguagacagagaaagagaacuacauaaguuagguaagugcgguucuuguguuuauaacaugauggggaaaagggagaagaaacuuggagaauuuggcaaagcaaaaggaucuagagcgauaugguauaugugguuaggggcccgauaccuagaauuugaagcauuaggguuccugaacgaggaucacugguuuagucgagaaaauaguuauucgggaguggaaggagaagggcuucauaaauuaggguauauucuaagagauauuucuaaaauaccugggggagcaauguacgcagaugauacugcaggcugggauacaaggauuacagaagaugauuuacacaaugaagagaaaauuacucaaagaauggauccagagcaccgacugcuggcaaaugccauuuucaaacuuaccuaccagaacaaggucgucaaaguccaaagaccgacgccaacaggaacugugauggacaucauaucgcgaaaagaucaaagaggaucuggucagguugguacauacggacuaaauacuuuuacaaauauggaagcccaacuggugaggcagauggaaggagaagggguacuaucaaaaacagaccuugaaaauccucaucucccagagaaaaagauuacacaauggcuggaaacuaaaggaguagaacgauuaaagagaauggcgauaucaggagaugauuguguggucaaaccaauugaugauagauuugcuaacgcauugcucgcacucaacgacauggguaaaguacgcaaagauauaccgcaguggcaaccguccaaggguuggcacgacuggcaacaaguaccauucuguagccaucacuuccaugaauuaauaaugaaagacggucguaaacucguggugccaugcagaccucaagacgaacuaauuggacgagcaagaauaucccagggagcaggguggucauugcgagagacggcguguuuagguaaggcuuacgcccaaauguggaguuuaauguacuuucauaggcgugaucugagauuagcaucaaaugcuauaugcagcgcgauaccgguucacugggugccaacgagcagaacaacuuggucaauucacgcccaucaucaauggaugacgacagaggauaugcucaccguauggaauagagucuggauagaagauaauccuuggauggaagauaaaaccccuauaacuacuugggaaaacgugcccuaucugggaaaaagggaagaucaauggugcggaucucugauaggcuuaacgucucgcgcaacaugggcacaaaacauaccuacggcgauucagcaaguacgaucauugaucggcaaugaagaguuucuagauuauaugccuagcaugaagagauuucgaaaagaggaggaaucagaaggggcaaucugguaa

SEQ ID NO: 22994 - RNA, 9873 nt, Artificial Sequence
  derived and/or modified CDS sequence (opt6) from DENV-3__KF954945__SS-prME
acuucauugugcuuaaugaugauucuuccugcggcacucgcauuucauuuaacuucccgcgacggagaaccacgcaugauaguagggaaaaacgaaagggguaaaagucuacuauuuaaaacagcuagcggaauaaauauguguacucuaauugcgauggaccuuggggaaaugugugacgacaccguaacauacaaauguccgcauauuacugaagucgagccggaagacauagauugcuggugcaauuuaaccuccacuugggucacuuauggaacgugcaaucaagcaggggaacauagaagagacaaaagaaguguagcucuggcgccgcacguaggaaugggauuagacacaagaacacaaacuuggaugucggcugaaggagcauggaggcaggucgaaaaaguugaaacaugggcauugcgacauccgggauuuacaauucucgcucuauuccuggcucacuauauaggaacaagucugacacaaaaagugguaauauucauucugcucaugcucguaaccccaaguaugacuaugcgauguguuggugucggaaaucgcgacuucguagagggauugucaggagcuacaugggucgauguaguacuugagcacggggguugugucacuacaauggcgaaaaauaaaccaacgcuugauauagaauuacagaaaaccgaagcuacgcaauuagcaauccugcguaaacuauguauugaaggaaaaauuacuaauauaacuacagauucacguugcccaacgcaaggcgaagcaguucuacccgaagaacaagaccaaaauuauguauguaaacacacuuacgucgacaggggauggggcaauggauguggguuauucgggaaaggaucccuuguaacuugugcaaaauuucaaugccucgaaccuauagaagguaaaguaguacaauacgaaaauuuaaaauacaccgugaucauaaccgugcacacgggcgaccaacaccaaguuggcaaugaaacacagggaauuacagcggaaauaacaccacaggcaucaacaacagaagcaauauuacccgaguacgguacgcuuggacuagaauguucaccaagaacgggacuugauuuuaacgaaaugauuuuauugacuaugaaaaacaaagccuggaugguacauaggcagugguucuuugaccuuccuuuaccauggacaucaggagcaaccacugaaacgccaacauggaacaggaaagagcuguuaguuacguucaaaaaugcucaugcuaagaaacaggaagugguuguccuuggcucacaggaaggcgcaaugcauacagcacuaacuggugcaaccgaaauacaaaauucaggaggaacgaguauauuugcgggccaccuuaaauguaggcuuaaaauggacaaauuagaacugaaaggaaugagcuaugcaaugugcaccaauacguuuguuuuaaagaaagaaguauccgaaacccagcacggcacuauucuaauaaaaguggaguauaaaggagaagaugcgccaugcaaaauaccauucagcacagaagauggucagggaaaagcgcauaauggcagguuaaucacagccaauccaguugugacgaagaaagaagaaccugugaauauagaggcugaaccuccguucggugaaagcaacauuguuaucgggaucggagauaaugcguuaaaaauaaauugguauaagaaaggaaguucaauagggaaaauguuugaagcgacggcucguggcgcacgacgaauggcaauucuuggugacacugcgugggauuuugggagugugggaggaguacuuaauucuuuggguaaaaugguccaucagauuuuuggcucagcauauaccgcacuauuuuccggcguaaguugggucaugaaaauugguauaggaguacucuuaacguggauaggucuuaacagcaaaaauacauccaugucauuuagcuguauagcgauuggaauaauaaccuuauaucuaggagcaguaguccaggcugauauggguugcguaauaaacuggaaggggaaggaacucaaauguggaagugggauauuugucacuaaugaaguucauacauggacagaacaguacaaauuccaagcagauaguccuaaacggcucgccacagcuauuguaggagccugggagaacggagucugcgguauucgcagcaccacucgaauggagaaccuacuauggaaacaaaucgcaaacgaacuaaacuauaucuuaugggaaaauaauauaaaacucacaguagugguaggggacacuauuggugucuuggagcaaggcaaaagaacauugacgccgcaaccgauggaauuaaaguauucuuggaaaacguggggcaaggcuaaaaucguaacagcugaaacccaaaauuccucauucauaauugauggaccuaauacaccugaguguccaucagcaucuagagcauggaauguuugggagguagaggacuacgguuucggaguauuuacuacuaauauuuggcuaaaacuaagagaaguguacacacaaaugugugaucaucggcugaugagcgccgcaguuaaagacgagcgugcaguacaugcugauaugggguauuggauugaaucucagaaaaaugguucguggaaacuagaaaaagccucucucauagaagucaaaacuuguacauggcccaaaucacacaccuuguggagcaacgguguuuuagagucggauaugauaauuccuaaaucacuugcgggcccgauuucccaacacaacuaccguccagguuaucauacacagacugcaggaccauggcacuuaggaaaauuagaacuagauuucaauuauugugaagguaccacgguuguuauuacagaaaauugcgguacgcggggaccaucucuaaggacaacaacgguaucagggaaguugauacaugaaugguguugcagaagcuguacgcuaccuccgcuacguuauaugggagaagauggauguugguauggaauggagauacgaccgaucagcgaaaaggaggaaaacaugguaaagagcuuagugucggccgguucgggaaaaguugauaacuuuacgaugggaguacuaugcuuagcuauauuauuugaggagguuaugagaggaaaguucgguaaaaagcacaugauugccggagucuucuuuacuuuuguacuucuacuaaguggacaaaucacuuggcgcgauauggcccacacacuaauaaugauugggagcaaugcgucagauagaauggguauggggguaaccuauuuagcacuaauugcaacuuuuaagauccagccauuccuagcacuaggauucuuuuuacgaaaacugacaagccgggaaaacuuauuauugggaguaggauuagcgauggcaacgacccugcaacuuccggaggauauagaacaaauggcaaauggcauagcacuuggguuaauggcuuuaaaacucaucacacaguuugaaacuuaucaauuguggacagcacuaauaucauuaaccuguaguaacacuauuuuuacacuaacaguagcuuggagaacagccacgcuaauuuuagccgguguaucacuacuuccuguuugucaaucaaguagcaugagaaagacagauuggcuuccaaugacagucgcagcgaugggcguaccaccguuaccuuuguucauuuuuagucugaaagauacccuaaaaagacgcaguuggccacuaaaugaaggagugauggcgguaggauuagucaguaugcuugcuucuagucuguuaaggaacgauguaccaauggcagguccguuaguagccgguggauuguuaauagcauguuaugucauaaccggaacuagcgcagauuugacuguugagaaagcagcugaugugacuugggaagaagaagcugaacaaacuggcguaucacacaaucuuaugauuacaguugacgacgacggaacaaugagaauaaaggaugaugagacagaaaauauacuaacaguacuuuuaaaaacugcguuacuuauaguuucugggauuuucccauacaguauuccagcgacacuacuuguauggcacacauggcagaagcagacacaaagaucggguguacuaugggauguuccaucaccaccagaaacacaaaaagcggaguuggaagaagguguauacaggaucaagcaacaagggauacuugguaaaacacaaguagguguugguguucaaaaagauggugucuuucauacaauguggcauguaacacgcggagccgugcuaacacacaauggaaaacgucucgagccuaacugggcuuccgugaagaaagacuuaauaucuuacggugguggauggcgacuaagugcacaauggcaaaaaggggaagaagugcaagugaucgcuguagaacccggcaaaaauccgaaaaauuuucaaacaaugccaggcacuuuccagacaacaacaggugaaauuggggcaaucgcacuagauuuuaaaccagguacaagugggaguccaaucauaaauagagaaggcaaaguggucggauuguacgggaauggagucguaaccaagaauggaggauacgucagcggaauagcacaaacaaacgccgagcccgacggaccuacuccugaacuugaagaagagauguuuaagaaacguaacuuaacuauaauggaucuucacccaggaagcggcaaaacuaggaaauaccuaccugccauagucagagaggccauaaaacguagauuaagaaccuuaauauuagcaccaacccgaguagucgccgcggaaauggaggaagcauuaaaaggacuaccaauaagauaucagacgacugcaacuaaaagugaacauacgggcagagagaucguugaucuuaugugucacgcaaccuuuacaaugagguuauuaucgccuguucgaguucccaauuacaaucucauaauaauggacgaggcacacuucaccgauccagcgucuauugcagccagaggauauauuucaacccgcguugguaugggugaagcagcagcaauauuuaugacagcaacaccgccaggaacagcagaugcauucccacagaguaaugcucccauccaagaugaggagagggauauaccagagagaaguuggaauaguggaaaugaguggauaacagacuuugcuggaaaaacuguuugguuuguaccuaguauuaaagcaggcaaugauauagcuaacugucuccguaaaaacgguaaaaaggugauacaacuuucgagaaaaacuuucgauaccgaguaccaaaagacaaagcuaaaugauugggauuuuguuguaacaaccgauauaucagaaaugggagcaaacuuuaaagcagacagggucauagacccuagaaggugccuaaaaccaguuauauuaacagacggacccgagcgaguaauacuggcaggacccaugccaguuaccgcggcuuccgcagcgcaaagacgagguagagucgggcgcaauccgcaaaaagaaaaugaucaauacauuuuuacaggccagccccucaacaaugaugaggaccacgcgcauuggaccgaagcuaaaaugcugcucgacaauauuaacacaccagaagggauaauuccugcauuauuugagcccgaacgagaaaaaucugcagcaauagacggugaauauagauuaaaaggugagaguagaaagacauuuguugagcuaaugcgaagaggagacuuaccuguguggcuugcacacaaggucgccagcgagggaauaaaauacacugacagaaaaugguguuucgauggucaacgaaauaaucagauucuagaagaaaauauggacguugaaauuuggacuaaagaaggcgagaagaagaaacuacguccacgauggcuggaugcccguaccuauagcgaccccuuggcacuaaaagaguuuaaagauuucgcugcaggcaggaaaucaaucgcuuuagacuuaguuacagaaauaggaaggguaccaagccacuuagcacacagaacacgcaacgcacuugacaaucugguaauguuacacaccagugaacaugggggccgagcauauagacaugcaguggaggaacuaccugagacuauggagacauuacuucuacuuggcuugaugauacuucuuacuggcggagcgauguuauucuuaauuuccggaaaagguauugguaagacuucaaucggacucauauguguaauagcgagcucugguaugcucuggauggcagagauaccgcuucaguggauugcaagcgcaauuguauuagaguucuuuaugauggugcuccucauaccagagccagaaaaacagagaacaccccaggacaaccaauuagcuuauguaguaauuggaauauuaacaauggcugcuauaauagcagcaaaugaaaugggcuuguuagaaacaacgaagcgggaccuugguaugucgaaggaaccuggagugguaucaccaaccaguuauuuagauguagauuuacaucccgcguccgccuggacacuguaugcaguggcaaccacaguaaucacaccuauguugcgacauacaauagaaaauucaacugcaaacgugagucuugcagcaauugccaaucaagcugugguacugaugggccuugauaaagguuggccaaucucaaagauggaucucgggguaccccuauuagcacuggggugcuauucgcaaguaaacccgcugacacuuacagcugcuguccuacuuuuggucacacacuacgcaaucaucggcccaggcuuacaggcuaaagcuacaagagaagcacaaaaacguacagcugcaggaauaaugaaaaauccgacgguugacgggauaauuacuaucgaucuagauccaguaaucuacgauagcaaguuugaaaaacaauuaggacagguaaugcuacuugucuuaugugcaguccagcucuuguuaaugagaacgagcugggcgcuaugugaagcucuuacacuagccacugguccaauaacaacucuaugggaaggcuccccaggaaaguuuuggaacacaacaauagcuguuucuauggccaacauuuucagagggaguuaccuagcaggagccggguuggcguucagcauaaugaaaaguguggguacaggaaaaagagguacagguagccaaggugaaacguuaggagagaaguggaaaaagaaauuaaaccaacuaucaagaaaagaguucgauuuauauaagaaaagugguaucacagagguagacagaacggaagcuaaagaagguuuaaaacgcggugagacaacucaucaugcaguaucacgaggcucggccaaacuucagugguuuguugagcggaauaugguuauuccagagggaagggugaucgaccuagguugugggcgcggaggauggucauauuauugugcuggucuuaagaaaguuacagaggucagggguuacacaaagggugggcccggacaugaagaacccguucccaugucaacauauggguggaauauaguaaaauuaauguccgguaaagauguauucuaccuaccaccggagaaaugcgauacacugcuuugugauauuggcgagaguaguccguccccgacaguggaagaauccagaacaauaagaguuuuaaaaaugguagagccguggcugaagaacaaucaauuuuguauaaaaguccuaaauccuuacaugccagcugugauagaacaccuagaaagacuacaaagaaaacacggaggaauguugguaagaaaucccuuaagcagaaacaguacccaugaaauguauuggauuaguaacggaacaggaaacauuguuaguuccguaaacauggugucacgccugcugcuaaaucgguuuacuaugacacaccgccgaccaacaauagagaaggacguagaucuuggcgcgggcacaagacacguaaaugcggagccugaaacuccaaacauggauguaauaggugagaggauuaagagaauaaaagaggaacauaacagcacauggcacuacgaugaugagaauccuuauaagacaugggcauaucacgggaguuaugaaguaaaggccaccgggagugccucgagcaugaucaaugguguaguaaaauuacuaacaaaaccaugggauguaguacccaugguaacucaaauggcuaugacggauacuaccccauuugggcagcaacgaguauuuaaagagaaaguagauacaagaacaccgaggcccaugcccggaacacggaagguuauggagauaacugccgaaugguuauggcgaacccuaggcagaaauaaaagaccaagauuauguacaagagaggaguuuacuaagaaaguaagaaccaaugcagcaaugggagccguauucacggaggaaaaccaaugggauagcgccaaagcggcaguagaagaugaagaauuuuggaaauuaguagaccgugaacgggaacuucacaaacuugguaaguguggaaguugcgucuauaauaugaugggaaaacgggaaaagaagcucggagaauuuggaaaggcaaaaggaagucgugcaauuugguauauguggcucggcgcacgcuacuuggaauuugaagcccuaggcuuucuaaaugaagaucauugguucucuagagagaacuccuauagcggaguugaaggagaaggacuacauaaauuaggcuauauucuacgagauaucaguaaaaucccugguggugcaauguaugcugaugacacagccgguugggacacacgaaucacagaagaugaucuccacaacgaagagaaaauuacacaacaaauggaucccgaacacagacuuuuagcaaaugccauauuuaaguuaacauaccagaacaaaguaguuaaaguucaacgcccaacuccuacuggaacuguaauggauauuauaucccgaaaagaucaacgagguuccggacaagugggaaccuacggacuuaacacauucacaaauauggaagcccaacucgucagacagauggaaggugaaggggucuugucaaagacagacuuggaaaauccacauuugccugagaagaaaauaacacaaugguuagaaacgaagggaguagaaagauuaaagcgaauggcaauaucuggagaugauuguguagugaagccuauugacgauagauuugcaaaugcacuacuggcauuaaaugacaugggaaaagugcggaaggauauaccacaauggcaacccaguaaagguuggcacgauuggcaacaagugccauuuugcagucaucauuuucaugaauuaauuaugaaagacgggcguaagcugguaguaccuugccggccacaagacgaauuaauuggucgagcaagaauaagucagggagcgggauggucucuacgagaaacggcaugccuagggaaggcauaugcucaaauguggaguuuaauguauuuucauaggagagaucuaagauuagcauccaacgcuaucuguagugcuaucccgguucacugggucccaaccucuagaacuacauggucuauacaugcucaccaccaguggaugacaacagaagauauguuaacuguuuggaauaggguguggauagaagauaacccguggauggaggauaaaacaccuaucaccaccugggaaaacguucccuauuuaggaaaacgagaagaucaauggugcggcagucuaauugggcuaacaucacgagcuacuugggcacaaaacauaccuaccgcaauucaacaaguuagaucucuaauaggaaaugaagaauuucuugauuauaugcccucaaugaaacgcuuuagaaaagaagaagagagugaaggcgcuauuugguaa

SEQ ID NO: 22995 - RNA, 9873 nt, Artificial Sequence
  derived and/or modified CDS sequence (opt6) from DENV-3__JX669495__SS-prME
acaucauuauguuugaugaugauauuaccugcagcuuuggcauuucaccugacaucuagggauggagaacccagaaugaucguugguaaaaacgaaagggguaaaucguuacuguucaaaacugcaucgggaauaaauaugugcacgcuaauagcaauggacuuaggugaaaugugugacgauacaguaacauacaaauguccacacauaacagaagucgaaccagaagacaucgauuguugguguaauuuaacgucgacauggguaacauaugggacaugcaaccaagcaggagaaagacgaagagacaaaaggaguguagcucuagcuccacacguugggauggggcuugauacaaggacucaaacauggaugagcgccgaaggagccuggagacaaguagaaaaaguugaaaccugggcauuaagacauccaggcuuuacgauuuuagccuuauuucuagcacacuauauaggaacuucuuuaacccaaaaaguaguaaucuuuauacuucuaauguugguaaccccgagcaugacuaugagaugcguaggaguaggaaacagagacuucguagaaggacugaguggugcaacaugggucgacgugguguuagaacacggaggguguguuacgacuauggccaaaaauaaaccgacgcucgacauugagcuucagaaaacagaagcuacgcaacuagccacacuacgaaaauuaugcauagaaggcaaaaucaccaauauaacaacagauucgagaugccccacgcaaggagaggcgguucuaccagaagaacaagaucaaaacuaugucuguaaacacacauaugucgaccgcggaugggguaauggaugcggacucuucggaaaagggucuuuagucacgugugcaaaauuucaaugucucgaaccgauagaaggcaaaguagugcaauaugagaaucucaaauauaccguaaucauaacaguucacaccggagaucaacaccaaguaggaaaugagacacaaggcgugacagcagaaaucacaccacaagcgucuaccacagaggccauauuaccugaguacgguacguuagguuuagaaugcucgccaaggacagguuuagacuuuaacgaaaugauucuccugacuaugaaaaacaaagccuggaugguccauagacaaugguucuucgaccucccuuuaccauggacgaguggggcaacuacugaaacuccuacguggaauaggaaagaacuauuaguaacguuuaaaaacgcacaugccaagaaacaagaggucgucgugcuaggaagucaagaaggcgcuaugcauacagcuuuaacaggagcaacagaaauacaaaauuccggcggaacgucgaucuuugcaggccauuuaaaaugcagacuaaaaauggacaaacuagaacuuaaagguaugaguuacgcaauguguaccaacacauucguccuaaagaaagaagugagcgaaacucaacaugggaccauauuaauaaaaguugaauauaaaggugaggaugcgccuuguaaaaucccuuucucgacagaagacggacaagguaaagcucauaauggacgauuaauaacugccaauccaguaguaaccaagaaagaagaaccuguaaacauugaagcagaacccccauuuggggaaagcaauauaguuauuggaaucggcgauaacgcccuuaaaauuaacugguauaagaaaggcucgucaauugguaaaauguuugaagcuacugcaagaggggcgagacgaauggcaaucuuaggugacacagcaugggacuuugggagcguagguggaguacuaaacagucugggaaaaaugguacaucaaauuuuuggaucagccuacacagccuuauucucaggaguaucauggguaaugaaaauugguauagggguauuacuaaccuggauuggcuuaaauagcaaaaacaccuccaugucguuuuccugcauugcaauuggaauaaucacauuguauuuaggcgcuguuguacaagcagauaugggaugcguaauaaacuggaaaggaaaagaauuaaaaugcggcucgggcauauuuguaacaaaugaagugcauaccuggaccgagcaauacaaauuucaggcagacagcccuaaaagacuagcuacggccauagccggugcaugggaaaauggaguaugugggauuagaucuacaacgcggauggaaaaucuuuuauggaaacagaucgcaaaugaauuaaauuauauauuaugggaaaacaauauaaaacuaacggucguaguaggcgauauaaucggaguauuggaacaaggaaaacgcacgcuaacuccacaaccaauggaacuaaaauacaguuggaaaaccugggguaaagccaaaauagucaccgcagaaacgcaaaauagcagcuucaucaucgacggucccaacacuccugaaugccccucagcuucaagggcuuggaaugucugggaaguagaagacuacggcuuuggagucuuuacgacaaauauaugguuaaaauuacgagaaguauauacucaguugugcgaccaucguuuaaugucugcugccguaaaggacgaaagagcaguucacgcagacaugggauacuggauagaaagucagaaaaaugggagcuggaaauuggagaaggcaaguuuaauagaagucaaaacaugcacauggccaaaaagucauaccuuguggucaaauggcguccuagaaagcgauaugauaauuccaaaaagucuggcgggaccuauaucacaacacaaccaccgaccuggauaccacacacaaacagcggggccguggcaucuugguaaguuggaacuggauuuuaauuauugugaaggaacgacaguagugauaacggaaaacugugggacuaggggacccucuuugcguaccacaaccguaucaggaaaacuaauacacgaauggugcugcaggucuuguacucuacccccauugagauacaugggggaagacgguuguugguacggaauggaaaucagaccuauaagcgaaaaggaagagaauauggucaaauccuugguauccgcagguagcgggaaaguggacaacuucaccaugggcguccugugucuugcaauucuuuuugaagagguaaugagagggaaauuuggaaagaaacauaugauagcgggcgucuucuuuacguucguauuguugcuaucaggccagauuacguggagggacauggcacacacccuuauaaugauuggcucaaaugcaucugauagaauggggaugggaguaacuuaucuagcacuuauagcaacguucaaaauucaaccauuuuuagcauugggauucuuccuaagaaaauugacaucccgugaaaacuuauuauuaggaguuggguuagcaauggccaccacacugcaauugcccgaagauauagaacaaauggcuaauggcauagcucugggccuaauggcucuaaaacuuaucacccaauucgaaacauaucaguuauggacggcccuaauaucccuaacguguucaaacacuauguuuacuuugacaguugcuuggagaacagcgacgcuaauucuagcaggaguaagucuauuaccggucugccaaagcagcucaaugagaaagacugauuggcugccuauggcgguagcggcaauggggguucccccacuaccacuauuuauauuuucauugaaagauacguuaaaaagacgauccuggccgcuuaaugagggggugauggccguaggccucgugucaauccuagccucgucucuacuacgaaaugaugugccgauggccggcccauuaguugcuggcggacuauugauagcgugcuauguaauaacaggaacgucagcagauuuaacuguagagaaagcugcugauauuacaugggaggaagaagcagagcaaacagggguuucucauaaucucaugauuacuguugaugaugaugguacaaugcggauaaaagacgaugaaacugagaauauacuuacuguauuacuaaaaacagcauuacugauagugucaggaguguucccuuauucuauaccagcuacuuuauugguauggcauaccuggcagaaacaaacucagagaucgggaguucuaugggacguacccuccccaccugagacacagaaagcagagcucgaagaaggagucuacagaauaaagcaacaaggaauauuuggaaaaacacaggugggaguaggcguacaaaaagaaggaguuuuucauacaauguggcacgugacaagaggagcaguacugacauauaacggaaaaagguuggaacccaacugggcaaguguuaagaaagauuuaauuagcuacggagggggcuggcgucucagugcccaauggcaaaaaggagaagaaguacaagucauugcggucgaaccagguaaaaauccgaaaaacuuccaaacaaugccagguacauuccaaacuacaaccggggaaauuggugccauagcacuagacuucaagcccggaaccucaggcaguccaauaaucaaccgggaagggaagguaguuggauuguauggcaauggugugguaaccaaaaaugguggcuauguuucagggauagcgcaaacuaacgcggagccggacggaccgacacccgaauuagaggaggaaauguuuaagaaacgcaacuuaacaauaauggaucuacaucccggaucagggaaaacacgaaaauaccuuccagccauaguucgggaggccauuaaacgucgacuaagaaccuuaauauuagcaccaacacgaguggucgcagcagagauggaggaggcuuuaaaaggacuaccaauacgauaccaaaccacagcuacuaaaagcgaacacacagggagggaaaucguagauuuaaugugucacgccacuuuuacaaugagacuacuaucaccaguacgaguaccaaauuacaauuuaauaauuauggaugaggcccacuuuacggauccagcaaguaucgcggcucgaggcuauaucucgacuagagucggaaugggagaggcagcugcaauauucaugacagcaacgccuccuggcacggcagacgcauuuccacaaagcaacgcuccaauucaggaugaggaacgcgauauacccgagaggaguuggaacaguggaaaugaauggaucacugauuuugcuggaaaaaccgucugguuugugccuucuauaaaagcagguaaugauaucgccaacuguuuacguaagaacggcaagaaaguaauccaauuaucaaggaaaacuuuugacacagaguaccagaaaacaaaauuaaacgauugggacuuugucguaacaacugauauuagugagaugggcgccaauuuuaaagcggaccgagucauugaucccaggagauguuugaaacccguaauauugacggacgguccugaaagaguaauacuagcuggaccgaugccagucacagcagcaucugcggcgcaacggagaggaagagucggcagaaauccucagaaagaaaacgaucaauauauuuucacuggucagccacucaauaaugacgaagaucaugcacacuggacugaagccaaaaugcucuuagauaacaucaauacaccagaggguaucaucccugcguuauuugagccugaacgugagaaaagugcggcaauagacggagaauaucggcuaaaaggcgagucccggaaaacuuuuguugagcuaaugagaaggggagauuuaccagucuggcuagcacacaaaguagccagugaaggaauaaaauacacggauagaaaguggugcuuugacggccaaagaaauaaucaaauauuagaagagaauauggauguagaaauauggaccaaggaaggagagaagaagaaacucagaccucgaugguuagaugcuaggacauauucagacccuuuagcacucaaggaauuuaaggacuucgcggccggucgaaaaucgauugcccuugacuuagucacugaaauagggcggguaccaucacaccuagcacauagaacccgcaaugcccuggauaaccuuguaauguuacacacuagcgaacauggcggacgugcguaucggcacgcugucgaggaguuaccugaaaccauggagacucuauuauuacuaggacuaaugauuuuauugacaggcggagcaaugcuauuuuuaaucaguggcaagggaauuggaaaaacaaguaucggacucauaugcgugauagcguccagcgguauguuguggauggccgaaaucccacuccaguggauugcgucagccauaguacucgaguucuuuaugaugguccuguuaauuccagaaccagaaaagcagagaacaccacaagacaaucaauuggcauauguugucauagguauccugacauuagcugccauaauugcagccaaugaaaugggauuacuggaaacuacuaaaagagaucucggaaugucaaaagaacccggaguaguauccccuaccucauaucuggacguugaucuucacccagccucagcauggacauuauacgcgguggcuacaaccguaauaacgccaaugcuaagacacacaauugaaaacagcacugcaaacgucaguuuagcagcaauugcaaaucaagcaguagucuuaaugggacuugauaagggauggcccaucucaaaaauggaucucgguguaccccuuuuagcguuagguuguuacucacaaguaaacccauuaacucugacugccgcgguacuauuauuaauuacucauuaugcaaucaucgguccagguuuacaagcaaaagcaacaagggaagcacagaaaaggacagcugcugggaucaugaaaaacccaaccguugauggaaucaugacgauagauuuagauccaguaauauaugacucaaaguucgaaaaacaacuaggccagguaaugcuucuaguacuaugugcaguacaguuacuguugaugagaacgagcugggcuuugugugaagcucuaacucuagcaacaggacccauaacuacccuaugggaagguuccccuggcaaauuuuggaacacuaccauagcagugaguauggccaacauuuucaggggaagcuaucuggccggugcaggucuagcauucaguaucaugaaauccgucggcacugguaaacguggcacaggaagccagggagagacauugggagaaaaauggaagaagaaacuaaaucaauuaucucgaaaagaguuugaucuuuauaagaaauccggaauuacagaaguugaccggaccgaagcaaaagaaggguuaaagagaggcgagaucacucaucaugccguaagcagaggauccgcaaaacuacaaugguucguagaaagaaacauggucauaccagaaggucggguaaucgauuuagggugcgggcgaggcggguggucauauuacugugcgggucuaaagaaaguaacugaaguacguggcuacacaaaggguggaccagggcaugaagaacccgucccaaugagcacauacggauggaauauuguuaaacuuaugaguggaaaagauguauucuaccuuccgccugagaaaugugacacacuuuugugcgacauaggagaaucaagucccucaccuaccgucgaagaaucuagaacaauucguguacuaaagaugguagaaccauggcugaaaaacaaccaauuuugcauaaaaguguuaaauccauauaugccaacgguuauugaacauuuagaacgacuacaacgaaagcauggaggaauguugguaagaaauccauuaucaaggaacaguacacaugagauguacuggauuucgaacggcacggguaauauaguugcuaguguaaacaugguaucacgauuacuuuuaaauagauucacgaugacacacagaaggccaacuauugaaaaagauguugaccucggugcuggaaccagacacguaaaugcugaaccagaaacgccaaauauggauguuauaggugaaaggauaaagagaauaaaagaagaacauaacaguaccuggcacuacgaugaugaaaauccguacaaaacgugggcauaucaugguaguuaugaagugaaggcaaccgguagugcuucaucuaugauaaauggcguaguaaaacuuuuaacgaaaccaugggacguagugccgauggucacacaaauggcaaugaccgacaccacuccuuuuggccaacagcguguauuuaaagagaaaguugacacgagaacgccucggucaaugccugggacuaggagagugaugggaauaaccgcggaauggcuuuggcguacacugggaagaaacaaaaagccacgacuuuguacaagagaagaguuuacaaagaaagugcgaacaaaugcugcaaugggagcuguauucacugaagaaaaccaaugggauagcgcaaaagcugcagucgaagacgaagacuuuuggaaauuagucgaccgagaacgcgaacuccacaaacuggguaaaugcggcuccugcguguacaauaugauggggaaacgagagaagaaacuaggugaauuuggaaaagccaaagguagucgggcgauuugguacaugugguuaggagcuagauauuuagaauuugaggccuugggcuuuuugaacgaagaccauugguucagccgugaaaauuccuauucgggcguagaaggcgaaggacugcacaaacuuggcuauauauuacgugauauaucuaaaauuccagguggagcaauguaugccgacgauacugcuggcugggacacgcgcauaaccgaagaugaccuacauaacgaggagaaaaucacacaacaaauggauccagaacauagacaguuggcaaaugccauuuuuaaacuuacguaccaaaacaaaguuguaaagguccagaggccaacucccacagggacugucauggacauaauaucacgaaaagaccagagaggaagcggccaagugggcaccuaugggcuaaauacuuuuacaaacauggaagcccaauuaauacgucaaauggagggcgaaggcguccugucgaaagcagauuuagaaaacccccauuuaccagagaagaaagucacacaguggcuugaaacuaaagguguagaacgguugaagcggauggcaauaaguggagacgauuguguuguuaagccgauagacgauagauucgcgaacgcauugcuagcacugaaugauauggguaaaguaagaaaggauauuccacaauggcaaccaucaaaaggauggcacgacuggcagcaagucccguucugcucacaccauuuucaugaacuaauaaugaaagacgguagaaaauuggucgugccaugucguccacaggaugaacuaauaggcagagcgagaauuucgcaaggagcaggauggucauugagagaaacagcaugccucggaaaagcauacgcgcaaauguggucauuaauguauuuccaucguagggaucuucgguuggcauccaaugcuauaugcucugcuguaccuguacauuggguaccgacaagucgaacuacuuggucuauccaugcacaccaccaguggaugacuacagaggacaugcuuacgguauggaaucgggucuggauagaggacaauccguggauggaagauaaaacaccuguuacuaccugggaaaauguacccuaucuagggaaacgcgaagaccaauggugcggcucccugauaggauugacgucuagagcaacgugggcccaaaauauaccaacggcuauucaacaaguaagaucucucauuggaaacgaggaauuuuuagauuauaugccaaguaugaaaagauuucguaaagaggaagaaagugaaggugcuauaugguag

SEQ ID NO: 22996 - RNA, 9873 nt, Artificial Sequence
  derived and/or modified CDS sequence (opt6) from DENV-3__JX669499__SS-prME
acaagccuuugcuuaaugaugauauugccugcagcacuggcuuuucaucuuacgucucgagacggugaaccuagaaugauuguagggaaaaacgaacgaggaaaaagucuuuuguuuaaaacugcaagugggauaaauauguguacucuaauagcaauggacuugggagaaaugugugaugauacggugacuuauaaauguccacauauuacagaggucgagccagaagacauagacugcugguguaacuuaacuucaacauggguuacuuaugguacaugcaaucaagcuggggaacgucggagggauaaacgaucaguugcauuggcgccacauguagguaugggcuuagauacaaggacacaaaccuggauguccgcugagggagcguggagacaaguggagaaaguagaaacaugggcauuacgccauccaggcuucacaauccuagcauuauuucuugcccacuauauugggacgucccuuacgcaaaaaguaguaauuuucauacugcucauguuagugacgccaaguaugaccaugagaugugucggaguaggaaauagggacuuugucgagggacuuucuggugcaacaugggucgacgugguccuagaacacggugguugcguaaccacaauggcuaaaaauaaaccgacucuugauauagaguuacagaaaacagaggcuacgcaacuagcuacgcuaagaaaacugugcauagaaggaaaaauuacgaauauaacaacagacuccagaugcccaacacaaggugaagcuguacuaccagaagaacaggaucaaaauuacgucugcaaacauacguacguagaucggggauggggaaacggcugcggacuguucgggaaaggaaguuuaguaacaugcgcaaaauuucaaugccuagaaccuauagaagguaaaguuguacaguaugaaaauuuaaaguauaccguuauaauuacaguacauacaggagaccaacaucagguagguaacgaaacucaaggagucacugccgagaucacaccgcaggcuucaacaacugaagcaauucugccugaauaugguacauugggucuggaaugcagcccaagaacuggcuuagauuucaaugaaaugauauuauuaacgaugaaaaacaaagcauggaugguacacaggcaaugguucuuugaucuuccacucccuuggacaaguggugccacaacagaaacaccaacuuggaaucgaaaagaacuacuugugacauucaagaaugcccaugcaaagaaacaggaagucgugguucuagggagucaagaaggagcaaugcauacagcauugacaggagcaacagaaauacaaaauucgggaggaacaucgauauuugcugggcaucuaaaaugucgccuuaaaauggauaaacuugaacuuaaagguaugaguuaugcuauguguacuaacacauucguucuaaagaaagaggucagcgaaacacaacacggaacaauucuaauaaaaguggaguacaaaggugaggaugcaccuuguaaaauuccauuuucaacagaagauggccaaggcaaggcacauaauggccguuuaauuacugcaaacccuguagugaccaagaaagaggaaccagugaacauagaagcagaaccacccuuuggugaaucaaacauaguuauaggaauuggagacaaugcauuaaaaauaaacugguauaagaaaggaucuuccauaggaaaaauguuugaggcaaccgccaggggagcaaggaggauggccaucuugggcgauacugcaugggacuucgggucugucggagggguuuuaaauagucuggguaaaaugguacaccaaaucuucgguucggcguacacggcauuauucucugggguuucaugggugaugaagauuggcauaggcgugcuauugacauggaucggucuuaauuccaagaacacaaguauguccuuuagcuguaucgcuaucgguauaauaacauuauaucucggugcuguaguacaagcagauaugggcugcgugauuaauuggaagggaaaagaauuaaagugugguucaggcauauuuguuacaaaugagguccauacuuggacagagcaauacaaguuccaagccgauaguccuaaacgacuggccacugcuauugcaggggcaugggaaaacgguguaugcggcauacgcaguaccaccagaauggaaaaccuauuguggaaacaaaucgcgaacgaacucaacuauauucuuugggaaaacaauaucaaacuaacugucguaguaggggauauaauaggcguucuugagcaaggaaaacgaacacucacuccacagcccauggagcuaaaauacucauggaaaacgugggguaaagcgaaaaucguuaccgcugaaacucaaaauagcagcuucauuauagaugggcccaacacccccgaaugcccaucugccaguagagcauggaaugugugggaaguugaagacuauggguuuggcguguuuacaacgaacauuuggcuaaaguuacgugaaguauacacgcaauuaugugaucacagguuaaugagcgcugcuguuaaagacgaacgcgcugugcaugcagacauggguuauuggauugaaagccaaaagaacggaucauggaagcuggagaaagcaucccuuauagaaguuaaaacuuguacauggccaaagagccauacccuauggucuaauggaguauuagaaagcgauaugaucauaccaaaaucauuagcgggaccuauaucucaacauaaucauagaccaggguaccacacccaaacagcgggacccuggcacuuaggcaaauuggagcuagauuucaacuauugugaagggacuaccguaguaauaacagaaaauuguggcacccggggcccaucuuuacguacaaccacggucucaggaaaacuaauacacgaaugguguugucguagcuguacuuuaccgccuuuaagauacaugggugaggaugguuguugguacgguauggagauacgaccaauuagugaaaaagaggaaaauaugguuaaaucccuuguuagcgcgggguccggaaaaguagauaacuucaccauggggguuuugugccucgcaauucuauucgaagaaguuaugagaggaaaauucgguaagaaacauaugauagccggggucuucuucacauucguccuauuacuaagcggacaaauaacauggcgagauauggcacacacauuaauuaugauaggaagcaacgcaucugaucgaauggguaugggaaucaccuaccuagcccugauugcgacauucaaaauacagccguuuuuggcguuaggguucuuucugcgaaaacugacaaguagagaaaauuuguuacuugggguaggccucgcaauggcaacaacacugcaguugcccgaagacauugaacaaauggccaacggaauagcgcucggauuaauggcauuaaaauuaaucacucaauuugaaacauaccaguuauggacagcuuuaaucucguuaaccugcaguaacacgauguucacccucaccguggcauggagaacagcuacucuuauauuagcugggguuagucuuuuaccggugugucaaucuuccucaaugcgaaaaacagauuggcucccuauggcaguggcugcgauggguguucccccauuaccacuuuuuaucuuuagccuuaaagacacgcugaaaagaagaaguuggccacuaaaugaaggcgucauggcaguugguuuaguaucaauucuagcuagcucacuuuugcggaacgacgucccuauggcaggaccauuaguagcagggggauuacugauagccugcuacgugauaaccggaacgucagcugacuuaacaguggaaaaagcggcagacaucacaugggaagaagaggcagagcaaacgggugugucacauaaccugaugauaaccguugaugaugacggcacgaugcgcauaaaagacgacgagacagaaaauauucuaacaguacuacuuaaaacagcacuuuuaauaguaagugguguauuuccauauucaaucccggcaacucuauuaguuuggcauacguggcagaaacaaacacaaagaagcggcguauuaugggauguuccaagucccccggagacucaaaaagccgaauuggaggaaggugucuaucggauaaagcaacaagguauauuugggaaaacucaaguaggaguuggagugcaaaaagagggugucuuucauacaauguggcauguuacaagaggugcaguacuuacuuauaauggcaaacgucuagaaccaaacugggcaucaguuaaaaaggaccuuaucaguuauggaggcgguuggcgucugagugcacaauggcagaaaggugaagagguucaagugaucgccguggaaccaggaaagaacccgaaaaauuuucagacaaugcccggaaccuuucaaacgacgacaggagaaauuggggccauugccuuagacuuuaaaccaggaacaucugggucaccuaucauuaacagagaagguaaagugguuggcuuguauggaaaugguguugucacaaagaauggaggauacguaagugggauagcucaaaccaaugcagaaccagauggcccuacuccugaacucgaggaagaaauguuuaagaaacguaaccucacaauaauggaucugcaucccgggucaggaaaaacaagaaaauaccucccugcuaucguaagagaggccauuaaaagaagacugcggacauuaauauuagcaccaacacgcguaguagcugcggaaauggaggaggcccuaaaaggucucccuauacguuaucaaacgacagcgacuaagucagagcacacggggagagaaauaguagaucuaaugugucaugccacauucaccaugcgcuuguuaucucccguccgaguaccaaauuacaaucuaauaaucauggacgaagcacauuuuacagauccggcuaguaucgcugcuagaggcuauauaucaacacggguuggcaugggggaagcggcagcuauuuuuaugacagcuacaccacccggaacagcagacgcauuuccucagucaaaugcaccuauacaggaugaggaacgggauauuccugaaagaagcuggaauagugggaaugaauggauuaccgacuucgccgggaaaacgguaugguuuguuccaagcauuaaagcuggaaaugauauagcaaauuguuugagaaagaacggcaagaaaguuauacaacuuucccgcaagacauuugauacggaauaucagaaaacuaagcuaaaugacugggacuuugucgugacaacagauauaagcgaaaugggggcgaauuuuaaagcggauagaguaauugaccccagaagguguuugaaaccaguuauccuaaccgauggaccugaaagaguaauauuagcaggcccaaugccugucacagccgcgucagcugcacagcguagaggaagaguugguagaaauccacaaaaggaaaaugaccaauauauauuuacaggccaaccacuaaacaaugacgaagaucacgcccauuggaccgaggcaaagauguuauuagauaauauuaauacacccgaaggaaucauuccugcccuauuugaacccgaaagagaaaagucagcagcuauagauggagaguauagacugaagggugagagcagaaagacguuuguggagcucaugagaagaggagaccugccggucuggcuugcucacaaaguagcaucagaagguauuaaauauacagauagaaaauggugcuuugaugggcaaaggaauaaucaaauccuagaagaaaauauggauguugaaaucuggacgaaagaaggugagaagaagaaacugcguccaagauggcuagaugcacgaaccuauucagaucccuuagcacuaaaggaauuuaaggauuucgcugcuggucggaagucgaucgcacuagaccugguaacagaaauagggcgcgugcccucccauuuagcacaucggacgagaaacgcguuggauaauuuaguuaugcugcauacgucugaacacggugggagagcauauagacaugcagucgaagaauugccagaaacgauggaaacgcuacucuuguuagguuuaaugauacuguugacagguggagcaaugcuauuuuuaaucaguggaaaaggaauuggaaaaacaaguauuggauuaaucuguguaaucgcaagcagugggauguuguggauggcggaaauaccucuucaauggauagcaucagcuauuguacuugaguucuuuaugaugguucuuuuaauaccagaaccggagaaacaaaggaccccucaagauaaucagcuagcuuaugugguaauuggcauucuaacauuagcugcaauaauugcagcaaaugaaaugggcuuacuggaaacgacaaaaagagauuuaggaaugucgaaagaaccaggaguagugucaccaacaagcuauuuagaugucgaccuucaccccgcaucagcuuggacguuauacgcaguagcaaccacagugauuacacccauguuacgucauacaauagaaaacagcacggcuaauguaagucucgcugcaauagcaaaucaagccguugucuugaugggacuagacaaaggauggccuauuuccaaaauggaucugggggucccuuuauuagcuuuggguuguuacagucaaguaaacccacuaacacuaacagcagcaguguugcuacugaucacacacuacgcaauuauugggccaggacuacaggcgaaagccacaagggaggcucagaaaagaacugcagcuggaauaaugaaaaauccaacaguagacgggauaaugacaaucgaccucgauccuguuaucuacgauaguaaauucgaaaagcaguuggggcaagugaugcuccuaguccucugugcaguucaauuacugcuaaugcguacauccugggcacuaugcgaagcacuaaccuuagcaacuggaccuauuacgacacucugggaagggucaccaggaaaauuuuggaauacuacuauugcuguaucaauggcuaauauauuuagggggucauauuuggccggugcuggucuugccuucuccauaaugaaaucaguugguacagguaaaagagguaccgggagccaaggugagaccuuaggagaaaaauggaagaagaaacuaaaccagcuauccaggaaggaguuugauuuauacaagaaauccggaauuacagagguagacagaacggaagcuaaagaaggccuaaaacgaggugaaauuacucaucaugcaguaucacgagguagcgcgaaauuacaaugguuuguagagcguaacaugguuaucccagaaggaaggguaauugaccuagguugcggaagaggcggaugguccuauuacugugcaggucucaagaaaguaacggaaguaagaggauauacaaaaggaggaccuggucaugaagaaccgguuccaaugaguacuuacgguuggaauaucguaaaacuuauguccggaaaggauguuuucuauuuacccccagaaaaaugcgauacucuguuaugugauaucggagaauccagucccucacccacaguagaagaaucacgaaccauucgagugcugaaaaugguagaacccuggcucaaaaauaaucaguuuuguauuaaaguucuuaauccuuauaugccaacaguaauagaacauuuagaacgccuacagaggaagcacggcggaaugcuuguccgaaacccucuaucgagaaauaguacccaugaaauguauuggauauccaauggaacaggcaauauuguggcaaguguaaauaugguaucaagacucuugcuaaaccgauucacgaugacccacaggaggccgacgauagaaaaagacgucgaccugggggcuggaaccagacacgucaaugcagagccagagacaccuaauauggacgugauaggcgagaggauaaagagaauaaaagaagaacacaauucaacauggcauuaugaugacgaaaaucccuauaaaacaugggcuuaccacggaucauacgaggugaaagcaacugguagugcgucuucaaugauaaauggaguaguaaaacuacuaacgaaaccuugggauguaguaccuaugguaacacagauggcuaugaccgauacaacaccauuuggacaacagcguguuuucaaagaaaaaguugauacacguacuccccgaaguaugccuggaacgcggcgugugauggguaucacagccgaguggcucuggagaacauuaggaagaaauaaaaagccgagacuguguacuagggaagaauuuacuaaaaagguuaggacaaaugccgcaaugggugcaguauuuacagaggagaaccaaugggacagugcaaaagcagcaguggaggacgaagauuuuuggaagcuagucgaccgcgaaagagaauuacauaaacuuggaaaauguggauccugugucuauaauaugauggggaagcgcgagaagaaauugggagaguucggcaaagcuaaaggcaguagagcuauaugguauauguggcuaggagccagauacuuagaguuugaagcauuaggauuuuugaaugaagaucauugguuuaguagagaaaauucuuacucugguguugagggcgaaggguuacauaaacugggauauauucuacgagauauaaguaaaauaccgggcggagcgauguacgcagacgauacagccgguugggauacaaggauuacggaagaugaccuccauaacgaagagaaaauuacccaacagauggauccugaacaccgucaauuagcgaaugcaauauuuaaacugacuuaucaaaauaaaguuguuaaagugcaacgccccacgccaacaggcaccguaauggauaucauuaguagaaaagaccagagagggagcggucaaguaggaacuuacgggcucaacacuuuuacaaauauggaagcccaacuuauaaggcagauggagggugaaggaguccucucuaaagcugacuuagagaacccgcauuuacccgaaaagaaaauuacccaaugguuagaaacgaaaggagucgaaagauuaaaaagaauggccauuucaggggaugauuguguaguuaaaccaauagaugaccguuucgcaaaugcauuauuggcguuaaacgauauggggaaaguaagaaaagauauuccucaguggcaaccuagcaaaggcuggcaugauuggcaacaagucccauuuugcucucaccauuuucaugaauuaauaaugaaggauggcagaaaacuugucgugccuugucgaccacaagaugaguuaauaggacgggcaagaauaagccaaggagcugggugguccuuacgagaaacugcaugccuuggcaaagcauacgcccaaauguggucuuuaauguauuuucaucgaagagauuuaagacucgcuucuaaugcgaucugcagugcugugccuguucacuggguaccgacaucaaggacgacuuggucuauacacgcgcaccaccaauggaugacgaccgaagacaugcugacggucuggaacagaguauggaucgaagauaauccuuggauggaagauaaaaccccgguaacgacaugggaaaauguuccauacuuaggaaagagggaagaccaauggugcggaagucuuauagguuugacaucaagagcuacaugggcucaaaauaucccgaccgcaauacaacaaguaagaucguuaauugguaaugaagaguuccucgacuacaugccaaguaugaaaagauuccgaaaagaagaagagucagagggcgcaauaugguaa

SEQ ID NO: 22997 - RNA, 9873 nt, Artificial Sequence
  derived and/or modified CDS sequence (opt6) from DENV-3__JX669492__SS-prME
accuccuuuugccuuaugaugauauuacccgccgcacuugcauuccaucugacgucaagagacggugaaccuaggaugauaguaggcaaaaaugaacgaggaaaaucacucuuguuuaaaacagcaaguggaauuaauauguguacguuaaucgcuauggaccucggagaaaugugcgacgauacggugacauacaaauguccucauauaacugaaguagaaccugaagacauugauuguuggugcaauuuaacuagcacuuggguuacauaugguaccuguaaccaagcaggagaaagacgacgagacaaaagaagcguagccuuagcgccacaugucgggaugggacuagauacaaggacucagacauggaugucagcugaaggugcuuggagacaaguugaaaaagucgaaacaugggccuugcgacauccgggauucacuauauuagcccuauuucuugcccauuauauaggaacuucgcucacccaaaaaguuguaauauuuauucuguuaauguuaguuacaccaaguaugacgaugagauguguaggaguugguaacagagauuucguggaaggucuuucgggagcuacguggguagaugucguucuggaacacggaggaugugucacaacaauggcgaaaaacaagccaaccuuggacauagagcuucagaaaacggaggccacacaauuagcgacauuacgaaaacuguguauugaagggaaaauaacuaauauaacaacugauagucgcuguccaacucaaggcgaggcuguccucccagaagaacaggaucaaaauuacgucugcaaacacacauacguagaucguggcugggguaacgguuguggacuuuucggcaaagggucccucguuacaugcgcaaaauuccaguguuuagaaccaauugaagggaaaguaguccaauacgaaaaccuuaaauacacaguaauuauuaccguccauacuggggaccagcaucaaguaggaaacgagacucagggaguaacggcagaaaucacaccgcaagcaaguaccacugaagcaauacuuccugaguauggaacgcuugguuuagaaugcaguccaaggacaggauuggauuuuaaugaaaugauuuuauuaacaaugaaaaauaaggcguggaugguacaucgucaaugguucuuugaccucccucuaccauggacguccggcgcgacaacggagacaccaacuuggaauagaaaagaauuguuaguuacuuuuaaaaacgcucaugcuaagaaacaagaagucguugucuuaggcucucaagaaggcgcgaugcauaccgcacuuaccggugcaacugaaauacaaaacucgggugggaccagcauauuugcugggcacuugaaguguagacucaaaauggauaaauuggaauuaaaaggcaugucguaugccauguguacuaauacguuuguacucaagaaagaagucagcgaaacacagcauggaaccauacugauaaaaguagaauauaaaggggaagacgcaccauguaaaauaccauuuagcacagaggacggacaaggaaaagcgcauaauggacgccuuauuacugcuaauccaguagugacuaagaaagaagaaccgguaaacauagaagccgaaccuccuuuuggagagagcaacauugucauuggaaucggagacaaugcacucaaaauuaacugguacaagaaagggucaagcauuggaaaaauguuugaagcuaccgcacgcggggccaggaggauggcgauauuaggugauacagcuugggauuuugguagcguagguggaguacuaaauucacuuggcaaaaugguccaccaaauauuuggaucugccuauacagcccuguucagugguguuaguuggguuaugaaaauaggaauaggaguacuccuuacuuggauaggacucaacaguaaaaauacgucuaugaguuucagcuguauagcaauaggcauuauuacgcucuaucucggagcaguaguucaagcagacauggguugcguaauaaauuggaaggggaaagaacuaaaaugcgggucaggaaucuuuguaaccaacgaaguacauacuuggacggaacaauauaaguuucaagcggauucaccgaaacgauuagcaaccgccauagccggggcuugggaaaaugggguaugcgguauccggucgaccacacguauggaaaaccugcuauggaaacagauugcuaaugaacucaacuauauacuaugggaaaauaauauaaaacucaccgugguuguaggagauauaauaggaguauuggaacaaggaaaaaggacauugacaccacaaccaauggaacuaaaauauucuuggaaaaccuggggaaaagcuaaaauagucacggcagaaacgcagaauagcuccuucauaauagauggaccuaacaccccagaauguccaagcgcaaguagagccuggaauguuugggaaguagaagacuacggauuuggaguguuuacuacuaacauauggcuaaaacuaagagagguauauacccaguuaugcgaucaucgucuaaugucggcggcuguaaaagaugaacgagccguacacgcugauaugggauauuggauugagucucagaaaaacgguuccuggaaauuggaaaaggccucauuaaucgaagugaaaacaugcacauggccgaaaagucauacgcuauggaguaacgggguauuagagucugauaugauaauaccuaaaagucuagccgggccaauuagucaacauaaucaucgaccgggguaucauacacagacugccgguccauggcaucuagggaaguuagaacuagacuucaauuauugugaagguacaacaguaguuauaaccgaaaauugugguacaaggggaccgucauuaagaacaaccacaguuucggguaaacuaauucacgaguggugcugcagaagcugcacauuaccaccacucagauauaugggggaagacggaugcugguauggaauggaaauaagaccgauaucugaaaaggaagaaaacaugguaaaaucgcugguuuccgccggaucaggcaaggucgacaauuucacuaugggcguacugugccuggcuauucuauucgaagaaguaaugagggguaaauucggcaagaaacacaugauagccgguguauucuucacauucguucuauugcucucaggacaaauaacuuggcgugauauggcucacacccucaucaugauaggaagcaaugcauccgauagaauggguaugggggucaccuaucuugcguuaauagcuacguuuaaaauccaaccauuuuuagcacuggguuucuuuuugcgaaaacuaacaaguagagaaaacuuguuacugggcguagggcuugcuauggcaacgacuuuacaauuaccugaagacauagaacaaauggccaauggaauagcuuuagguuuaauggcgcugaaacuaauaacccaguuugaaacauaccaauuauggacggcauuaauaucuuuaaccuguaguaauacgauguuuacccucacaguugcuuggaggaccgccacuuuaauccuagcugggguaagucuacugccuguuugucaaagcagcuccaugcgcaagacugauuggcuuccuauggcaguggccgcaaugggaguacccccucuaccauuauuuauauuuagucuaaaagauacgcuaaagagaaggucauggccucuaaacgaaggcgugauggcaguaggguuaguaucuauuuuggcuucgagcuuauugcggaaugacguaccgauggcagguccccuuguugcugguggucuacucauagcuuguuaugucauuacaggaacaucugccgauuuaacagucgaaaaggcggcagacaucacgugggaggaagaagcggaacaaaccggaguuagccauaaccuuaugauaacuguagaugacgauggaacaaugcgaauaaaagacgaugagacagaaaauauucuuaccguccuauugaagacugcacuucucauagugucggguguuuuuccauacagcauccccgccaccuuauuaguauggcacaccuggcaaaagcaaacgcagagaucaggcguuuuaugggauguaccaucaccaccagaaacucaaaaggccgaacucgaggagggaguuuaucggauaaaacaacaaggaauauuuggcaaaacacaaguaggcguaggaguacaaaaggaagguguauuucacaccauguggcacgugacacgcggagcuguauuaacuuacaacggaaaacgacuagaacccaauugggcuucagucaagaaagaucugauaucauauggaggcggauggagacuaagcgcacaauggcaaaaaggcgaagaaguacagguaauagcaguagaaccggggaaaaacccgaaaaacuuccagacaaugcccgggacauuccaaaccacaaccggagaaaucggcgcuauagcacucgacuuuaaaccuggcacgagcggaucaccgaucauuaauagggaagggaaaguagucggccuauacggcaauggggucguuacuaagaaugguggauaugugaguggaauugcacaaacgaaugcggaacccgauggcccgacuccagaacuagaggaagagauguuuaagaaaaggaaccuaacuauuauggauuuacaucccggcucaggcaaaacucggaaauacuuaccggcuauuguucgagaagccauaaaaagaagauugaggacacugauacucgcaccaaccagaguugucgcugcugaaauggaagaagcauuaaaagguuugccaaucagguaccagaccacagcgacgaaaucugaacauacgggaagagagaucguggaccuuaugugucaugcaacguucacgaugcgcuugcuaucuccaguuagagugcccaacuauaauuuaauuauaauggaugaagcacauuucacagacccugcauccauugcagcaagaggauauaucucaacuagaguuggaaugggagaagccgcggccauauucaugacggcaacucccccaggaacggcagaugccuucccccagucaaaugcaccaauacaagaugaggaaagggacauuccagaaaggucauggaauaguggaaaugaguggauuacggauuucgcgggaaagacuguuugguuuguuccuucuauuaaggcaggaaaugauauagcgaauugccucaggaaaaacggaaagaaggugauccaacucucacguaagaccuuugacacugaauaccagaaaacuaagcucaaugacugggauuuuguaguaacaacagauauaucggaaaugggagcuaauuucaaagcagaccgaguuauagauccacguagguguuugaaaccgguaauacuaacagaugguccagaaagaguuauucuggcuggucccaugccaguuacugccgcuucagcagcgcaaagacgugguagggugggaagaaauccccaaaaggagaacgaucaauacauauuuaccggccaaccccuaaauaaugaugaggaccacgcucacuggacugaggcaaaaaugcuuuuggacaauauaaacacucccgaaggaauaauaccagcgcuuuucgaaccugaaagggaaaagucggcugcuauagauggagaguaucgccuuaaaggcgagucgcgaaagaccuuuguugaauugaugcgacguggagauuugccgguauggcuagcgcauaaaguggcaagugaaggcauaaaguauacagaccgaaaaugguguuuugauggucaacgaaauaaccaaauauuagaggaaaauauggacguggaaauauggacaaaagaaggcgagaagaagaaacuaagaccccgaugguuagaugcgcgcacauacucggacccacuagcccucaaagaguucaaagauuucgccgccggaagaaaguccauugcgcuggaucuaguuacugaaauagguagagugccgagccacuuagcacacaggacucgaaaugcgcuugacaaucugguaaugcuacacacaucugaacacggcggcagagcuuaccgacacgcgguggaggaacuuccagagacuauggagacucuccuacugcuaggguuaaugauauuauuaacugguggagcuauguuauuucuuaucagugguaaaggcauuggaaaaacgucaauugguuuaauauguguaauagcuucuaguggaaugcuuuggauggcagagauaccucuacaauggauagcauccgccauaguauuggaguucuucaugaugguauuacucauaccugaacccgaaaaacaacgcacuccacaagacaaucagcuugcauaugucguuauuggaauuuuaaccuuagcagcaauaaucgccgcaaacgaaaugggccuuuuggaaacaacuaagcgugauuuaggaaugucgaaagaacccggaguuguuucaccuacgaguuauuuagauguugaucugcauccagcuagugcuuggacccuauaugccguugcaaccacaguuauaacucccaugcuuagacauacuauugaaaacucuacugcgaaugugucguuagcagcaauagcaaaucaggcgguugucuuaauggguuuagacaaaggguggccuauaucaaaaauggauuuaggagugccucuauuagcguuaggauguuauucacaagugaacccauuaacacugacagcggcaguauuacuauuaauaacacacuaugcaauaauaggccccggccuucaagcgaaggcuacacgagaagcacagaaaagaacugcagcaggaauuaugaagaauccaacugucgacggcaucaugaccauagacuuagauccgguaaucuaugacucaaaauucgaaaaacaacucggccagguaaugcuucuaguuuugugcgcaguacaauuguuacuuaugagaacaaguugggcguugugugaggcucuaacauuagccacggguccaauaaccaccuuaugggagggcagucccgggaaguucuggaauacaacaauugcaguuucuauggccaauauuuucagggguaguuaccuugcaggagccggucuagcguuuaguauaaugaaauccgucggaacuggcaagcgaggaacugguagccaaggcgaaacccugggagaaaaauggaaaaagaaacuaaaucagcuaucuagaaaagaauuugauuuauauaaaaagaguggaauuacugaagucgaucguacagaagcgaaagaaggguuaaagcguggcgagauaacucaccacgcaguuaguagaggaagugcgaaguuacagugguuugucgaacggaacauggucauacccgaagggcgcguuauagaucuuggauguggcagaggaggauggucauacuacugcgcuggacuaaagaaaguaaccgaagugagaggauacacuaaaggcgguccagggcaugaagaaccugugccuauguccacauacggguggaauauaguuaaauuaaugucagggaaggauguguucuauuuaccuccugaaaagugcgacacguuauuaugcgacauaggugaaagcucaccuaguccuacgguugaagaaucaaggacuaucagggucuuaaaaauggucgaaccuugguugaaaaauaaucaguuuugcauaaagguucuaaacccuuauaugccgacuguaauagaacacuuagaaagacuacaacgaaaacauggaggcauguuaguacgcaauccccugucgagaaacaguacacacgaaauguauuggauaaguaacggaacggguaauauaguagcaucuguuaauaugguaucaagguuguuauuaaaucgauuuacgaugacacauagacguccuaccauagaaaaagacguagacuuaggcgcggguacaaggcauguaaaugcagaaccugaaacaccaaacauggaugucauaggagaaagaauaaaacgaauaaaagaagaacauaacucgacuuggcacuacgacgacgaaaauccauauaaaacaugggcauaccacggcucauaugaggucaaagcuacugguucugcaucaucaaugaucaaugguguagugaaauuguuaacaaagccaugggaugucgucccuaugguaacacagauggcgaugacagauacgacaccguuuggacaacaacgcguuuuuaaagaaaaaguugauacccggacgccgaggucaaugccagggacacggagaguaauggguaucacagccgaauggcuauggagaacguuggggcgcaauaaaaagcccaggcucugcacuagagaggaguucacaaagaaaguuaggacuaaugcagcaaugggugcaguguucacugaggaaaaucaaugggacagcgcaaaagcagcgguagaggaugaagauuucuggaaauuaguugauagagaaagagaacuacauaagcuggggaaaugcgggaguuguguauauaauaugaugggaaaaagagagaaaaaguuaggagaguucggaaaggcaaaaggaucaagagcaauaugguacaugugguugggagcuagauaccuugaguucgaagcgcuagguuuccuaaacgaagaccauugguuuaguagagaaaacucauauucgggugucgaaggagagggacugcacaaacugggcuauauuuuacgagacauaucgaagauaccuggaggugcgauguaugcggaugacacugcagggugggauaccaggauaacagaagacgacuuacauaacgaagagaaaauaacacaacagauggacccugaacaucggcaacuugccaaugcaauuuuuaagcugacguaccagaauaaaguaguuaaaguacaacgaccaacacccacagguacaguaauggauauuauaagucgaaaggaccaaagggguagugggcagguaggaacauacggauuaaacacuuucaccaauauggaagcacaacuaauacgacagauggaaggcgaaggaguccuuaguaaggcagaucuagaaaauccacaccuaccggagaagaaaauuacccaauggcuagagacgaaaggaguugaaaggcuuaaacgaauggcuauaaguggagaugauuguguagugaagccuauagacgauagguucgcuaaugcauugcuagcacuuaaugacauggguaaaguaagaaaggauauaccacaauggcagccaagcaagggauggcacgauuggcaacaaguaccauuuugcucucaucauuuccacgaauuaauaaugaaagacgggagaaaauuaguaguuccuuguagaccccaagaugaauuaauaggaagggcaaggauuucccagggggccggauggucacugagagaaacagcuugcuuaggaaaagcguaugcccaaauguggagccuuauguauuuccaucgaagagaucuuaggcuagcauccaacgccauauguagcgcggucccaguacauuggguaccgacaaguagaacaacauggaguauacaugcgcaucaccaauggaugacgacugaggauaugcuaacaguauggaaucgaguguggauagaagauaacccuuggauggaagacaaaacgcccguuacaaccugggaaaacgugccauaccugggaaaacgugaagaucaguggugcggaucauugaucggccuaacauccagagccacaugggcucaaaauauaccaaccgcaauccaacaaguccguaguuuaauaggaaaugaagaguuucuagauuauaugccaucuaugaagagauucagaaaggaagaagaaagcgagggcgcaauaugguaa

SEQ ID NO: 22998 - RNA, 9873 nt, Artificial Sequence
  derived and/or modified CDS sequence (opt6) from DENV-3__JX669500__SS-prME
acgagucucugucugaugaugauuuuaccagcagcauuagcguuccauuuaacuucacgcgauggugaaccacgaaugauaguugggaaaaaugaacgcgggaaauccuuacuguuuaaaacugcgucagguauaaacauguguacauugaucgcuauggaccuaggagaaaugugugaugauacagucacguacaaauguccucauauuacugaagucgagccugaagacauagauuguugguguaauuuaacuucgacuuggguaaccuaugggacuugcaaucaagcaggggaacggcggagggauaaacgguccguggcucuagcaccacacguagggaugggacuggauacuagaacucaaacuuggaugucugcugaaggagcauggagacaaguagaaaaaguugaaacaugggcauuaagacauccgggguucaccauucucgcacuauuccuugcucacuauauagguacuagccuaacacaaaaagucguaauauucauauuauugauguuaguuacuccauccaugacaaugagguguguagguguuggaaaccgagacuuuguagagggauuaucaggagcgacauggguagauguaguccuagaacauggaggaugugucaccacaauggcuaaaaauaaacccacauuagacauugaacuccagaaaacggaagcaacccaauuagcaacguuacguaaacuauguaucgaagguaaaaucaccaauauaacaacugacucgcguuguccuacacaaggugaggcuguguuacccgaagaacaagaccaaaacuaugucuguaaacauacauauguagaucgcggaugggguaauggaugcggauuauuuggaaaagguucauuaguuacaugugcgaaauuucaaugcuuagaaccaauagaaggaaaaguaguccaauaugaaaaucuaaaauacaccguuauaauuacgguacacacuggugaucaacaucaagucggaaaugaaacccaagguguuacugccgaaauuacaccgcaagcaucgacuaccgaagccauacugccagaauauggaacgcuaggacuagagugcagcccaagaacuggauuggauuucaaugaaaugaucuuacuaaccaugaagaacaaagccuggaugguucaccggcagugguucuuugaucugccucuaccauggacauccggagcaacuacugaaacacccacauggaauaggaaagaauuauugguaacuuuuaaaaacgcacaugccaagaaacaagaggugguggucuuagggagccaggaaggugcgaugcacacugcgcugacuggagccacggaaauucaaaacagcggugggacaagcauauuugcaggccauuugaaauguaggcuaaaaauggauaaauuagaauuaaaaggaaugagcuacgccaugugcaccaacacguucguccuaaagaaagaagugucugaaacacaacaugguacuauauuaauaaaaguugaauacaagggugaagaugcucccuguaaaauccccuuuucuacggaggauggccaagguaaagcucacaauggaagguuaauuacagcaaauccagugguuaccaagaaagaagaaccaguuaauauagaagcagaaccaccauucggagaauccaacauuguaauagguaucggagacaaugcacuaaaaauaaauugguacaagaaagguaguucaauagguaaaauguuugaagcaacagcaagaggagccagaagaauggcaauuuuaggggauaccgcaugggauuuuggaaguguuggcgguguucuuaauucguuaggaaaaaugguacaucagauauuugguucagcuuacacagcacuauuuaguggcguuuccugggucaugaagauaggcaucggcguuuugcuuacuuggauugggcuuaacucuaaaaauacgucgaugucuuuuucuuguaucgcgauaggaaucauuacacuauacuuaggcgcaguuguacaagcugacaugggaugcguuauaaacuggaaaggcaaggaacuuaaguguggauccggcauuuuugugacgaaugaaguccacacguggaccgagcaguacaaguuucaagccgacaguccuaagagauuagcgacagcaaucgccggagcgugggaaaauggcguuugcggaauacgaaguacuacuagaauggaaaacuuauuguggaaacaaauagccaacgaguuaaauuacauauugugggaaaacaauauaaaauuaacugugguaguuggcgacauaaucgguguuuuagagcaagguaagaggacacuuacgccacagccaauggaauuaaaauauucguggaaaacaugggggaaagcaaagauaguuaccgccgaaacacagaauagcaguuuuauuauagacggaccaaacacaccagaaugucccagcgcaagcagagccuggaacgucugggaaguggaagauuacggauuuggcguguucacaacuaacaucuggcucaaauuaagagaggucuacacccaacuuugugaucacagacucaugucugcugcaguuaaagaugaacgcgcaguucacgcugauaugggcuauuggauagaaucacagaaaaacgggucauggaaauuagaaaaagcuagccuaauagaggugaaaacgugcaccuggccaaaaucacacacuuuauggucgaauggugucuuagagucggauaugaucauuccaaaaucauuggcugggccuauaucacaacacaaucauaggccggguuaccacacucaaacugcaggcccuuggcacuuaggcaaacuugagcuagacuuuaacuauugcgaagggacgaccgucguaaucacagagaacugugguacuagaggaccgucuuuacgaacgaccacugucaguggaaaauuaauccaugaaugguguugucguuccugcacgcuuccuccgcuacgauacaugggagaagacggcugcugguaugguauggaaauaagaccgauauccgagaaggaagagaacaugguaaaaaguuugguuagcgcugggaguggaaagguugauaauuucaccauggguguccuaugucuugcgauauuauucgaagaaguaaugcgagggaaauuuggcaagaaacacaugaucgcuggcguauucuuuacauuuguauuacuacucuccgggcaaauaaccuggagagauauggcacacacccuuauaaugaucggcaguaaugcaagugaucggauggguaugggcguaaccuaucuagcuuuaauugcuacuuuuaaaauacaaccuuucuuggcacuaggauucuuuuugcggaaguuaacuucaagggaaaaucuauuacuuggggugggguuagcuauggcaacaacauuacaauuaccggaggacaucgaacaaauggcaaauggcaucgcccuuggauuaauggcacuaaaacuuauaacacaauucgaaacauaccagcuguggacugcucugauaagccuuacuuguucuaauacuauguucacgcucacaguagcauggcguacagccacauugauauuggcaggcgugagccugcugcccguuugucagagcucgaguaugcgaaaaacagacuggcuaccaauggcaguagccgcaaugggcgucccgccacucccguuauucauuuucagucuaaaagacacauuaaagcguagaucuuggccacugaaugaagguguaauggcaguaggcuuaguaaguauauuagcuuccuccuuguugaggaaugacguacccauggcaggaccucuagucgcaggggguuuauugauagcauguuacguuaucaccgggacgucagcagauuuaaccguagaaaaagcagcagacauuacuugggaagaagaggcugaacaaacaggaguaagucacaaccuaaugauuacagucgaugaugacgguacgaugagaaucaaggacgacgaaacagaaaacauauuaaccgugcuccuaaaaacagcauuauuaauaguaucgggaguauucccuuacuccauaccugcaacuuuauuaguauggcauaccuggcaaaaacaaacacaacguucaggaguauugugggacguaccgaguccaccggaaacacaaaaagcagaauuagaagaagggguuuaucgcauaaaacaacaagguauauucggaaaaacgcaaguagggguggguguucaaaaagaaggaguauuccacacaauguggcacguaacaagaggagcuguauuaacguacaauggaaaacgauuggaacccaacugggcuucaguuaagaaagaucugaucagcuacggaggcggcuggcgucuuucagcacaguggcagaagggagaagagguacaaguaauagccguagaaccgggcaaaaacccgaaaaacuuccagacaaugccugguaccuuucaaacaacuacuggugaaauaggagcaauagcauuagauuuuaaaccugguacgagugguucacccauaauaaauagagaaggaaaaguaguaggauuauaugguaaugggguaguaaccaaaaaugguggauauguaucagguaucgcccaaacaaaugcagaaccagaugguccaacuccggaacuagaagaagaaauguucaagaaaagaaacuuaacaauuauggaccuacacccagguagcgguaaaacuagaaaauacuuaccugccauaguucgagaggccauaaaaagaagauuacgaaccuuaauauuagcgcccacacgugucguugccgcagaaauggaggaagcacugaaaggacuaccaauaagguaucagaccacagcgacgaaaucagaacacacuggacgagaaauagucgaccuaaugugucacgccacguuuacaaugaggcucuuaucgccaguacgggucccuaauuacaacuuaauaaucauggaugaagcucauuucacagacccagcaaguauagcagcuaggggcuauauaagcaccagaguaggcaugggcgaagcagcugcaauauuuaugaccgcaacacccccaggaacagcugacgcauuuccccaaaguaaugcacccauacaggaugaagaaagagauauaccagagcggucuuggaauagugguaaugaauggauuaccgacuuugcugguaaaacaguaugguuuguuccuaguauuaaagcuggaaaugauauagccaauugucuucgcaaaaauggcaagaaaguaauccaacuuagccggaagacauuugauacagaauaucagaaaacuaaacucaaugacugggacuuuguuguuacgaccgacauaucugaaaugggggccaacuuuaaggcugacagaguaauugauccuagaaggugccuaaaaccggugauauuaacagauggcccagaacgcguuauauuagccgggccuaugccaguaaccgcugcuucagcagcacaaaggcgcggucgagucgguaggaacccucaaaaagaaaacgaucaguauauuuuuacaggccaaccauuaaauaaugaugaagaucacgcgcauuggacagaggcaaaaauguuauuagacaauauaaauacaccugaagggauaauuccggcuuuauuugagccugaaagggagaaaagcgcagcaauagauggagaguaccgacucaaaggagagucuaggaaaacauuuguggaacugaugaggagaggggaucuaccaguuuggcuagcacacaagguagcaucugaaggaaucaaauauacugaucgcaaauggugcuucgauggucagcgaaacaaucaaauauuagaggagaacauggacguagaaauuuggacaaaagaaggagagaaaaagaaacuccgcccgcguuggcuagacgccagaacauacagcgaccccuuggcccuaaaggaauuuaaggauuuugcggcagggcgaaaaaguauugcgcuugacuuaguaacagaaaucggaagaguuccuagccacuuagcacaucguacgagaaacgcucuagauaaucuaguuaugcuacacaccucugagcauggaggaagggcuuaccgacaugcaguugaggagcuaccagaaacaauggagacucuccuacuuuuagguuuaaugauacuacuuacaggaggggcaaugcuuuuccucaucucaggaaaggguaucggaaaaacuucaauuggccugaucugcguaauugcaaguucggguaugcuauggauggccgaaauuccacuccaauggauagcuucagcuauaguucucgaauuuuucaugaugguacuccucauuccugagcccgagaaacaaagaacaccacaagauaaucaauuagcguauguaguaauugguauacucacucuggcagcaaucauagcagccaaugagaugggucucuuagaaaccacaaaacgagaccucggaaugucgaaagagccaggugugguaagcccgacuucauacuuagauguagaccugcauccagcuagugccuggacccuuuaugcaguggcaacuacugucauuacaccaaugcuacgucauacuauagaaaauucgacagcgaacgucagucuggcugcuauagcaaaucaagcgguaguacugaugggguuggacaaagguuggccaauaucuaagauggaucuuggcgugccacuauuagcauuaggaugcuauucucagguaaauccccuuaccuuaacugccgcaguacuguuacucauaacacacuacgcaaucauuggcccuggucuacaagcuaaagccacgagagaagcccaaaaacgcacugcagcgggaauuaugaagaauccaaccguagacggaauuaugacuauagaucuagauccugucauauaugauucaaaauucgaaaaacaacuagggcaaguuaugcucuuaguacuuugcgcuguacaguugcugcuuaugcgaacaucuugggccuuaugugaggccuuaacguuagcaacuggaccgauuacaacguugugggaaggaucaccagguaaauuuuggaauacuaccauugcaguaucgauggcaaauauauucagaggaaguuauuuagcaggagcuggucuagcuuuuaguauaaugaaaagugucgggaccgggaaaagggguacagggucccaaggagaaacauugggcgaaaaguggaagaagaaauugaaccaauuaagucgcaaagaauuugaucuauauaaaaagagcgguauaacggaaguagacagaacugaagccaaagaggguuuaaaaaggggugaaauaacucaucaugcaguaucacguggaagcgccaaguuacaaugguucguagagcguaauauggucauaccagaaggccgugucauugacuuagguugcggaagaggcggcuggaguuacuacugugcaggauugaagaaaguuacagaaguaagaggguauacaaaaggaggaccaggacaugaagaaccuguaccuaugagcacauacggauggaauauaguuaaacucaugagcggaaaagauguauuuuauuuaccaccggaaaaaugcgauacucuccuuugcgauauuggcgaaucaucuccguccccaacuguagaagagucucgcaccauucgaguauuaaaaaugguagaaccgugguuaaagaauaaucaauucugcauaaaagucuugaauccuuauaugccaacugugauagagcauuuggagcgauuacaacguaaacacggugggaugcuaguuagaaacccacucucccgaaauaguacccacgagauguacuggauaaguaacggcaccggaaauauaguagcgagcguuaacaugguuagcaggcuacuauuaaacagauucacaaugacgcacagacggccaacuauagaaaaagauguggaucuaggcgcaggaaccagacacguaaacgcagaaccggaaacgccgaauauggaugucauaggagaaagaauaaaaagaaucaaagaagaacauaauaguaccuggcacuacgacgaugagaacccguauaaaacaugggcuuaccauggaucauacgaaguuaaagcgacuggcagcgcuaguuccaugauaaacgggguagugaaacuucuaacaaaaccaugggauguggucccaaugguaacccaaauggcaaugacugacaccacccccuuugggcagcaaagaguguuuaaggaaaaaguugacaccagaacaccuaggccaaugccuggaaccagacgaguaaugggaauaaccgcggaauggcucuggcgcacauugggacguaauaagaaaccuagacuguguacacgggaggaauuuacaaagaaaguuaggacuaacgcagcaaugggagcuguguucacagaagaaaaccaaugggauuccgcaaaggcagcugucgaagacgaagauuuuuggaaguuggucgaucgagaaagggaacuacacaaauuaggaaaaugcggcuccugcgucuacaauaugaugggaaaaagagagaagaaacuuggagaauuuggcaaagccaaaggaagccgagccauuugguauauguggcuuggugcuagauaucuggaguucgaggcuuuggguuucuuaaacgaagaucacugguucucaagagagaacagcuauucagguguagaaggagaaggauuacauaaacuaggguacauauuacgcgacaucaguaaaauuccaggcggagcuauguaugcggacgauacagccggcugggauacgagaauuacugaagacgacuuacauaacgaagagaaaaucacccagcagauggacccagagcaucgacaauuggcaaaugcaaucuucaaacuuacuuaccaaaauaaagucguaaaaguucaaagaccgacuccaacuggaacugucauggauauaaucucaaggaaggaccaacgcgguuccggacaaguggguaccuauggucuaaauacauuuacgaauauggaagcccaauuaauaagacaaauggagggugaagguguacucaguaaagcugaucuggaaaauccgcaccuccccgagaagaagauaacacagugguuagaaacgaaaggaguagagaggcuaaaacguauggcaauaucuggugacgauugcguagucaaaccaauagaugacagauucgcaaaugcauuacucgcucuaaaugauaugggaaagguaaggaaggauauuccccaauggcaacccucuaagggauggcacgauuggcaacaaguaccuuucuguucacaccauuuccacgaacuaaucaugaaggauggcagaaaauuagucgugccuugucgaccgcaagaugaauuaauagggcgggcaaggauaucccaaggagcugguuggucucuaagagaaaccgcuuguuuaggaaaggcauacgcucaaauguggucacucauguauuuucauagacgcgacuuacgacucgcaucgaaugcaauuugcagcgcuguaccugugcauuggguccccacaagucgaacgacuuggucgauacacgcgcaccaucaguggaugacuacagaggacaugcucacggucuggaaccgaguuuggauugaagacaacccauggauggaagacaaaaccccagugacuacuugggaaaauguaccuuaccuaggaaaacgugaagaucaaugguguggaucauuaauaggucuaacaagccgagcaaccugggcacaaaauauaccuacagcuauucaacagguaagaagucuaauugggaacgaagaguuccuggauuauaugccuucgaugaaaagguuuagaaaggaagaagaaucggaaggugcuauuugguga

SEQ ID NO: 22999 - RNA, 9873 nt, Artificial Sequence
  derived and/or modified CDS sequence (opt6) from DENV-3__JX669497__SS-prME
acuagcuuaugucugaugaugauacuuccggcagcacuugcauuucauuuaacgagcagagacggugaacccagaaugauaguagggaaaaaugaacgaggaaaaaguuugcucuuuaaaacagcuagugguauaaauaugugcaccuuaauugccauggacuugggagaaaugugugacgacacaguaacuuauaaauguccccauauuacugaaguagaaccagaggauaucgacugcugguguaaucucaccucgacauggguuacauauggaaccugcaaccaagcuggugagagaaggagggauaaacgaucaguugcucuagccccacauguaggaaugggacuugauacuagaacgcaaacauggaugagugcagaaggugccuggcgacaaguagaaaaaguagaaacuugggcguugagacaucccgguuuuacuauacuggccuuauucuuagcacacuacauaggcacuucgcuaacacaaaaaguuguaauauucauacuacuuauguuaguuacacccucuaugacaaugcgguguguugguguuggcaauagagacuuuguugagggucucaguggagcgaccuggguagauguaguauuggagcaugggggcugugugacgacuauggccaaaaauaaaccgacauuagauaucgaacuccagaaaacagaagcuacucaacuggcaacccuucggaaauuauguauagaaggcaagauaacaaacaucacaacugacaguagguguccgacccaaggugaagcugugcugcccgaggagcaagaccaaaauuacguaugcaagcacacauauguggacagggguugggguaacggauguggguuauucggaaaagggagccuggugacaugcgccaaguuccaauguuuagaaccaauugaaggaaaaguaguucaguaugaaaaucuaaaauauaccguaaucaucacaguacauacgggugaccaacaccaaguggggaaugaaacucaaggcgucacggcugaaauaacgccccaagcaucuaccaccgaggcaauccuuccagaauacgguacacucggcuuagaaugcaguccucgaacaggguuagacuuuaaugagaugauacuucuaacuaugaaaaauaaagcauggaugguucaccgccaaugguucuuugaucuaccguugcccuggacaaguggggcaacgaccgagacccccacguggaauagaaaagaauuacugguuacguucaaaaaugcacacgcgaagaaacaggaaguaguaguuuuaggaucacaggaaggugcaaugcacaccgcuuugaccggugcuacugaaauccaaaacagcggugguaccucaaucuucgcaggacaucugaaauguagacuuaagauggacaaauuagaacuaaaagguaugaguuaugcaauguguaccaauaccuucgugcuaaagaaagaaguuagcgaaacacagcaugguacuauacuaauaaaaguggaauauaaaggagaggaugccccguguaagauucccuucaguacugaagaugggcagggaaaagcccacaacggacgccucauaacagcuaacccuguaguuacaaagaaggaagaaccuguuaacauagaagcagagccgccauucggugaaaguaacauagucauaggaauaggugacaaugcgaguaaaauuaauugguauaaaaaggguuccucaauaggaaaaauguucgaggcaacagcuagaggagcgagacggauggccauacuuggugacacagccugggacuucggaucuguagguggcguauuaaauaguuuaggaaaaaugguucaucaaauuuucgguagcgccuauacagcacuuuucuccgggguaucauggguaaugaaaauuggaauaggcguguuacucacuuggaucggacuaaauagcaaaaauaccucuaugucuuucucuuguaucgcaauaggcauuaucacacuauaucuuggugcagucguucaagcagacauggguuguguuauaaauuggaagggcaaagaacucaaaugcggcucagggauauuuguaacuaaugagguccauaccuggacagaacaguacaaauuucaagcagacucaccuaagaggcuugcuacagcgauugcaggagcaugggaaaauggaguaugugggaucaggucuaccacgagaauggaaaauuuacuauggaaacagaucgcaaacgaauugaauuauauucuaugggaaaauaauauaaaacucacaguaguugucggugauauaaucggaguucuagaacagggaaaacggacacuaacaccucaaccaauggaacuaaaauauucuuggaaaacauggggaaaagcuaaaauagucaccgccgagacacaaaacucaucauuuauuauugacggucccaacacgccggaguguccgagcgcuagcagagccuggaacguaugggagguagaagauuauggauucggagucuucacgacaaacaucuggcuaaaacucagagagguauacacucaacuaugugaucauagguugaugagugcagcaguuaaagacgaaagagccguacaugcagacaugggauauuggaucgagagucagaaaaaugguucuuggaaauuagagaaggcuaguuuaauagagguuaaaacaugcacauggcccaagagccauacacuuuggucaaauggaguauuggaaucagauaugauaauaccaaaaucauuagcaggaccuauaucgcagcauaaucauagacccggauaccauacucaaacagccgguccguggcauuuaggcaaacucgaguuagauuucaauuacugugagggcacgaccguaguuaucaccgaaaauugcggcacacggggaccuagucuuagaaccacaaccgucucaggaaaacuuauacaugaguggugcugcaggucaugcaccuuacccccguuacgauauaugggagaagauggaugcugguacggcauggaaauaagaccaaucuccgagaaggaagaaaauaugguaaaaaguuugguuuccgcagggagugguaagguagauaacuuuaccaugggaguccucuguuuggcaauucuauucgaagaaguaaugcgagggaaauucggcaagaaacacaugauugcagggguauucuuuacauuuguuuuacuucuuaguggacagauaacauggcgcgauauggcacacacauuaauuaugauagguagcaaugccagugaucguaugggcaugggugugacauacuuagcacuaauagcaacauucaaaauacagccuuucuuggcacucggauucuuuuugagaaaacuuacgaguagagaaaaucuucuuuuagguguaggcuuagcaauggcgacuacgcuccaacuaccggaggacauagaacaaauggccaauggcauugcgcuuggauuaauggcucucaaguuaauaacacaauuugaaacguaccagcuuuggaccgcacuuauaucgcuuacaugcucuaauacgauguuuacauugacgguagcauggcggacugcaacgcugauuuuggcugggguaagucuucuaccugucugccaaucaagcaguaugcggaaaacugauugguugcccauggcaguagcagcaaugggugugccuccauuaccucuauuuauauuuagucucaaagauacacuuaaaaggagauccuggcccuugaacgaaggugugauggcggugggucuagucaguauccuagcauccagccuucuccgcaaugauguuccaauggcaggaccgcuagucgcugguggucuauuaauagcguguuauguaauuacagggacauccgcagaccucaccguagaaaaagcagcggauauaacgugggaagaagaagcagaacaaacgggagugagccacaaucucaugauuacaguugacgaugacgguaccaugagaauuaaggaugaugaaaccgagaacauacucacugucuuacucaaaaccgcgcuauuaauuguaucaggggucuuucccuauucuauaccagcaaccuuacucgucuggcacaccuggcagaaacaaacacaaaggaguggaguucucugggacguaccuagcccaccagaaacacagaaagcagaauuagaagagggcguguacagaaucaagcaacaaggcauauucggaaagacacaggugggaguaggaguacagaaggaagguguguuucacacuauguggcaugucacuagaggagcaguacucacauauaaugggaaacgauuagaaccaaacugggcaagcgucaagaaagauuuaauaucauacgguggaggauggagauuaucagcacaauggcaaaagggcgaagaaguucaagucauagcaguggaaccaggaaagaacccuaaaaacuuucaaacgaugcccggcacauuucaaacaacaacuggagagauaggagcuauugcuuuggacuuuaaaccuggaacguccggcuccccaauaauuaaccgugaaggcaaaguuguagggcuuuacggcaacggcgucguaacuaaaaacggaggguaugugaguggcauugcacaaacgaaugcagaaccggacgguccaacaccagaauuagaagaagagauguucaaaaagcgcaauuuaacgauuauggaucugcauccuggaucuggaaaaacacgcaaauauuugccggcaauuguaagagaagcuaucaaaagacgacuuagaacucugauauuagcuccaacgcggguuguagccgcggagauggaagaggcauuaaaggguuuaccuauacgauaucaaacuacggcaacaaaaucugaacauaccggucgagaaauuguggaccuuaugugucaugcaacguucacaaugcgcuugcuaucucccguuagaguucccaauuacaaccuaaucauaauggaugaagcgcauuucacagauccugcaagcauagcagcaagaggauauauaucuacuaggguaggaaugggugaagcagccgcaauauucaugacugccacaccgccggguacagcugaugcauuuccacaaagcaacgcaccgauacaggacgaagaaagagauauaccagagcgaaguuggaacucuggaaaugaguggaucacagacuuugcggggaaaaccguuugguucguaccuagcauaaaagcggggaaugauauugcaaauuguuuacgaaagaauggaaagaaagugauucaacuaaguagaaaaaccuucgauacagaauaccagaaaacaaaacuuaaugauugggacuuuguuguaacaacggacauuucugagaugggcgcaaacuuuaaagcggacagaguaauagauccuagacgaugucugaaaccagucauacuaacagacgguccugaacguguuauuuuggcagggccgaugccaguuacagcagcaagugcggcacaacgaagggguagaguaggucgaaauccucaaaaagaaaacgaucaauauaucuuuaccggacaaccacugaauaaugaugaagaucacgcacacuggaccgaagcaaaaaugcuccuggacaacauuaacacuccagaggguaucauuccagcacuauucgagccggaacgugaaaaaucagcagcaauagauggagaguaccggcugaaaggagaaagccggaaaacuuucguugaauugaugagaaggggagaccucccaguauggcuagcacauaaaguggcaagugaaggaauaaaauauacugaucgcaaguggugcuuugauggucaacgaaauaaucaaauauuagaagaaaacauggauguugaaaucuggacuaaagaaggcgaaaagaagaaauuacguccuagauggcuugacgcaagaacauauucagauccauuggcacuaaaggaauuuaaagauuucgccgccgguagaaagucuauagcucuagaucucgucacggagauuggaaggguuccuagucaucucgcucaucggacucgaaacgccuuggauaacuugguaaugcuacauacaagugagcauggugggagagcauacagacacgccguugaagaacuaccggagacgauggaaacuuuacuauugcuuggacuaaugauauuauuaacuggaggugcuaugcuuuuucucauaagcggcaaaggaauugggaaaacaagcauaggguuaauuugcguaauagcaucguccggcaugcuauggauggcagaaauuccuuuacaauggauugcuucagcuauagucuuagaauuuuucaugaugguucugcuaauuccagaacccgaaaaacagagaacaccccaggauaaucaauuggcguacguugugauugguauauuaaccuuagccgcaauaauugccgcuaaugaaaugggcuuauuagaaaccacaaaacgcgaucuuggaaugagcaaagagccuggugucguaaguccaaccucauaccuugaugucgaucuacauccugcgucugcauggaccuuguacgccguagcuacaaccgucauaacuccaaugcuaaggcacacuauagagaacucgaccgcaaaugucagccuagcagcuauugcaaaccaagcaguaguauugaugggcuuggauaagggguggccaaucuccaagauggauuuagguguaccacuacuggcccuuggguguuauucucaaguuaaccccuuaacgcucacugcugccguguuauuacucauuacucauuaugcaauaauaggaccugggcuacaagcuaaagcuacucgggaggcgcagaagagaacggccgcagguaucaugaaaaauccaacagucgaugguauaaugaccauagaccuugauccaguuauuuacgacaguaaguuugaaaagcaacuugggcaaguaaugcuucuaguccucugugcaguacaauuguuauuaaugcgaacaucaugggccuugugugaagcucucacuuuagcaacgggcccaauaacaacccucugggaaggaucaccaggaaaguuuuggaacacuacaauagcugucucuauggcaaacauauuucgagggucauauuuagcuggggcaggccuagcauuuagcauuaugaaaagcguggggacagggaagcgagggacuggaucucagggggaaacccucggagaaaaguggaagaagaaacuuaaucaacuuagucgcaaagaauuugaucuuuauaagaaaucuggaauuacagaagucgauagaacugaagccaaagaaggauuaaaaagaggggagaucacccaccacgcagugucuagaggaagugccaaguuacaaugguuuguugaaagaaauauggucauacccgagggccgcgugauugaucuugguugcggacgaggagguuggucuuauuauugugcuggacuuaagaaaguaacugagguaagggguuauacaaaaggcggccccggucaugaagaaccuguuccuaugaguacauacggauggaauaucguaaaacuaaugucggguaaagacguauucuaucuaccaccagagaaaugcgauacuuugcuuugugauaucggcgaaucaucccccagccccaccguugaggaauccagaaccauuagaguucuaaaaaugguggaaccauggcuuaaaaauaaucaauucugcauaaaaguacuaaauccguauaugccaacuguaauugaacaccuugagcgacuacaaagaaaacauggugggauguuaguaagaaacccacugagccgcaauucuacucacgaaauguauuggauuucaaacggaacaggcaauauaguagccagcguaaauaugguuagccgucugcuauuaaacagguuuacaaugacucauagaagaccuacaauagaaaaagauguggaccuaggugcugggaccaggcauguuaaugccgaaccugagacaccuaauauggauguuauaggugaaagaaucaagagaauuaaggaagaacauaacucaacauggcauuaugaugaugaaaaccccuauaaaacaugggcguaccacggaagcuaugaagucaaggcgacggguucagcuaguucuaugaucaauggaguagugaaauuguuaacuaaaccaugggauguagucccuaugguaacacaaauggcuaugacagacacgacgccguuuggucaacagcguguauucaaagaaaaaguagacaccagaaccccacgaucaaugccggguaccagaagggugauggggauuacagcagaaugguuguggaggacauuagguaggaacaagaaaccaagacuuugcacaagagaagaguuuaccaaaaagguaaggacaaaugcagcgaugggggcggucuuuaccgaagaaaaccaaugggauagugccaaggcggcuguagaagaugaagacuucuggaaauuaguugaucgcgaacgagaauuacacaaacuggguaaauguggaaguugcguuuacaauaugauggggaaaagagagaagaaacugggugaauuuggcaaagccaaaggcucgcgcgcuaucugguauauguggcugggugcucguuaucuagaguuugaagcauugggcuuuuugaaugaggaucauugguuuucaagagaaaauuccuacucugguguugaaggggaaggacuucauaaauugggauauauauuacgagauaucucaaaaaucccagguggcgccauguaugcagaugauacggccggaugggacacccguauaacggaagaugacuugcacaaugaagagaaaauuacacaacaaauggacccagaacaucgacaguuagccaaugcaauuuuuaaacuaaccuaucaaaacaaaguuguaaaaguacaaaggccaaccccuacaggaacuguuauggauaucauaucaagaaaagaucagaggggcaguggucaaguugggacauaugguuuaaauaccuucacaaauauggaagcccaauugauaaggcagauggaaggcgaaggaguauugucuaaggccgauuuagaaaauccucaccucccagaaaagaaaauaacucaauggcuugaaacuaaaggaguagaaagauuaaaaaggauggcuauaucaggcgacgauuguguaguuaaaccuauagaugaucgauucgcaaacgcauuacuagcauuaaaugauaugggcaaaguaagaaaagacauuccacaauggcaaccuucaaagggauggcaugauuggcaacaaguaccauuuuguucucaccauuuccacgaauuaauaaugaaagauggaagaaaauuagucguaccaugccggccgcaagaugaauuaauaggucgugcucgaaucagccaaggagcuggguggucauuacgagaaaccgccugucuuggcaaggcuuaugcccagauguggagucuuauguacuuccauagaagagaccuaagacuugcaaguaaugcuauuugcagcgcuguuccuguccauuggguaccaaccucaagaacgacuuggucaauucaugcacaccaucaguggaugacuacagaagauaugcuaaccguuuggaacaggguguggauugaggauaacccauggauggaagacaaaacuccgguaacgacaugggaaaaugugccauauuuagguaaacgggaggaucagugguguggaucauugauaggacuuacuuccagagcgacaugggcccaaaacauaccuacugcgauacaacaaguaagaaguuuaaucgggaaugaggaguuccucgauuauaugccauccaugaaaagauuucgaaaagaggaagaaagcgaaggugcuauaugguaa

SEQ ID NO: 23000 - RNA, 9873 nt, Artificial Sequence
  derived and/or modified CDS sequence (opt6) from DENV-3__JX669501__SS-prME
acaucauuaugcuugaugaugauucugccagcagcacuagccuuccacuuaacaagucgagauggugaaccaaggaugaucguggguaaaaacgaacgaggaaaaucauuacuguucaaaacugccucggguauuaauaugugcacacucauugcaauggacuuaggggaaaugugcgacgauacagucacguacaaauguccucacaucacagaaguugaaccugaagauauagacuguugguguaacuuaacguccacaugggugacauauggaacauguaaucaagcaggagaaaggagaagggacaaaagaucaguggcacuagcaccucauguugguaugggucuagauaccaggacgcagacguggaugagcgcagaaggagcuuggagacaagucgaaaaaguagaaacaugggcacuuagacaucccgguuucacaauacuagcuuuauuucuagcccauuauaucggaaccucuuuaacacagaaaguaguuaucuuuauacuuuugaugcuggucacuccaucuaugacaaugagauguguagggguuggaaacagagauuuugucgaaggucuaucuggagcaacauggguugauguaguuuuagaacacggugguugugucacgacgauggcuaaaaauaaaccaacccuggauauagaacuacagaaaaccgaagcuacgcaauuggcaacucugcgcaaauuauguauagaaggcaaaauaacuaacauaaccacagacagcagaugcccuacacagggagaagccguacugccugaagaacaagaucaaaacuacguaugcaaacauaccuacgucgaucgggguugggggaacgguuguggacuguucgguaaagggucuuugguaacaugugcuaaauuccaauguuuggagccaauagaaggcaaaguaguacaguacgaaaauuugaaauauacaguuaucauuacaguacacacuggggaccaacaucaagucggcaaugaaacgcaaggugugacugcugaaauaaccccgcaggcuucaacaacugaagcaauuuugcccgaguacgguacccugggacuugaguguucaccaagaacaggccuagauuuuaaugaaaugauauuacugacuaugaaaaacaaggcuuggaugguucauaggcagugguuuuucgaccucccgcuaccuuggacaucaggagcaacgacagagacucccacauggaaucggaaagagcuuuugguaacuuucaaaaaugcgcacgccaagaaacaagagguugucguucucgggagucaagagggggccaugcauaccgcuuuaaccggcgccacagaaauccaaaacucgggaggaacaaguaucuuugcaggccaucuuaaaugccggcuuaaaauggauaaacuagaacuaaaaggaaugucuuacgcuaugugcacaaauacauuuguucuuaagaaagagguaagugaaacacaacacgggacgauacuaauuaaaguagaguaccgcggagaagaugcgcccuguaaaaucccauuuuccacugaggauggccaagggaaagcccacaacggaagacugaucacagcaaacccagucguaaccaagaaagaagaaccgguaaacauagaggcugaaccuccuuuuggagaaaguaacauuguaaucgggaucggagacaaugcuuugaaaauaaacugguacaagaaaggauccuccauuggaaaaauguuugaagcaacggcacguggagcaagaagaauggccaucuuaggugauacagcgugggauuuuggcucaguggguggcguacucaacucccuaggcaaaaugguucaucaaauauuuggaucugccuacacggcgcuguuuagugguguaucauggguuaugaaaauaggcauaggaguuuuauuaacuuggauaggucuaaacucgaaaaauacuagcaugaguuuuucaugcauugcaauagguauaauaacacucuaucugggcgcaguaguacaagcagauauggguuguguaguuaacuggaaagguaaagaacugaaaugcggaucagguaucuuuguuaccaaugaaguacacacauggaccgaacaauacaaauuccaagcugauucgcccaaacgacuagcaacugccauugccggugcgugggaaaauggugucugcgguauaagaucaaccacacgcauggagaacuugcuauggaaacagauagcaaacgaacuuaauuauauccuuugggaaaauaauauaaaauuaaccguugugguaggagacauuauaggggugcucgaacaaggaaaaaggacacuuacaccucaacccauggaacugaaauauucauggaaaacauggggaaaagcuaaaauaguuacggcugaaacccaaaacucaucauuuaucauagauggcccaaauacucccgaauguccuagcgcuucucgugcauggaauguaugggaagucgaagauuacggauucggaguauuuacaacgaacauuugguuaaaauuaagggaaguauauacacagcuaugugaccauagauuaaugucagcugcaguaaaggaugaacgcgcuguucaugccgacauggguuacuggauugaaagucagaaaaauggcagcuggaaauuagaaaaggcaagucuaauagaaguuaaaaccugcaccuggcccaaaucucacacauuauggucgaacggaguuuuagaauccgauaugauuauacccaaaagccucgcagggccaaucucccaacacaaccaccgcccgggauaucauacacaaacggcuggaccguggcaucuuggaaaacuugaauuagauuucaacuauugugaggguacuaccguugugauaacggaaaauuguggcacgcgggguccuagucuucgaacaaccacgguauccgguaaauuaauccacgaaugguguugcaggaguugcacucuuccaccuuuaagauacaugggggaagauggauguugguacggcauggaaauuagacccauaagugaaaaagaagagaauauggucaaaucauuagucucugcaggcucuggaaaaguagauaauuucacaaugggaguccucugccuugccauucucuucgaggaaguaaugagggguaaauuuggcaaaaagcauaugauugcaggagucuucuuuaccuuugugcuuuuauugucaggccaaauaacguggagggacauggcucacacacucacuaugauuggauccaaugcuagugaucguaugggcaugggaguaaccuaucuagcgcuaauagcuacuuuuaaaauccaaccauucuuagcucuaggauucuuucugagaaaauugacuagcagggaaaauuuacuuuuaggugugggacuagcuauggcgacgacccuacaacuuccagaggauauagaacagauggccaacggaauagcacugggacugauggcacucaaauuaaucacucaguuugaaacguaucaacuauggacugccuuaaucucgcuaaccugcucuaacaccauguucacacuuaccguggcguggagaacggcuacacuaauacucgcugguguguccuuguuacccguaugucaaucaaguaguaugcgaaagacggacuggcuucccauggcaguugcagcgaugggaguaccgccauuaccacuuuucauauuuucccucaaagacacccuaaaaagacgaucuuggccuuuaaaugaaggaguaauggcaguaggccuagugagcauauuagcuuccucgcuacuaagaaaugauguaccuauggcgggaccauuaguagcugggggacuucuaauugcauguuauguaaucacaggaacguccgccgaccucacaguugaaaaagcugccgauauuaccugggaagaagaagccgaacaaacuggcguuucucacaaccugaugauaaccguagacgaugauggaacgaugcggauaaaagaugaugaaaccgaaaacauacucacuguauuauuaaaaacugcucuccugauaguuucuggaguuuuuccuuauucgauuccagcuacguugcuagucuggcauacguggcagaagcaaacucaaagaucuggaguuuuaugggauguaccuucuccuccugagacccaaaaagcugagcucgaggaaggagucuacagaaucaaacaacaaggaaucuuuggcaaaacacaaguugggguaggugugcagaaggagggcguguuucauacaauguggcauguuacaagaggggcaguccucacguacaacggcaaacgauuagagcccaacugggcauccgugaagaaagauuuaaucucuuaugguggaggauggcgauuaagugcccaguggcaaaagggggaagaaguacaggucaucgcaguugaaccuggcaaaaaccccaaaaauuuucaaacgaugccuggaacuuuucaaaccaccacuggagaaaucggcgcaaucgccuuagauuuuaaaccaggaacguccggaaguccaauaaucaacagggagggaaaaguuguaggacuguauggaaaugguguuguaaccaaaaauggugguuacguaucggguauagcacagacaaaugcggaaccugauggcccaacgccugaauuagaggaagaaauguuuaagaaaagaaacuuaacaaucauggauuuacauccgggaaguggcaaaacaagaaaauaccuuccagcaauaguccgggaagcuauuaagcguagacuaagaacuuuaauuuuggcacccacaagaguagucgcugcugaaauggaagaagcacuaaaaggacucccaauuagguaucagacuacugcaacuaaaagcgagcauacaggaagagagaucguugauuuaaugugccacgcaacuuuuacuaugagacuacuuagccccguacgcguuccgaauuacaaccuaauaauuauggaugaagcucacuuuacugauccggcuucgauugcugcucgaggguauauaucuacaagggugggcaugggcgaagccgccgcaaucuucaugacggcaacaccuccaggaaccgcugaugcauuuccacaaaguaaugcuccuauccaagacgaagaaagagacauaccagaaagaagcuggaacucagggaacgaauggauaaccgacuucgccgguaaaacgguaugguuuguaccuaguauaaaggccggaaaugauauagcuaacugccucaggaaaaacgguaagaaaguaauccaacuaucuagaaaaaccuucgauacagaauaccagaaaacaaaacugaaugauugggauuucguaguuacaacugauauaucagaaaugggugcaaacuuuaaagcggauaggguaauagacccacgaagaugccuaaagccaguaaucuuaaccgacggaccggaaagggucauuuuagcagggcccaugccagugacugcagccucugcagcccaaagacgagggagaguaggucgaaauccacaaaaagaaaacgaccaauacauuuuuacaggacaaccuuuaaacaaugaugaagaucaugcccauuggacagaagccaaaauguuacuagacaauauaaauacaccagaaggcaucaucccagcccuauucgaaccagaaagagaaaaaucagcagcaaucgauggagaauauagacugaaaggggaaaguagaaaaacauuuguugaauuaaugagaagaggcgaccugcccguguggcucgcucauaaaguagcuagcgagggaauaaaguauacugauagaaaaugguguuucgacggccaaagaaauaaccagauauuagaggaaaauauggacgucgagauuuggacuaaggagggugagaagaagaaauuacgaccaaggugguuagacgcuagaacuuacagugauccacuugcguuaaaggaguucaaagauuuugccgccgggcgcaagucuauagcacuggaucuagugacagagauuggacgcguacccucucaccuggcacacaggacgcgaaacgccuuagauaauuuaguaauguuacacaccagcgagcaugggggaagggcguacagacacgcuauggaggaauuaccagaaacuauggaaacauuacuauuauuaggauuaaugauucuacucaccggaggcgcgaugcuauuuuuaauaucuggaaaggggauugguaagacaucaauugggcucauuugcgugauagcaaguagugguauguuguggauggcugagauaccucuucaguggaucgcuagugcaaucguauuagaguucuuuaugaugguauuauuaauaccagagccagaaaaacagaggaccccucaagauaaccaacuagcauauguaguuauagguauacuaaccuuggcagcaauaauugcagcuaacgagauggguuuauuagagacaacaaaacgagaucuggguaugucaaaagaacccggcgucguuuccccuacaucguaucuugacguggauuugcauccugcuagugcauggacuuuauaugcgguugccacaacaguaauaacuccuaugcuuagacacacuauugaaaauaguacagcaaaugugucauuggccgcaauugcaaaucaagcuguuguguuaaugggcuuggacaagggguggccuauaucaaagauggauuuaggaguaccccuuuuagcauuagguugcuauucacaaguuaauccauuaacauuaaccgcagcagucuuauuacugaucacucauuaugcaauaaucgggccuggauuacaagcaaaagcuacuagggaagcccaaaagaggacugccgcuggaauuaugaaaaauccuacuguggacggaaucaugacgauagauuuggauccaguuauguaugacucuaaauuugaaaaacaguuaggacaaguaaugcuuuugguauugugugcaguccaacuauuauuaaugagaacauccugggcauugugugaggcucuaacacucgcaacaggcccaauaacgacauugugggaagguucuccagggaaauuuuggaacacaacuauagccguaagcauggcuaauauuuuuagagguucauaucuagcaggagcuggcuuagcguucagcauaaugaaaucagucggcacggggaaaagaggaacaggaucgcagggagaaacuuugggugaaaaauggaagaagaaauuaaaucaauugagccguaaagaauuugaucuguacaagaagaguggcaucacugaaguugauagaacugaagcgaaagaaggacuaaaacgaggggagauuacacaucacgcgguauccagggggagcgcaaaacuacaaugguuuguagaaaggaacaugguaauuccagagggacgcguuauugacuuggguugcggacgugguggcuggucuuauuacugugcaggccuuaagaagguaacugaaguacgcgguuauacaaagggcggucccggucaugaagaacccgucccgaugaguacuuauggguggaauaucgucaaacugaugucaggaaaagauguguucuaucucccuccggagaaaugcgauacacuacucugugacaucggugagagcucaccgucgccuacaguagaggagagcaggacaauuagaguccuaaaaaugguggaaccauggcucaaaaauaaucaauuuugcaucaaaguccuuaauccauacaugcccacgguaauugaacacuuagagcgauuacaaaggaaacauggcgggauguuagugcggaauccgcuaagcagaaauucuacccacgagauguauuggaucucaaacggcacuggaaacauuguagcaucggucaacaugguaucccgauugcuucuuaauagauuuacuaugacacaucgaaggccuacaauagaaaaagauguagaucugggggcaggcacaagacaugucaacgcagaaccagaaacuccaaauauggacguuauuggugaaagaauuaagaggaucaaagaagaacacaacucaacauggcauuaugacgaugaaaauccuuauaaaacaugggcguaccacggaucguacgaaguaaaggccaccgguagugccucaucaaugauaaauggggucguuaaauuauugaccaaacccugggacguugugccgaugguaacacagauggcgaugaccgacacaacaccguucggucaacaaagaguauucaaagagaagguugauacaagaacaccuagaucuaugccgggaacaagaaggguaaugggcauaacggcagaauggcuguggcgaacucuaggaagaaacaagaaaccaagauuauguacaagagaagaguuuacuaagaaaguacggaccaaugcugcaaugggagcaguuuuuacggaggagaaucaaugggauucagcaaaagcugcgguugaagacgaggacuuuuggaaacuuguagauagagaaagagaguuacacaaacuggggaaaugugguucauguguauauaacaugaugggaaaaagagagaagaaacuaggugaauuugguaaagcaaaaggaagcagagcuaucugguauauguggcuuggggcacgauauuuagaauuugaagcguuagguuucuugaaugaagaucacugguucaguagagaaaacaguuauucugguguagagggggaaggucugcauaaacuagguuacauuuuaagagauauaucaaaaauaccugguggggcuauguaugcagaugacacagcugguugggacacgcgaauaacugaggaugacuugcauaaugaagagaaaauuacccaacaaauggacccggaacaccgacaacuugcaaaugcaauauuuaaguuaacauaucaaaauaaaguagugaaaguucaaagaccaacaccaacaggaaccguaauggauaucauaagcaggaaagaucaaagagguucaggacaagucggcacuuauggauuaaacacauuuacaaacauggaagcucagcuaauaagacaaauggagggcgaaggaguacuuuccaaagcugaccucgaaaauccucaucugccugagaagaaaauaacucaaugguuagaaacaaaagguguugaacgguuaaaaagaauggccauaagcggugaugauugugucguuaaaccuauugaugaccgcuucgccaaugcguuauuagcguuaaaugauauggguaaggugcgaaaagacauuccacaauggcaacccucaaaaggauggcaugacuggcaacaaguuccauuuuguagccaucauuuccaugaacuaauaaugaaggauggccguaagcuagucgugccgugccgaccccaagacgaacuaauagguagggcuagaauaucucagggugcaggauggagucuacgagaaaccgcaugucuagguaaagccuaugcacaaauguggucgcuaauguauuuucauagaagggauuuacgccuagccaguaacgcuauuugcagcgcugucccaguacauuggguaccaacaucuagaaccacgugguccauccaugcacaucaccaguggaugacaacagaagauaugcuaacuguuuggaacaggguauggauagaagacaauccuuggauggaggauaaaacuccagugacaacuugggaaaacguuccauacuuggguaaaagagaagaucaaugguguggcucgcuaauuggacugacaucuagagccacaugggcacaaaacauuccuacagcgauucaacaaguccgaucauuaauagguaaugaagaguuccucgauuauaugccgucgaugaaaagguuucgcaaagaagaagaaagcgagggcgcuaucugguaa

SEQ ID NO: 23001 - RNA, 9873 nt, Artificial Sequence
  derived and/or modified CDS sequence (opt6) from DENV-3__JX669494__SS-prME
acaagucuuugucuuaugaugauucuuccagcugcuuuagcuuuucacuugacaucacgugacggagaaccucgaaugauaguagggaaaaacgaaaggggaaaaucgcuucucuucaaaacagcaucugguacaaacaugugcacucuaauugcuauggaucuaggugaaaugugugaugauacuguuacuuauaaaugcccccauauaacggaaguugaacccgaggauauagauugcugguguaauuuaacuucaacauggguuaccuacggaacuuguaaucaagcaggcgagcgccggcgagauaaaagaucgguugcacuagcaccacauguugggaugggguuagauacaaggacacaaacuuggaugucagcagagggagcuuggagacaagucgaaaaagucgagacuugggcauuacggcauccuggguucacuauucuagcacuuuuucuagcccauuacauuggaacuucguugacgcaaaaaguugugaucuucauuuuacuaauguuggucacccccucaaugaccaugcggugcgucgguguagguaacagagauuuuguagaaggccuaucuggugcuacaugggucgacguuguacuagaacauggaggaugugugacaaccauggcgaaaaauaaacccacuuuagauauugaauugcagaaaacugaagccacacaguuagccacccucagaaaauuaugcaucgaaggaaaaauuacuaacauuacgacagauucacgauguccgacccaaggagaggcuguacuaccagaggaacaagaucaaaauuauguuuguaaacauacuuacguagaucgaggaugggggaacgguugugguuuauuugguaaaggaaguuuagugacaugcgcaaaauuucaaugucuagaaccaauagaaggaaaaguaguccaauaugaaaacuuaaaauacacagugaucaucacuguacacacaggugaucaacaucaaguuggaaaugaaacccaaggagucacagcugagauuacuccccaagcaucgacaacagaagccauccuuccugaauacggcacucuuggcuuggaauguaguccacggacuggucucgacuuuaaugaaaugauccuucuaacuaugaaaaacaaagccuggaugguacacaggcaaugguucuuugauuuaccccuuccguggacgaguggagcaacaacagaaacaccgacuuggaauaggaaagaacucuuaguaacauuuaaaaaugcgcaugcuaagaaacaagaaguaguugucuuaggcucucaggaaggagcgaugcacacugcuuuaacuggagcuacagaaauucaaaauucuggcggaacaucaauauuugcaggacauuuaaaaugucgauuaaaaauggacaaauuagaacuuaaagggaugucauacgcuauguguacaaauacguucguuuugaagaaagagguaagcgaaacucagcauggaacgauauugauaaaaguugaauauagaggggaagacgcaccuugcaaaauaccuuuuuccacugaagauggacaaggcaaagcgcacaacggccgucucauuacagcaaauccggucguaacuaagaaagaggaaccagugaauauugaagcagaaccaccuuucggagagaguaacauaguaaucggcaucggggauaacgccuuaaaaauuaauugguacaagaaagguucauccauaggcaaaauguuugaagccacugcucgaggagcaagaagaauggcgaucuuaggcgauacagcgugggauuucggcucuguuggaggaguucuuaacucucuagguaaaaugguacaucaaauuuuugggagcgcuuacacugcauuguuuucgggagucucuugggugaugaaaauugguauuggagucuuauuaaccuggauagguuuaaacagcaaaaauacaaguaugagcuucucgugcauagcaaucggcaucaucacgcucuacuugggcgcuguaguccaggcugauaugggauguguuauuaauuggaaaggaaaagaacuaaaauguggauccggaauauuuguaacgaacgaagugcauacauggaccgaacaauauaaauuucaagcagauaguccaaaaagauuagcuacggcgauugcuggagccugggaaaacggagucugcgggauaaggucaacaacaaggauggaaaacuugcucuggaaacaaaucgcaaaugagcuuaacuacauacuuugggaaaacaauaucaaacucacagugguagugggcgacauuauuggugucuuagaacaggguaaacgaacuuugacaccccagccaauggaacuaaaauauucauggaaaacaugggggaaagcaaaaauagugaccgcagaaacacaaaauaguucauuuauuauagacggaccaaacacgccggaguguccgagcgcgucuagagcauggaauguuugggaaguagaagauuauggcuuuggaguuuuuaccacgaauaucuggcucaaauuaagggaaguuuacacccaacugugugaucaucguuuaaugucggccgcaguaaaggaugaaagagccguacaugcagauaugggguauuggaucgaaucucagaaaaauggaaguuggaaauuagaaaaggcuucgcuaauagaagucaaaacaugcacauggccaaagagccauacauuguggagcaauggaguccuagaaagugauaugaucauuccaaaaucgcuagcaggucccaucagucaacacaaccacaggccaggguaucauacacagacggccgggcccuggcaucuagguaaacucgaauuagacuuuaauuauugugagggaacaacaguagucaucaccgaaaacuguggcacacggggcccuucucuucgaaccacaacaguauccgggaaacugauccacgaaugguguugcagauccugcacacuuccacccuugcgcuauaugggggaggauggcugcugguacggaauggaaauucgcccaauaucagaaaaagaagaaaacaugguuaagagccuaguuagcgcuggaucuggcaaaguugacaauuucacgaugggaguacuaugcuuagcuauacuauuugaagaaguaaugagaggaaaauuuggcaagaaacacaugauagcgggaguacuuuuuacguuuguauuauuauuaucuggccaaauuaccuggcgagauauggcacauacauuaauuaugauugguucaaacgcgucagaucguauggguaugggaguuacauauuuagcucuaaucgcaacuuuuaaaauacaaccguuucuagcuuugggauucuuucuuagaaagcucaccagcagggagaaucuucuacuaggagucggacuagcaauggcgacaacgcuccagcuuccagaagacauagaacaaauggcuaacgggauagcauuaggauuaauggcauuaaaacuuauaacucaguucgagacauaccaacuauggacagccuuaauuucccucacguguagcaacaccauguucacuuuaacaguagcauggcgaacugcuacuuuaauccuagcaggaguaucacuauugccaguuugucaauccuccucaaugaggaaaacagacuggcuaccuauggcgguggcagcuaugggcguuccaccgcuaccccuauuuaucuuuucacuaaaagacacacuaaagagaaggagcuggccgcucaaugaaggugugauggcaguagguuuaguaaguauuuuggcuucaagucuacuaaggaacgauguaccaauggcaggaccauuaguggccggugguuuacuuauagccugcuauguuaucacgggaacuucagcugauuugacaguagagaaagcggcagauauaacaugggaagaagaagccgaacagacuggggugagccacaaucuuaugauaacuguagaugaugacgguaccaugcgcauaaaggacgaugaaacagaaaauauuuuaaccguauuauugaaaacagcuuugcuaaucguuucuggcgucuucccguauagcauuccagcgacguuacuuguauggcauacauggcaaaaacaaacacagagaucaggcguccuaugggacgugccuucaccaccagaaacccaaaaggccgaacucgaagaagguguauauaggauuaaacaacaagguaucuucggaaaaacccaagugggaguuggcguacaaaaagaagggguuuuccauaccauguggcacguaacuagaggggcaguacuaaccuacaauggaaaaaggcuagaaccuaacugggcaucuguuaagaaagaucucauuucauauggaggaggguggagguuauccgcucaauggcaaaaaggugaggaaguccagguuaucgcuguugaacccggcaaaaaucccaaaaauuuucaaaccaugccugggaccuuccagacgacuaccggagagauaggagcgauugcauuagauuuuaaacccgguacgagcgguagccccauaauuaaccgugaaggaaaagugguaggucuguauggaaaugggguaguuaccaaaaaugguggcuauguauccggaauagcacaaacaaaugcagaaccagauggaccuacacccgaacucgaagaggagauguucaagaaaaggaaccuaacgaucauggacuuacacccaggauccggcaagacuagaaaauauuuaccagccauuguuagggaggcgauaaaacggagguugcgaacguugauuuuagcgcccacaagaguuguggcugcagaaauggaggaagcacugaaaggucuaccaauccgauaucaaaccaccgcaacaaaaucugagcacacagggcgugagaucgucgaccuuaugugccaugcaacauucacuaugagguuacugucuccaguucgagugccaaauuauaauuuaauaauaauggacgaagcucacuucacagacccagcaucgauagcugcgcgaggguauauuagcacgagagugggaaugggggaagcagccgcuauauuuaugacugcgacaccgccugggacagcggacgcuuuuccacaauccaacgcgcccauccaagacgaagagagagacauaccugagcguucuuggaacucagggaaugaauggauaacggauuuugcaggaaaaacugugugguucguaccuucaauuaaagccggcaacgauauagcaaauugucuuaggaaaaaugggaagaaagugauacaacuuagcagaaaaaccuuugacacggaauaucaaaagaccaagcuaaaugauugggauuuuguaguaacgacugauauauccgaaaugggugcaaacuuuaaggccgaccgagucauagauccgagacgaugccuuaaaccuguaauacuuacugacgguccagagcgugucaucuuggcagguccgaugccuguaacugcagcuucagcagcccaaaggcggggaagaguugggagaaauccccaaaaggaaaaugaucaauauauauucacggggcaaccgcuaaauaacgacgaagaucaugcacauuggacagaagcaaaaaugcuucucgauaauauaaauaccccagagggcauuauucccgcauuauucgagccagaaagggagaagucagccgcaauagauggggaguaucggcuaaaaggagaaucccguaaaacuuuuguugaauuaaugaggagaggcgaucuaccuguuuggcuagcccauaaaguggccuccgaaggaauuaaguauaccgauagaaagugguguuucgauggucaaagaaauaaccagauuuuagaagagaacauggacguugagauauggaccaaagagggugagaagaagaaauuaagaccaagauggcuggaugcgagaaccuauucugauccguuagcacuaaaagaauuuaaggauuucgcugcggguaggaaaaguauagcgcuugacuuaguuacugaaaucgggcggguaccaucgcauuuagcacaucgaacacgcaacgcauuagacaacuuaguuaugcugcauacaucagagcaugguggucgagcguacaggcacgcaguagaagaacuuccagagaccauggaaacuuuacuacuguugggguuaaugauuuuacuaacaggcggagcgaugcuauuccuaaucucggggaaggguauuggcaaaacaaguauuggauuaaucuguguaauagcuucuagugguauguuauggauggcugaaauuccucugcaguggauagcauccgcaaucguccucgaguucuuuaugaugguucugcucauaccagaaccagagaaacagcgcacaccacaggauaaccaauuggcauacguuguuauagggauucuuacgcuagcagcaauaauagcggcgaaugagaugggauuguuagaaacaacgaaacgggaucuuggaaugucaaaagaaccugguguaguaucaccuacaucauaccucgaugucgaucuccaccccgccucagcauggacgcuauaugcaguugcaacgacaguaauaacaccuaugcuucgucacacaauugagaacucgacugcuaacguaagccuugcagcaauagcaaaccaggcggucguucuuaugggacuugacaaaggauggccaaucucaaagauggacuuaggagugccauuguuagcauugggauguuauagucaggugaauccucuuacuuuaacggcagcgguacuucuccuaaucacgcauuacgcgauuauaggcccaggacuucaggcgaaagcgacaagggaagcccagaaacggacagcagcgggaaucaugaagaacccaacaguggacggcauaaugacuauagacuuggauccgguaauauacgauucaaaauuugagaaacaacuaggccaggucaugcuucuagugcucugugcggugcaguugcuacuuaugcgcacuagcugggccuuaugugaggcuuuaacgcucgcaacagguccuaucacuacuuuaugggaaggcucuccaggaaaauucuggaacacaacgauagcagugucaauggcaaauauauuuagaggcucauaccucgccggugcggguuuggccuuuaguauaaugaaguccgucggaacugguaaacgaggaacagguucgcaaggugaaacauuaggugagaaguggaagaagaaacuaaaccaacugucacgaaaagaauuugauuuauacaaaaagaguggaauaacugaaguugauaggacagaagcgaaagaaggacuuaagagaggugaaaucacacaucacgccguaucaagagguagugcuaaacuucaaugguuuguugaaagaaauaugguaaucccagagggaagaguaauagaucuagguuguggcagagguggauggucuuauuacugcgcaggucuaaagaaagucacagaaguucgcggauauacgaaaggagguccugggcaugaagaaccuguaccgaugagcacauauggcuggaacauagugaaauuaaugucaggcaaagacgucuucuaucuaccaccggaaaaaugugacacuuuguuaugugacaucggagaaaguucuccaaguccuacuguugaggaaucgcggacgauacgcguucuaaaaaugguagaaccuuggcucaaaaauaaucaauuuuguauaaaaguacuaaaucccuacaugccaacugucauugagcaucucgagaggcuccaaagaaaacacggugggauguuagugaggaauccauuaagucgcaauucaacacaugaaauguauuggauuucaaacgggacaggcaauaucguagcuucagucaacacuguaucacgcuuacuuuugaauagauucacaaugacucauaggagaccuacaacagaaaaagacgucgaccucggugcuggaacaagacauguuaaugcagaaccugaaacgcccaacauggauguuaucggagaaagaauuaaacgcauaaaagaagaacauaacucaaccuggcacuaugaugacgaaaauccauauaaaacaugggcguaccauggaagcuaugaaguaaaggcuacaggauccgcaucgucaaugauaaauggugugguuaaacuccucaccaaacccugggauguaguaccaauggugacacaaauggcuaugaccgacacaacaccauuuggucaacaaagaguauuuaaagaaaaggucgauacaaggacucccagaucaaugccgggaacaaggcgugucaugggaaucacugcagagugguuauggcguacacugggacgaaacaagaaaccccgauuauguaccagagaagaguucacuaagaaaguacgaacaaacgcagcaaugggggcgguauuuacugaagaaaaccaaugggacucagcgaaagcugcuguggaggacgaagacuucuggaagcuaguugaucgugagagggaacuccauaaauuagggaaauguggcagcugcguauacaauaugaugggaaaacgagagaagaaauugggcgaauuugguaaagcuaagggaagccgagcaauaugguacaugugguuaggcgcucgcuaucuggaauuugaagcauuagguuuucuaaaugaggaccauugguuuucgagagaaaauucauauagcggcguggaaggugaaggacugcauaaguuaggcuacauccuucgagauauaaguaaaauaccggguggagcuauguacgccgacgauacggcaggaugggacacgcgcauuacagaagacgacuuacauaaugaagagaaaauuacacagcaaauggacccggaacaccgucaacuagcuaacgcgauauuuaaguugacuuaccaaaauaaaguaguaaaaguucaacgcccaacgcccacagguaccguaauggauaucauaucaaggaaagaccagcgaggaucuggccaagucgguacuuauggcuuaaacacguucacaaauauggaagcccaguuaauaagacagauggagggggaaggugucuuaucaaaggcagaccuugaaaacccacacuuacccgagaagaaaauaacacaauggcuggaaaccaaaggaguggaacgauuaaaaaggauggcaaucucaggcgacgauugcgugguaaaaccuauugaugacagguucgcuaaugccuuauuagcccuaaacgauaugggcaaagugcguaaagauauuccacaauggcaacccuccaaaggauggcaugauuggcaacaggucccuuucuguucucaccauuuucaugaauugauaaugaaagacggaagaaaguuagugguuccauguaggccacaagacgaauuaauagggcgugcaagaauaucacaaggugcagguuggagcuuacgagaaacagcgugccucggaaaagcauaugcucaaauguggucgcugauguacuuucaccgaagagauuugagacuagcuagcaacgcaauauguucugcggucccaguacauuggguaccgacaaguagaacuacuuggucaauacaugcgcaccaucaauggaugacaacagaagauaugcuuacgguguggaaucgaguauggaucgaagacaauccguggauggaagacaaaaccccggucacaacaugggaaaacguccccuaucucggcaaacgcgaagaucaauggugcggcucucuuauugggcucaccucgagagcgacaugggcacaaaauauaccuacagcaauccaacaaguaagaaguuugauagguaaugaagaauuucuggauuacaugccuucaaugaaaagauucagaaaagaagaggaaagugaaggggcuauaugguaa

SEQ ID NO: 23002 - RNA, 9873 nt, Artificial Sequence
  derived and/or modified CDS sequence (opt6) from DENV-3__JX669503__SS-prME
acaucuuuuugccuaaugaugauacugccagcugcucucgcauuccauuuaacaaguagagauggugaaccuagaaugauagucgguaaaaaugaaagaggaaaaaguuuacuuuuuaaaacagcaagcggaaucaauaugugcacgcugauagcaauggauuugggagaaaugugugacgauacagugacguauaaaugcccucacauaacugaaguggaaccggaagauauagauuguugguguaaccuuaccaguacauggguaacuuauggaacauguaaccaagcaggagaaagaagaagagauaaaagaaguguagcucucgcaccucacguugggaugggacuagauacucgcacacagacuuggaugagcgcagaaggugcuuggcgacagguagaaaaagucgaaacuugggcauuaaggcaccccggauucacaauucuugcuuuguuuuuagcgcauuauauaggcacaucccucacccagaaaguuguaauuuucaucuuguuaaugcugguaaccccaucaaugacgaugcguugcguaggggucgguaauagagauuucguggaaggucugucaggagcuacaugggucgaugucguucuggaacacgggggcugcguaacuacaauggcgaaaaacaaaccaacauuagacauugaauugcagaaaacggaggcgacacagcuugcuacccuacgaaaacuguguauagaggguaaaauaacuaauauaacuacagauaguagaugucccacucagggcgaagcagucuuaccagaagaacaagaccagaacuauguauguaaacacacguacguagaucgaggauggggaaaugggugugggcuuuucggaaaaggaucauuaguaacaugugcaaaauuucaaugccuagaacccauagaaggaaaaguuguacaauacgaaaaucuaaaauacaccguuaucauaacggugcauacuggugaccaacaucaaguaggaaacgaaacucaaggcguaacugcagaaauuaccccacaagcaagcaccacagaagcaauacuuccggaguauggcacuuugggauuagaauguucaccuaggaccgguuuagauuuuaaugaaaugauauugcuaacgaugaaaaacaaagccuggaugguccauagacaaugguucuuugauuuaccauuaccauggacuagcggugcaacaacugaaacuccaacauggaaucguaaagaacuauuaguuacauuuaagaaugcgcacgcgaagaaacaagaaguagucguguuaggaucgcaagaaggcgcaaugcacacagcauuaaccggugcgacagaaauccaaaacucaggagguacauccauauuugcgggucauuugaaaugcaggcuaaaaauggauaaguuagaauugaaagguaugagcuaugcaaugugcacuaacacguuuguccuaaagaaagaagucagcgaaacccaacaugguacaauacucauaaaaguggaauauaaaggcgaagacgcgcccuguaaaauuccauuuagcaccgaggauggacaaggaaaagcgcauaacggacgguuaauaacagcaaauccuguugugacuaagaaagaagaaccaguuaacauagaggccgaaccuccauucggcgaaucgaacauaguuauagguaucggagauaacgcuuuaaaaaucaacugguauaagaaaggaucgaguaucgggaaaauguucgaggcaaccgcgaggggagcccgaagaauggcaauccuuggagauaccgcuugggauuucggaagcgugggcggcguucugaauagucucggaaaaauggugcaucagauauucggaagcgcguauacagcucuauuuucugggguuucauggguuaugaagaucggaauuggaguccuacuuacuuggauaggccuuaacaguaagaauacuagcaugagcuucaguugcauagcuauugguauaauuacucuuuaucugggggcagugguucaagcagacauggguuguguaauuaauuggaaaggaaaagaacugaaauguggcucaggcauuuuuguuacuaaugaaguucauacguggacagaacaauacaaauuccaggccgacucucccaaacgacucgccaccgcgauagcuggugcgugggaaaauggagucuguggaauuaggagcaccaccagaauggagaaucuucuauggaaacagauagcaaaugagcuuaacuauauacucugggaaaacaauauaaaauugacugucgugguaggcgacauaaucggcguauuagagcaaggcaagagaaccuuaaccccacaaccaauggaacuuaaauacaguuggaagacguggggcaaagcaaagauagucaccgcugagacacaaaauucaaguuucauaauugacgguccaaauacaccagaaugucccagcgcgucacgggcauggaauguaugggaaguagaagacuacgguuucggcguauuuacaacuaacaucuggcuaaaacuaagagagguguacacucaacugugcgaccaucgccuuaugucggcugcaguaaaagaugagcgugccgugcacgcagauaugggcuauuggauugagagccagaaaaauggaucguggaagcuggaaaaagcgagcuuaauugaaguaaaaacgugcacuuggcccaaaagccacacauuauggucaaacggcguacucgaaucugacaugauaaucccaaagucauuagcuggaccuauaucccaacauaaccaucguccggguuaucacacccaaacagccgguccauggcacuugggaaagcucgaauuagauuuuaacuacugcgaagguaccaccguaguaauaacagaaaauugcgggacccgagguccgucgcuaagaacaacaacaguaucagguaaacuuauacaugaauggugcugucguucauguacauuaccaccacuuagauacaugggcgaagauggaugcugguacgggauggaaauaagaccuaucagcgaaaaagaagaaaacaugguaaaaucauuaguauccgcagguuccggaaaagucgacaauuuuacaaugggcguacuaugucuggccauucuguuugaagagguaaugcgaggaaaauucggaaagaaacauaugauugccggaguauuuuucaccuuuguauuacuacucaguggacaaauaacuuggcgggauauggcacauacguuaauuaugaucggaagcaaugcaucugaucgcaugggcaugggaguaacuuacuuagcacugauagccacauucaaaauacaaccuuuucuagccuuaggauuuuuccucagaaaacuaacaucgagggaaaacuugcuauugggaguugguuuggcgauggcaacgacguuacaguuaccagaagacauagaacagauggcgaaugguaucgcccuaggacuuauggcuuuaaaauugauuacacaauuugaaacuuaccaacuauggacggcgcuuauuucauuaacaugcagcaauacaauguucacguuaacuguugccuggcguaccgcaaccuuaauucuagcaggaguaucauugcuuccuguaugucaaaguucaucgaugcguaagacugauuggcucccuauggccguagcagcuaugggggugccuccgcuaccacuuuucauuuuuaguuugaaagauaccuuaaaaagaaggagcuggccacuaaacgaagguguuauggcaguagguuuaguuagcauauuagcaucaucucugcuccggaacgaugucccaauggcaggaccgcucguugcuggcggucuuuuaaucgcauguuauguuaucaccgguacaucagcugauuuaaccgucgaaaaagcagccgauauuacuugggaagaagaagcggaacaaaccggcguaagccauaauuuaaugauaacaguugaugaugacgggacgaugcguauaaaagacgacgaaaccgagaauauauuaaccgugcuacuuaagaccgcacuucugauaguaucaggaguauuuccauauagcauaccggcaacacuuuugguauggcacacauggcaaaaacaaacacaaagaucagggguauuaugggacguaccaucacccccagagacacagaaagccgaauuagaagaagguguguacagaauaaagcagcagggcauauuugguaaaacucaaguggggguugggguacaaaaagaaggaguauuucauacaauguggcauguaacaagaggugcaguucugaccuacaacgguaaacgguuggaaccaaacugggcaucaguaaagaaagaccuaaucuccuacggcggugguuggaggcuaucagcacaauggcaaaagggggaggaagugcaagugauagcgguagaaccagguaaaaaccccaaaaauuuucaaacgaugcccggaacuuuccagaccacaacgggagaaauaggagcgaucgcauuagauuuuaaaccagggaccucaggcagccccauuauaaacagagaggggaaagugguagggcuuuacgggaaugguguagugaccaagaauggaggauaugugucagguauagcccaaaccaaugcagaaccugaugguccaacacccgagcucgaagaagaaauguucaaaaagagaaauuuaacaaucauggacuugcacccuggaucagguaaaacgagaaaauaucuacccgccauuguacgggaagcuauaaaacgcagacuacggacgcuaauauuagcaccuaccagagucguggcagcugaaauggaagaagcauuaaagggauuaccaauccguuaccagacaacagcaacuaaaucagaacauacuggaagagaaauuguagaucucaugugccacgccacguuuacaaugcgccucuuauccccaguccguguuccgaauuacaaucuuauaauaauggacgaagcgcacuuuacagacccggcuagcauagcagcacgaggguacauuagcacacgcguaggaaugggcgaagcugcugcaauauuuaugacagcaacuccaccagguacugcagacgccuuuccgcaaucaaaugcaccuauccaggacgaagaacgagacauaccggaaaggaguuggaacucagggaaugaauggauuacagacuucgcaggaaagacaguaugguucguaccuucuauuaaagcagguaaugacauugcaaauugccuuaggaaaaacgggaagaaagucauccaauuaucgcgcaagacauuugacacugaguaucagaaaaccaagcuaaacgauugggauuucguaguaacgacggauauuucagagaugggugcaaauuuuaaagcagauaggguuauagacccaagaagguguuuaaaaccaguaauacuuacugaugggccugaaagaguaguccucgcuggcccaaugccaguaaccgccgccucagcagcacaacgacgaggcagaguaggacgcaauccacagaaagaaaacgaucaauauaucuuuacaggacagccucuaaauaaugacgaggaucacgcacauuggaccgaggcaaaaaugcuccuagauaauauaaacacuccagagggaaucauuccagccuuauuugaaccagagagagaaaagucagcugcuauagacggugaauauaggcuaaagggagagagccgcaaaacuuuugucgaauuaaugaggagaggggauuuacccguuugguuagcccauaagguugcauccgaaggaauuaaauauacugaucguaaaugguguuuugacggucaaagaaauaaccagauuuuggaggaaaauauggacguggaaaucuggacgaaagaaggagagaagaagaaauuacgaccacgcuggcuagaugccagaacuuauuccgacccauuagcauuaaaagaauuuaaagauuuugccgcuggacguaaaaguauagcacuagaucuugucacagagauaggucgcgugccaagccauuuagcacacagaacgcggaacgcacuugauaaucuagugauguuacacacaagugagcacggcggccgugccuacagacacgcuguagaagaacuaccagagacgauggaaacccuccuccugcuaggauuaaugaucuuacucacgggaggagcgaugcucuuuuuaauuagugguaaaggaaucgguaaaacaagcauuggucuaauuugcgugauugcaagcucaggaaugcuguggauggcggaaauuccccugcaauggauugcgagugccaucguauuagaguucuuuaugaugguacuuuuaauuccagaaccagaaaaacaaagaaccccucaagauaaccaacuggcuuauguaguaauaggcaucuugacgcuggcggccaucauagccgcgaaugaaaugggccuauuagagacaacaaaaagggauuuagggaugucuaaggaaccaggcgucgugucuccaacaucguacuuagaugucgaucugcacccugcaucggcguggaccuuauacgccguagccacuacuguaauaacaccaauguuaagacauaccauugaaaacuccacagcaaaugucagucuugcagccauugcaaaucaagcaguaguguuaaugggccuugauaaaggguggccaauauccaaaauggaccucggcguuccccuccuugcucuagguuguuauagccaaguaaauccccuaacucuaacagcugcaguguuauuacugauaacucauuacgcaauuauuggaccgggcuuacaagccaaagcuacccgugaagcucaaaaacgaacagcggcgggaauaaugaaaaaccccaccgucgauggaauaaugaccauugaucuugauccugugauauaugauucgaaauuugaaaaacaacuuggucaaguaaugcuuuuaguacuaugugccguccagcuucuucuuaugcgaacauccugggcccucugugaagcucuuacccucgcuacgggaccgauuaccacccucugggaaggaucaccaggaaaauucuggaauacaacuauugcgguuucgauggcaaauauauuucgcggaaguuaccuugcaggggcuggauuagcauuuaguaucaugaagucaguagggaccggaaaaagggguacuggaucgcagggggaaacucucggugagaaauggaagaagaaauuaaaucaauuaucuagaaaagaauuugauuuguacaagaaaucggguauuacagaagucgacagaacagaagcaaaagaaggauuaaaacggggugagauuacucaucaugcaguaaguagaggaucagcuaaacuacagugguuuguagagaggaauaugguuauaccggaaggccgugucaucgacuuggguuguggacgagguggcuggucauacuauugugcagguuuaaagaaaguuaccgaggucagagguuacacgaaagggggcccaggucacgaggaaccaguuccaaugaguaccuacggcuggaauauuguuaaauuaaugagcgggaaagaugucuuuuacuuaccgccugaaaaaugugacacgcucuuaugcgauauaggggaaucuucaccaucuccuacgguagaggaaucuagaacaauaagaguucuuaagaugguugaaccuuggcucaaaaauaaccaauucuguauaaaagucuuaaauccguauaugccaacaguaauagaacaucuggaacgguuacaaaggaagcacggaggaaugcuaguacguaauccuuuaucaaggaauagcacgcaugaaauguauuggauaaguaauggaaccggcaauauaguagcaagcguaaacaugguuucucguuuacuauuaaauagauuuacaaugacccaccgacgaccaaccaucgagaaggacguugacuuaggagccgguacaagacacguaaaugccgaaccugaaaccccgaacauggauguaauaggugaacgcaucaaaagaauaaaagaagaacacaauucuaccuggcauuaugacgacgaaaaccccuauaagacgugggcauaccauggaucauaugagguaaaagcuacaggcucggccaguagcaugaucaauggaguaguaaagcuccuaacaaaacccugggauguuguaccuauggucacgcaaauggcuaugacugacacgacgccauuuggacaacagagaguguuuaaagaaaaaguugauacucgcacaccgcgcucgaugcccggaacucgacguguaauggguauaaccgcagaaugguuguggcguacucuugggcgaaauaagaaaccgagauuauguacaagagaagaguucacuaagaaaguaagaacaaaugccgcaaugggagcgguauuuacggaagagaaucagugggauucagcaaaagcggcuguagaagacgaggauuucuggaaacucguggaccgugaacgugaacuacacaaauuaggaaaauguggguccugcguuuauaauaugauggggaaaagagagaagaaacuuggagaauuuggaaaagcgaaaggaagccgcgcaauaugguauaugugguuaggggcuagauacuuagaguucgaggcucucggauuucuuaaugaggaucacugguuuagccgugaaaauucuuacagcggugucgaaggugaaggauuacauaaacuaggauacauauuaagagauauaucaaaaauuccuggaggcgcuauguaugcugaugacacagcagguugggauacaaggauuacagaagaugacuugcacaaugaggagaaaauaacccaacaaauggauccggagcaccgccaauuagcaaacgcuauuuuuaaauuaacauaucaaaauaaaguugugaaagugcaacggccuacaccgacgggaacugugauggauauaauuucucggaaagaucaaagagggucgggacaagucgguacuuauggguugaauacguucaccaacauggaagcgcaacuaauuagacaaauggaaggcgaaggaguauuaucaaaggccgaccuagaaaauccacaccucccagagaagaaaauaacucaguggcuagaaacaaaaggggucgaacggcucaaacguauggcuaucucuggugacgacugcguaguaaaacccauugaugaccguuucgcaaaugcguuacuagccuugaacgauauggguaaaguaaggaaggauauuccccaauggcagccaucuaaaggauggcacgauuggcaacaaguuccuuucuguagucaucacuuucaugaguugauuaugaaagacggacguaaguuaguuguaccuuguaggccacaagacgaauuaauaggcagagcgaggauaucucaaggcgccggcuggagucucagagaaacagcgugucucggcaaagcguaugcgcaaaugugguccuuaauguauuuccauagacgagauuuaagauuagcauccaaugcgauaugcuccgcuguuccuguucacugggucccgacgaguagaaccacauggucuauucaugcccaccaucaauggaugacaacugaagacaugcuaacuguauggaauaggguuuggauagaagacaacccauggauggaagacaaaacacccguaacaaccugggagaacgugccuuaucucgguaaaagggaagaucaauggugcgggucauuaauaggcuuaacuucccgagcaaccugggcacaaaauauucccacggcaauccaacaagugcggucccuuaucgggaaugaagaauuucucgauuauaugccuucgaugaaacgauuuaggaaagaggaagaaagcgaaggagcgauaugguaa

SEQ ID NO: 23003 - RNA, 9873 nt, Artificial Sequence
  derived and/or modified CDS sequence (opt6) from DENV-3__JX669493__SS-prME
acauccuuuugcuuaaugaugauucuuccugcggcauuagcguuucacuugaccaguagggauggugaaccgcgcaugauagucgggaaaaaugaaaggggaaaaagccucuuguuuaaaacagccucuggaauaaauaugugcacguugaucgcaauggacuuaggcgaaaugugugacgacacuguaacguauaaauguccgcauauaacggaaguugaaccagaagacauagacuguuggugcaauuuaacaucuacuuggguuacauaugggaccuguaaucaagccggagaaagaagacgagacaaacgaagcgucgcguuggcuccccauguggguaugggcuuggacacacgcacucaaacauggaugucagcagaaggggcauggcgacaaguagaaaaagucgaaacaugggcauuaaggcacccaggauucacgauucuugcacuuuuccuugcucauuacauuggaacuucucucacgcaaaaaguggucaucuucaucuuacuaaugcugguaaccccgucaaugaccaugcguugcguuggcguuggaaaccgugacuuuguagaaggauuaaguggggccacgugggucgacgucguccuagaacauggagggugcgugaccacgauggccaaaaauaaaccgacgcuugacauugaauuacagaaaacagaagcuacacaauuagcuacucuuagaaaauuauguauagaaggaaaaauaacuaauauaacgacggauucacgauguccgacucaaggcgaggccguacugccagaggaacaagaucaaaauuacguguguaaacacacguaugucgaccgcggauggggaaauggauguggauuauucggaaaaggaucucucguuacuugcgcaaaauuccaaugccucgaaccaauagaagguaaaguaguacaauacgaaaaccucaaauacacaguaaucauaacaguacauacaggcgaucagcaccaaguugguaacgagacccaagguguaacggcugagauaacuccacaagcuaguaccaccgaagcgauuuuaccagaauaugguacucucgguuuggaguguucccccaggacaggauuggauuuuaacgaaaugauacuuuuaacaaugaaaaauaaagcauggaugguacacagacaaugguucuucgauuugcccuuaccauggaccagcggagcuacuacagaaacacccacguggaauagaaaagaauuguuagucacauuuaaaaaugcacaugcaaagaaacaagaaguuguuguauuaggaagucaggagggagcuaugcauacugcuuuaacaggagccacagaaauacaaaauagcgguggaacaucaaucuucgccggacacuugaaaugcagacucaaaauggauaaauuagaauugaaagguaugucuuaugcaauguguacaaauacauuuguuuugaaaaaggagguaucggaaacccaacauggcacaauauuaauaaagguagaauauaagggagaggacgcuccguguaagauacccuucaguacagaagacggucagggaaaagcccauaauggacgccugaucacugcuaauccaguaguuacgaagaaagaagaaccaguaaacauagaagcagaaccaccauuuggggaaagcaacaucgucaucggaauuggagacaacgcauuaaaaauaaacugguauaagaaagggagcuccauugggaaaauguuugaagcuacagcaaggggagcacgaagaauggcaauauugggugacacugcgugggacuuugguagcguagggggaguacuaaauucauuggggaaaauggugcaucagauuuucggcucagcauauacugcguuauucuccgggguaaguugggucaugaaaaucggaaucggaguacuacuaacguggauugguuugaacuccaaaaauacuucgaugucauucucuugcauagcaauuggaauaauaacucuauaccuaggggcagugguccaagccgauauggggugcgugauaaauuggaaaggcaaggaauugaaaugugggucuggcauuuuugucacaaacgaaguacauacauggacugagcaguauaaauuccaggcagacaguccuaaaagacucgcaaccgcuauagccggagcaugggaaaaugguguauguggaauccgcaguacaacacgaauggaaaacuuauuauggaaacaaauugcaaacgaacucaauuacauacuaugggagaauaauaucaaacuuacgguagugguaggcgauauaauuggaguacucgaacaaggaaaaagaacccugacaccacagccuauggaacuuaaauauucguggaaaacuuggggaaaggcuaaaauuguaacugcagaaacacaaaauucaaguuuuaucauugacgguccaaauacuccugaguguccguccgccaguagggccuggaauguuugggaaguagaagauuaugguuucgggguauucacgacaaauauaugguuaaaacugcgugaaguauacacgcagcuuugugaccaccgacucaugagcgcugcgguaaaggaugaaagggcugugcaugcugauaugggguauuggauugaaucgcaaaagaauggaaguuggaaacuagagaaggcaaguuuaaucgaaguaaaaacauguacauggccaaaaagccauacacuauggaguaacggaguguuagagucggauaugauaauacccaaguccuuagcagguccaauaagucaacacaaucauaggcccggguaccauacacaaacugcaggucccuggcaccucggcaaacuagaauuagauuuuaacuauugcgaaggaaccacaguaguaauaacagaaaauugcgguacgcguggcccuucacuacguacgacgacagugaguggaaaacuaauacaugaguggugcugcagaucuugcacccuaccuccauuaagauauauuggagaagauggaugcugguauggcauggaaauaagacccaucucggaaaaagaagagaauauggugaaaucuuuaguuucggcaggaagcgggaagguggacaacuuuacuaugggaguacuuuguuuagcaauccuauucgaagaaguuaugagagguaaauuuggcaagaaacauaugauagcuggcgucuucuuuacauucguccuucugcuaucuggacagauaacauggagagauauggcucauacacugauuaugauaggaucaaacgccucggauagaaugggaaugggaguuaccuaccucgcguuaauagcaacauucaaaauacaaccauuuuuggcuuuaggauucuuucuucgaaaacucacaagccgcgaaaaucuauuauuaggagucggacuagcuauggcaacgacauuacaauuaccagaagauauagagcaaauggcaaauggaaucgcccuuggauuaauggcauugaaauuaauaacccaguuugaaacauaucaacuauggacagcccuuauaucguuaacuuguagcaacacuauguuuacauuaacugucgccuggcgaacggcaacucuaauauuagcaggaguaagucuuuuacccgucugucaaucgucaucaaugaggaaaacagauugguuaccuauggccguagccgcgauggggguuccucccuuaccucuguucauauuuagccuaaaggauacgcuaaagcgacguaguuggccgcugaacgagggcgucauggccguaggcuuggugucuauuuuggcuaguucacuauuaagaaaugauguuccaauggcagguccccuaguugcaggcggucuucuaaucgcauguuacgucauuacuggaacgagcgcagaucuaacuguagagaaagcggcagacauuacuugggaagaggaagcggagcaaacuggaguaagccauaacuugaugauuacuguugacgacgacgguacgaugcguauuaaggaugacgagacagaaaacauacuaacugucuugcuaaagacagccuuacugaucguaaguggagucuuucccuauucaauccccgcgacacuuuuaguauggcacacguggcagaaacagacacaaagaagcggaguacucugggaugucccuaguccaccugaaacgcaaaaagcagaacuagaagaaggaguauauagaaucaaacaacaagguauauucggaaaaacccaaguaggagucggaguccaaaaagagggaguguuccacacgauguggcacgucacgagaggggcaguacuaaccuacaaugggaagaggcuagaaccaaauugggccagugugaagaaagaucuaauuuccuaugggggaggauggcgcuuaucugcacaauggcaaaagggagaagagguacaggugauagcagucgaaccagguaagaacccgaaaaauuuucaaacaaugccaggcaccuuucaaacgaccacuggugaaauaggagccauagcacuggacuucaaaccaggcacaaguggcagcccuauaauaaauagagaaggcaaaguaguuggauuauaugggaacggaguaguuacuaaaaauggaggauaugucuccgguauagcucaaacaaaugcugaaccugaugggccuacaccggaauuggaagaagaaauguucaagaaacguaaucuaacuauuauggauuuacaucccgggucuggaaagacucgaaaauauuugccagcuauagucagagaagcuaucaagcgaagauuacggacucuuauccuugcaccaacgagagucguugcagcagagauggaagaagcacuaaagggauuaccaauaagauaucaaacuacagcuacgaagagugaacauacgggacgggaaaucguugaucuuaugugccacgcgacauuuaccaugcgauuacuuucgccuguacgcguaccaaacuauaaccuuauaauuauggaugaagcucacuuuacugacccagccaguauagcggcaagaggauacauuucgacacgagucgguaugggcgaagcggcagcgauauuuaugaccgcaacuccaccgggaacagcggaugcauuuccccaaucaaaugcgccaauucaagaugaggaaagagacauaccagaacggucauggaacuccgguaacgaguggauaacagauuucgcaggaaaaacggugugguucgugccaucaauaaaagcugguaaugacaucgcaaacuguuugcguaagaauggaaagaaaguaauccaauuaucgagaaagacauucgauacugaauaucagaaaacaaaacuaaacgauugggacuuuguggugacuaccgacauuucagaaaugggagccaacuucaaagcagaccguguaauagauccuagaagaugucuaaaaccugugauucuuacugacggaccagagaggguaauacuagccgggccaaugccgguaacugcggcaucagccgcucaaagaagagguagggucgggaggaacccgcaaaaagagaaugaucaauacaucuuuacuggacagccgcuuaauaaugacgaagaucacgcucauuggacggaggcuaaaauguugcuggacaauauaaauacgccagaagggauaauuccugcauuauuugaaccagagagagagaaaagcgcagccauagauggagaauacagauuaaaaggugaaagcaggaaaacuuucguagaacucaugcgcaggggcgauuugccaguauggcuugcacauaaaguagcaagugagggcauuaaauauacggacagaaaguggugcuucgacggucaaagaaacaaccaaaucuuagaagaaaauauggacguugaaauauggaccaaggaaggagagaagaagaaacuaagaccgcguugguuggaugcaagaacauacucagacccauuagcacucaaagaguuuaaagacuucgcagccgguaggaaaaguauagcuuuggaucugguuacugagauaggacgagugccaucacacuuagcacauagaacaagaaaugcauuggauaauuuagugaugcugcauacuucagaacacggugggcgcgcauaucggcaugccguggaagaacugcccgaaacaauggaaacacuccucuuacuaggacucaugauauuauuaacaggcggcgccaugcuauuucucauaucaggaaaggggauaggaaaaacaucaauagggcuuauuugcguuauagcuucaagcggaauguuauggauggcagaaauacccuuacaguggauagcaucagcgauaguucuugaguucuucaugaugguuuuguugauaccagaaccagaaaagcaaaggacaccacaagauaaucaacuggcguaugucguuauaggaauccuaacccuggcugcaauaaucgcagcaaacgaaaugggccuauuggaaaccacaaagcgugauuuaggaaugagcaaagaacccgggguagugagcccuacuucuuauuuagaugucgaccugcacccggcaucugcauggacucuguaugcaguagcuacaacugugauuacucccauguuacgccacacaauagaaaacagcacagcaaacgucucgcucgcagcuauagcaaaucaggcaguaguguuaauggguuuagacaaagguuggccuaucuccaaaauggauuuaggaguuccucuacuggcucuggguugcuacagccaaguuaauccucugacauugacggcggcuguccuauuacuuauuacccacuaugcaauaauuggaccaggucuccaagcaaaagcgaccagggaggcccagaagaggacggcagccgggauuaugaagaacccaacaguagauggaaucaugacaauagaccuugauccuguaauuuaugacaguaaauuugaaaagcaguuaggucagguaaugcuccuaguauuaugcgcgguucaauuguuacuuaugcgcacaucuugggcauuaugugaagcauuaacguuagcaacaggcccaauaacgacuuuaugggaggguucaccuggcaaauucuggaauacgacaauagcaguaucgauggcaaacauauuccgaggaucauaucucgcuggagccgguuuagcauucucuauuaugaaaagcguaggaacggguaagcgaggcacaggcagccaaggagaaacauugggcgaaaaguggaagaagaaacugaaucaacuauccagaaaagaguucgaucuauauaagaaaaguggaauaaccgagguagauagaacagaagcaaaagaagggcugaaaaggggagaaauaacgcaucaugccguaagccgaggcagcgcuaaguuacaaugguuugucgaaagaaacaugguaauucccgaagguagagugaucgauuugggaugcggcagaggugggugguccuauuauugugcagguuuaaagaaaguuacugagguucgaggauauacuaaagggggaccugggcacgaagaaccgguaccuaugucuacauacggauggaauaucgugaaacuuaugagcggaaaagaugucuuuuauuuaccucccgaaaaaugugauacgcuacuaugugauauaggugaaagcucgccaucgccgaccgucgaagaaagccgaacaauuagaguuuuaaaaaugguagaaccgugguugaaaaauaaccaauucuguauaaaaguuuugaacccauauaugccaacaguaaucgaacaccucgaaagguuacaaaggaaacacgguggaaugcuuguaagaaauccauuauccagaaauucaacacacgaaauguauuggauuucuaaugguacuggaaacauugucgcaucugugaacaugguuucacgguuauuauuaaauagauuuacgaugacacauagaagaccaacaauagagaaagauguagauuuaggcgcagggacaagacauguuaacgccgagccugaaacaccaaauauggacguuaucggagaacgaauaaaacgaauaaaagaagaacacaacucaaccuggcauuaugacgaugaaaauccauacaaaacaugggcuuaucaugggucguaugaaguaaaggccacagguucugcuucgaguaugauaaauggagucguuaaacuacuaacgaaaccgugggauguaguacccauggucacgcaaauggccaugacagauacuacaccuuuuggucaacagagaguauuuaaagaaaaaguggacacucgaaccccgagaaguaugcccgguaccaggcgaguaaugggaauaacagccgagugguuguggcgaacauuaggucgcaacaagaaaccuaggcuaugcacucgcgaagaauuuacgaagaaaguucguacaaacgcagcgaugggagccguuuucacagaagaaaaucaaugggauuccgccaaggcagccguagaagaugaggauuuuuggaagcuaguugaccgagagagagaauuacauaaauuggguaaauguggaucuugcguauacaacaugauggggaaacgugagaagaaauuaggugaauuuggaaaagcaaaagggucacgggccauuugguacauguggcuuggagcaagauaccuagaguucgaagccuuaggauuucugaacgaggaucacugguuuagucgugaaaauucuuauucggguguagaaggcgagggauuacauaaguuaggauauauauuaagagauauuagcaaaauuccaggaggggcuauguaugcugacgauacggccggcugggacacaaggauaacugaagaugaccuacacaaugaagagaaaauaacccagcaaauggaucccgagcacagacaauuagcuaaugcuauauuuaaacuaacuuaucagaacaaaguagugaagguacaaaggcccacacccaccggaacggucauggauauaauaucgcgaaaagaucaaaggggaaguggacagguggggacauauggacugaacaccuuuaccaacauggaagcucaacuuauacgucaaauggaaggagagggggugcuaucgaaagccgacuuagaaaauccucaucucccagagaagaagaucacacaaugguuagaaacuaaggguguagagagacuuaagcguauggcaauuaguggagaugacuguguaguaaagccaauagacgauagauuugccaaugcgcuacucgcacuaaacgacauggggaaaguaagaaaagauauuccacaguggcagccauccaaaggguggcacgacuggcagcaagucccuuuuuguucgcaucacuuccacgaguuaauaaugaaggaugggagaaaauuaguaguuccuuguagaccacaggaugaacuaauaggaagggcaagaauuagucaaggugccgguuggucuuuacgcgaaacugccugccuagguaaggcuuaugcgcaaauguggagucuaauguauuuucaucgccgagauuuacgguuagccagcaacgcuauuuguagugcuguaccaguacacugggucccgacaucaagaacaacuuggucuauacacgcucaucaucaauggaugacgacagaggauaugcucacugucuggaaccguguuuggauugaagacaaucccuggauggaagauaaaacacccguaacaacaugggaaaacguaccauaccucggcaagagagaagaucaauggugugguucauugauaggacugacgucaagagcaaccugggcucaaaacaucccuacagcgauucaacagguacggagucuuauuggaaacgaagaguuccuggauuauaugccuucuaugaagagauuucguaaagaggaggaaagugaaggagcaauaugguag

SEQ ID NO: 23004 - RNA, 9873 nt, Artificial Sequence
  derived and/or modified CDS sequence (opt6) from DENV-3__JX669504__SS-prME
accaguuuaugccuaaugaugauacuuccggcggcguuagcuuuucaucuaaccagucgugauggagaaccacgaaugauugucgggaaaaaugaaagaggaaaaucauugcuauuuaaaacugcaagcggaaccaacauguguacuuugauugcaauggauuugggagaaaugugcgaugauacuguuaccuauaaaugcccacauauaacagaaguagaaccggaagacauugacugcugguguaaccucacaaguaccugggucacuuauggaaccuguaaucaagcgggagaaagaagaagagacaaaagaucagucgcgcuagcuccacacgugggaaugggacucgacacgcgaacacaaacuuggaugucugcagaaggggcuuggagacaaguggaaaaaguagaaacaugggcguuacgacauccaggauuuaccauuuuggcguuguuccuugcucauuauauugggaccucacuuacccaaaaagucguaauauucauauuauugaugcuugucacuccgucaaugacgaugcggugcguaggaguggggaaucgggauuucguagaaggacuaagcggcgccacaugggucgauguaguauuagagcauggagguugugugacaacaauggccaaaaauaaaccaacucuugauauagaauuacagaaaacugaggcaacucaauuagcgaccuuacgcaaacuaugcauagaaggaaaaauaacaaacauuacgacugacucuaggugcccaacccaaggagaggcaguacuaccugaggaacaagaucaaaacuaugucuguaaacauacguauguagauagggguuggggaaaugguugugguuuauuuggcaaagggaguuuggucacaugugcaaaauuccaaugccuagaacccauugaagguaaaguaguccaauacgaaaaccucaaauauacaguaauaauaacaguccacacaggggaucaacaucagguaggaaaugagacucagggaguuacugcugaaauaacaccacaagcuaguaccacugaagcaauauuaccggaauaugggacauuaggauuagagugcuccccucggacaggucuugacuuuaaugaaaugauuuugcucacaaugaaaaauaaagccuggaugguccauagacagugguuuuucgaucuaccucuacccuggacgucuggagcuaccacagaaacgccgacauggaauagaaaagaguuauuagucacuuuuaaaaaugcucacgcaaagaaacaggaaguugucguacucggaagucaagagggugccaugcacacggcauuaacaggugcaacagaaauacaaaauucugguggcaccucuauuuucgccggacaucucaaaugucgauuaaaaauggauaaacuagaauuaaaagggaugagcuaugcaauguguacuaauacuuucguuuugaagaaagaagucucagaaacacaacauggaacuauacugaucaaaguagaauacagaggggaagacgcucccuguaaaauaccauucaguacagaagacggucaagggaaagcccauaaugggcgcuuaauuacagcaaauccaguaguuacgaagaaagaagaaccaguaaauauagaagccgagccuccauucggcgaguccaauauuguaaucggaauaggagauaaugcuuuaaaaauaaacugguacaagaaaggauccagcaucggaaaaauguuugaagcaacggcacgaggcgccagaagaauggcgauacucggggauacugccugggacuucgggaguguuggugggguucucaauaguuugggaaaaauggugcaucaaauuuuugggagugcauacacagcacuguuuaguggaguuaguugggugaugaaaauugggauuggaguccuacugacguggauuggacuaaauagcaaaaauacuucuaugucauucaguuguauagcgaucggcauuauaacacuauaccugggagcaguuguucaggcagauaugggauguguaauuaauuggaaaggaaaagaauuaaaauguggaagcggaauauucgugacaaacgaagugcauacauggacggaacaauauaaauuucaagcagacucuccgaaacgauuagcuaccgccauagcuggagcaugggaaaacgguguuuguggaaucaggucgacaacgagaauggaaaauuugcucuggaaacaaauugcgaaugagcuaaacuacauuuuaugggaaaacaacauuaaauugacaguaguaguaggcgauaucauaggcguguuagagcaaggaaaacgaacuuuaaccccucaaccaauggaacucaaauacucauggaaaacaugggggaaagcgaaaauaguaaccgcagaaacucaaaauuccucauuuaucauugauggucccaauaccccggaaugcccaucagcaagcagggcguggaauguaugggagguugaagauuauggauuuggaguauuuaccacaaacauauggcuuaaacucagagaaguuuauacucaguuaugcgaucaucguuuaaugagugcugccgucaaggacgaaagagcaguucacgcagacaugggguacuggauagaaagccagaaaaauggaucuuggaagcuagaaaaagcaaguuugaucgaaguuaaaacuugcacauggccaaaaucgcauacucuguggucuaacggggucuuggagucagauaugauaauacccaaaucacuagcagguccuauuucacaacauaaucaccgaccgggauaccauacucagacugccggaccuuggcaucuagguaaauuagaauuagacuuuaauuauugugaaggaacgacagugguaauaaccgaaaauugcgggacacgagggccuuccuuacgaacuacgacaguaaguggcaaacuaauucacgaauggugcugcagaaguugcacauugccgccacuccgcuauaugggugaagauggcuguugguauggaauggaaauacgaccuauaucugaaaaagaagaaaacauggucaaaucacucgucagcgcugguucagguaaaguagauaacuucaccaugggagugcuauguuuagcuauauuguuugaagaaguuaugagagguaaauuugggaaaaagcauaugauagcaggcguauucuucacauugguauuauugcuuuccggacaaaucacauggcgagauauggcccacacgcuaauaaugauaggaagcaaugcuagcgauagaaugggaaugggggugacguaccuugcacuaauugcuacauucaaaauacaaccauuuuuagcucuuggauucuuucuacgcaaauuaacuucaagagaaaaucuauuauuaggcgucgggcuagcgauggcuaccacucuacaacuaccugaagacauagaacaaauggccaacggcauagcccuagguuuaauggcacuaaaacucauuacacaguuugaaacuuaccaacuauggacagcuuuaauuucauuaacuuguagcaauacaauguucacacuuacagucgcauggcgcacagcgacccuaaucuuagcaggggugucauuguugccgguaugucagagcuccucaaugagaaaaacugauugguuaccgauggcaguagcggccauggggguaccacccuuaccucuguuuauauuuucauuaaaggauacccuaaaacgaagaucuuggccacuaaaugaagguguuauggccguugguuugguuucuauauuggcgaguucgcuucuaaggaacgaugugcccauggcaggaccucucguugcaggagggcuacuuauugcauguuauguaauuacaggcacaagugcagaucuuacgguugagaaggccgcugacauuacuugggaagaggaagcagaacaaacuggaguuucccauaaucuuaugaucacaguagaugacgacgguacaaugaggauuaaggaugacgaaacugaaaauauauuaacaguccuauuaaagacagcgcuauuaauuguaucaggaguuuucccuuauaguauaccagcaacucugcuuguuuggcacacguggcaaaaacaaacgcaacggucuggaguccuuugggacgugcccagcccuccagaaacccaaaaggcugaauuagaagaaggaguauaccgcauaaaacagcaaggaauauucggaaagacccagguaggagucgguguacaaaaagaaggcguauuucacacaauguggcacgugacacgaggggcaguucugacuuacaacgggaaacgauuagaaccaaacugggcuucaguuaagaaagaucugauaucauacggaggaggauggaggcucucagcucaguggcaaaagggggaagagguccaaguaauagcaguggaaccggguaaaaauccuaaaaauuuccaaacaaugcccgguacuuuucaaaccacuaccggagagaucggcgcuauagcguuagacuucaaacccggaaccuccgguucuccuaucauaaaucgcgaagguaaaguagucggguuauaugguaauggaguugucacuaaaaauggagguuaugucucaggaaucgcgcaaacuaaugcggaaccugaugggccuaccccugaacuugaagaagaaauguucaagaaacgaaacuuaacaauaauggauuuacacccaggaucgggcaaaacaagaaaauaucuuccagccauuguccgggaagcgauuaagagacgauugagaacucuuauauuagccccaacgcgagucgucgccgccgaaauggaagaggcuuuaaagggccuaccaauuagguaccaaacaacggcaacuaaguccgaacacacggggcgugaaauagucgauuuaaugugucacgccacguuuaccaugcggcuguuaucuccagucagaguuccaaacuacaacuuaauaaucauggacgaggcacacuuuacagauccagcuaguaucgccgcaagagguuauauaagcacgcguguugguaugggggaagcagcagcaauuuuuaugacggcgacaccuccagguacagcugacgcuuucccgcaaucaaacgcuccgauccaagacgaagaaagagacauuccugaaaggaguuggaacucgggaaaugaguggauaacagauuucgcuggaaaaacagugugguuuguaccaucaauaaaggcugguaacgauauagcuaacuguuuaaggaaaaauggcaagaaagugauacagcuuucaagaaaaacuuucgauaccgaauaccagaaaacuaaauuaaaugauugggauuuuguagucacaacggauauuucagaaaugggagcuaauuuuaaggcagaccggguuauugacccaagacgaugcuugaagcccguuauauugacggacgggccggaacguguaaucuuagcaggccccaugccuguaacagcagcuagcgcugcgcaaagacgggguaggguaggacgaaacccacagaaggagaaugaccaauacauauucacugggcaaccuuuaaauaaugacgaagaucacgcacacuggaccgaagcuaaaauguuauuggacaacauaaauacgccugaaggaauaaucccagcacuauucgaaccagaacgugagaaaagcgccgcaauugauggagaauaucguuugaagggcgagagccguaaaaccuuuguggaacuuaugcggagaggagaucuuccaguauggcucgcgcauaaaguagccucugaaggcauuaaauacaccgacagaaaauggugcuucgacggacaaagaaacaaucaaauauuagaggagaauauggauguagaaauauggacaaaagaaggagagaagaagaaauuaagaccacguuggcuugacgcacgaacuuauucagacccacuagcauuaaaagaauuuaaggauuuugcagccgggaggaaaucaauagcauuagaccuaguuaccgagauaggaagagucccaucccaccuggcacacagaacaagaaacgcucuagauaaccuaguuauguugcauacgucagaacauggagggagggcguauagacaugcaguugaggaauuaccggaaaccauggagacuuuguuauuacuaggguugaugauuuuauuaacaggcggcgcuauguuauucuuaauuaguggaaagggcauaggaaaaacaaguauagguuugaucuguguaauagcuagcuccgguaugcuauggauggcggaaauaccucuacaauggauagcaucagcaauaguccuugaguucuucaugaugguacuucuaauaccagaaccugaaaaacaaagaacuccucaagacaaccaacuugcauacgucgugauuggcaucuuaacauuagcugcuauuauagcagcuaacgagaugggauuauuggaaacaacgaaacgagauuuaggaaugagcaaagaaccaggaguugucucucccacuucauaucuagaugucgaucuacacccugccucagcauggacauuguacgcaguggcgaccacagucauaacucccaugcuacgacauaccauagaaaauucgacagcgaacguuucuuuagcagcuaucgcgaaccaagcaguagucuuaaugggacuugacaaaggauggccgaucagcaagauggaccuaggugucccuuuauuagcacuaggaugcuacucucaaguuaauccauuaacguuaacagcagcaguauugcuucuaauaacacacuacgcaauuauagguccaggacuacaagcuaaagcaacccgcgaagcgcagaaaaggacggcugcugguauuaugaagaaucccacaguagacggcauaaugacaaucgacuuagauccaguaauauaugacucaaaauucgaaaaacaauuaggccaaguuaugcuucuaguauuaugugcaguucaacuacuacuaaugcggacaagcugggcucuuugugaggcccuuacacuagcaaccggaccgauaaccaccuuaugggaagguucaccaggcaaauucuggaauacaacaauagcugugucaauggcaaauaucuuccguggaaguuacuuagcuggagcaggcuuagccuucagcauuaugaaaaguguggguaccggaaaacgaggaacuggaagccagggugaaacucugggcgaaaaguggaagaagaaacucaaucaacuuucacgaaaagaauuugaccucuauaagaaaucaggaauaaccgaaguugauagaacagaggccaaggaagggcuuaagcgaggugaaauuacgcaccacgcuguaagccgaggcucagcaaaacuacaaugguuugucgaaagaaacaugguaaucccagaagguagggugaucgacuuagggugugggcggggcgguuggaguuauuauugugccggauugaagaaaguaacugaggugaggggguacacaaaaggaggacccggccacgaggagccgguucccaugucaacauaugguuggaacauagucaagcuaaugucugggaaggacguauuuuacuugccuccagaaaaaugcgauacguuauuaugcgauaucggagagucgagcccaaguccuacugucgaagaaucaaggacgauacggguacuuaaaaugguagaaccuuggcuaaagaauaaccaauucuguauaaaaguacuaaacccguacaugcccaccguuauagagcaccuagaaagauuacagcggaaacacgggggaaugcuaguaaggaauccucucucgaggaacucaacacaugaaauguauuggauuaguaacggaacaggaaacauaguagcuucagucaacacugugagcagacuuuuacuuaauagguuuacaaugacacauaggcguccgacgacugaaaaggacguagaucuaggggcgggaacuagacacgucaacgccgaaccagaaacaccgaauauggacguaauuggagaacggauaaagcggaucaaagaagaacacaacucuacauggcacuaugaugacgaaaaucccuauaaaaccugggcauaucaugguucauacgaagugaaggcaacggggucagcgagcucuaugauuaacggaguggugaaacuguugacgaaaccuugggauguggucccuaugguaacacaaauggcgaugacagacacaacgccuuuugggcaacaaagaguguucaaagaaaaggucgauacgagaacaccgagaaguaugccgggaacccgaagaguaaugggcauuacagcggagugguuguggaggacccucggucgaaauaagaaaccacgacuauguacccgugaagaguucacuaagaaagugcguaccaaugcagcgaugggcgcugucuucaccgaagagaaccaaugggauucagcaaaagcagcuguagaagaugaagacuucuggaagcuagucgacagagagcgagaguugcauaaauuaggaaaauguggaaguuguguguauaacaugaugggaaaacgagagaagaaauuaggggaauuuggaaaagcaaaaggcucgcgagcaauuugguacaugugguuaggagcccgauaccuugaguuugaagcacuuggcuucuuaaaugaggaccauugguuuagucgugaaaauagcuauagcggcgucgaaggugagggauugcauaaacuuggauacauucucagagauauaucgaaaaucccggguggggccauguaugcugaugacacugccggaugggauaccagaauuaccgaggacgaucuucauaacgaagagaaaaucacacaacaaauggauccagagcauagacaauuggcaaaugcuaucuucaaauuaacguaucaaaauaagguaguuaagguacagcguccaacaccuacgggaacaguuauggacauaaucucaaggaaggaccaaagggguagcggccagguagguacguacggauuaaacaccuucacaaauauggaagcgcaacuaauccgacagauggaaggugaagguguacuuaguaaagcagaucucgaaaacccacaucugcccgagaagaaaauuacacaaugguuagaaacaaaaggugucgaacgccuaaaacgcauggcuauaagcggagaugauugugugguuaaacccauugacgacagguuugccaaugcucugcuggcauuaaaugauaugggaaaaguaagaaaagauaucccacaauggcaacccucaaagggauggcaugauuggcaacagguacccuuuugcucgcaucacuuccaugaguuaauuaugaaggacggacgcaaauuagugguuccgugccguccacaggacgaacuaauagggagagccagaauaagccagggagcugguuggagccuaagggagacggcaugucuagggaaagcauaugcacagauguggagccucauguauuuccauaggagagauuuacgcuuagcaucuaacgcaauaugcucugcugugccaguccauuggguaccgacaucaagaacgacuuggucuauacaugcacaucaccaguggaugacaacagaggacaugcuaaccgucuggaaucguguguggauagaagauaauccauggauggaagauaagacaccugucacuacaugggaaaaugugccguaucuggguaaacgugaagaccaaugguguggaucccugauugguuuaacaucacgagcgacaugggcucagaacauucccacagcaauccaacaaguaagaagucucauagguaacgaagaguuccuggauuacaugccuucgaugaaaagguuuagaaaagaagaagaaucugaaggagcuaucugguaa

SEQ ID NO: 23005 - RNA, 9873 nt, Artificial Sequence
  derived and/or modified CDS sequence (opt6) from DENV-3__JX669506__SS-prME
acuagcuucugccuaaugaugauucuaccugcugcacuagcauuucaccuaacaagucgagauggagaaccacgcaugauaguaggcaaaaaugaacgaggaaaaucacuccuauuuaaaacagcaucuggaauaaacauguguaccuuaauagcaauggaccuaggugaaaugugugacgauacaguuacauacaaaugcccacauauaacugaaguugaaccagaagauauagauugcuggugcaacuuaacauccaccuggguuacauacggaacgugcaaccaagcuggugaaagacguagagauaaaagaucaguggcacuagcgccacacgugggaaugggacuagauacacguacacaaacauggaugagcgccgaaggggcauggcgccaaguagaaaaagucgaaacuugggcacuucgucauccugguuuuacaauauuagcuuuauuuuuggcacacuacaucggaacuagcuuaacccaaaaaguuguuauauuuauauuacuaaugcuaguuacaccaucuaugacaaugcgauguguagguguaggaaaucgagauuuuguugaaggauuaaguggagcaacaugggucgaugugguacucgaacaugggggauguguaacuacuauggcuaaaaauaaaccaacauuagauauagaacuucagaaaacugaagcuacucaacucgccacucuucggaaacuauguauugaaggaaaaauuacaaacauaacaacagauagucgaugucccacucaaggagaagcugugcuaccggaagaacaagaucaaaauuacguguguaaacacaccuacguugauagaggcuggggaaauggaugugggcuauucggaaaaggaagucuuguuacaugugcuaaauuucaauguuuagaaccaauagaaggcaaagugguacaauacgagaaucugaaauauacuguaauaaucacuguacauacaggggaucaacaccaagucggcaacgagacgcaaggaguuaccgcugaaauaacaccacaagcgucaacaacugaagcaauauugccggaauaugguacauuaggauuggaaugcucuccaagaacgggauuagauuucaaugaaaugauccuauuaaccaugaaaaacaaagcauggaugguacacaggcaaugguuuuucgaccuacccuuaccauggaccucuggggcaacuacugagaccccaacguggaacagaaaagagcuauuagugacuuuuaaaaaugcgcacgcuaaaaagcaggaagucguuguacuaggaucacaagagggcgcaaugcauacugcucucacaggugccaccgagauacaaaauagcggugguacaucuauuuuugcuggccacuuaaaaugcagauuaaagauggacaaguuggaguuaaagggaaugucauaugcaaugugcacaaauacauucguguuaaagaaagaagucagcgaaacacaacacggaacaauauugauaaaaguugaauauaagggagaagaugccccauguaaaauucccuucuccacugaagauggacaagggaaggcuuauaaugggagacuaaucaccgccaacccgguaguuacgaagaaagaggaaccuguuaauauagaagcugaaccacccuuuggagaaaguaacauagugauagguaucggagacaaugcacuaaagauaaauugguauaaaaagggaagcaguauagguaaaauguuugaagcuacugcaagaggugcaagaagaauggccauucuuggggauacagcaugggacuucggaaguguugggggcgucuuaaauagucuuggcaagaugguccaccaaauuuucgggucagcauacacagcucucuuuucuggcguaagcuggguaaugaaaauaggaauaggcguuuuauuaacauggauagguuuaaauuccaaaaauacaucgaugucuuucaguuguauagccauaggaauaauuaccuuauaccucggugcaguaguucaagcugauaugggaugcgugauuaacuggaaagggaaagaauuaaaaugcggaucuggaauuuuugugacaaaugaggugcauacguggacugaacaauacaaauuucaagcagacagccccaaaaggcuagcgacggcaauugcaggagccugggagaacgggguuuguggcauucguucuacuacacguauggaaaaucuuuuauggaaacaaauagccaacgaacuaaauuacauauuaugggagaauaauauaaaacuaacagugguagucggugauauaaucgguguuuuagaacaaggaaaaagaacgcucacaccacagccaauggaauuaaaguauaguuggaagaccuggggaaaagcaaagauuguuacagcagaaacacagaacucaucauucauaaucgauggaccuaacacaccagaguguccauccgcuucuagggcuuggaauguuugggaaguagaagauuaugguuucggaguuuuuacaacaaacauuuggcucaaguuaagggagguuuauacccaauuaugugaucauagauuaaugucggcagcuguaaaagaugaaagagcgguacacgcagacauggguuacuggauugagucacagaaaaacgguucguggaaauuagaaaaagccucucuaauugaaguaaaaaccuguacauggccgaagucgcauacauuguggucuaacggaguauuagaguccgauaugaucauuccuaaaagucucgcaggccccauaucucagcacaaucauaggccaggcuaucauacgcagacagcgggcccuuggcacuuggggaaauuagaguuggauuuuaacuauugugaaggaacuaccguuguaauaacagaaaacugcggaacaagaggcccuagccuacgaaccacaacaguaucagggaagcucauucaugagugguguuguagaucauguacacuuccuccacuucgauauaugggcgaagauggauguugguacggaauggaaauaagaccgaucagugaaaaagaagaaaauauggucaagagcuuaguuagcgccggaucaggaaagguugauaauuuuacuauggguguuuuaugcuuggcuaucuuguuugaagaagugaugcguggaaaauuuggcaagaaacacaugauugcaggaguauucuuuacauuuguccucuugcucucuggucagauuaccuggagagauauggcgcacacauuaaucaugauaggaagcaaugcaagugaucgaaugggaauggguguaacguauuuagcgcuuauagcaacguuuaaaauacaaccauucuuagcauuaggauucuuccuuagaaaguuaaccucgcgagaaaacuugcuacuggggguaggucuggcgauggcaacaacacuacaacuaccagaagauauugaacaaauggccaacggaauagcacuuggacugauggcacuuaaacuaauaacucaauucgaaaccuaccaauuauggacugcucuuaucucgcucacuugcagcaacacaauguuuacauuaaccguugcauggagaacagccacacuuauauuggcugguguuucgcugcuuccaguuugccaaucuucaucuaugcgcaaaacagacugguuacccauggcgguagccgcaaugggugucccaccauugccuuuguuuauauucucauuaaaggauacauuaaagagaagaucguggccacucaacgaaggggugauggccguaggauuaguaucaauauuagcaagcucccucuuaagaaaugacguccccauggcuggaccauuaguagccgguggacugcuaauugccuguuauguuaucacuggaacaagcgccgaucuuacaguagaaaaagcugcagauauuaccugggaagaagaagcugaacagacagguguaucucauaauuuaaugauaacaguggaugaugauggcacuaugcgaauuaaggacgaugaaacggagaacauuuuaacaguacuauugaagacagcccuuuugauaguaucaggaguauucccauacaguauaccggcgaccuuauuaguuuggcacacauggcagaaacagacacaaagaagcggaguacuaugggaugugccaucuccaccugaaacgcaaaaagcagaacucgaagaaggaguauaucggauaaaacaacaaggaauauuugggaaaacacaaguagggguagggguccagaaagaaggaguauuccauacuauguggcacgugacacgaggagcuguacuaacauauaaugggaagcgauuagagccaaacugggcaucgguuaaaaaggaucugauaagcuacggugggggauggagacuaagcgcacaauggcaaaaaggagaagaaguacaaguuauagcugucgaaccgggcaaaaaucccaaaaacuuucagaccaugccgggaacauuccagacuacuaccggugaaauaggagcuauugcauuggauuuuaaacccggcacaucaggaucgccuauuaucaaucgggaagggaaaguuguuggccuauauggcaauggcguugucaccaaaaauggugguuauguuagcgguauugcacaaaccaacgccgaaccagaugguccaacuccagaauuagaggaagaaauguuuaagaaacggaaccuaaccauaauggacuugcauccaggaagcggaaaaacucgaaaauacuuaccugccauaguacgggaagcuauuaaacgcaggcuaaggacucuaauacuugcaccuaccagaguaguagcagcugagauggaggaagccuugaaaggacuacccauacguuaccaaacaaccgccacuaaaagcgagcauaccggacgggagaucguugacuuaaugugccaugccacguucacgaugagauuguuaucaccggucaggguucccaauuauaacuuaaucaucauggaugaagcacauuuuaccgaucccgcgucaauagcugcuagagguuacauaaguacuagaguaggcaugggugaggcugcagcaaucuuuaugacugcaacaccaccaggaacagcugaugcauuuccgcaaaguaaugccccaauucaagaugaggaacgcgacauucccgaacguaguuggaauagcggaaaugaauggauaacugauuuugcaggcaaaacuguaugguucguaccaaguauaaaagcagggaacgacauugcuaacugccuacgcaaaaacggaaagaaaguuauacaacucucgcggaaaacguuugauacugaauaucagaaaacaaaguuaaaugacugggauuuuguaguuacaaccgacauaucagaaaugggggcgaauuucaaagcugacaggguaauagacccaagacguuguuugaaaccuguaauucucacagacggaccggaaagaguuauucuagcuggcccuaugccaguuacugccgcaagugcugcacaacgacgcggcagaguuggaagaaauccgcaaaaagagaaugaccaauacauauucacugggcaaccuuuaaauaacgacgaagaccaugcacacuggacugaagcuaagauguugcucgacaauaucaauaccccugaggguaucauacccgcauuauuugagccggaaagagagaaaucagcugcaauagacggugaauaccgccucaagggugagucacgaaagaccuucguagaauuaaugagacgaggcgauuuaccaguauggcuggcacauaaagucgccucagaagggauaaaauauacagaccgcaaauggugcuucgacggccaaagaaauaaucaaauucuugaagaaaacauggauguagagauuuggacaaaagaaggcgagaagaagaaauuacgaccaagguggcuagaugcaagaaccuacagugaccccuuggcauuaaaagaauuuaaagauuuugcggcgggucgaaaaagcaucgcuuuggauuugguuacagagauuggaagaguaccaagccaucuagcacauagaaccagaaaugcacuagauaacuuagucaugcugcauacaucagaacauggcggcagagcauaucgacaugcuguugaggagcuacccgaaacaauggaaacauuauuacuauugggucuuaugauacuguuaacaggaggagcuaugcuuuuucucaucucggggaaaggaauagggaaaacuuccauaggucugauauguguaauagcgaguucgggaauguuguggauggccgaaauacccuuacaguggauagcaagugcgauagucuuggaauuuuucaugaugguucucuugaucccagaacccgaaaagcaacgcacgccccaggauaaccagcuggcauacguaguuaucggcauccucacacuagcagcaaucauagcagcgaacgaaaugggccuuuuagaaacaacuaaacgugacuuaggaaugagcaaagaaccagguguaguuaguccaacauccuauuuggacguagauuuacacccagccucagcauggacuuuauacgcaguggcaacaaccgucaucaccccaaugcugaggcauacuauugagaauagcacugcgaacgugucacuugcagcaauagcgaaccaagccgucguacuaauggggcuagacaagggauggccaauaucaaaaauggauuuaggugugccccugcuugcuuuagguuguuauucacaaguuaacccucuaacacuaacugcagcgguacugcugcugauuacacacuaugcuauuauagggccuggacuccaggcuaaagcaacacgugaagcgcaaaagcgcaccgcugcgggaauaaugaaaaacccuacaguugacggcaucaugacgauagaccuugaucccguuauauacgacucaaaauuugagaaacaacuaggacaaguuauguuauuaguucuaugcgccguacaauuauuacuaaugagaaccucuugggcuuuaugcgaggcccucacgcuagcuacaggacccauuacuacauugugggaagguucgccgggaaaauucuggaacaccaccaucgcgguaucaauggcaaauauuuuucguggguccuaucuagcgggagcaggucuagcauuuucgauaaugaaaucaguaggcaccgggaaaagaggaacggguagccagggugagacuuuaggagaaaaauggaaaaagaaacuuaaccaacuaucacgcaaagaauuugacuuauauaaaaagagcggaauaacagaaguggauagaacagaagcgaaagagggauuaaaaaggggcgaaauaacccaucaugcuguuagcagagguucggccaagcuacagugguuuguugaacguaauaugguaauuccagaaggaagaguuauagaucugggaugugguagaggcgggugguccuauuacugugccgguuugaagaagguaacugaagugagaggauauacuaaaggugguccagggcaugaagaaccuguaccaaugucuacauacgguuggaauauaguaaaguugauguccgguaaagacguauuuuaucugcccccagagaagugcgauacccuucucugugacauuggcgaaucgucgccaaguccuacgguggaagaaucaaggacaauaaggguacuaaaaaugguagaaccuuggcucaaaaacaaucaauuuuguaucaaaguucuaaaccccuacaugccaaccgugauagaacauuuagaacgccuacagagaaaacauggaggaauguuagugaggaacccuuuauccagaaauucaacucacgaaauguacuggauauccaauggcacagguaacauaguugcaaguguaaauaugguaagucgucuauuauugaauagauuuacaaugacccaccgucgaccuacaauugaaaaggacguggauuuaggggcagguaccagacauguuaaugcugaaccggaaacuccuaacauggaugucaucggcgaaagaauuaaaagaaucaaagaagaacacaauucaaccuggcacuaugaugaugagaaccccuacaagacaugggcauaccauggauccuaugaaguuaaggccacggguuccgcaagcucgaugauuaacgggguugucaaauuguuaacgaaaccaugggaugucguuccuaugguaacacaaauggcaaugacagacacuacaccauuugggcaacaaaggguauuuaaagaaaaagucgauacgagaacgccucguaguaugccagguacgagacgaguuauggguauaaccgccgaaugguuauggcgaacucugggccgcaauaagaagccuagacuuuguacacgagaagaguucacaaagaaaguaagaacuaaugccgcaaugggggcgguuuucacagaagaaaaucagugggacagugcuaaagcagcggucgaagaugaagauuucuggaaacucguagaccgagaacgagaacuacacaaguuaggaaaauguggaaguugcgucuauaauaugaugggcaaaagagagaagaaacucggagaguucgggaaagcaaaggggucaagagcaauuugguacauguggcuaggagccagguacuuagaguucgaggcuuuaggguuucuaaacgaggaucauugguuuucuagggaaaauuccuauagcgguguggagggagaaggguugcauaaacuaggauauauacuacgagacauaucuaaaauuccaggaggagcgauguacgcagacgauacagcaggaugggauacacgaaucaccgaagaugaucuucacaaugaagagaaaauuacucagcaaauggacccugaacauagacaauuggcuaacgcgauauucaaacuaacauaccaaaacaaaguaguaaaaguucaaagaccaaccccgacagggacuguaauggacauuauuaguagaaaagaucagagaggcucaggucaggucgguacauauggccuuaacacauucacgaauauggaagcccaacucauaagacaaauggagggagagggugucuuaucaaaagcugaucucgaaaacccccaucuaccagagaagaaaauaacgcaauggcuagaaacaaaagguguagaaagacucaaacgaauggcuauuaguggggacgacuguguuguaaagcccauagacgauagauuugcaaaugcgcuacuagcguuaaaugacaugggcaaagucagaaaagauauaccacaauggcaaccuucaaaaggguggcacgacuggcaacaaguuccauuuugcagccaucauuuccacgaauuaauuaugaaggacggaagaaaauuaguaguaccgugcagaccucaggaugaguuaauaggacgugcgaggauaucgcaaggagccggguggagccuuagagaaacagcauguuuaggcaaggcguaugcacaaauguggucauuaauguauuuucaccgucgggaucuucgacucgcgaguaacgcgauauguagugcggugccgguucauuggguaccaacaaguagaacuacguggagcauacaugcucaucaucaauggaugaccacagaggacaugcucacaguauggaauaggguguggauugaggauaacccuuggauggaagauaaaacuccugugacaacaugggaaaaugugccguacuuggggaaaagggaagaccagugguguggaucguuaauuggccuuacaucacgugccacaugggcacaaaacauaccaacagcgauucagcaaguaaggucacuaauuggcaaugaagaguuccuugauuauaugcccucaaugaaaagguuucguaaagaagaggaaagcgaaggagcuaucugguag

SEQ ID NO: 23006 - RNA, 9873 nt, Artificial Sequence
  derived and/or modified CDS sequence (opt6) from DENV-3__JX669496__SS-prME
accaguuuauguuuaaugaugauauuaccagcggcauuagcuuuccaccuaacaucuagagauggugaaccaagaaugauaguggggaaaaacgaaagaggaaaaucccugcuauucaaaacugcaucaggaacaaacauguguacacuaaucgcaauggauuuaggggaaaugugugaugauaccguuacauacaaauguccgcauaucacugaaguagaaccggaagauaucgacugcugguguaaccuaacauccacuugggugacguacggcacuugcaaucaggcuggagagcgucgucgggauaagagauccguggcauuagcuccacacgugggaaugggacuggacacaaggacccaaaccuggaugagugcugaaggagccuggcgacagguggaaaaaguagaaaccugggcuuuacgucacccaggcuuuacaauauuagcauuauuucuagcacauuacauuggaaccucacuaacacaaaaaguagugauuuuuauuuuguugauguuaguuaccccuuccaugaccaugcgaugcguaggagugggaaaccgagacuuuguagagggucuaucaggcgcaacuuggguggacgugguauuggaacauggagguugugugacaacgauggcuaaaaacaaaccuaccuuggacaucgaauugcagaaaacagaggcuacgcaauuagccacacuaaggaaacuauguaucgaggguaaaauaacuaacauaaccacagacucgagaugucccacacaaggagaagcgguauugccugaggaacaagaucaaaauuacgucugcaaacauacguacguagauagaggauggggaaacggaugcggacuauuugguaaaggaaguuuaguaacaugcgcaaaauuucaaugucuagaaccuauagaaggaaaagucguacaauaugaaaaucugaaauauacugugauuauuacuguccauacuggugaccaacaucaaguagguaaugagacgcaagggguuacggcggaaauaacaccccaagcaucaacaacggaagcgaucuuaccagaauacggaacacucggucucgaguguucuccgcgaacgggauuagauuucaacgagaugauacuacuaacaaugaaaaauaaagcauggauggugcacagacaaugguucuuugauuuaccacuaccauggacgaguggggccacgacagaaacuccaacuuggaaccgaaaagaacuucucguuaccuuuaaaaaugcgcaugcgaagaaacaagaaguaguuguuuuaggaucccaggaaggugcuaugcacacggcacuuacaggugcuacggaaauacaaaauucuggugguaccucuauauucgcgggucaucuaaaaugcagauugaaaauggauaaguuggaacuaaaagggaugaguuacgcgaugugcgcaaauacauucguccugaagaaagaaguaucagagacacaacacggaacaauucugaucaaaguugaauaucguggugaagaugcuccaugcaaaauaccuuucaguacagaggacggccaaggaaaagcucauaauggacgucuaaucacugcaaacccaguuguuacaaagaaagaagaaccuguaaauauagaggcggaaccuccguuuggagaaaguaauauagucaucggaauuggugauaaugcauuaaagauaaauugguacaagaaagggucgucaauuggaaaaauguuugaggcaacagcccguggugcacgaagaauggcaauucucggggauacugcuugggauuucggcucagucggugggguauuaaacagcuuaggaaaaaugguacaucaaauuuuuggauccgcauacacagcuuuauucucaggaguuucuuggguuaugaaaauuggaauuggaguguuauuaaccuggauaggacucaauagcaaaaauacgagcauguccuuuaguuguauagcaauuggcauuauaacguuauaucugggagcaguuguucaagcugacauggggugcgucauaaauuggaagggaaaagagcuaaaauguggaucgggaauuuucguaacgaaugaaguacauacuuggacggaacaauacaaguuucaagcggauaguccuaaaagacucgcuacugccauugccggugcgugggaaaacgguguaugugggauuagaaguacaacaaggauggaaaauuuauuauggaaacaaauagcuaaugaauuaaacuauauuuugugggaaaauaauauuaaacuaacgguaguaguaggggacauaauaggaguucuugaacaaggaaagaggacgcuaacaccccaaccaauggaguuaaaauauucauggaagaccuggggaaaagcuaaaauugucacagcugaaacacaaaauuccucuuucauaaucgacggcccaaacacuccugaaugcccgucugcaucacgagcauggaacgucugggagguagaggauuauggcuuugggguauuuacgaccaauaucugguugaaacuaagagagguauauacucaacuuugugaccaccgcuuaaugucagcggcggucaaagaugaaagagcaguccaugcugauaugggcuacuggauugagucucaaaagaauggcagcuggaaauuagaaaaagcgucacuuauugaaguaaaaacuuguacauggccuaaaagccacacuuuauggucaaacgguguccuugaaucagauaugauaaucccaaaaucgcuagcaggacccauuagccagcacaaccaccgucccgguuaccauacccaaacagccggaccauggcauuuggguaaacucgagcuagauuuuaauuauugcgaggguacgacugucguaauuacugagaauugcggaacuagagguccgagucuacgaacuaccacagucagcggaaaauuaauacaugaaugguguuguagaaguuguacuuuacccccucuacgcuauaugggcgaggauggguguugguauggaauggagauacgcccuauaucagaaaaagaagagaacauggugaaaucuuuaguuucagcagguucuggaaaaguugacaacuuuacgauggggguucuuugucuagcaauacuauuugaagaagugaugcgggguaaguucggcaagaagcauaugauagcgggcgucuuauuuacguuuguacuccuguuaaguggacaaauaacuuggagagauauggcccauacacuaauaaugauaggaucgaacgccucggaucgaaugggcaugggcgucacuuaccuagcgcuaauagcuacuuuuaaaauucaaccuuuucuugcgcuaggguucuuuuuacgcaaacuaacaaguagggagaaucuauuguugggagucggucucgcaauggcuacaacccuccaauuaccugaagauauagaacagauggcuaacggaaucgcguuagguuuaauggcauuaaaauugauuacgcaauucgaaacuuaucaacuguggacugcauuaaucucacugacauguuccaauacaauguuuacacuaaccguagccuggagaacggcuacccuuauucuagcuggaguaucauuauuacccguaugccaaagcucgucaaugcgcaaaaccgauuggcugccgauggcaguggccgcaauggguguaccuccacugcccuuauucauauuuucgcuaaaagacacguugaaaaggagaucguggccucuuaacgaaggaguuauggcugucggccuugucucuauucuagcgaguaguuuacuaaggaacgacguaccuauggcuggaccacugguagcaggaggauuacuaauagcauguuauguuauuacaggaacaucugcugaucuaaccguugaaaaagcagcugacauuacaugggaagaggaagccgaacaaacaggggugucacauaauuugaugauaacaguggaugaugauggaaccaugcgcauaaaagaugacgaaacugagaacaucuugacuguccuucugaaaacagcauuguuaauaguaagcggcguuuuuccguacucaaucccagcaacgcuccuaguauggcauacauggcagaaacaaacgcaacgaaguggcguacuaugggaugucccuucaccuccagaaacgcaaaaagcagaacuggaagaaggcguauacagaaucaagcaacaagggaucuucgguaaaacccaagucgggguaggaguucaaaaagaaggggucuuucauacgauguggcaugucacacguggagcugugcuaacguauaaugggaagcggcuugaaccaaauugggccucuguuaagaaagauuuaauaaguuauggaggaggauggagacugagugcccaguggcagaaaggagaagaaguacaaguuauagcaguagaaccugggaagaauccuaaaaacuuucaaaccaugccaggcacauuucaaacaacuacaggagagauaggcgcaauagcucuggauuucaaaccuggaacaucuggcagcccaaucauuaaucgugagggaaaagucguaggcuuauacgguaacgguguaguuacaaagaauggaggcuauguaucgggaauagcucaaacuaacgcagaaccugaugggccuacaccagaacuugaagaggaaauguucaagaaacguaacuuaacuauuauggauuugcauccagguagcggaaaaacaaggaaauaucuaccggcaauaguaagggaagccauaaagcgucguuuacguacacuaauucuagcuccuacacgcguaguagcagcagagauggaagaagcacuaaagggguugcccauccgauaucaaaccaccgcuacuaaauccgaacacaccggcagagaaauaguagauuuaaugugucacgcaacauuuaccaugcguuuauuauccccaguacgagucccuaauuauaaucucaucauuauggaugaagcacauuuuacggauccagcgucaauugccgcgaggggauauauuaguacacgaguagguaugggcgaagcagcagcaauauucaugacugcaacuccgccaggaacagcugacgcguucccgcaaaguaaugcuccgauccaagaugaagagagagacauuccugagcggucauggaacaguggcaaugaauggauaacagacuuugccggcaaaacuguaugguuugugccgagcauaaaagcuggcaaugauauagccaacugccuccggaagaaugguaagaaaguaauccaauugucaagaaagacauucgacacagaguaucagaaaaccaaacuuaaugauugggacuucguggucaccacugauauuucggaaaugggcgcuaauuuuaaggcagauagaguaauagacccaagacgaugcuuaaaaccuguuauacuuacggacgguccggaaagaguaauuuuggcggguccaaugccaguuacggcagcgucagcugcgcagagaagaggacggguaggaagaaacccacaaaaagaaaaugaucaguauauauuuacaggccaaccacuaaacaaugaugaggaucacgcacacuggacugaagcaaaaauguuacucgacaauauuaauacuccagaagguauuauaccagcauuguuugaaccagaaagagaaaagucggccgcuauagauggagaguaucgacuaaaaggugaaucuagaaagacauuuguugaacuaaugagaaggggagacuuaccaguguggcucgcucacaaaguugcaucggaaggaauaaaguauacagaucguaaaugguguuuugauggucaacgcaauaaucaaauauuagaagagaauauggauguugaaaucuggaccaaagagggagagaaaaagaaauuaagaccuagauggcuggacgcaagaacuuauagugacccuuuggcauuaaaagaguucaaagauuuugccgcgggacgaaaguccaucgcgcuugaccugguuacagaaaucggacgaguuccaagucacuuagcccaccgaacgaggaaugcucuagauaacuugguaauguuacacacuucggaacaugggggcagagcauaucggcaugccguugaagaacuccccgaaaccauggagacacuacuacuacuugggcuuaugauuuuacuaacuggaggugcaauguuauuuuugauuaguggaaaaggaauugggaaaacgagcauaggcuuaauaugugucauugcaucuucaggaauguuauggauggcugaaaucccacuacaauggaucgcaucagcuaucguucuugaguuuuucaugaugguauuauugaucccggaaccggaaaaacagcguacgccacaggacaaucaauuggcauauguuguuauaggaaucuuaacuuuagcagcaauuauugcugcaaacgaaaugggucuucuagagacaacaaaaagggaucuaggaaugaguaaggagcccggaguggugucuccgaccucguaucuugauguagaccuacacccagcaagugcauggacacuauacgcaguagcaacaacaguaauaacacccaugcuacggcacacaauagaaaauucaacugcgaaugucucuuuggcugccauugcgaaccaagccguaguacugaugggcuuagauaaagguuggcccauuucuaaaauggaucuuggcguacccuuacucgcacuuggcugcuauagucagguaaauccauuaaccuuaacggcagcgguccuacucuugauuacccacuaugcaaucauagguccaggacuucaggcuaaggcaacaagagaagcgcagaaacgaacagcagcgggcauuaugaaaaacccaacuguugauggcaucaugacuauagaccuugaucccgucaucuaugacucgaaauucgaaaagcagcuagggcagguuaugcuuuuaguacucugcgcagugcaacuccuacuaaugaggacaucaugggcacugugugaagcccuuacauuggccacaggcccaauuacgacucuaugggaaggaaguccgggaaaauucuggaauacaaccauagccgucuccauggcgaacauauuucgaggaucuuauuuggcuggagcagguuuagcguucuccauuaugaaaagcguaggcaccggaaagagggggacagggucgcagggugaaacacucggagaaaaauggaagaagaaacuuaaucaauuaucgagaaaagaguucgacuuauauaagaaaaguggcaucacagaagucgaccgcacugaagcaaaagaagguuuaaaacggggagagauuacucaucaugccguuuccagaggcagcgccaaauuacagugguuuguagaaagaaacaugguaauacccgaaggccgaguuauugaccuuggguguggccggggagguugguccuauuauugugcaggccuaaagaaagugacagaaguaagaggauauaccaagggaggaccaggccaugaagaaccagugccuaugucaacguaugguuggaacauugugaaacuaaugagugguaaagauguauuuuaccucccaccagaaaaaugugauacccuacuaugcgauauuggcgaaucaaguccuaguccaacaguagaagaaucuaggacuauaaggguauuaaaaaugguagagccuuggcuaaagaacaaucaauuuugcauaaaaguacuaaauccuuauaugccuacaguaauagaacaccucgaaagacuucagcgcaaacauggaggaaugcuaguccguaauccacuaaguaggaauagcacucaugaaauguauuggauaaguaaugggaccggaaacauuguugcaucuguaaauacaguaagcagacuucuguuaaaucgauuuacaaugacacaccgacguccaacuacugaaaaagauguugacuuaggagcugggacaagacauguuaaugcugagccagaaacaccaaacauggauguuauaggugaacgaaucaaaagaauuaaagaggaacauaacaguacauggcauuacgacgaugaaaaucccuauaagacuugggcguaccacggaaguuacgaaguaaaagccacagguagcgcaucaucuaugauaaacggagucguaaaauuauuaacuaaaccaugggauguuguaccgauggucacucaaauggcaaugacagacacaacaccauucggacaacaaaggguguucaaagaaaaaguagacacgagaaccccacgcaguaugccuggaacucgucgaguaaugggaaucaccgcugaaugguuauggagaacacuuggacggaauaagaaacccagauuauguacuagagaagaguuuacuaagaaggucaggacaaaugcggcaaugggugcgguuuucacagaagagaaucaaugggacucggcaaaagcagcaguugaagacgaagauuuuuggaaauuaguugauagggagagggaacuacacaaacuaggcaaaugcggcaguuguguuuauaacaugauggguaagcgcgagaagaaacuaggggaauuugggaaagcaaaaggaucuagagcgauuugguacaugugguugggagcccguuaccuagaguuugaagcucuugguuuccugaaugaagaucacugguucucucgagaaaauucauauuccggaguagagggagaagguuugcacaaauuagguuauauucuuagagacauaucuaaaaucccagggggcgcaauguacgcagacgauacggcuggaugggauacccgaauaacggaagaugaucuacacaacgaagagaaaauuacccaacaaauggauccagagcaucgucaacuagcuaaugcuaucuucaaacuaaccuaccaaaacaaagucguaaagguacaacguccuacuccaacgggaacgguuauggauaucauaucuaggaaagaccaacguggaaguggucaaguugguacuuacggucucaauaccuuuacaaauauggaagcacaguuaauaagacaaauggagggagaagguguauuaaguaaagcagauuuagaaaauccccacuuaccagagaagaaaaucacacaauggcuggaaacaaagggaguggaacgucugaagcguauggccauaagcggggaugauuguguugucaagccgauugaugauagguuugcaaacgcacuucuagcauugaaugacaugggcaaggucagaaaggauaucccucaguggcagccaucaaagggauggcaugacuggcaacaaguaccguuuugcagucaccauuuucaugaguuaauuaugaaagauggacggaagcuagucguuccguguagaccacaagaugaauugauugggagagcuagaauaucacaaggagcaggguggucucuaagagaaacggcuuguuuagguaaggcauaugcacaaaugugguccuuaauguacuuucauagaagggaucuuagacucgccucgaaugccauaugcucagccguaccuguacacugggugccgaccagcagaacaacauggucaauccaugcucaccaccaauggaugacaacagaagauaugcucacaguguggaauagaguauggauagaagacaacccguggauggaggacaagacccccguaacgacuugggaaaauguaccauaccuuggaaagcgagaagaccagugguguggcucucucaucggauugacaucgcgagcaacgugggcccagaauauaccgacggcuauacaacaaguccgaucuuugauaggaaaugaagaauuucuagacuauaugccaagcaugaaacguuuccggaaagaggaggaaucugaaggagcaauuugguaa

SEQ ID NO: 23007 - RNA, 9873 nt, Artificial Sequence
  derived and/or modified CDS sequence (opt6) from DENV-3__JX669490__SS-prME
acgagucucugcuugaugaugauacugccugcagcacuagcguuucauuuaacuucucgugauggcgaaccccgcaugauaguaggcaaaaacgaaagagguaaaucccugcucuuuaaaacugcgucugguauuaauaugugcacgcuaauagcaauggacuuaggugaaaugugugaugacacaguuacauauaaauguccacauauuacugaaguagaacccgaagauauugacugcugguguaauuuaacaaguacuugggugacauauggcacaugcaaccaagcgggggaacgaagacgggacaaacgaucaguugcauuagcaccacauguaggcaugggacuagauacacgaacccaaacauggaugucggcagaaggggcuuggagacaagucgaaaaaguggagaccugggcuuuaagacacccuggauuuaccauacuagcgcucuuucuggcgcacuauauuggaacaagucuaacacaaaaaguagugauauucauauuguuaauguuaguaaccccuucaaugacaaugagauguguuggcguaggaaauagagacuuuguagaaggacuuucuggcgcaacuugggucgauguaguauuagaacauggcggauguguuacuaccauggccaaaaauaaacccacucuugacauagaacuacagaaaacagaagcaacucaauuagcuacacuacgaaaacucugcauagaagggaaaauuacuaauauuacaaccgauuccagaugcccaacacaaggagaagcaguauuaccggaggagcaagaccaaaacuauguauguaaacauacguauguggaucgaggauggggaaauggaugcggccuauucgggaaagguucauuaguaacaugcgcaaaauuucaaugccuagagccgaucgaaggaaaaguuguccaauacgaaaaccuaaaauauacuguaauaaucacaguucacacaggagaccagcaucaggucggaaacgaaacccagggcguaacugcagaaauaacgccacaggcaucaacgaccgaggcgauuuuaccagaauacgggacgcuuggacuagaaugcagccccaggacuggacucgacuucaaugaaaugaucuugcucacaaugaaaaacaaagcauggaugguucaucgccaaugguucuucgaucugccauuaccauggaccucgggagcaacaacagagacuccgacguggaaccgaaaagaacucuuaguaacuuuuaaaaacgcacacgccaagaaacaagaaguuguaguccucggaucacaggagggagcaaugcacaccgcuuuaacgggagcgaccgaaauccagaacagugguggcacaaguauuuuugcaggacaucuaaaaugcagguugaaaauggacaaauuagaacucaaaggaauguccuaugcuaugugcacaaauacauuugugcucaagaaagaagucagugaaacccaacacgguacuauccugauaaaaguagaguaucggggagaagacgcuccauguaaaauaccauuuagcacugaagauggccaaggcaaagcucacaacggacggcuaauuaccgcaaauccaguaguaaccaagaaagaagaacccguaaauauugaagcggaacccccauucggugagaguaauauaguaauagggauaggagacaaugcguugaaaauuaauugguauaagaaaggaucuucuaucgggaaaauguuugaggcaacugcgagaggagcgagacguauggccauccucggugacacugcaugggacuucggaucggugggaggaguccuuaauucauuagggaaaaugguacaucaaauauuuggaagugcauacacggcuuuauucucuggcgugagcuggguaaugaaaaucggcauaggaguacuuuugacguggaucggccuuaauucuaaaaacacuagcaugucauucucgugcauagcaauaggaauuauaacacuuuaucuaggagcaguaguucaagcagauaugggaugcguaauaaauuggaaagggaaggaauugaaaugugguucaggaauauuuguaacaaaugaaguacacacuuggacagaacaguauaaauuccaagcugauucccccaagcguuuagccacagcgaucgcaggagcuugggaaaacggaguaugugguauaagaaguacuacuagaauggaaaacuuauuauggaagcagauugcuaacgaauuaaacuauauauuaugggaaaacaacauaaaacucacuguuguagucggagauaucauaggaguauuagaacaagguaaaagaacuuugacuccucaaccaauggaauuaaaguauuccuggaagaccuggggaaaagcaaaaaucguuacugcugaaacacaaaacagcucuuuuauuauagaugguccgaauacuccugaaugucccuccgcauccagagcguggaauguuugggaaguugaggauuacgguuucggcguauucaccacuaacaucugguugaaauuacgggaagucuacacucaacuuugugaucaucgcuugaugucagcagcgguaaaagaugaacgagcaguacaugcugauaugggcuauuggaucgaaucucagaaaaauggcagcuggaaacuugaaaaagcaucucuaauugaaguaaagacaugcacguggccgaaaagucauacccucuggucaaacggugugcuagagagugauaugauaauaccaaaaucucuagcagggccuauuagucaacauaaucacaggccagguuaucauacucaaacugcaggacccuggcaccuuggaaaacuggaacuugacuuuaacuauugugagggaacuacagugguaauuacagaaaacugugguacgcgaggaccuucacuuagaaccacgacaguaagcggaaaauugauucacgaaugguguuguagaucuugcacccuuccaccgcuccguuauaugggcgaagauggauguugguacggcauggaaauacgacccauuagugaaaaagaagaaaauaugguaaaaucuuuaguuuccgcugguucagguaaaguggauaauuucacuauggguguucucugccuagccauauuauucgaggaagucaugagagguaaguucgguaagaaacauaugauagcagggguauucuucacauuugucuuacuuuuaucaggucaaaucacguggcgagacauggcucacacuuuaauaaugauaggaagcaaugcgucagacagaaugggaaugggcgucacuuaucuagcucucauagcaacguuuaaaauccaaccuuuccucgcauuaggauucuuucuuagaaaauuaaccucacgcgaaaaucuauuacuaggaguagguuuagcaauggcgaccacgcuccaacucccagaggacauagaacaaauggcgaauggcauagcguuaggauuaauggcacuaaaacuuauaacucaauucgaaacuuaucaauuguggacugcuuuaauaucacucacaugcucuaacacaauguuuaccuuaacuguugcauggcgaacagcgaccuuaaucuuagccgguguuaguuuacuaccaguuugccagucuucaucuaugagaaaaacagacuggcuaccaauggcgguagcugcaauggguguaccaccuuugccauuauucauauucagcuugaaagacacuuugaaaagacgaaguuggccacuuaaugaaggagugauggcuguuggucuuguaucuauuuuagcuucaagccugcugcgaaacgauguuccuauggcagguccucuggucgcaggaggauuacuaaucgcaugcuauguuauuacuggaaccucagcugaucuaacuguagaaaaagcagcugauauuacaugggaagaggaagcugagcagacgggagucucacauaaucucaugauuacugucgaugaugacggaacuaugagaauaaaagaugaugaaacggagaacauuuugacaguacuccugaaaacagcuuuauuaauaguaagugggguuuuuccuuauaguauuccugcaacucuccuaguauggcauacuuggcagaaacaaacucaaaggagugguguauuaugggacgucccuucaccgccagaaacucaaaaggcagaauuagaagaaggagucuaucguauuaagcaacaggggaucuucggaaaaacccaagugggcguaggaguacaaaaagaaggaguguuccacacaauguggcacguuaccagaggggcaguauugaccuauaauggcaaacguuuagaaccaaacugggcuagugucaagaaagaccucaucagcuaugguggagguuggcgauuaucagcccaguggcaaaaaggcgaagaagugcaagucauugcaguagagcccggcaaaaaucccaagaauuuccaaaccaugccaggaacauuucaaacuacaacgggcgagauuggcgccauagcccuugacuuuaaaccaggaacaucuggaucaccaaucaucaacagggaaggaaagguaguagggcuauauggcaauggaguuguuaccaaaaacggaggauauguuucaggaaucgcacaaacaaacgcggaaccagacggaccuacacccgaacucgaggaggaaauguuuaaaaagcguaaccucacaauuauggacuuacauccugguaguggaaaaaccagaaaauauuuacccgcaauaguaagagaggccaucaaacgcagacuacguacacuaauucuggcacccacaaggguaguugcugcugagauggaagaagccuuaaaaggucugccuauaagauaccaaaccacagcuaccaaaucugaacacaccggacgagaaauaguagaccucaugugucacgcuaccuucacuaugagauuacugucaccaguaagagugccaaauuacaauuugaucauaauggaugaggcacacuucacugauccggcgucaauagcagcacggggauauauuucaacacguguuggaaugggagaagcagcugcuauuuuuaugacugcaacucccccaggcacggcugaugcauuuccucaaaguaaugcaccaauacaggaugaagaaagagauauaccugaaagaucauggaacucugguaacgaauggaucacggacuucgcuggaaaaaccguaugguuuguacccucaauuaaagcaggaaaugauauagcgaauugcuuaaggaaaaauggaaagaaaguaauacaauugagcagaaaaacuuuugauacggaguaccagaaaacuaaacugaaugauugggauuuuguaguaacgacagacaucucagaaaugggggcgaauuucaaagcugaucgcguaauagauccuagacgaugccuuaaaccagucauucugacggacggaccggaacgaguaauacuagcaggacccaugccaguuaccgccgcuagugcggcucaaagacguggaagaguagguagaaacccucagaaagaaaaugaucaauacauuuucacagggcaaccacuaaacaaugacgaagaucaugcucauuggacagaagcaaaaaugcuucuugauaauauaaauaccccugaagguauuauuccugcccucuuugaaccagagcgugaaaaaucugcggcgauagauggcgaauacagacuaaaaggagaaucccguaaaacguucguagaacuaaugcggaggggagauuuaccuguuugguuggcgcacaaggucgcauccgaaggaaucaaauacacugacagaaaauggugcuuugacggccaaagaaacaaccaaauauuagaagagaacauggacguagaaauauggacaaaagagggugagaaaaagaaacugaggccacgauggcuagaugccaggacauauagugacccucuagccuugaaagaauuuaaagauuuugcugcaggcaggaagucaauagcauuggaccuagucacugagauaggucgagugccuagucaccuggcacauagaacccguaacgcacuugauaaccuaguuauguuacauacaagugaacaugguggccgugcguaucgucacgcgguggaagaauuaccagaaaccauggaaaccuuacuauuacuagguuugaugauacuucuaacaggaggagcaauguuauuuuuaauaagugguaaagguauaggaaagacaucgauaggucuuaucugcgugauugcuaguaguggaauguuauggauggcggaaauuccuuuacaauggauagccagugcaauaguucucgaguucuuuaugaugguccuuuuaauuccugaaccugaaaaacaaagaacaccccaagauaaucaauuagcguacguuguuauagguauucucacauuagcagccauaauagccgcaaaugaaaugggauuauuagagacgacaaaacgcgauuuaggaaugucgaaggaaccaggugucgucagcccuacaucauaccuagaugucgaccugcauccagcgucugcauggacuuuauaugcuguugcuacuacaguaauuacuccaaugcuaaggcacaccauagaaaauuccacugcaaacguaucauuagcugcaauugcaaaccaggccguagugcuuaugggauuggauaagggauggccgauaucgaagauggacuuaggggugccauugcuugcccucggcuguuacagucaaguuaaccccuugacccuaacugcagcgguguuguugcuuauaacacacuacgcaauuauuggacccggacuacaagccaaggcgacaagagaggcacaaaagcgaacugcugcagggauaaugaaaaauccaaccgucgauggcauuaugacaaucgaucuugacccaguaaucuacgauaguaaauucgaaaagcaauuaggacagguuaugcuacugguccuaugugcaguccaauuacuacuaaugagaacgucuugggcccuaugugaagcauuaacucuagcaaccggucccauuacaacccucugggaaggaagcccaggaaaauuuuggaauacgaccauagcgguuucaauggcgaacauuuuuagagguuccuaccuagcuggagcaggguuggcuuuuucaauaaugaaauccguagguacuggcaaacguggaacuggaucucaaggagaaaccuugggcgaaaaauggaagaagaaacuuaaccaacuaagucgaaaagaauuugaccuguauaaaaagucaggaaucaccgaagucgaucggacugaggcaaaagagggccuaaaacgcggcgagauuacucaccacgcaguaucgcgaggaucugccaaguuacaaugguucguagaacgaaauauggucauaccagaagggcgaguuauagaccuaggcugcgggcguggcggauggucauacuauugugccggacuaaagaaaguaaccgaaguaagagguuauacuaaagggggaccugggcacgaagaaccaguuccuaugaguaccuacggauggaacauagugaaauuaaugagugggaaggaugucuuuuacuugccuccggaaaagugugauacucugcugugcgacaucggugaguccagccccucuccaacuguugaagaaagcagaaccauucgcguccucaaaaugguagaacccuggcugaaaaacaaccaauuuuguauuaaaguauuaaacccauauaugccaacugucaucgaacaucuugaaagguuacaacgaaaacauggagguaugcuagucagaaacccauuaaguagaaacucaacucaugagauguauuggaucaguaauggaacgggaaacaucguagcgucagucaauaugguuagucgacugcuuuugaauagauuuacgaugacucaucgucggccgacaaucgaaaaagacguagaucuuggagcugggacuagacacguaaaugcagaaccggaaacgccuaacauggauguaaucggcgagagaauaaaaagaauaaaggaagaacauaacaguacuuggcacuaugaugacgaaaaucccuauaaaacaugggcauaucaugguucauaugaaguaaaagccaccggaucggcgucaucaaugaucaauggcguuguaaaguuacucacgaaaccgugggacgucguaccaaugguaacucaaauggcgaugacugauacuacgccauucggacaacaaagggucuucaaagaaaagguugacacuagaaccccgagaaguaugcccgggacacgaagaguaauggguauuacggcggaauggcucuggcgcacucugggcagaaacaagaaaccacgucuaugcacacgugaagaauuuacgaagaaggugcggacaaacgccgcuaugggagcgguguuuacagaagaaaaucaaugggauucagcaaaggcagcuguugaggaugaggacuucuggaaacucgucgaccgcgagagagaauuacauaaacuggguaaaugcggaagcugcguguauaacaugauggguaaacgggagaagaaacuaggagaguuuggaaaagcaaaggggucaagagcaauaugguauauguggcuaggcgcgagauaccuggaguucgaagcucuuggauuccuaaacgaggaucacugguuuaguagagaaaauucuuacucaggaguggagggcgagggccuucacaagcuggguuauauacuaagggauauaucuaagauaccugguggggcuauguaugcagaugauacagcagggugggauacucgcaucacagaagacgaucuacauaaugaagagaaaauuacucaacaaauggacccggaacauaggcaauuggcaaacgcaauauucaaacugaccuaccaaaacaaagugguaaaagugcaacgaccgacuccaacugguaccguuauggauauaauuagucguaaggaccaaagaggauccgggcaaguagguacauauggccuaaauacauucacaaauauggaagcucaacuaauaaggcagauggaaggggaagguguuuuaucaaaggccgaucuugaaaauccucacuuaccugaaaagaagauaacccagugguuggaaacgaaagggguugagcgacugaaacgaauggccauaaguggugacgauuguguagucaagccuauagaugaucguuucgcuaaugccuuauuagcauuaaacgacaugggaaaaguaagaaaagacaucccacaauggcaaccuuccaaagguuggcaugauuggcaacaagugccguuuuguagucaucauuuccaugaauugaucaugaaagauggaagaaaacucguagugccuugcagaccucaagacgaacuaauugggagggcccggauaagucaaggcgcaggcuggagucuuagagaaacugccugcuuaggaaaagcauaugcccagauguggagucucauguacuuccauagacgggauuugagauuagcaagcaaugcuaucugcucagcugucccagugcauuggguaccaacgagcaggaccacauggucaauccaugcgcaucaccaguggaugacuacagaagacaugcuuacaguguggaauagaguauggauagaggacaaucccuggauggaagacaaaacgcccgucaccacgugggaaaauguuccauaccuuggaaagagggaagaccaauggugcggaucacuaauuggacugacaucccgagcaacuugggcccagaauauaccaacggcaauucaacaaguucgaucacugauagggaaugaagaguuccuugacuauaugccuucaaugaagagguuucggaaagaggaagaauccgaaggagcuauaugguaa

SEQ ID NO: 23008 - RNA, 9873 nt, Artificial Sequence
  derived and/or modified CDS sequence (opt6) from DENV-3__JN406515__SS-prME
acgucccucugcuuaaugaugaugcuaccugcaacccuggcauuucauuuaacuucuagagacggugaacccagaaugauuguugggaaaaaugaacgaggaaaaagucuucuauucaaaacugcuagcggaauaaauaugugcacacuuauagcaauggauuuaggagaaaugugugacgacacuguuacauauaaaugcccucuaauaacagaaguagaaccggaagauauagauugcugguguaaucucaccaguacuuggguaaccuaugguaccugcaaccaagcaggagaacaccggagagacaaaaggucaguugcgcucgcaccucacguaggcaugggacuggacaccagggcucaaacauggaugucagcagaaggcgcauggcgacaaguagaaaaaguugaaacuugggccuucagacauccuggauucacaauucuagccuuauuccuugcacauuacauuggcacaucgcuuacgcaaaaaguaguaauauucauauuacucauguuagugacacccucuaugacaaugaggugugugggaguaggcaaucgagauuucguugaaggauuaucuggcgcgacuuggguggacguuguccuagaacaugggggaugcguuacaacaauggccaaaaauaaaccuacauuagauauagaauuacagaaaacugaagcaacgcaauuggcgacucuacguaaauuauguauagaaggaaaaaucacaaaugucacaacagacucgagauguccuacacaaggagaagccauacugccagaagaacaagaucaaaauuacgugugcaaacauacauacguagacagaggaugggguaacgguugcggacuuuuuggcaaaggaucuuuggucaccugugcgaaauuucaaugccuugaguuaauagaggguaaaguaguacaacaugaaaauuuaaaauauacuguaauuauaacgguucacacuggagaccaacaucaaguuggcaaugaaacacaaggagucacugcugaaauuaccccucaagcgagcacagucgaagcaauucuuccugaauacgggacacuaggacuagaauguucuccacguacgggacuugauuuuaaugaaaugauacugcuaacuaugaaaaauaaggcuuggaugguacaucgucaaugguucuuugaucuuccacuuccauggacuucaggggccacgaccgagacucccaccuggaacaagaaagaauuacucguuacuuuuaaaaacgcccaugccaagaaacaagaaguagucguucuagguucccaagaaggggcgaugcauacugcucuuacaggcgcuacggaaauacaaacuagcgggggaaccucgauuuuugcagggcauuugaaaugcagauuaaaaauggauaaacuugaacuuaaaggaaugaguuaugcuaugugcucaaacgccuuuguacuaaagaaagaaguaucagagacccaacauggaacgaucuugauaaaaguugaauacaaaggagaggaugcuccauguaaaaucccauuuagcacagaggaugaacaaggaaaagcacauaaugguagauuaauaacagcaaauccaguuguuacgaagaaagaagaaccaguaaauauagaagccgaaccuccuuucggggagucaaauauuauuauuggaaucggugauaaagcucucaaaauaaauugguauaagaaagggucuucaaucgguaaaauguuugaagcgacagcacguggugcucggcguauggccauccuaggugacaccgccugggacuuuggaucaguuggcggagucuuaaacucacucgggaaaaugguacaucaaauauuugguuccgcuuauacugcucuauuuucaggagucucauggaucaugaaaauagggauaggaguuuuacugacauggauagggcuuaacucuaaaaauacuucgaugucguucucuuguauaguaauaggaauaauaacuuuauauuugggugcaguugugcaagcugauauggguugcguaauaaacuggaaagguaaagagcugaaguguggaucaggaaucuuuguuacaaaugaaguucauacguggacagaacaguauaaauuccaagccgauaguccaaagcggcuugcaaccgcuauugcaggagcaugggaaaauggagugugcggaaucagaagcacuacaagaauggaaaaccuucuuuggaagcagaucgcuaaugaacuaaacuacauacuuugggaaaacaacauaaagcucacagucguagucggagauauuaucggcguacucgaacaaggcaagagaacguuaacuccucaaccaauggaauuaaaauauaguuggaaaacgugggguaaggcuaaaauuguaacugcugagacgcaaaauaguucuuuuauaauugacggaccaaacacucccgaauguccuaacgcaucuagagcauggaauguuugggagguagaagacuacggcuuuggaguuuuuacaacaaauaucugguuaaaguuacgagaaauguauacucaauugugugaccacagacuuaugucagcggcaguaaaagaugaaagagcuguucacgcugauaugggauacuggaucgaaucucagaaaaauggcaguuggaaacuugaaaaagcuagcuugauagagguuaaaaccuguacauggccaaaaucacauacucuauggaguaaugguguucuggagucggacaugauaauaccaaaauccuuagcugggccaauaucacaacauaauuauagaccaggguaucacacccagacagcaggaccauggcacuugggaaaauuagaauuggacuuuaauuauugugaagggaccacaguggugauuacugaaaauugugggacaagaggaccaaguuugagaacgacgacagugucugguaagcucauccacgaaugguguugccguucuugcacauuaccaccauuacguuauaugggugaagauggauguugguaugggauggaaauuagaccaauaaacgaaaaagaggaaaacaugguaaagucccuaguaucugcaggcucgggcaaagucgauaacuuuacuaugggaguccucugcuuagcuauacuauucgaagaaguaaugagaggaaaauuuggcaagaaacacaugaucgccgguguuuuguuuacguucguucuccuauuaucuggacagauuacauggagagacauggcucgaacacuuaucaugaucggaucuaacgcaucugaccgaaugggcaugggcguuacuuaucuggcccuuauugcuacauuuaaaauucaaccuuuucuagcuuugggcuucuuucuucggaaauuaacgagcagggaaaacuuauuacuuggaguugguuuagccauggcaacaacucuacaauuacccgaagauguggagcagauggcaaauggcauugcauuaggauugauggcucuaaaacuuauaacccaauucgaaacuuaccaguuauggacugcucuaguuucacucauguguaguaacacuauuuucacacuuacagucgcuuggcguacggcaacacuaaucuuagcugguaucucuuuauucccagucugucaauccaguucaaugagaaaaacugauugguugcccaugacaguugcagcuauggggguaccaccauuaccuuuauuuauauuuaguuuaaaagauacacuuaaacgaagaucauggccccuuaacgaaggugucauggcuguaggacuuguuuccauauuggccucaucuuuauugcgcaaugauguaccuauggcugguccgcuaguugccggugggcuacucauagcauguuauguaauaacaggcacaucagcagaccuaacuguagaaaaggcggcagauguuacuugggaagaagaggcugaacaaacggguguaucgcauaaccuaaugauuacggucgacgacgaugguacaaugcgaaucaaagaugaugagacggagaauauucugacaguacuacuaaagaccgcauuacuaauaguuucgggaauuuuccccuauuccauacccgcaaccuuauuagucuggcacacguggcaaaaacagacccaacguucaggaguucugugggaugugccaaguccuccugaaacgcaaaaagcagaauuagaagaagguguuuaccguauuaaacaacaagggauauuuggaaaaacucaagugggcguaggaguccaaaaggaaggaguauuucauacgauguggcaugucaccaggggagcagucuuaacauacaauggcaaaagguuggagccaaacugggcaagugucaagaaagacuuaauaucauacggaggcggauggagauuaucagcccaauggcagaaaggagaagaaguacagguaaucgcaguugaaccaggcaaaaauccgaaaaauuuucaaacaaugccgggaauauuucagacaacaacgggggaaaucggggccauugcauuagauuuuaaaccugguacaaguggaaguccaaucauaaaucgugaaggaaaggucgucggauuauacgggaauggagucguaacuaagaauggaggguauguaucuggaaucgcccaaacuaaugcugaaccagaugggccaaccccggaacuugaagaggaaauguuuaagaaaagaaaucuaacaaugauggacuugcauccuggaagugggaaaacacguaaauaucuacccgcuauaguacgagaagcaaucaaacgaagacugagaacucuaaucuuagccccgacaagaguuguagccgcugagauggaagaggcuuuaaaagggcuuccuauacguuaucagacuaccgcuaccaaguccgaacauacagggaaagagauuguagaccuaaugugccacgccacauuuacaaugagguuguuaucgcccguaagagugccaaacuauaaucucauuauaauggaugaggcucacuuuacugauccggcaagcaucgcagcacgaggcuauauuagcacgagagugggcaugggggaagcagcugcuaucuuuaugacagcaacacccccuggaacugcugaugccuucccacaaagcaacgcuccgauacaggacgaggaaagggacauuccagagaggaguuggaacucagguaacgauuggaucacagacuuugcugggaaaaccguaugguuuguaccaaguauaaaagcaggcaaugauauagcaaauuguuugaggaaaaauggaaagaaaguaauccaauuaagcagaaaaacuuucgauacugaauaccagaaaacgaaacuaaaugauugggauuucguuguuacgacagauaucucugagaugggugcuaacuucaaggcggaccgugucauugacccgagaagaugucuaaagcccguuauacuuacagauggaccagaacguguaauacuugccgguccgaugccugucacaguagcaucugcagcccagagacgaggaaggguuggaagaaauccgcagaaagaaaacgaccaauauauauucacuggucaaccccuaaacaaugacgaagaucaugcccauuggaccgaagcgaaaauguuacuagacaauauuaauacuccugagggaaucauacccgcucucuucgaaccagaaagagagaaaagugccgcuauagacggggaauaccgcuuaaaaggugaaagcaggaaaacuuucguugaacuaaugcgucguggggacuuacccguuuggcuugcccacaaaguugccagugagggaauaaaguauacugacagaaagugguguuuugauggcgaacgcaauaaucaaauuuuagaagaaaauauggaugucgaaaucuggacuaaggaaggcgagaagaagaaauuaaggccuagauggcucgacgcucggacauauagcgauccgcuagcccuaaaggaauuuaaggauuuugcagcgggacgcaaaucaaucgcccuagaccuaguaacugaaaucgggagagugccgagucaccuagcccauaggacacggaacgcauuagauaaccuaguuauguuacauaccagcgagcacggggguagagcauaccgccaugcaguggaagaacuuccggagaccauggaaacccucuugcuacugggcuuaaugauccucuuaacugguggagcaaugcuuuuucuuaucagugguaagggaguaggaaaaacauccauaggauuaauaugugucgucgccucaucugguaugcuuuggauggcugacauuccuuugcaauggauagcaagugcgauuguauuagaguucuuuaugaugguacuacuaauuccggaaccugaaaaacagcgaacuccacaggacaaucaauuggcguauguggucaucggaauuuuaacauuggcugcaaucguggcagcuaaugaaaugggcuuauuggaaacaacaaaaagggauuuggguaugaguaaggaaccaggcguggugucaccgacgagcuaccuggauguggaucuccauccagcuucagcauggacauuauaugcaguagcaacaaccgugauaacaccaauguuacgacauaccauagagaauaguacugcaaaugucagcuuggcagcuauagcuaaccaagcgguaguacugaugggauuagacaaaggauggcccaucuccaaaauggauuuaggcguaccuuuacuagcucuuggguguuauucucaaguuaacccacuuacguuaacagcggcuguuuugcuauuaguuacacauuacgcaauuauaggucccggguuacaagcaaaggcaacccgcgaagcccagaaaagaacggcggcggguauuaugaagaaccccacgguagaugguauaaugacuauagaucuugaccccguuauauacgauaguaaauuugagaaacaauugggucaaguuaugcuuuuaguguuaugugcuguacaacuucucuuaaugcgaacuucgugggcauuuugugaagcccuaacacuagcaacugguccaauaacgacacuaugggaggggagccccgguaaauucuggaauacaacuauagccgugucgauggcgaauauuuuccggggauccuauuuagcgggagcuggauuagcuuuuucaauuaugaaaucugucggaacaggaaagcgggggaccgguucucaaggugaaacucugggagaaaaauggaagaagaaauuaaaccaacuaucaaggaaagaguucgaucuauacaagaagucugguauaacugaaguagauaggacagaagcaaaggaaggacugaaacggggugaaauaacucaccacgcagucucuagagguagugcuaaguuacaaugguuuguugaacguaacauggugauucccgaaggucgagucaucgaucuagguuguggccgaggugguuggucuuacuacugugcuggucuaaagaaaguuacugaagugcgcggguacacaaaagguggaccuggacaugaagaacccguacccauguccacguaugguuggaacauaguuaaauugaugagcgguaaagauguauuuuaccuaccaccagagaaaugcgauacgcuccuaugcgauauaggugaaucuaguccgagcccgacaguagaagaaucaagaacaauucguguacuuaaaaugguagaaccgugguuaaagaauaaucaauuuuguauaaaaguacuaaauccauacaugccuacaguuaucgaacaccuggaacguuuacaaagaaaacacggaggaauguuaguuagaaauccucucagucgcaauucaacccacgaaauguauuggauaucuaacggaacuggcaacauaguaaguucagucaauaugguaucuagacuguuauuaaauagauucacaaugacuuauagacgcccgacuaucgaaaaggacguggacuuaggugcaggaacaagacacguuaacgccgaaccugaaacaccuaacauggacguuauuggugaaagaauaagacggaucaaagaagaacauucaucaacauggcacuaugaugaugaaaauccauauaaaacaugggccuaucauggguccuaugaaguaaaagcaacaggcucagcaucaucgaugaucaauggcguagucaaauuguuaaccaaacccugggacgucguacccacagugacucaaauggcaaugaccgacacaacaccauuuggacaacaaagaguauucaaagagaaaguagauacaagaaccccuaaacccaugccaggaacaagaaaagugauggagauaacugcagaauggcuguggcgaacauuaggacgaaauaaacguccaagacuuuguacgcgugaagaauuuacuaagaaagugcguacuaacgccgcaaugggggcagucuucacugaagaaaaucaaugggauagugcaagagcagcaguagaagaugaggaauuuuggaaacuuguagaucgcgaaagagaauuacacaaguuaggcaagugugguaguuguguauauaauaugaugggaaaacgugagaagaaacugggcgaauuuggaaaagcaaaaggaucacgcgcuauaugguauauguggcuuggugcaagauaucuggaauuugaggcacuuggauuuuuaaacgaggaccacugguuuucucgugaaaauucauacagcggagucgaaggugaaggcuuacacaaacuaggauauaucuugagagauauaucuaaaauaccaggaggagcgauguacgcggaugauaccgcgggaugggacacaaggauuacggaagaugauuugcauaaugaggagaaaaucacacagcagauggauccagaacauagacaacuugcuaacgcuauauuuaaauuaacuuaucaaaacaagguugucaaagugcaaagaccaacuccaaaaggaaccgugauggauauaaucaguagaaaggaccaaagagguuccggucagguugggacauacgggcucaacaccuucacaaauauggaagcacaacuaauucggcaaauggaaggugaaggaguauuaaguaaaacagauuuagaaaacccgcaucuauuggagaagaaaaucacucaaugguuagaaacgaaaggcguugaaagauugaaaagaauggccauuucaggcgacgauuguguaguaaaacccauagacgacagauuugcaaacgcauuguuagcucugaaugauaugggcaagguccguaaagauauaccgcaguggcaaccaagcaaagguuggcacgauuggcagcaagucccuuuuuguucacaccauuuucaugagcuaauaaugaaagauggaagaaagcuagugguuccuuguagaccccaagacgaacuaaucggacgugcaagaauaucacaaggcgcagguuggucuuuaaaggaaacagcuuguuuaggaaaggcuuaugcacagaugugggcacuaauguacuuccaucggagagaucuaaggcuugcaucgaaugcuauuuguucugccguaccugugcauuggguuccgaccucaaggacaacguggucaauacacgcucaccaccaauggaugacaacugaagacaugcuuacuguauggaauagaguguggauugaggauaauccauggauggaggauaaggcucccguaacaaccugggaagauguuccauacuuaggaaagcgagaggaccaauggugcgguucuuugauaggcuuaaccagccgugccaccugggcucaaaacauauugacugcaauacagcaaguccgaucuuugauugggaaugaggaguucuuagauuauaugcccaguaugaaaagauuucgaaaagaggaggaaucggaaggggcgauaugguga

SEQ ID NO: 23009 - RNA, 9873 nt, Artificial Sequence
  derived and/or modified CDS sequence (opt6) from DENV-3__JN406514__SS-prME
acaagucuguguuuaaugaugaugcuaccagcaacucuagcguuucacuuaaccucgagggauggagaaccgagaaugauaguugguaaaaaugaacguggaaaaucauuacuauuuaaaacagcaucugggauuaauauguguacccucaucgcuauggaucucggagaaaugugugaugauacggugacauauaaauguccacuaauugcggaaguugaaccggaagauauugauuguugguguaauuugacaucaacauggguaacauacgggacuuguaaucaagcuggcgaacaucgaagagauaaaaggagcguggcuuuagccccucacguugggauggggcuagauacaagaacacaaacuuggaugucagcggaaggcgcauggcgacaaguugaaaaaguugaaacaugggcacuucgucacccaggcuuuaccauccuggcuuuguucuuagcgcauuauauagguacaaguuugacucaaaaagugguaauauucauuuugcucaugcuuguuaccccgucuaugacgaugagauguguugguguggguaaucgugauuuuguugaaggacuaagcggagcaaccugggucgacguaguauuagaacacgguggaugcguuacuaccauggcuaaaaauaaaccaacuuuagauaucgaauuacagaaaaccgaagcgacacaauuagcuacucugagaaaauuguguaucgaagguaaaauaacuaacauuacgacagacucuagauguccuacucaaggggaggcaauacucccggaagaacaagaucaaaauuauguuugcaaacauaccuauguagauagggguuggggcaauggaugcggacuauuuggaaaggguagccuagugacuugugcaaaauuucagugccuugaaccgaucgaaggaaaagucguucaguaugaaaaucuuaaauacaccguuauuaucacagugcacacaggugaucaacaucaaguaggaaacgauacucaaggaguaacgguggaaauaacuccccaagcuaguacaguugaggcaguccuacccgaauacggaacccuaggccuagaauguucaccaagaaccggacuggauuuuaaugaaaugauauuauuaaccaugaaaaauaaggcauggaugguccaccggcaaugguuccuggacuugccccuaccguggacaucaggugcuaccacugaaagaccgacguggaacagaaaagagcuauuagucacuuucaaaaaugcgcacgcgaagaaacaagaaguuguaguucuaggcagccaagagggcgcaaugcauacagcuuuaacgggagcgacagagauccagaacucuggcgguaccaguaucuuugcagggcaucuaaaaugcagacucaaaauggacaaauuagaguuaaaaggaaugaguuaugccaugugccuaaacacauuuguacucaagaaagaaguguccgagacacaacaugguaccauacucauaaaaguagaauacaaaggugaggaugcucccugcaagaucccauuuagcacagaggauggacaagguaaggcgcacaacgggagacucaucaccgcaaauccagucgucacuaagaaagaggagccaguuaauauugaagcagagccuccauucggagaaaguaacauaguaauaggcauuggagacaaagcgcugaaaaucaacugguacaaaaaggguaguucaauuggcaaaauguuugaagcuaccgccagaggagcgcguaggauggcuauauuaggagauacagcaugggauuucggcaguguugggggaguacuaaacucucuaggaaagaugguccaucagauauucgguucagcuuauacggcccucuuuaguggcgucuccuggauaaugaaaauaggaauugggguacuucuaacauggauaggauuaaauagcaaaaauaccucaaugagcuuuuccuguauagugauaggcaucauaaccuuauaucuuggagcgguaguucaagcugauaugggaugcgucauaaacuggaaaggaaaagagcuuaaaugcggcuccggcauuuuuguaacaaacgaaguucauaccuggacagaacaguauaaauuucaagccgacucaccuaaaaggcuagccacggcuauagcgggugcaugggaaaauggaguguguggaauacgaucaaccacaagaauggaaaaucuuuuauggaagcaaaucgcaaaugaacugaauuauauuuuaugggagaauaauauuaaguuaacagugguaguaggcgauacaauaggaguacuggaacaaggaaagagaacccuaacuccacaaccgauggaacuaaaauauucauggaaaaccugggguaaagccaaaauuguuacagcugagacacagaacucuaguuuuauuauagauggucccaacacgccagaauguccaucugcuucacgcgcauggaauguuugggaaguggaagauuacggauucggcguguucucaaccaauauauggcuaaaacuacgagagguuuauacucagucaugcgaccauagacuuaugucagccgcgauuaaagaugaacgugcagugcaugcugacaugggguacuggauugaaucacagaaaaacgggucuuggaaacuugaaaaagcaucauuuauagagguuaaaacaugcauauggccaaaaucacauaccuuauggagcaaugguguguuggaaagugauaugauaauuccuaaaucucucgccggcccgauaucacaacacaaucacagaccaggauaccauacacaaacagcugguccuuggcaucuaggaaaacuagaauuggacuuuaauuacugcgagggaacgacaguaguuauuacggaaaauugcggcacuagaggaccaucgcucagaaccacaacugucucugguaaacucauacaugagugguguuguagaucuuguacuuuaccaccacugagauacaugggggaggauggcuguugguacggaauggaaaucagaccuauaaaugaaaaagaagaaaauauggucaaaucacugguuucugcugggucugguaaaguugauaauuuuacaauggguguauuauguuuagcgauacuuuuugaggaaguaaugagaggaaaguucggcaagaaacauaugauagcugguguacuauuuaccuuuguacugcuucuaucaggucaaaucacuuggcgagacauggcucauacauuaauuaugauuggaaguaaugcgucagacaggaugggaauggguguaacuuaucuugcauuaauagcaacauuuaaaauacaaccguucuuggcguugggauucuuucuuagaaaacuaacuucacgcgaaaaccucuuauuagguguuggccuggcgauggcaacgacucuacagcuaccagaggacauagaacaaauggcgaacggaauugcauuagggcuuaugacucuuaaauuaauaacacaauuugaaacuuaucagcuuuggacugcuuuagugagucuuaccugcucuaauacgaucuucacuuugaccguggccuggcgaacagcaaccuuaaucuuggcugggguuagcuuacuaccucuaugucaaucgucuagcaugcgcaaaacggauuggcuuccaaugaccgucgccgcuauggguguaccuccuuuaccacuguuuauuuucucacuaaaggauacuccaaagagaaggucauggccacuaaacgaaggcguaauggccguuggcuuagucuccauuuuggccagcaguuuacuaaggaacgauguuccuauggcugggccccucguggccggaggcuuacuuauagcguguuacguaauaacaggaaccucagcagauuuaacgguugaaaaagcagcagauguaacaugggaagaagaggccgagcagaccggaguuucacauaaccuaaugauaacgguagacgacgacggcacaaugcgaauuaaagacgaugagacugagaacauacuaaccguacuucuaaaaacugcccuacugauagucagcgggauuuuuccauacaguauaccagccacauuguugguuuggcacacguggcaaaaacaaacucaacggucuggagugcuaugggauguaccuucuccaccugaaacgcaaaaggccgaacuagaagaaggaguauauagaauaaaacaacaaggaaucuuuggaaaaacccaaguuggaguggggguacaaaaagaaggcguguuucacacuauguggcauguuacgcgaggugcgguccuaacacacaaugggaagagacuggagccaaacugggcaagcguaaagaaagacuuaauaaguuauggaggaggauggcgacuuucagcacaguggcagaaaggcgaggaaguccaaguaauagcagucgaaccagguaaaaaccccaaaaauuuucaaacaaugcccggaauauuccaaacuaccacgggugaaauuggugcuauagcucuagauuuuaaaccgggaacuucggggagcccaauaauuaauagagaagguaaaguaguaggauuauacgguaauggugugguuaccaaaaacggaggcuauguaucugggaucgcucagaccaacgccgaacccgaugggccgacuccagagcuggaagaagaaauguuuaagaaacgaaaccuaacuauaauggaucuacauccaggcuccggaaaaacucguaaguaucucccagcuauuguuagagaggcgauaaaacgcagacuaagaacacuaaucuuagcuccaacacguguaguagccgcugagauggaagaagcacuaaaagggcuacccauaagauaccaaacaacggcaacaaaauccgagcauacgggaagagaaauuguugaccucaugugccaugccacauuuacuaugaggcuauuaagcccggugcguguaccaaauuacaacuugauuaucauggaugaagcacauuuuacugauccggcaagcauagcagcaaggggauacauuucuacgcgcgucggcaugggcgaggccgcugcuauauuuaugacagcgaccccaccaggcacagcagaagcguuuccccaaucgaacgcaccuauucaggaugaagaaagagacauuccagaaaggaguuggaacucagguaacgaauggauuacggauuuuguagguaaaacgguaugguuuguaccaaguauaaaagcagguaaugacauagcgaauuguuugcgcaaaaauggaaagaaaguaauacaauuaucuagaaaaaccuuugacacugaauaucagaaaacaagacuaaaugauugggauuucgucguaaccacugauauaucggaaaugggcgccaacuucaaggccgacagaguuauagacccgcgaagaugucucaaaccuguuauauuaacagauggaccagaaagaguaauucuagcgggucccaugccugugacagcugccucugcggcacaaagacgagggagaguaggcaggaauccucaaaaagaaaaugaucaguacauuuucacaggacaaccguugaacaaugaugaagaucaugcucacuggacagaagcaaagaugcuacuagauaauauaaacacaccugaagggauaaucccugcucuuuucgaaccggaacgagagaaaagugcugcaauugacggggaauaccgacuuaaaggugaaucaagaaaaacauuuguugaacuaaugagaagaggagaucuacccgucuggcuagcacauaaaguagcuucggaaggaauaaaauacacagacaggaaguggugcuuugacggagaacguaacaaccagauauuggaggaaaacauggacguagagauauggacuaaagaaggagaaaggaagaaauuaagaccgcggugguuagaugcaagaacuuauucugacccguuagcucuaaaggaguuuaaagauuucgcugcugguagaaagagcauagcucucgaccuaguaacagaaauagguagaguaccuucccaucucgcccaccgaacaagaaaugcucucgacaaucucguuaugcuacauacuuccgaacacggaggucgagccuaucggcaugcgguugaagaauuaccagagacgauggaaacccuuuugcuauugggccuuaugauucugcucacuggcggagcuaugcuauuuuuaauaucuggaaaaggaauuggaaagacuucuauaggucuuauaugcguuauagucaguucagguaugcucuggauggcagacgugccauuacaauggauagccagugcgaucguuuuagaguucuuuaugaugguccuccucauucccgaaccagaaaaacaaaggacuccacaggauaaucaguuagcguauguuguaauaggaauacuaacucucgcagcaaucguugcugcuaaugaaaugggauuauuagaaacuacaaaacgggaccuaggaaugucuaaagaacccggaguuguuuccccgacgagcuaccuugauguggaccuccauccagcgucugccuggacucuguaugcuguugcuaccacgguuauaacaccuaugcuaaggcauacaauagaaaauuccacggccaauguuagucucgcugcaauagcuaaucaagccguaguuuuaaugggauuagacaaaggauggccuauuucaaaaauggaucuaggcgucccuuuauuagcacuuggcuguuacagucagguaaacccacuaacguuaacggcugcaguucuucucuuggucacacauuacgccaucauaggaccgggauuacaggcuaaagcuacucgagaagcgcagaaaaggaccgcugccgguauaaugaaaaaucccacuguagacggcauaaugacaaucgacuuagaccccguuauauaugacucaaaguuugaaaagcagcuaggacagguaaugcuucucguguuaugugcgguacaacuauuauuaaugcgcacaaguugggcacuaugugaggcauuaacauuagcuaccggaccuauaacuacuuugugggaaggcuccccagguaaauuuuggaauacaacuaucgcaguaucgauggcuaauauuuuccgagggagcuaucucgcuggugccggauuagcuuucagcauuaugaaguccguagguacaggcaggagaggaacaggaucucagggagaaacacuaggagagaaauggaagaagaaauuaaaccaauuaagccggaaagaguucgaucuuuauaagaaaucugggauaacagaaguagacagaacagaggcuaaggaaggccuaaaaagaggggaaacaacucaccaugcugucucaagaggcucagcuaaacuccaaugguucguagaacgaaauaugguaauaccugaaggacggguuauagauuuaggauguggaagaggugguuggucauauuauugugcaggauuaaagaaaguuacagaagugagaggauacacaaaaggcggcccgggccacgaggaaccuguuccaaugucuacauacggcuggaacaucguaaaacuaaugucgggaaaagacguuuucuauuugccucccgaaaagugugauacuuuacuaugcgacauaggagaguccuccccuucgcccacuguugaagaaucccguacuauacgaguguuaaaaauggucgaaccauggcuuaaaaacaaccaguucugcauaaaagucuuaaacccauacaugccaacgguuauugagcauuuagagcgccuacaaagaaaguacgggggaauguuaguucggaacccccuaucuagaaauuccacgcaugaaauguacuggauuucgaauggcaccgguaauauaguaucaagcgucaacaugguuucaagguuacuuuuaaaccguuuuaccaugacccaccggaggcccacgaucgaaaaagauguugaccugggugccggcacgagacacguaaaugccgaaccugagacaccgaauauggacgugauaggagaacguauuaaacgaauuaaagaggaacacagcaguacuuggcacuacgacgaugaaaauccauauaaaacuugggcauaucauggaucguaugaaguuaaagcaacaggaucagcaaguucaaugaucaaugguguaguuaaguuguuaacuaaaccaugggauguaguuccaaugguaacacaaauggcgaugaccgauacgacacccuuuggacaacaaagaguguucaaagaaaaaguagauacacgaacaccaaggccuaugccuggaacaagaaaagugauggaaauaaccgcagaauggcuuuggcgaacacuaggcaggaauaagaaacccaggcucugcacgcgagaagaauuuacaaagaaaguaaggacaaaugcugcuaugggugcaguuuucacagaagaaaaucagugggacucagcacgagcagcaguggaggaugaagaauuuuggaaacuuguagacagagaaagagaacuacacaaacucgggaaaugcggcaguuguguauacaauaugaugggaaaaagggagaagaaacugggagaauuuggaaaagcaaaaggaaguagagccaucugguauaugugguuaggagcacguuacuuagaauuugaggcuuuaggauuccugaacgaagaccauugguuuucacgcgaaaauucauacaguggggucgagggggagggacuccauaaacuaggauacauucugcgcgauauuucaaaaauuccggguggugcaauguaugcugacgauacagcgggaugggauacucgcauaacagaagaugaucuacauaaugaagagaaaaucacacaacagauggauccugaacauaaacaacucgcgaacgcuauuuuuaaacuuacuuaccagaacaaaguaguaaagguucaaagaccuacacccaaggggaccguaauggacauuaucucucguaaagaucagagaggcuccgggcaaguugggacauauggacuuaauacauuuacaaacauggaggcucagcuuguucgacagauggaaggggaaggaguucuaaguaaagccgaucuagaaaauccacaccuuuuagagaagaaaauaacucaauggcuggaaacaaaaggaguugagagguuaaaacgaauggcuauauccggagacgacugcguaguuaaaccaauagaugauagauuugcuaacgcuuuacuugcucugaaugauaugggcaagguucgaaaagacauuccucaauggcaaccuuccaagggauggcaugacuggcaacaaguuccauucugcucccaccacuuucaugaauugaucaugaaggaugggagaaaguugguugucccauguagaccacaagaugaacuaauaggucgagcacgaauaucacaaggggcaggauggucauuaaaagagacugccuguuuagggaaagcguaugcucaaauguggucacuaauguacuuucaucgcagggauuuacgucuugcuuccaacgcuauuugcagcgcaguaccuguacacugggugccuacaucacgaacaacguggucuauacacgcacaccaucaguggaugacaacugaggacauguuaacaguauggaaucgaguauggauagaagacaauccuuggauggaagauaaaacgccagucacaacaugggaggacguacccuaucuaggaaaaagggaagaucaauggugcgggucauuaauaggccuuacaagccgcgcuacaugggcacaaaacauacugacagcgauacagcaagucaggucgcuaauuggagacgaggaauuuuuagacuauaugccaaguaugaaacgauuuagaaaagaagaggaauccgaaggugcuauuugguaa

SEQ ID NO: 23010 - RNA, 9873 nt, Artificial Sequence
  derived and/or modified CDS sequence (opt6) from DENV-3__KT726340__SS-prME
acuagcuuaugccugaugaugauacuaccagcggcucucgcauuccauuuaacgucgcgagacggggaaccgcgaaugaucgucggcaaaaaugaacguggaaaaucgcuauuauuuaaaacagccaguggaauaaauauguguacuuuaaucgcaauggacuugggagaaaugugugacgauacagugacauauaaauguccccauauaacugaaguugaaccagaagauauugacugcuggugcaaucucacaaguacguggguuacuuaugggacuugcaaucaagcuggugaacauagaagggauaaacguagcguggcauuagcaccacacguaggaaugggacuagauacuagaacgcagacguggaugagcgcagaaggugcuuggcgacaaguugaaaaaguagaaacaugggcacucaggcaucccggauuuacaauacucgcacuauuucuagcacacuauauaggaaccagucucacgcagaaaguaguaaucuuuauuuugcucauguuagucacacccaguaugaccaugcguuguguaggggugggcaauagagacuuugucgaaggacucagcggcgcaacauggguagauguggugcuagaacacggcggauguguuaccacaauggcgaaaaacaaaccaaccuuagauauagaauuacagaaaacugaagcaacccaacuagcaacuuuaaggaaauuguguauugaaggcaaaauaacaaacauaacaacugauucaagaugcccaacacaaggugaagcggugcugcccgaagaacaagaucagaauuacguauguaaacauacauauguggaucgagguuggggaaacgguugcggacuuuuugguaaagguagucucguaacgugugcgaaauuucaauguuuggaacccauagaaggaaaaguaguacaauaugaaaaucuaaaauacacagugauuaucacuguucacaccggagaccaacaccagguuggaaaugaaacucaaggaguuacagcugaaauuacgccucaagcaagcacgacagaagccauucuacccgaauauggcacacugggacuugaauguaguccgagaacuggccuagauuucaaugaaaugauauuauuaacaaugaaaaacaaagcauggaugguacaucgacaaugguucuuugauuuaccucucccuuggacaaguggagcaacuacagaaacgccaacauggaaucggaaagaacugcuaguaacauuuaaaaaugcacaugcuaagaaacaagagguaguagugcuaggaucacaagaaggagccaugcacacggcuuugaccggugcuacagaaauccaaaauaguggagggacaaguaucuuugcuggacaucucaaaugccgacuaaaaauggacaaacuagaacuaaaaggaaugucuuaugccauguguaccaauacauuugugcugaagaaagaagugucugaaacgcaacaugguacaauccugauaaaaguagaauauaaaggagaagacgugccuugcaaaaucccauuuucaaccgaggacggucaagguaaagcucacaacgggcguuuaauuacugcaaacccgguaguaacuaagaaagaagaaccgguaaacauagaagcagagccaccauuuggggagucuaauauaguaaucgguauaggggauaaugcacuuaaaauaaacugguacaagaaagggucaucgauaggcaaaauguucgaggccacggcaaggggcgcaagacguauggcaauuuuaggagauacggcaugggacuucggcagcguuggaggcguauuaaacagucuaggaaaaaugguacaccaaauauuugguucugcauauacagcucuauuuagcggcguauccuggguaaugaaaaucggaauugggguucuuuuaaccuggaucggacuuaacaguaaaaauacgagcaugaguuucucuuguaucgcaauugggauuauuacacuuuacuuaggagcaguaguacaggccgauaugggaugcguaauaaacuggaaagguaaagaauuaaaauguggcucaggaauauucguaacaaacgaaguacacacauggacggaacaguauaaauuucaagcagauagcccaaaacgccuugcuacagcuauagccggugcaugggaaaacggggucugcggcauucgaagcacuacaagaauggaaaauuuacucuggaaacaaauugccaacgaauuaaauuauauacuaugggaaaauaacauaaaauuaacgguugucguaggagacaucauaggcguuuuagaacaaggaaaacggacgcucacgccacaacccauggaguuaaaauauucguggaaaaccugggguaaagcaaaaaucguuacagcugaaacgcagaacucaaguuucauuauugauggaccuaacaccccggagugccccucagcaagucgggcuuggaauguaugggaaguagaggauuacggauuuggcguauuuacuacaaacaucuggcuaaaauuacgagaaguguacacccagcucugugaccaccgauuaaugucggcugcaguaaaagaugaacgagcuguacacgcagacauggguuauuggauagaaagucagaaaaacggaucuuggaaauuagaaaaggcuucccucauugaagucaaaacgugcacuuggccaaaaucacauacacuguggaguaauggcguccuagaaucggauaugauuauaccuaaaagucucgcuggcccaauaucgcaacauaacuacaggccaggauaccauacacaaacggcaggaccauggcaucuggguaaauuagaacuugauuuuaauuauugcgaaggaacgacaguaguaauuacggaaaacugugggacuagagggccaucacuuaggacaacgacagucucaggaaaauuaauucaugaguggugcugccgcaguuguacccuucccccgcuucgauauaugggugaagaugggugcugguacggaauggaaauucgaccuauuucggagaaggaggagaacaugguuaaaucacuuguuucagcagggucuggagagguugauaauuucaccauggggguacuaugucucgcaauucuguuugaagaggugaugcgaggaaaguuuggaaagaaacauaugauugcaggcguuuucuucacauuuguauuacuucucagcggccaaauaacauggcgagauauggcgcacacauugauaaugauagggucaaaugcaagcgaccgaaugggaaugggaguaacauacuuagcgcucauagcaacguuuaaaauucaaccauuuuuggcguuaggguuuuuccucaggaaacuuacaucccgugaaaaccuauuacuuggggucggauuagcaauggcgacgacccuacaauuacccgaggacauagaacaaauggcaaacgguaucgcauuagggcuaauggcguuaaaacuaaucacucaauuugaaacauaucaacucuggaccgcuuuaauaucacugacuuguucuaacacaauauucacccuaaccguagcuuggcgaacggcaacuuuaauauuagcgggugugucccuacuacccguaugucaaaguaguucuaugaggaaaacagacugguugccuaugaccguugcagcgauggguguacccccuuuaccacuauuuauauuuucauuaaaagacaccuuaaagcguaggaguuggccacuuaaugaagguguaauggcuguuggucuagucagcauucucgcaagcucacuauuaagaaacgaugugccaauggcagggccucuaguagcaggcggcuuacuaauagcuuguuaugucauaacaggaacuuccgccgaucucacuguagaaaaggcagcugacguaacaugggaagaagaggcagagcaaacugguguuucucauaaucucaugauaacaguagacgaugauggaacuaugcgaauaaaagacgacgagacagaaaacauucuaacuguacuacuaaaaacagcucucuugaucgucaguggaauuuucccuuacucaauaccggccaccuuacucguauggcacacuuggcaaaagcaaacgcaacgcucuggcguucucugggauguaccaaguccgccugagacacagaaggcugaacuugaagaaggcguuuaucguauuaaacaacaggguauuuucggaaaaacacaaguugggguuggcguccaaaaagaaggaguauuucauacaauguggcauguuacgcgaggugcugucuugacauacaaugguaaacgacuggaaccuaacugggcgagcguuaagaaagaccuaauaucauacgggggaggauggagguuaucagcccaguggcagaaaggagaggaagugcaaguuauugcgguagaaccggguaagaacccuaaaaacuuucaaacaaugccuggcaccuuccaaacaacaacgggugaaauuggagccauagcccuagauuuuaaaccagguacaaguggaaguccuauaauaaaucgagaagggaaaguugugggacuguaugguaauggcguaaucacaaagaauggaggauacguuagcgggauugcccaaacaaacgcagaaccagauggaccuacaccagaacuagaagaagaaauguuuaaaaagagaaaccucacaaucauggauuuacauccugggagcggaaagacacgaaaauacuuaccugcuauuguaagggaagcaauaaaacggcggcuaagaacccuuauauuggccccuacaaggguaguagcugcugaaauggaagaagcauuaaaaggccuaccgauuagguaucaaacuacagcaacuaagagcgaacauaccggucgggaaaucgucgaccucaugugccaugccacguucacaaugagacuucuaaguccuguaagaguuccaaauuauaaucuaauuaucauggaugaagcacauuuuacagaucccgcuucaaucgcggcucggggauauauaucgacccgugugggaaugggcgaagcagcggcaauuuucaugacggcaaccccaccaggcaccgccgacgcguucccgcaaagcaacgccccaauucaggaugaggaacgagacauaccggagagaaguuggaacucuggcaaugaauggauaaccgacuucgccggcaaaacugugugguuugugccauccauuaaagccggcaaugauauagcuaacuguuuaaggaagaaugggaagaaaguaauccaguuaagcaggaagacauuugauacagaguaccagaaaacuaaacuuaaugacugggauuucguaguuacuacggauauuagcgagaugggcgccaauuuuaaagcagauagagugaucgauccucgaaggugcuuaaaaccaguaauucuuacagaugguccugagcgcguaauucuagcgggaccuaugccaguuacagcagcaucagcagcucaacgaagaggucggguaggacgcaacccacaaaaggaaaacgaccaguauauauucacaggucaaccacuuaauaaugacgaagaccacgcucauuggacggaagcaaaaaugcuucuugacaauauuaauacgccagaagguauaauaccugccuuauucgaaccagaacgggaaaaaucggcugcaauugacggagaauaucguuuaaaaggagaaucuagaaaaaccuuuguagagcuaaugcggagaggcgaucuuccgguauggcuugcacacaaaguugcaagugagggaaucaaauauacagauagaaaauggugcuuugauggacaaagaaauaaucagauacuagaagagaacauggauguugaaauauggacaaaagaaggagagaagaagaaacuaagaccccgaugguuagaugcuaggacauacagugauccguuagcuuugaaggaauuuaaagacuucgcagcuggucgaaaaagcauugcacuugacuuaguuacagaaauugguagaguaccgucucaucuagcccauaggacaaggaacgcacuugacaaucuaguaaugcuccauacuucagagcacggcgggaaagccuauagacaugcgguugaagaauuaccagaaaccauggaaacauuguugcuacuggggcuuaugauauugcuuaccgguggggcaaugcuauucuuaauaagcggaaaagggauagguaaaacaaguaucggacucaucuguguaauagcgucuucagguauguuauggauggcagaaauuccauuacaguggauugcuagcgcaaucguucuggaauuuuucaugaugguacuuuuaauaccagaaccugaaaagcaacgaacgccucaagauaaccagcuagcauauguagucauuggaauccucacucucgcagcaauaauagcggcgaaugaaaugggucugcuagaaacgaccaaaagagaccuugggaugucuaaggaaccgggcguuguuuccccaacuucauaccuagauguagaccuccaccccgcuagcgcuuggacacuuuaugcaguugcaacaacaguaauuacuccaauguugcgacauacaauugaaaauucgacagcaaauguaagucuagccgcgauugcuaaccaagcuguuguauuaauggguuuagauaaaggauggcccauaucuaaaauggaucuaggaguaccacugcuugcucuaggauguuacucacaaguaaauccauugacacuuacugcagccgucuuacuguuaauaacucauuaugccaucauugguccgggacuacaagcaaaggccacgcgagaagcucagaaacggaccgcagcaggaauaaugaagaacccaaccgucgauggaaucaugacaauagaucucgacccagucauauacgacuccaaauuugaaaagcagcuaggucaaguaauguuauuaguguuaugugcgguccaacuacuucuaaugagaacaucuugggcguuaugugaggcucuuacacuagcaacuggaccuauaacuacauugugggaagguagcccaggcaaguuuuggaauacuacaauagccguuucuauggcgaauauauuuagaggaaguuauuuagcuggagcuggucucgcguucucuauuaugaaaucuguagguacagggaaacgggguacgggaucacaaggagaaacuuuaggugaaaaguggaagaagaaacucaaccaauuaucacgaaaagaguucgaccuuuauaagaaaucugggaucacugagguugauagaacagaagcaaaagaaggacuaaaaaggggcgaaauaacccaccacgccguaucaagaggcuccgcgaaacuucaaugguuuguggaaagaaacaugguaauuccugaggguagaguaauugaccucggcugcgggcgaggcggauggucauauuauugugcgggacucaaaaaggucacagaaguaagaggauauacaaaagguggcccuggacaugaagaaccaguuccuaugucgacauaugguuggaauauuguaaaauugaugagcggaaaggauguauuuuaucucccacccgaaaaaugcgacacgcuacugugugauauaggcgaaucaaguccaucuccaacgguagaggaaucgagaacuauuagagucuuaaaaaugguugaaccuuggcucaaaaauaaucaauucuguauaaaaguacuaaacccauacaugcccacgguagucgaacaucuagagagauugcagcguaaacauggcgggauguugguucguaauccacuuagcagaaauaguacacaugagauguacuggaucuccaauggaaccggaaauauaguagcaucaguaaacaugguuagucgcuuacuuuuaaaucgcuucacaaugacacacagaaggccaacaauagaaaaggauguugacuuaggugcagggacgcgucaugucaacgccgaaccugaaacgcccaacauggacgugauaggugaacguaucaaaagaauaaaagaagaacauaacagcacauggcacuaugacgaugaaaacccauacaaaaccugggccuaccauggaucauacgaagucaaggcgacagguucagccucauccaugaucaauggugucguaaaacuacuuacuaagccgugggacguaguacccaugguaacacagauggcuaugacggauacaacgccguuugggcagcaaagaguguuuaaagaaaaagucgauacacgaacccccaggucuaugccaggaacaaggcgugugaugggcauaacugcagaauggcucuggaggacccuuggacgaaauaaaaagcccagacugugcaccagggaagaguucacgaagaaagugcggacaaaugcggcgaugggcgcaguuuucaccgaagaaaaucagugggauagugccaaggcagcaguggaagaugaggauuuuuggaaguuggucgaccgugaaagggaauuacauaaauuaggaaaaugcggaaguugcgucuacaauaugaugggaaaacgggaaaagaaacugggugaauuugguaaagccaaaggaagcagagcuaucugguauauguggcuuggugcacgcuauuuagaguucgaagcacuuggauucuuaaacgaagaucacugguuuucgcgugaaaacaguuacaguggaguagaaggcgaaggauuacauaaauuaggguauauauuacgagacauuaguaagauaccuggcggagccauguaugcggacgacacagcaggcugggauacucguauaaccgaagacgaccuacacaacgaagagaaaauuacacaacaaauggacccugaacauaggcaauuggcuaaugcuauuuuuaagcugacuuaucaaaacaaagucguaaaagugcaacgaccaaccccaacagggacagucauggacauaauuucaagaaaagaucagcgagguucuggacaagucggaacuuauggacuaaauacuuuuacuaauauggaggcccaauuaauccgacagauggaaggagaagguguacuuucgaaagcugauuuagaaaacccgcgacuaccggagaagaaaaucacccaguggcucgagacgaagggaguugaacgacuuaaacgaauggccauaagcggcgaugauugcguuguaaaaccaaucgacgaccguuuugccaacgcuuugcuugcacuuaacgacauggguaaaguacgaaaagacauaccgcaauggcagccuagcaaaggguggcacgauuggcaacaaguaccuuuuuguucccaucacuuccaugaauuaauaaugaaagauggucgaaaguuagucgucccuugucgcccccaggaugaguuaauaggcagagccagaauaucacaaggggcagguuggucccuaagggaaacagcauguuugggaaaggcuuaugcacaaauguggagccugauguacuuucauagaagagaucuaagauuggcaucgaacgcaauuugcagcgcagucccggugcauugggucccaacaagucgcacaacguggucaauacacgcacaccaucaauggaugacaacagaagauauguuaacaguauggaauagaguuuggauagaagauaauccuuggauggaagacaagacacccauaacaacgugggaaaauguacccuaucuaggcaaacgugaagaccaauggugcgggucacucauaggacuuacuucaagagccacgugggcucaaaacauaccaacagcuauucagcaagucaggucauuaauagguaacgaagaguuucuugauuacaugccuaguaugaagagauuucggaaagaagaagaaucagaaggugcaauaugguag

SEQ ID NO: 23011 - RNA, 9873 nt, Artificial Sequence
  derived and/or modified CDS sequence (opt6) from DENV-3__KT726345__SS-prME
acgagccucuguuuaaugaugauauuaccugcagcauuagcauuucauuuaacaucgagggauggagaaccgcggaugauaguugguaaaaacgaaagaggaaaaagucuacuuuuuaaaacggccucuggaaucaacaugugcacccuaauagcuauggauuuaggggaaaugugcgacgauacaguaacuuauaaauguccucauauaaccgaagucgaaccagaagacauagacuguuggugcaauuuaacaucuacaugggugaccuacggaacuugcaaccaagcaggggagcaucguagggacaaaagaucaguagcucuagcaccucauguagggaugggucuggauacaagaacacaaacauggaugagcgcugaaggggcuuggaggcaaguggaaaaaguugaaacaugggcauuacgccacccuggauuuacuauuuuagcguuauuccuagcccauuacauaggaacaucucuaacucaaaaagucguuaucuuuauccuccugauguuaguaacgccuucaaugacaaugagguguguagguguagguaaccgcgauuuuguugaaggacugucgggcgcuacuuggguagauguaguccuugagcauggugggugugugacaacaauggccaaaaauaaaccaacgcuugacauagagcugcagaaaacagaggcuacacaauuagccacauuacgaaaacuauguauagaaggcaaaauuacuaauauaacaaccgacucaagaugucccacacaaggugaagcuguuuuacccgaggaacaagaucaaaacuacguauguaaacauacauauguagacagagguuggggaaauggaugcggauuauuugggaaaggcuccuuaguuacuugugcgaaauuccaaugcuuagaaccaauagaaggaaaaguaguacaauaugagaaucugaaauauacuguuauaauaacuguucacacuggugaccaacaucaagucggaaaugaaacgcaaggaguuacugcagaaauaaccccacaagcauccacuaccgaggccauccuaccagaauaugguacguugggcuuggagugcuccccaagaacuggauuagacuuuaacgagaugauauuauugaccaugaaaaauaaagccuggaugguccacagacaaugguucuuugauuuaccacuaccuuggacaucaggagcaacaacugaaaccccaacuuggaauagaaaagaacuauuaguaacuuuuaaaaaugcacaugccaagaaacaagaaguagucguacuggguucacaagaaggugcgaugcacaccgcacuaacuggugcuacagaaauccagaacucaggcggaacgaguaucuuugcaggucacuuaaaauguagacuaaaaauggauaaauuggaacuaaaagguaugucauaugcuauguguacaaauaccuucguauuaaagaaagaagucagugaaacucaacauggcacaauacuaauaaaaguugaguauaaaggggaggacguacccuguaaaauuccuuucuccacagaagacggacaaggaaaagcacauaacggaagauuaauaacggcaaacccagucguuacuaagaaagaggaaccagugaauaucgaagcugagccucccuuuggcgaaagcaauauaguaauagguaucggagauaaugcacuaaaaauaaacugguauaagaaaggaucgaguaucgggaaaauguucgaagcaacagcaagaggagccaggaggauggcaauucucggagauacagcuugggacuuugguucugucggagguguucuaaauagcuugggaaaaaugguacaucaaauuuucggaagugcuuauacggcauuguuuucaggugucucgugggucaugaaaauaggaauaggcguguuguugaccuggauaggguuaaacaguaaaaauacaaguaugucguuuagcuguaucgccauuggcaucauuacacuauauuuaggugcaguaguacaagcagacauggguuguguaauuaacuggaaagguaaagaauuaaaauguggaagcggcauuuuuguaacuaaugaaguccacacauggaccgagcaauacaaauuccaggccgauuccccaaagcgcuuagcuacagcuauagccggagcgugggagaauggggucugcgggauaaggucaacgacucguauggagaauuuauuauggaagcaaauagcaaaugagcuaaacuacauucugugggaaaacaacaucaaacuaacaguaguuguaggagauaucauaggaguacucgaacaaggaaagagaacuuuaacaccccaacccauggagcuaaaauauaguuggaagacaugggguaaagccaaaauaguuacagcugagacgcaaaacucguccuucauuaucgauggaccuaauacuccugaaugcccaagcgcgaguagagcguggaacguaugggagguggaagacuacggauuuggaguauuuacaacaaacauuugguuaaaacuuagagaaguauauacucaacucugcgaccacaggcuuaugagugccgcaguuaaagacgaacgugccguacacgcagacauggguuacuggaucgaaagucagaaaaauggcagcuggaaauuagaaaaggcuucccuuauagaaguaaaaacauguacuuggccuaaaagucauacgcuuuggaguaauggagugcuugaaagugauaugauaauacccaaaucacuugcgggaccuauuucucagcauaaucauagaccuggcuaucacacccaaaccgcagggcccuggcaucuaggaaaauuagaauuagauuucaauuacugugaaggcacuacgguugugaucacugaaaauugcgggaccagagguccaucguugcgaacgacaacuguuucugguaaacugauacaugaaugguguugccgaagcuguacuuugccaccguuaagauauaugggagaagacggcuguugguacggaauggagauuaggccaauuucagaaaaagaagaaaacaugguaaagucauuaguuagugcagguucggguaagguagauaauuucaccaugggggugcuuugccuggcgauccuauuugaagaaguaaugcguggaaaguucggcaagaaacacaugauagcaggagucuucuuuacauucguucucuuauuaucagggcaaaucaccuggagggacauggcucacacgcuaaucaugauagguaguaacgcgagcgaccgaauggguaugggugugacguaucuagcacuuauugcaacauuuaaaauacaacccuuucucgcacuuggcuucuucuuaagaaaacucacgucgcgagagaaucuguuauugggaguuggucuagcuauggcgacaacccuucaacuucccgaagauauagagcagauggcaaaugggaucgcauuaggauuaauggcauuaaaacuaauaacccaguuugaaacguaucaguuguggacugcguugauaucucugacauguucaaauacaauauucacauuaacaguggcauggcgaacggcaacacuaauacuugccgguguuucuuuacucccagucugucagucaucuucuaugcgaaaaacagacuggcuuccuauggcaguagcagcuaugggcguaccuccacuuccacuauucauauucucccuuaaagauacacuaaaacguaggagcuggccccuuaaugaaggaguaauggcaguaggcuuagucucaauucuagcuucuucgcuacuucgaaacgauguuccuauggcaggcccgcuuguagcgggaggacuauuaauagcauguuaugucauaacggguacgucggcggauuuaacuguagaaaaagcagcagacauaauaugggaagaagaagcagaacaaacuggaguaagccacaauuuaaugauaaccgucgaugacgacgguacgaugcguaucaaagaugacgagacagagaauauacuaacaguucuauugaaaacugcccuacuaauagugucagguauuuucccguauucaauaccugcaacauuacuuguguggcacacauggcaaaaacaaacacaaagauccgguguauuaugggacguacccucgccaccugagacacagaaagcagagcucgaagaagguguauacagaauaaaacaacaaggcauuuuugguaaaacacagguagggguuggaguacaaaaagaaggaguguuucacaccauguggcaugucacuagaggggcgguauuaacacacaauggaaaacgauuagaacccaauugggccaguguuaagaaagacuuaauuaguuaugguggcggcuggagacuaucugcucaauggcaaaaaggagaagaagugcaggucauagccguugagcccggaaagaauccuaaaaacuuccaaaccaugccugggacuuuucaaacgacaacaggcgaaauaggagcgauagcauuagacuuuaagccagguacaagugggaguccaaucauaaauagggaaggaaaaguagucgggcuauacgguaaugguguaguaaccaaaaaugggggauacguaucuggaauagcccagacuaacgcugaaccugauggaccgacgccugaauuagaagaggagauguuuaagaaacgaaacuuaacuauuauggaucuccauccggggagugguaaaacaaggaaguauuuaccggcaauaguacgagaagcuauaaagaggcgcuugaggacacuuauauuggcaccaacucgaguagucgcagcagagauggaggaggcuuuaaaaggucuucccauaagguaccagacaacagccacaaaauccgaacauaccgguagagagauagucgaccucaugugccacgcgacuuuuacgaugagacuauugaguccuguaagggucccuaauuauaaccuaaucauaauggacgaggcccauuuuacugacccugccucuaucgcagcaagagguuauauaucaacccggguagguaugggagaagcagcagcaaucuucaugaccgcaacgcccccgggcacggcagacgcauuuccacaaucuaaugcgccuauacaagacgaggagagagauauuccagaacguaguuggaacucaggcaaugaguggauaaccgauuucgcagguaaaacagucugguucgugccgucuauaaaagccggcaaugacaucgccaauugucuacguaaaaacgguaagaaaguuauucaacuuucccguaaaacguucgauaccgaauaccagaaaaccaaacuaaaugacugggacuucguagucaccaccgauauaagcgagaugggagcuaacuucaaagcugacagaguaauagacccccgucguugucuaaaaccaguaauacuuacugacggcccagaaagggucauucuagcuggaccgaugccaguaaccgcagcaucggcugcucagaggaggggacgaguuggccggaauccucaaaaagaaaaugaucaauacauuuuuacuggacaaccgcucaacaacgaugaagaccacgcacauuggacugaagcaaaaaugcuuuuagauaauauaaauacuccagaaggcauaauaccagcacuuuuugaaccagagcgcgagaagagugccgcaauagauggugaauaucgacuuaaaggggaaucacggaaaacguuuguagaauuaaugcgucgaggcgaucuacccguuuggcuagcccacaagguugcgagcgaaggaauaaaauacacugaucguaaaugguguuuugauggucagcggaacaaccaaauucuagaagaaaauauggaugucgaaauuuggacuaaagaaggggagaagaagaaauuaagacccagauggcucgacgccagaacauauuccgacccacuagcacuuaaagaguuuaaagacuuugcugcugguagaaagucaauagcgcuagauuuagucacagagauaggacguguaccaagccaucuagcccaucggacuagaaacgcacuugauaaucuuguuauguuacacacuagcgaacacggagggagagcauauagacaugccguagaagaguuaccggaaacaauggaaacacucuuguugcuaggccugaugauauuauuaacugguggggcgaugcucuuucuuauaagcggaaaagggauaggcaagacaucuauaggucuaauuuguguaauagccucaucaggaaugcucuggauggcugagaucccguuacaauggauagccagugcaaucguguuagaauuuuucaugaugguacuauuaauaccugagccagaaaaacaacgaacgccccaagauaaccaacuugcauauguaguaauaggaauacugacgcuagcagcaauaauagcagcaaaugaaaugggguuguuagaaacaacgaaacgggauuugggaaugucgaaggaaccgggaguaguguccccuaccaguuaucuggacguugacuuacacccagcaagcgcguggacucuuuacgcuguugccacuacaguaauaaccccuaugcuacgacauacgaucgagaacucuaccgccaaugucuccuuagcagcaauugcuaaucaagcaguuguguuaaugggucucgacaaaggauggccuauuucuaaaauggaucuaggagugccacuacuugcuuuaggaugcuauagucaggugaauccucuuacacuaaccgcagcaguauuacuuuuaaucacacacuaugcuauaauagguccgggacuacaggcuaaggcaacucgugaagcacagaaaagaaccgcugcggggauaaugaagaauccaacaguggauggaauaaugaccauagaccuggacccuguuauauacgauucaaaauuugaaaagcaacugggucaaguaaugcuguuaguguuaugugcuguccaacucuugcuuaugaggacuucuugggcauuaugugaagcacuuaccuuggccacugguccgauuacaacguugugggaagggagucccggaaaguuuuggaauacuacaauagcuguuucaauggcgaauaucuuucgugguucuuacuuggcgggagccggauuagcauuuucgauuaugaaaucaguuggaacagggaaaagagguaccggaucgcaaggugaaacuuuaggagaaaaauggaagaagaaauugaaccaacuaucucguaaagaauuugaucuauacaagaaaucaggaauuacugagguggaccgaaccgaagcuaaagaaggacuuaagagaggagagauuacacaccaugcugugucuagaggaagcgcgaaacugcaaugguucguugaacggaacaugguaauuccugaaggaagaguuaucgaucuaggaugcgguagaggaggguggaguuauuauugcgcgggacuaaagaaaguuacggaagugcgaggcuacaccaaaggaggaccugggcacgaagaaccuguaccuaugucuaccuacgguuggaacaucguuaaauugaugucaggcaaggauguguucuauuuaccaccagaaaagugcgacacauugcuaugugacauaggagaaucuaguccaaguccaacuguugaagagagccgaacaauuaggguuuuaaaaauggucgaaccuuggcucaaaaacaaccaguucugcauuaaaguauugaacccauauaugccuacggucauagaacauuuggaacguuugcaacgaaagcacggagggaugcuggugagaaauccucuaucuagaaauagcacccaugaaauguacuggauuucgaacggaacaggaaauauagucgcuaguguuaauaugguaucaagauugcuucuaaauagauuuacaaugacucauaggaggccaaccaucgaaaaagauguugauuugggagcuggaacacgucaugugaaugcggagcccgaaacucccaauauggauguuauuggcgaaagaaucaaaagaauaaaagaggaacacaacucaacuuggcauuacgaugaugagaaucccuauaagacuugggcauaucauggcucguaugaagugaaagcaacgggcucggcaucaaguaugauuaacggaguggucaaacuacuaaccaaaccaugggacguuguuccaaugguaacacaaauggcuaugacggacacaaccccauucgggcaacaacgaguauuuaaagaaaaagucgauacuagaacaccgcggucaaugccagggacacgacggguuaugggcauaacagcagaauggcuauggagaacucuuggacgaaauaagaaaccgagguuauguaccagagaggaauuuacuaaaaagguuagaacuaacgcugcaaugggagcagucuuuacugaagaaaaccaaugggauucugcgaaagcagcuguggaagacgaagacuucuggaaguugguagaccgugaacgagaauugcauaaauuagggaagugcggaaguugcguauauaacaugaugggaaaacgagagaagaaauuaggggaauuugggaaagcgaaagguucacgagcaauaugguauauguggcucggcgcccgauaucucgaguucgaagcauuaggauuucuaaacgaagaucacugguuuagcagagaaaacaguuacaguggcguugaaggagaaggcuugcauaaauuaggauacauccucagagauauaagcaaaauaccaggaggcgcuauguaugcagaugauaccgcuggcugggauacaagaauuacugaggacgauuuacauaaugaagagaaaaucacccagcaaauggauccagagcaucggcaauuagcaaaugccauauuuaaguuaacauaucagaauaaaguugugaagguccaacggcccacaccaacuggaacagucauggauauuauaaguagaaaagaucaacgaggaucaggacaaguaggaacuuacggccucaauaccuuuacuaauauggaggcgcaguuaauacgucagauggagggugaaggcguauuguccaaagcugauuuagaaaacccccacuugccugagaagaaaauaacacaauggcuagaaacuaagggaguugagagauuaaagagaauggcaauaucgggagaugauugcguugugaaaccuauugacgauagguuugccaaugcauuacucgcuuuaaacgauaugggaaaagucagaaaagacaucccgcaguggcaaccaucuaaggguuggcaugacuggcaacagguaccauuuugcagccaucauuuucaugaacuaauaaugaaagacggacguaaguugguagugcccuguaggccgcaagaugagcuaauaggucgugcuagaauuucucaaggugcuggguggagucuacgggagacagcgugucuuggaaaagccuaugcacagauguggucauuaauguacuuucauaggcgagauuuaagacuagcaagcaacgcgauaugcucggcuguacccgugcauuggguaccaacuucgagaacaacauggucaauucaugcucaucaucaauggaugacuacggaagauaugcuaaccguauggaaucgaguuuggauugaagauaauccguggauggaagauaagacgccuguaacaacaugggaaaacgugcccuaucuuggaaagcgggaagaucaaugguguggaucacugauaggucuuacaucacgugcgacgugggcacagaacauuccaacagcaauacaacaagucagaaguuugauaggaaacgaagaguucuuagauuauaugccaucaaugaaaagguucagaaaggaggaagagucagagggagcuauaugguaa

SEQ ID NO: 23012 - RNA, 9873 nt, Artificial Sequence
  derived and/or modified CDS sequence (opt6) from DENV-3__KT726349__SS-prME
accagcuuauguuuaaugaugaucuuacccgcagcucuagcuuuccaccuaaccaguagagacggagaaccgagaaugauaguuggcaaaaacgaacgugggaaaucacuucuguucaaaaccgcaaguggaauaaauaugugcacucugauagccauggaucuuggagaaaugugugaugauacgguuacauauaaauguccucacaucacugaaguagaacccgaagacaucgacugcuggugcaaucugacgagcacuuggguaacauaugguacauguaaucaagcgggagaacauagacgcgauaaacgcagcguagcuuuagcgccucacgucggaaugggccuugacacaaggacccaaacauggaugagugcagaaggagcguggagacagguagaaaaaguagaaacgugggcauugcgacaccccgguuuuacaauuuuagcgcuuuucuuagcacacuacaucgguacuagcuugacacagaaagucguaauuuuuauacuacuuaugcuuguaacaccauccaugacaaugcgauguguaggcguagguaaucgugauuuuguugaagguuuaucaggugcaacuuggguagacguuguacuagagcaugguggaugcguaacuacgauggccaaaaacaaaccuacacucgacaucgagcuacagaaaacugaagcuacacaauuagcaacccuucgaaaacuauguauagaaggcaaaauaacuaacauaacaacagauuccaggugucccacgcaaggagaagcaguuuuaccagaagaacaagaucaaaauuaugucugcaaacauacauacguagaucguggauggggcaacggcugcgguuuauuuggaaaagggucacuuguaaccugcgcgaaauuccaaugcuuagagccgaucgaaggaaaaguaguccaauacgagaaccuuaaauauaccguuauaauaacaguucacaccggagaucagcaccagguggguaacgaaacacaagguguaacugcagagauaacuccgcaagcaucuaccacugaagcuauauugccagaguacgguacuuuaggauuagaauguucuccacggacuggauuggauuucaacgaaaugaucuuguugaccaugaaaaauaaagccuggaugguacauagacagugguucuuugaucuaccccuaccauggacaagcggugccacaacggagacacccacuuggaaucggaaagaacucuuagugacuuucaaaaaugcacacgcgaagaaacaggaggucgucguguugggcagucaagaaggagcaaugcauacugcccuuacgggagcuacugagauccaaaacucaggagguacaaguauuuuugcaggacauuuaaaaugcagacuaaagauggacaaauuagagcuuaaaggaaugucauaugccauguguacaaauacauuugugcugaagaaggaagucucagaaacucagcauggaacuauacugauaaaaguggaauacaagggugaagauguaccguguaagauacccuuuucgaccgaagauggacaaggaaaagcucauaacggucguuuaauaacugcgaacccaguaguaacuaagaaagaagaaccuguuaauauagaagcagagccgccguuuggcgaaagcaacauagugaucgggauaggcgacaaugcuuuaaagauaaauugguacaagaaaggaucgucaaucgggaaaauguuugaagcuacagcaagaggggcaagacggauggcaaucuuaggagacacagcaugggauuuugggucgguaggaggaguauuaaauucacucggaaaaaugguccaucagaucuuugggucugcauauacugcauuauuuucggguguuagcuggguuaugaaaauaggcauuggagugcucuuaacauggaucggacuaaauucgaaaaauaccucaaugagcuuuucauguauagcuaucgguauaauaacgcuuuaccuuggcgccgucgugcaagcagacaugggguguguuauaaauuggaaagggaaagaauugaagugcgguagcgguauauucguaacgaaugaaguucauacauggacagaacaauauaaauuucaagccgauaguccaaaaagauuggcuaccgcgaucgcuggggcaugggaaaauggcguuugcggaauacgaaguacgacacguauggagaauuugcuauggaagcaaauugccaacgaacuaaauuauauacuuugggagaauaacauuaaacucacgguagugguaggggauauaauaggaguccucgaacaaggaaaaaggacucuaacaccccaaccaauggaacuuaaguacaguuggaaaacauggggaaaagcgaagauaguuacagcagaaacccagaauaguaguuucauaauagauggaccuaauacaccagaaugccccucagcuucaagagcuuggaaugucugggaaguugaggacuauggauuuggaguauuuacuacgaauauauggcuaaaguuacgugaagucuauacacaacugugcgaucaccgucuuaugucagcugcuguuaaagaugaacgagcaguccaugcggauaugggguauuggauagagagucagaaaaauggauccuggaaacucgaaaaggcaucauuaaucgaaguaaaaacaugcacuuggccgaaaucgcauacccuauggucaaaugguguuuuagaaucugauaugauaauaccaaaaucguuggcggggcccauaagccaacacaaucaucgaccgggauaccauacccaaacagcugggccauggcaucucggcaaauuagagcuggauuuuaacuauugcgaaggaacaaccguaguuaucaccgagaauugcggcacaagggggccuagucuacgcacuacaaccguaagcgguaaacuaauacacgaauggugcuguagaucauguacacuaccaccauuaagauacaugggcgaagauggauguugguauggaauggaaauucgaccuauaagcgagaaggaagagaauauggugaaaagucuuguuucggcgggaucaggaaaaguugacaauuucacaauggguguacuuugccuugcaauuuuauuugaagaaguuaugcggggaaaguucggaaagaaacauaugauagcaggcguauuuuucacauuuguacuauuacuuucagggcaaaucaccuggcgagacauggcacauacccugauaaugauuggaucuaacgcuucugaccgaaugggaauggguguaacuuaucuagcacugaucgcgaccuuuaaaauacaacccuuucuugcauuaggauucuuccuacggaaacuaaccagccgugaaaaucucuuauuggguguuggacuugcaauggcaaccacuuuacaauuaccagaagacauagaacaaauggcaaaugggauagcacuaggguuaauggcuuuaaaacuaaucacacaauucgaaacauaccaauuguggacugcucuuauaucccuaacaugcucuaacacuauuuuuacacuaacgguagcauggagaacugcgacacuaauccuugcaggaguuaguuugcuacccgugugccaaucuuccucaaugcgaaaaacagacuggcuaccuauggcaguugccgcaaugggaguuccgcccuuaccccucuuuaucuuuucacugaaagauacuuugaaaaggcgaagcuggccucucaacgaagggguaauggcuguuggccucguaucgauucuagcaucuucccuucuacgcaacgacgucccuauggcuggaccucuaguggcuggaggacucuuaauugccuguuacgucauaacugguacaagugcagaucucacaguagaaaaagcggcggauauaacaugggaagaggaagcagagcaaacggggguuagucauaaucuaaugauaacaguggacgaugauggcaccaugagaauaaaagaugacgaaacggaauccauacuuacuguacuuuugaaaacagccuuacuaaucguuaguggcauauuuccuuauaguauuccggcgacucuauuaguauggcauacauggcaaaaacaaacucaaaggucugggguucuuugggauguuccgagucccccagaaacacaaaaagcugagcuagaagaagggguauauagaauuaaacaacaggggauuuuugguaagacacaagucggagugggcguucaaaaagaaggaguauuucauacaauguggcacgugaccagaggggcaguacuuacacauaauggcaaacggcuagaaccuaauugggcuucagucaagaaagaccucauaucguacggagguggcuggcgauuaucggcucaauggcaaaaaggcgaagaaguacaaguaauugcuguugaaccgggcaaaaaucccaaaaacuuucaaacgaugccggggacguuucaaacuacaacgggugaaauuggggcaauugcacuagauuuuaaaccgggaacaucuggauccccgaucauaaauagggaagguaaaguuguuggucuguauggcaauggugucgugacuaaaaacggaggcuauguaucuggaauugcgcaaacgaaugcugagccugauggacccacuccagagcuagaagaagagauguuuaagaaacgaaaucucacgauuauggaccuucacccugggagcgggaaaacaagaaaguacuuaccagcuauagugcgagaagcgauaaagagaagacucagaacauuaauccuagcaccaacacgggucguggcagcagaaauggaagaggcccuaaaaggauuaccgauaagguaucaaaccacggcuacaaagucagaacacacaggcagagaaauaguggauuugaugugucacgccacauuuaccaugcgacuacucucacccguuagaguacccaacuacaauuuaaucauaauggaugaagcccacuuuacugauccagccaguaucgcagcucgaggauauaucagcacgcgaguugguaugggagaagcagcagcaauauuuaugacagcaacgccuccaggaacagccgacgccuuuccucaaucaaaugcucccauacaggaugaggaacgugacauaccagaaaggaguuggaacucaggaaacgaauggauaacagauuucgcagguaaaacggucugguuuguuccuucaaucaaagcagguaacgacauugcuaacuguuugaggaaaaaugguaagaagguuauacaauuaagcaggaagacauucgauacagaauaucagaaaacgaaacuuaaugauugggauuuuguagucacgaccgacauuucagaaaugggagcuaauuuuaaagcugauagagugauagauccgaggagaugucuaaaaccaguaauacuuacugauggcccagaacgcguuauauuagcggguccaaugcccguaacugcagcuucagcggcgcaacgacgagggagagucgggcgaaauccacaaaaagaaaaugaucaauacauuuucacagggcagccacucaacaacgacgaagaucacgcgcacuggacggaagcgaaaauguuacuagacaauauaaauacaccagagggaauaauaccggcguuauuugaaccugaacgagagaaaagugcagcgauagauggugaauacagauugaaaggcgagagucgaaaaacuuuugucgaauugaugcgacgaggggaccugcccguauggcuugcccacaagguggcaucggaggguauaaaauauacugauagaaaaugguguuuugauggucagcgaaauaaccaaauacucgaagagaauauggacguagaaauauggacaaaagaaggggagaaaaagaaauugcggccgagauggcuagacgcaagaacguauucggauccauuggcuuuaaaagaauuuaaagacuuugcugcaggucgaaaaaguauagccuuggaccucguaacagaaauuggacgaguaccaagucaucuugcgcauagaacaagaaaugcccuugauaaccuaguaauguuacauacaagugaacauggaggcagggcauaccgccaugcuguagaggaguuaccugagaccauggagacacucuuacuucuuggacucaugauucuguuaaccgguggagcuaugcuguucuugauaucagggaaaggcauaggaaaaacuagcauaggacuuauaugcguaauugcuaguucagggauguuauggauggcggaaauaccccuucaauggaucgcaagcgcaauugugcucgaauuuuucaugauggugcuccugauuccugaacccgaaaagcaaagaaccccucaagacaaccaacuagcuuauguuguaauaggaauacuaacuuuagcugcuauaauagcagccaaugaaaugggauuacuagaaacuacaaaacgcgaucuugguaugucgaaggagccagguguagucucaccuacaaguuacuuagacguugaccuucacccggcuucagcauggacauuguacgcugucgcaacuacaguaauuaccccuaugcuaagacauacaauugaaaauagcacagcuaacguuucuuuggcagcaauugccaaccaggcgguaguacucaugggacuagauaaaggauggccgauauccaagauggauuuaggagugccauuacuugcacuaggcuguuauagucaaguaaacccuuuaacacuaacagcagcagucuuguuacugauuacgcauuacgccauaauagguccgggcuuacaagccaaagccaccagggaagcucagaaaagaacagcggcuggaauuaugaagaaucccacaguggauggaauuaugacgauugaccuugauccaguuauauaugauagcaaauuugagaaacaacuuggacaaguuaugcuauuaguauuaugugcaguccaacuacuacuaaugcgcacaucaugggcauuaugugaagcucucacauuagcgaccgggccgauaacaacgcuaugggaaggaagcccaggaaaauucuggaauacuaccauugcagucaguauggccaacauauuucgggguucauacuuggcuggcgccggguuagcauucucuauuaugaaaagcguugggacugggaaacgaggaacagguucacaaggagagacccuuggagaaaaguggaagaagaaacuaaaccaacuuucucguaaagaauuugacuuguacaagaaaucagguauuacugaaguagaccgcacagaagcgaaggaaggauugaagcgaggugaaauaacacaccacgcaguuucgcgaggauccgcuaaauuacaaugguucguagaaagaaacaugguuauuccagagggaagaguaauagauuuagguugugguagaggaggauggaguuauuauugugcuggucucaagaaaguaacggaggugagaggauacacuaagggagggccgggacaugaggaaccaguacccaugucaacauacggcuggaacauagucaaguuaaugucagguaaagaugucuuuuaucuaccgccagaaaaaugugacacucuccuaugugacaucggggaauccagcccaucaccaacaguggaagaaaguaggacaauaaggguauuaaaaauggucgaaccuuggcugaaaaauaaucaauucuguauuaaaguguuaaaucccuauaugccaacaguaauagagcaucuggaacgguuacagaggaaacauggcgggaugcuagucagaaauccacuuuccagaaauaguacccaugaaauguauuggauuucuaaugguaccgggaacauuguugcaucagucaacaugguaaguagacucuuauugaauagguucacaaugacacauaggagacccaccauagaaaaagauguagacuuaggcgccgggacccgacauguaaaugcugagcccgaaacaccaaauauggauguuauaggugaacgaauuaaacgcaucaaagaggaacauaauucaaccuggcauuaugacgaugaaaaucccuacaaaacuugggcguaucacggcucguaugaaguaaaagcaacagggucagccaguucaaugauaaacggaguagugaaauugcuaacaaaacccugggaugucgucccuauggugacacaaauggcaaugaccgacacaacaccuuuuggucaacaaaggguguucaaagaaaaaguagauacccguacaccccgaagcaugcccggcacgagacgaguaaugggcauaacugcagaauggcucuggaggacacucggcagaaauaagaaaccgagacuuuguacaagagaagaguucacuaagaaagugcguacaaaugcugccaugggagcuguauuuacugaagaaaaccaaugggacagcgcaaaggcugcaguugaggacgaagacuuuuggaaguuaguugaucgagagagagaacuccacaaauuagguaagugcggaucaugcgucuacaacaugaugggaaaaagagagaagaaacugggagaauuuggcaaagcaaaagguucacgcgcaaucugguauauguggcuuggcgcgcgauaucuagaauuugaagcgcuaggcuuucugaaugaggaccauugguuuucaagggaaaacucauacucuggaguagaaggugaaggacugcacaaauuaggguauauauuaagagauauaucaaaaaucccugguggugcaauguaugcagacgauacagcagggugggacacacgaauuaccgaagacgaccuacauaacgaagagaaaaucacacagcaaauggacccagagcacagacaguuagcaaacgcaauuuuuaaauuaacauaccaaaauaaagucguaaagguccaaagaccuacaccuacaggaaccgucauggacauuauaucaagaaaggaucaaaggggaucagggcaaguugggacauauggacuaaauacguuuaccaauauggaggcccaguuaauacgacagauggaaggagaagguguauuaagcaaagcugaucuggaaaacccucauuuacccgaaaagaaaauuacacaauggcuugaaacaaaaggaguugagaggcuuaaaaggauggcuauaucgggugacgacugcguuguuaaaccuaucgaugacagauucgcuaaugcauuguuagcccuuaaugacauggggaagguucguaaagacauaccgcaauggcaaccgagcaaaggauggcaugacuggcagcaaguuccguucuguucccaccauuuccaugaacuaauuaugaaagacggaagaaagcuaguaguaccgugucggccgcaagaugaacugaucggucgagcacgaauuucucaaggagcuggauggucauugcgggagacagcgugucucggaaaagcauacgcgcaaauguggaguuuaauguacuuucaccguagggaucuccgauuagcaagcaacgccauuuguucagcuguaccaguccauuggguaccaacaagccgcacaaccuggucaauucaugcacaccaucaauggaugaccacagaagacaugcuaacagucuggaacaggguuuggauugaagauaauccauggauggaagauaaaacaccaguaacaaccugggaaaauguaccuuaccucggaaaaagagaagaccaauggugcggaucgcucauuggucuaacaagucgagcgacaugggcucaaaauauaccuacugcuauucaacaaguacgaaguuugauagggaacgaggaauuucucgacuacaugccaucaaugaaacguuuuaggaaagaagaagaaucugagggcgccauaugguga

SEQ ID NO: 23013 - RNA, 9873 nt, Artificial Sequence
  derived and/or modified CDS sequence (opt6) from DENV-3__KT726347__SS-prME
acaagccugugucuuaugaugauauuaccagcagcgcuugccuuccacuuaacuucacgcgacggugaaccacguaugauaguaggcaaaaaugaaagggggaaaucacuuuuguucaaaacggcuucaggaauaaauauguguacguugaucgcaauggaccuaggagaaaugugugaugacacagucacauauaaauguccucauaucacugaaguagaaccugaagauauugacuguugguguaauuuaacgaguacuuggguaacauauggaacauguaaucaagcaggagaacacagaagggauaaacgaagcguagcuuuggccccacacguggguaugggauuagacacacgaacccaaaccuggaugucagcagaaggagcguggagacaaguagaaaaaguagaaaccugggcuuuaaggcauccgggauucacaauauuggcauuauuucuagcucauuacauuggcaccucauugacacaaaaaguagucaucuuuauucuuuuaaugcuaguaacgccgaguaugacuaugagaugcguaggugucggaaacagagauuucguugaagguuugaguggugcaaccuggguggaugucguauuggaacacggaggauguguaacgaccauggcuaaaaauaaaccgacccuugacaucgaguuacagaaaacggaagcaacucaacuagcaaccuugagaaaacuauguauagaagguaaaauuacuaauauaacaacagacagucgguguccuacacaaggagaagcuguacugccagaagaacaagaccaaaacuaugucugcaaacacacuuacguggacagggguugggguaaugguugcggauuguuugguaaagggucucuagucacgugcgccaaauuucaaugcuuggaaccuauugagggaaaaguugugcaauaugaaaacuuaaaauacacugugauaauaacgguccauaccggcgaccaacaccaaguaggaaaugaaacgcaaggaguaaccgcagaaauaacuccucaagcaagcacuacggaagcgaucuuaccggaguaugggacguugggacuagaauguagcccgagaacaggauuagacuuuaaugagaugauacuuuuggcaaugaaaaacaaagcauggaugguucaucgacaaugguuuuucgaucuucccuuaccauggacaucaggagcgacgacugagacuccgacuuggaauagaaaagaauuauuaguaacauucaaaaaugcgcaugccaagaaacaagaaguugucguacuuggaagccaagaaggugcuaugcacacagcgcugaccggagcgaccgaaauacaaaacucaggcggaacgaguauuuucgcaggacauuuaaaaugcagacucaaaauggacaaauuggaauuaaaagggaugucauacgcaauguguacaaauaccuucguacucaagaaagaagucucggaaacacaacacgggacgauucuuauaaagguagaauauaagggagaagacguacccuguaagauacccuucuccacggaagauggucaggguaaggcccauaacggcagauugauaacugcaaacccaguuguaaccaaaaaggaagaaccuguaaacaucgaagcugaaccuccuuucggugaaagcaauauaguaauagguauuggagauaacgccuugaaaauaaauugguacaaaaaggguagcagcauaggcaaaauguuugaagccacagcucguggcgcgagacgaauggccauccuuggcgacaccgcaugggauuucggcagcguaggcgguguacuaaauucucugggaaagaugguacaucaaaucuuuggaagcgccuacacagcacuuuucagcgguguaucuugggugaugaagauagguauuggaguccucuugacguggauuggacuaaacuccaagaacacgagcaugaguuuuucauguauagcuauaggaauuaucacuuuauaucugggagcaguugugcaggccgacaugggaugugugauuaauuggaaaggaaaagagcuaaaguguggcuccgguaucuucguuacuaaugaaguacauacauggaccgaacaauauaaauuccaagccgacagccccaagcgacucgcuacagcgauagcaggagcaugggagaauggagucuguggaauaaggucuacuacgagaauggaaaauuuacucuggaaacagauugcuaaugaacuuaauuauauauuaugggagaacaacauaaaauuaacggucguugugggagauauaauuggcgugcucgagcaaggaaagcggacauuaacaccccaaccaauggaacuuaaauauagcuggaaaacaugggguaaagcaaaaauaguuacggcagaaacucaaaacaguuccuuuauuaucgacgggccuaauacaccagaguguccaagcgccuccagagcauggaaugugugggagguagaagauuacggauuuggcguuuuuacaacaaacaucuggcucaaguuacgagagguauauacucaauuaugugaucacagacuuaugagugcagcaguaaaagaugagcgagcaguacacgcagauauggguuauuggauagaaucacagaaaaacggaaguuggaaacuggagaaagcgucucuaaucgagguuaaaacuuguacuuggccgaaaucacacacauuauggucaaaugggguccuagaguccgauaugauaauuccaaaaucuuuagcaggaccuauuucgcaacauaaucaucgcccuggguaucacacacaaacagcaggaccauggcauuuagguaagcuagaguuggauuucaauuauugcgaagguacgacuguaguuauaacagaaaacugugguacgagggggccgagccuaagaacaacuacuguaucaggaaaacugauacacgaaugguguuguaggaguuguacucuaccaccccuaagguacaugggagaagacggguguugguauggaauggagauaaggccgauaagugagaaagaagaaaauauggugaaaagccuagugagugccggaucugggaaaguggacaacuuuacuaugggagugcuaugucuagcgauacuuuuugaagaaguuaugagaggaaaguuuggcaagaaacauaugauagcgggaguauucuuuacauuugucuuacuauuauccgggcagauuacuuggagggauauggcgcacacgcuaauaaugauaggaagcaaugcaagcgacaggaugggaaugggugugacauaccuugcgcuaauugcuacauuuaagauacaacccuucuuggcauuagguuucuuuuuaagaaaacuaacgucgagagaaaacuuauugcuugggguaggguuagcaauggccacgacucugcaacuaccagaggauauagaacaaauggcaaacgguaucgcauuaggacuaauggcuuugaaacuuauaacacaauuugagacuuaccaacucuggaccgcacugauuucauugaccuguagcaauaccaucuuuacucuuacagucgcuuggcguacugccacucuaauuuuagcuggagucucauuauugccaguaugccagucgaguaguaugcgaaagacagacugguugccaauggcaguagccgcaaugggagugccaccguuaccucuuuuuaucuucaguuuaaaagauacauuaaagagacgaaguuggccacuuaacgaaggcguuauggcaguuggucuaguaucaauucuugcgaguucguuacuucggaaugacgucccuauggccggaccauugguugccggaggccuuuuaaucgcuuguuaugugauuacaggaacgucugcugaucucacaguagaaaaggcagcagauauuacaugggaagaagaagccgagcaaacaggagugucacauaaccuaaugauuacaguagaugacgaugggacaaugagaauuaaggaugaugagacagagaacauucuuacuguauuacuaaaaacggcauuguuaauuguaucuggaauauuuccauauagcauaccggcuacguuauuaguauggcacacauggcaaaaacagacccaacggucaggaguucucugggacguacccagcccuccugaaacgcaaaaagcugaacuugaggaaggaguauauagaauuaaacaacaaggcaucuucgguaaaacacaaguugggguagggguucagaaagagggaguuuuucacacuauguggcauguaacaagaggugccguguugacacauaaugguaaacguuuggagccuaauugggcaaguguuaagaaagauuuaauuagcuauggcgguggauggcgccuuagcgcacaauggcaaaaaggggaggaagugcaaguaauagcaguggaaccagguaaaaacccaaagaacuuccaaacaaugcccggaacguuccaaacaacaacgggagagauaggcgcgauagcucuggacuuuaaaccaggaacauccggaucccccauuauuaacagagagggcaaaguagucggucuuuacggaaauggugucgugacgaaaaauggaggauacgucagugggauagcacaaaccaacgcagaaccagacggaccaacuccagaacuagaagaagaaauguucaagaaacggaauuuaacuauaauggaucuucauccuggaucgggaaaaacuagaaaauacuugccggcaauaguacgagaagccauuaaaagacgacuaagaacacuaauucuagcacccacacggguuguagcagccgaaauggaagaagcccugaagggauuaccaauacguuaccaaacaaccgcaacaaagucugagcacaccgguagggaaauaguagauuuaaugugccaugcuacauucaccaugagauuguugucgccgguuaggguaccaaacuacaaucuaaucauuauggaugaagcacacuuuacggacccggcaucaauugccgcacguggcuacauaaguacuaggguagguaugggagaagcggccgcaauauuuaugacagcgacuccucccggcacagccgacgcuuucccacaaucgaacgcuccaauccaagaugaagaaagagauaucccagaaaggaguuggaacaguggcaacgaguggauaacggauuucgcagggaaaacaguuugguuugucccuucuauuaaggcaggaaacgauauugcaaauugcuuaaggaaaaaugguaaaaagguaauacaauuaaguagaaaaacauuugacaccgaauaccagaaaacuaagcuaaacgauugggacuuugugguuacaacggauauaucagagaugggagcuaacuuuaaggccgaccgaguaauugauccgagacguugccugaagccagugauacuuacugauggucccgagagagucauccuagcgggcccaaugccaguaacagcagcaucggcggcgcaacgacgaggucgcguaggccggaauccacagaaagaaaaugaucaauacauauucacaggucagcccuuaaauaaugaugaagaucacgcacacuggacugaagccaaaaugcuauuagacaauauaaacacccccgaaggaaucauucccgcacuguucgagcccgagagagaaaagucagcagcaauagauggggaauaucgucugaaaggagagagccgaaagacuuuuguggaacuuaugagacggggugauuuaccgguuugguuagcccacaaaguugcuagugagggaaucaaguauacggaucggaaauggugcuucgauggucaaagaaauaaccaaauucuggaagaaaauauggauguagagauauggacgaaagagggagaaaagaagaaauuaagaccacgauggcuagacgcacgaacauacucggauccucucgcucuuaaggaguucaaagacuucgcggcaggaagaaaaucgauugcuuuggaccuaguaacggagaucggacgagugcccucacaucuagcgcauagaacacggaacgcuuuagauaauuugguaauguuacacaccuccgagcacggcggccgagcauauagacacgcaguugaggaauugcccgaaacaauggaaacauuauugcugcuagggcuaaugauacuucucacugguggagcgauguuauuucuaaucagcgguaaagguaucggcaagacgucuauagggcuaauuugugugauagcaucaaguggaauguuauggauggccgagauacccuugcaauggauagcuucagccauuguauuagaauuuuucaugaugguguugcucauacccgaaccugagaaacaaaggacuccccaagacaaucaacuagcuuaugucguaaucggcauauuaacacuagcagcgauuauugcagcgaaugaaaugggauuauuagagaccacaaaaagggaucuuggaauguccaaagaaccuggcguugucucaccaacaucauaucuagacguagauuuacauccugcaucagcauggacuuuauaugccguggcaacuacuguuauaacuccaauguugcgacacacgauugagaacuccacagcaaacguaucccuagcagcaauugcuaaucaggcaguaguacugaugggcuuggacaaagguuggccaauaucaaaaauggaucuaggugucccacuguuagcgcucggauguuauucacaaguaaauccccuuacgcuaacagcagcagugcuuuugcugauaacccauuacgcaauaauaggaccaggucuacaagcuaaggcaacccgagaagcccagaaaagaaccgcagcugguauuaugaaaaacccuacaguugaugguauaaugaccauagacuuagauccggucauuuacgauagcaaauucgagaaacaacugggucagguaauguuauuaguacuaugugccguucaacuuuuacucaugaggacaucuugggccuuaugcgaagccuuaacucuagcaacuggaccaaucacaacacuuugggaaggcuccccagguaaguuuuggaauacaaccaucgcugugaguauggcuaauauauuuagaggguccuacuuggcaggggcuggauuggcauucaguauuaugaaaucaguaggaaccggaaaaagggggacaggaucacaaggggaaacauuaggagaaaaguggaagaagaaauugaaucaguuauccagaaaagaauuugacuuguacaagaaaucggguauuacagaaguugauagaacagaggcaaaagagggguugaagagaggugaaaucacucaucaugcagugucuagaggcagugcuaaacuucaaugguucgucgaacgaaauauggugauaccggaaggucgcguuauugauuuaggcuguggcagaggaggauggaguuacuacugcgccggucuaaagaaagucacggaaguacguggguacacgaaagguggacccgggcaugaggagccagugcccaugucaacuuaugguuggaacauuguaaaacugaugagugguaaagacguauucuaucuaccaccagaaaaaugcgauacgcuucuaugcgauauaggugaguccucuccgucaccaacaguagaagagucgagaacgauuagagugcuaaaaaugguggaaccauggcuuaaaaacaaucaauucuguauuaaaguauuaaacccuuauaugccuacuguuauugaacaucuagaaagauuacaacggaaacaugggggaauguuaguaagaaauccuuuaucaagaaauucgacacacgaaauguauuggauaucaaauggaacggggaacauaguugcgagcguuaacauggugucgagauugcuuuuaaacagauucacaaugacacacagaagaccgacuauugaaaaagauguugaucuuggggcuggaacacgacacgugaacgccgaaccggagacgccuaacauggauguuauaggagaaagaauaaaaagaaucaaagaagaacauaacucaacguggcacuacgaugaugagaacccuuauaagacaugggcuuaucauggcucauacgaaguaaaagccacaggauccgcuuccucaaugaucaacgguguaguuaagcuauuaacaaaaccgugggauguggucccgaugguaacgcaaauggcgaugacagauacaaccccauuuggucaacaacgcgucuuuaaggaaaaaguugauaccaggacuccacguagcaugcccggcacuagaaggguaaugggcauaacagccgaauggcuuuggaggacguuaggccgaaacaagaaaccaaggcuuuguacgcgugaagaguucacuaagaaagucagaacuaaugcagcgaugggcgcaguguuuacugaagaaaaucaaugggacuccgcgaaagcugcagucgaggacgaagauuuuuggaaauugguugacagagaaagagaauuacacaaauuaggcaagugcggaucauguguuuauaauaugaugggaaagagagagaagaaauuaggcgaguucgguaaggcaaaaggcucaagagcuaucugguauauguggcugggcgcgagauacuuggaguuugaagcguuaggcuuucuuaacgaagaccacugguucagucgugaaaacucauauucgggcguagaaggggaggguuuacacaaacucggguacaucuuaagagauaucagcaaaauaccugguggggccauguacgccgacgauacugccgggugggauacccguauuacggaggaugaucuacauaaugaagagaaaauaacccaacaaauggauccagaacacagacaauuagcaaaugcuauauucaaacuaacguaucagaacaaagugguuaaaguucaacguccaacaccaacaggcacuguaauggauaucauaucuagaaaggaccaaagaggcucugggcaaguaggaacguacggcuuaaacacuuuuacuaauauggaagcacaacucauaagacaaauggagggagaaggcguccuaucuaaagcugauuuagagaacccgcaucuaccagagaagaaaaucacacaauggcuugaaacaaaagguguggagcgacucaaacgaauggcaauuagcggcgacgauugugucgugaaacccaucgacgaccgcuucgcaaaugcacuucuagcauuaaaugauaugggaaaaguuaggaaagauauaccacaguggcaaccuagcaaaggauggcaugauuggcaacaaguaccuuucuguagucaccauuuucaugaacuuauaaugaaagacggucggaaauuggucguuccauguagaccacaagacgaacucauugguagggcuaggauuucucaaggggccggauggagucuuagagaaacugcuuguuuaggaaaagcauaugcucaaaugugguccuuaauguauuuccauaggcgcgauuugcguuuagcaucaaaugcuaucuguagugcuguaccgguacauuggguaccaacuagccggacgaccugguccauccacgcucaccaccaauggaugacgacagaagacaugcuaacaguuuggaaucguguuuggauugaagauaaucccuggauggaagauaaaaccccugucaccacuugggagaauguuccuuauuuagguaaaagagaagaucaguggugcggaucucugaucggucuuacgagcagagcaaccugggcacagaauauaccuaccgcaauucagcaaguaaggagccugauagguaaugaggaguucuuagauuauaugccgucaaugaaacgauuccggaaagaggaagagagcgagggugcuauuugguaa

SEQ ID NO: 23014 - RNA, 9873 nt, Artificial Sequence
  derived and/or modified CDS sequence (opt6) from DENV-3__KT726352__SS-prME
acuucuuuaugcuugaugaugauacucccagcggcguuagcuuuucaccuaacaaguagagauggagaaccuagaaugauagucggcaaaaaugaaagaggaaaaucauuauuguuuaaaacggcuagugguauuaauaugugcacauuaaucgcaauggauuuaggugaaaugugugaugacacugucacuuacaaauguccacacaucacagaaguggaaccugaagauaucgacuguugguguaaccuaacaaguacuuggguuacauaugguacauguaaccaagcgggagaacacagacgagauaaaagauccguugcacuagcaccccauguaggaaugggacuggacacaagaacucaaacauggaugucugccgagggcgcauggcggcaaguugaaaaaguggaaacuugggcacugagacaccccgguuucacuauauuagcucucuuccuagcgcacuauauaggaacaagucuaacgcaaaaaguuguuauauuuauauuacuaauguuaguuacacccucaaugacgaugaggugugugggagucgguaacagagauuucguagaaggacugucuggcgcuacaugggucgacgucguuuuagagcacggaggcugcguaacaacaauggccaaaaauaaaccgacguuggacauugaacuacagaaaacugaagcgacucaguuagccacgcuucguaaacuuuguaucgaagguaaaauaacaaauaucacaacugauaguagguguccuacacagggugaggccguacucccagaagaacaagaucaaaacuacguuugcaaacauacuuauguggacagaggaugggguaacggauguggacuauucggaaaaggcagucucguuacaugugccaaauuucaauguuuagagccgauugaaggaaaaguaguacaauaugaaaacuugaaguauacaguaauaauuacuguccauacuggggaccagcaucaaguagguaacgaaacccaaggaguuacagcugagaucacaccgcaagcguccaccaccgaggcaauacuacccgaauauggcacacuagggcuagagugcuccccacgaacagguuuagacuuuaaugaaaugauauuacugacaaugaaaaacaaagcauggaugguacauagacaaugguucuuugauuuaccacuacccuggacuucaggagcaacaacagaaacgccaaccuggaaucguaaagaauuguuagucacuuucaagaacgcacaugcuaaaaagcaagaaguuguaguacuaggaagucaagagggagcuaugcauacagcuuuaacaggcgcuacagaaauacagaauagcggagguacaucaauauucgcuggacauuugaaaugccguuuaaagauggacaaacuagaacuaaaaggaaugagcuaugcgaugugcacgaauaccuucguuuuaaagaaagaaguaucagaaacacagcacgggaccauuuugauuaaggucgaauacaaaggcgaagacgucccgugcaaaauaccguuuucuaccgaagauggccaaggcaaagcucauaauggaagacuuauuaccgcuaauccaguuguuaccaagaaagaggaaccagugaauauagaagccgaaccgccuuuuggggaaucaaauauuguaauugguaucggugacaacgcauugaaaauaaacugguauaagaaaggcaguucaauugguaaaauguucgaagcgacugcaaggggagcaagaagaauggcuauacucggugauacagcaugggacuuuggaucuguuggaggaguguuaaauucguuaggcaaaaugguucaucaaauauuuggguccgcauacacagcauuguuuagcgguguaucuuggguaaugaaaauaggaauaggaguauuacuaaccuggauaggucugaacucgaaaaauacaucaauguccuuuucgugcauugcaaucggaauaaucacgcuauacuuaggagccgucguacaagcagacaugggaugcguaauaaacuggaaggguaaagagcuaaaauguggaucuggcauauuugugacuaacgaagugcauacguggacugaacaauauaaauuucaagcggacucuccuaagagacuagcgacagccauugccggcgcaugggaaaacggcguaugcggaauacgguccacaacucguauggagaauuugcuguggaaacaaauagccaaugaguugaauuacauauuaugggaaaauaauauuaaacuaacgguuguggugggggauauuauuggaguccucgagcaagguaaaagaacucuuacaccacaaccaauggaauuaaaauauucuuggaaaacauggggaaaagccaaaauaguaacagccgaaacgcaaaacucaucguuuauaaucgaugguccuaauacaccugaauguccuucggcuucuagagcauggaauguuugggaaguugaggauuauggcuuugggguauuuacaacaaauaucugguuaaaacugcgagaaguguacacacaauuaugugaucacaggcuuaugagugcagcaguuaaagaugagcgagcuguacaugcggacaugggauauuggauagaaucgcaaaagaauggcucauggaaauuggaaaaggcuagcuugauugaagucaagacauguacauggccuaaaagucauacacuuuggagcaauggcgucuuagaaucugacaugauuauuccaaagucguuagcggggcccauuucucaacauaaccaucguccgggauaucauacacaaacugcgggaccauggcauuuaggaaaauuggaacuagacuuuaauuauugugaggguacaaccgugguaauuacggaaaauuguggaacaagaggcccuucacuacggacgacuaccguuucaggaaagcuaauacacgaaugguguugcagaaguuguacuuuaccuccauuaagauauaugggugaagacggcuguugguacggcauggagauuagacccauuucagagaaggaagaaaacauggucaaaucacuugugagugcaggaaguggaaaaguugauaacuuuaccaugggcgugcuaugccuagcaauacuuuuugaagaggucaugagagguaaauuugggaaaaagcauaugauagcuggaguauucuuuacguucguguuacuacuauccggacaaauaacguggagagauauggcccacacauugauaaugauuggaucgaaugcgagugauagaauggguaugggagugacuuaccuugcucuaauagccaccuuuaaaauccagccguucuuagcucuaggauuuuuccuaaggaaauuaaccucacgggaaaauuuauuauuagggguaggcuuagcaauggcgacuacgcuacaauugccugaagauaucgaacagauggcaaacggaauagcauuaggucuuauggcucuuaaacucaucacccaauuugagacauaucagcucuggacagcucuaauuucgcuaaccuguucaaacacaaucuuuacacuuacaguugccuggcgcaccgcaacuuugauucuggcuggagugagucuguugccagugugucaaucaaguucgaugagaaaaacagacuggcuuccaauggcuguugccgcgaugggcguacccccacuuccacuguuuaucuucucccuaaaagacacucugaaaagacgaucguggccacuuaaugagggcgucauggccgugggguuagugucaauacuugcgagcucccuguuaagaaaugacguucccauggcggggcccuuagucgcaggaggucucuugauugcuugcuacgugauaaccggaacgagcgcagacuugaccguagagaaagcugcagacauaacaugggaagaggaagcagaacaaacaggugucucacacaaucuaaugaucacgguggacgaugauggaacaaugcgcauaaaagacgaugaaacagaaaauauacucacaguacuauuaaaaacagcccuauugauaguuucagguauauuuccauacuccauccccgccacgcuuuuaguauggcacacauggcagaaacaaacgcaaagaagugguguccuaugggaugugcccaguccgccagagacgcaaaaagccgaacuggaagaaggaguauaccgcauaaaacagcaaggaauauuugguaaaacacaagugggagugggaguccaaaaagaagggguauuucacacuauguggcacgugacuaggggugcuguguugacgcacaacggaaaaagauuagaaccaaauugggcgaguguuaaaaaggaucuuauaucuuacggggguggauggcgacuauccgcacaguggcaaaagggagaagagguucagguaauugcuguugaaccuggcaaaaaccccaaaaauuuccaaacgaugccaggcacguuucaaacgacuacaggagaaauaggggccaucgcgcuagauuucaaacccggaacuucuggcucaccaauaauuaacagagaaggaaagguaguuggacucuaugguaauggaguaguaaccaaaaacggaggguaugucaguggaauagcccaaaccaaugcagagccggaugguccuacaccagaauuagaagaggaaauguuuaagaaacgcaaccugacgaucauggauuugcacccgggcucuggcaagacacguaaauauuugccugccauaguaagagaagccauuaaacggaggcugagaacauugauucuagcaccgacaagaguaguggcagcggaaauggaagaggcuuugaaaggacuuccuaucagauaccaaacaaccgcuacaaaaagugaacacacgggcagggagauaguagacuuaaugugccaugcaacguucacuaugcgcuuauuaucgccaguucgggugccaaauuauaaucucauaauuauggaugaagcacacuucaccgaccccgcauccaucgcagcaagaggauauauuaguacacgagugggaaugggggaggcugccgcuauuuuuaugacggcgacacccccagguacagcggacgcauuuccacaaagcaaugcaccaauacaagaugaagaaagggacaucccagaacgaucuuggaacagcggaaaugaauggauaacagacuucgcuggcaaaaccguaugguuugugccaagcauaaaagcaggaaacgauauagcgaauugccuuaggaaaaacggaaagaaagugauccaacugucccgaaaaacauuugacacugaauaucagaagacuaaguuaaaugacugggacuuuguggucacaaccgauauuucagaaaugggagcuaauuuuaaagcagauagaguuaucgauccaaggcgcugucuuaaaccaguuauacuaacagauggaccagagagaguaauuuuagcugggccaaugccagucacagccgccagugcugcucaacgaagaggacguguaggcagaaacccgcaaaaagaaaaugaccaguauauauuuacgggucaaccauuaaacaaugaugaagaucaugcacauuggacagaagcuaaaaugcuauuggauaacauaaauacgccugaaggaaucauaccagcacuuuuugaacccgaaagagagaaaagcgcagcaauagauggcgaauacagguugaaaggagagucuagaaagaccuucgucgaauuaaugcggcgaggugaucugccuguaugguuagcacacaaaguagcguccgaaggcaucaaauauacggaucgaaaaugguguuuugacggacagcggaauaaucagauauuggaagaaaacauggauguugaaauauggacuaaggaaggugaaaagaagaaacuucgaccgaggugguuagaugcaagaaccuacucagacccucuagcauuaaaagaauuuaaagauuuugcugcggguagaaaauccaucgcucuugaucugguaacggaaaucggacggguucccagucaccuugcacauaggacuagaaaugcucuggacaacuuaguuaugcuacauacgucagaacacggcggaagggcguaucgacacgcaguggaagaguuacccgagacgauggagacuuuacuuuugcuaggccuaaugauauuacucacgggaggagccaugcuauuucucauuucgggaaaagggaucggaaagacaaguauuggacugauuugcguaauugcaucaagcgggauguuauggauggcagaaauuccccuacaauggauagccagugcgauaguucucgaguucuuuaugauggucuuauuaauuccagaacccgaaaagcagcgaacaccgcaggacaaucaacuugcauauguaguaauagguauacuuacuuuagcagcuauuauagcagcaaaugaaaugggccugcuagaaacaaccaaacgugaccuaggaaugaguaaagagccgggaguggucucaccgacaucauauuuagauguagaccuacacccagcguccgcuuggacccuauaugccguagcaaccaccgugauaacuccaaugcugcgucauacaaucgaaaauagcacagccaacgugagucuagccgcuauagccaaucaagccguaguguugauggggcuugauaaagguuggccuauaaguaaaauggaccugggugucccuuugcuagcacuaggcuguuauucucaggugaacccucuaacauuaacggcagcuguacuuuuauuaauaacacauuacgcuauaaucggaccaggacuacaagcuaaagcaaccagagaggcucaaaaacgaacugcagcaggaaucaugaaaaauccuacaguugauggaaucaugaccauagacuuagacccugugaucuaugacaguaaguuugagaaacaacugggacaaguuauguuauuagucuugugugcugugcaacuuuuauugaugcguacuucgugggcauuaugcgaggccuuaacucuugcgacagggcccauaacuacguugugggaagguucuccgggaaaauuuuggaacacaacaauagccguaagcauggcaaauauuuuccgaggaucauauuuagccggggcuggguuagcuuucaguauuaugaaaucaguaggaacuggcaaaagagggacaggcagucaaggagaaaccuuaggugagaaauggaagaagaaacuuaaucaacuaaguaggaaagaauuugacuuauacaagaaaagugguauaacugaaguagaucguacggaagcgaaagaaggacucaaaaggggagaaauaacccaucacgcaguaucaagggguucagcuaaacuucaaugguucguugaacggaauaugguuauaccugaggggagggucaucgauuuagguuguggaagagggggauggagcuauuauugcgcaggacuaaagaaaguuacugaaguuagaggauauacuaaaggaggacccggacacgaggaacccgugccaaugaguacuuacgguuggaacauagucaaguuaaugaguggaaaagacgucuuuuaccuucccccugaaaaaugugacacccucuugugcgacaucggcgaaucuucacccuccccuacagucgaagagucaagaacuauacgaguucuuaagaugguugaacccugguugaaaaacaaucaguuuuguauaaaaguacucaaucccuacaugcccacuguuauagaacaccucgaaagacuacagaggaaacacgggggcauguugguacggaauccauuaucgaggaacucuacgcacgaaauguauuggauaucuaacggaaccggaaauauaguggcgaguguuaacaugguaaguagguuguuacuaaaucgauuuacuaugacacacagacgaccagcaauugaaaaggauguggaucugggcgcggguacacggcacgugaaugcagaaccagagaccccaaacauggacgugauuggggaacgaauaaagcgcaucaaagaagaacauaauaguacauggcacuaugaugaugagaacccauauaaaaccugggcuuaccacggcucauacgaaguuaaggccacaggcagcgcuucgucaaugaucaacggaguuguaaaacuuuuaacuaagccuugggaugucgucccgaugguaacacaaauggcgaugacugauacaacacccuuugggcaacaaagaguguuuaaagaaaaaguugacacucguacacccagaucaaugccugggacacgacggguaaugggcaucacagcagaguggcuauggagaacacuggggcguaauaaaaagccucgauuauguaccagggaagaauuuacgaagaaagucaggacaaaugcggcaaugggagccguuuucacggaagaaaaucagugggauagugcuaaagcagcuguugaagaugaagauuuuuggaaauuaguugaccgagagagagaacuacacaaauuagguaaauguggaucauguguauauaauaugaugggcaaacgggagaagaaauugggcgaguucgguaaagccaaggguagccgagccaucugguauauguggcugggugcaagauauuuagaauuugaagcgcuaggguuuuuaaaugaagaccauugguucaguagggaaaauagcuacuccggcgucgaaggagaaggucuacauaaauuaggauacauuuugagagauauuuccaaaauuccgggaggcgcaauguaugcugaugauacagcaggcugggauacgagaauuacugaagaugaucugcacaaugaggagaaaauuacacaacagauggauccugaacauagacaauuagcaaacgcgaucuuuaaauuaacauaccaaaauaaaguaguaaaagugcaaagacccacaccgacaggcacaguaauggauauaauuagcagaaaagaucaaaggggcuccggacaaguaggaacauacggacuaaacacauuuacaaauauggaggcacagcuuauacgacaaauggaaggugaaggaguccuaucaaaggcagaucuugaaaauccccacuugcccgaaaagaaaauaacccaguggcuugagacaaaaggaguugaacguuuaaaaagaauggcgauaaguggagacgacugcguuguuaaaccaauagaugauagauuugcaaaugcgcuauuagcgcugaacgacaugggcaaagugagaaaagauauaccccaauggcagcccucaaaaggcuggcaugacuggcagcagguaccauucuguagccaucacuuucacgaacucaucaugaaggauggccguaaacucgugguaccuugcaggccacaggaugaacugauagggcgagcacgaauaucacaaggagcaggguggucauuacgugaaacagccugucuggguaaagcauacgcccaaauguggagcuuaauguauuuccaccgacgggauuuaaggcuugcgucaaaugcuauauguucagcaguaccagugcacuggguaccaacuucacguacuacauggagcauacacgcacaucaccaauggaugacgaccgaagauaugcucacaguauggaaccgugucuggauugaagacaauccguggauggaggauaaaaccccaguaacaacuugggaaaauguuccauaccuaggaaaacgagaagaucaauggugcgguaguuuaaucggcuuaacgucucgagcuacuugggcacaaaauauaccaacggccauacaacaaguuagaucucuuauugguaaugaagaauuucuagauuauaugccaucuaugaaacgcuuuaggaaagaagaagagagugaaggagccauuugguaa

SEQ ID NO: 23015 - RNA, 9873 nt, Artificial Sequence
  derived and/or modified CDS sequence (opt6) from DENV-3__KT726356__SS-prME
acaaguuuauguuuaaugaugaucuuaccagcugcauuagcauuucaucuuacuucgcgugacggugaaccgagaaugaucguggguaaaaacgaacgcgguaaaagccuucuauuuaaaacugcgagcgguaucaacauguguaccuuaauagcgauggaucuaggggaaaugugugaugauaccguaaccuacaaaugcccacauauaacugaaguggaaccagaagauaucgauugcugguguaacuuaacaucuacaugggucacuuaugguacuuguaaucaagccggagaacaucgucgagacaaacgaucuguugcucuugcgccacacguuggaauggggcuagauacaagaacacaaacuuggaugagcgcugaaggugcauggcgucaaguugaaaaaguagaaacaugggcauuacgccauccaggcuuuacaauccuagccuuauuuuuggcccacuauaucggaacaucucugacacaaaaaguagucauuuuuauacuacuuauguuagugacaccaucuaugacgaugaggugcguagggguugggaaccgagauuucguggaaggccuuucgggagcaaccuggguugauguaguauuagaacaugguggaugugucacaacaauggcgaaaaauaaaccaacuuuagauauagaauuacagaaaacggaagcaacgcaauuggcgacacuuaggaaauuaugcauagaaggaaaaauuacaaauaucaccacagacaguagguguccaacacaaggagaagcgguauuacccgaagaacaagaucaaaauuacgucugcaaacauacauacguagauagaggauggggcaaugguugcggguuauuuggaaaagguucgcuaguaacaugcgcaaaauuucaaugccuugaacccauagaagguaaaguaguucaauaugaaaaucugaaauauaccguuauaaucacugugcacacgggcgaucaacaucaaguuggcaaugaaacccaggggguaaccgccgaaauuacuccccaggcuucgaccacagaagcuauacuaccagaauacggcacuuuaggccucgaauguucaccacgaacgggucuggacuucaacgaaaugauacuucuuaccaugaaaaacaaagcguggaugguucaucgacaaugguucuuugauuugccuuuaccauggacaaguggugcuacuaccgaaacgccuacguggaauaggaaagaauuacuuguaacuuucaaaaaugcucaugccaagaaacaagaaguuguuguuuuggggucccaggagggagcaaugcauaccgcauuaaccggggcuacagagauucagaacucaggcggaacaaguauauuugcaggucaucugaaaugucgacuaaaaauggauaaauuagaauuaaaaggcaugaguuaugcaauguguacaaauacauucguacuuaagaaagaaguuagcgaaacgcaacacgguaccauccuaauuaaaguagaauacaaaggagaagauguaccuugcaaaauacccuuuucuacugaagauggccaaggcaaagcacauaauggcagauugauuacagcuaaucccguagucaccaagaaagaagaacccguaaauauugaggccgagccgccuuucggagagucuaauauaguaaucgguauuggggacaacgcauugaaaauuaacugguacaagaaagggucuagcauagggaaaauguuugaagcuacagcccguggugcucgccgcauggccauauugggagacacugcuugggacuucggcucugugggaggaguucuaaauucauuagguaaaauggugcaucaaauauucgguagugcguauacagcguuauucucuggagugucauggguuaugaaaauuggaauaggcguacuuuuaacauggauagguuuaaacuccaaaaauaccagcaugucauuuaguuguauagcuauugggauaauaacacuauaccuaggagcagucguacaggcagauaugggcugcguaauaaauuggaaaggaaaagagcuuaaauguggcucaggaaucuuugucaccaaugaaguccauacuuggacugagcaauauaaauuccaagcugacaguccaaagagauuagcaaccgcaaucgcgggugcuugggaaaacgggguauguggaauaagaucaacuaccagaauggagaaucuucuauggaaacagauagcaaacgaacuaaacuacauacucugggaaaacaauaucaaauuaacaguaguagucggggacauuauaggagugcuagaacaaggaaaacgaacuuuaacuccccaacccauggaacugaaguacaguuggaaaacauggggaaaggccaaaaucguuacagcagaaacacagaauagcucauuuauaauagacggcccgaacacucccgaaugcccaagugccucaagagcauggaauguuugggaaguugaggauuauggauucggcgucuucacaacaaauaucuggcugaaauuaagagagguuuauacucaguuaugugaccauagguuaaugucagcagcuguaaaagaugaaagagcuguccacgcagauauggguuacuggauagaaucacagaaaaaugggagcuggaagcuagagaaagcgaguuuaaucgaaguaaaaaccuguacauggccaaagucgcauacacucuggucuaauggaguauuagagagugauaugauaauuccgaagucacuagcaggaccaauuagccaacauaaccacagaccgggauaucauacacaaaccgcagggcccuggcauuuaggaaaauuagaacuugacuuuaauuacugugaagguacgacggucguuauaacagaaaauuguggcacucgaggcccgagccuaagaacuaccaccguaucugggaaacuuauccaugaaugguguugccguucauguacauugcccccacuaagauacaugggagaagauggcuguugguaugguauggaaauaaggccuauaagugaaaaggaagaaaacaugguaaaaucguuagucucagcagguucgggaaaagucgauaauuuuacgaugggagugcuauguuuagcaauccucuuugaagagguuaugcgaggcaaauucggcaaaaagcauaugauagccgguguauucuuuacauuugucuuauuacuuucagggcagauuacauggcgugauauggcacacacacuuauaaugauuggauccaaugcgucugacagaaugggaaugggugugacauaccuggcguuaaucgccacauucaaaauacaaccauucuuagcccuaggauuuuuccugaggaagcucacaagccgcgagaaucuauuacuggggguuggacuggccauggcaacgacgcuacaacuaccugaggacaucgaacaaauggcgaaugguauagcauuaggcuugauggcguuaaaacuaauuacccaguuugaaaccuaucagcuauggacagcauugauaagccugacgugcagcaauacaauauuuacauuaaccguugcguggagaacugcaacacucauauuagcuggcguaucccuacuuccgguuugccaaucgaguucaaugcggaagacagauuggcuacccauggccguugcggcuaugggaguaccaccacuaccccuguucauauuuuccuuaaaagauacgcuaaaacgacguucauggccacuuaacgaaggggucauggcugucgggcuuguaucaaucuuggccaguagccuucugcguaacgacguucccauggcggguccauuauuggccggagggcucuuaaucgcauguuauguaauaaccggaacaucggcagauuuaacaguagagaaagcagcagauauaacgugggaagaggaagcggaacaaacaggaguuagccauaaucuaaugauaacaguugaugacgauggaacgaugaggaucaaggaugaugaaaccgagaacauccucacaguguuacucaaaaccgcucuuuugauaguuucggggaucuuuccauauagcauaccugcaacgcuauuaguauggcauacauggcaaaaacagacacagagaaguggaguacuuugggauguaccgucacccccggaaacucagaaggcagaauuagaagagggaguuuaucggauuaaacaacaagguauuuuuggcaaaacccaaguagguguaggaguacagaaggaaggaguauuucauacaauguggcaugucacacgaggagccguucuaacucauaacggcaaaagacuagaaccuaauugggccagugugaagaaagaucuuaucuccuauggaggagguuggcgauuaucggcgcaauggcaaaaaggagaagaaguacaaguaauagcgguggaaccaggaaagaacccgaagaauuuccagacgaugccuggaacuuuccaaacaacgacgggggaaaucggagcaauugcccuggacuuuaaaccagguacaaguggaucuccuauuauaaaucgggaaggaaaaguuguaggucuauacggcaacggugucguaacgaaaaacggugguuauguuagcggcauugcacagaccaaugcagaaccugacggacccacuccagaauuagaggaagagauguuuaagaaaagaaaucuaacaauaauggaccuacacccaggaagugguaaaacaagaaaauaccuucccgcaauuguucgagaggcuaucaaacgcagauuaagaacuuugauauuggcacccacaagagugguagcugcagaaauggaggaagccuugaaaggauugccaauccgguaucaaacaacggcuacaaaaagugaacacacuggcagagaaauaguugaccucaugugucaugcgacauucacaaugcgauuauuaagcccaguaagaguuccuaauuauaaccuaauaaucauggaugaagcacauuuuaccgacccggcgaguauugccgcgagaggauacauuuccacucgaguaggaaugggugaggcagcagcaauuuuuaugacugccacaccuccgggaacagcagaugcguucccgcagagcaaugcgccgauucaagaugaagagagagauauaccagaaagaaguuggaacucuggcaaugaguggauaacggacuucgcaggaaagacuguaugguucguucccaguauaaaggcaggcaacgauauagcuaauugucuaaggaaaaauggcaagaaagugauucaauuaagucgcaagacauuugauaccgaauaucagaaaacuaagcugaaugacugggauuuuguggugacuacugauaucucagaaaugggagcgaacuucaaagcggaucgaguaauagauccacguagauguuuaaaaccggugauuuuaacggacggucccgaaagagugauacucgcgggacccaugccgguaacggcggcgagugcugcacagagaaggggacgggucggacguaauccucagaaagagaacgaccaguauauauucacaggucaaccacuaaacaaugacgaggaucacgcacacuggacugaagcaaaaaugcuccucgauaacauaaacacucccgaagguauaauaccggcuuuauucgaaccugaacgcgagaaaagugcugcgauagacggagaauacagacuaaagggagaaagccgaaagacauuuguugaacuaaugaggagaggugauuuaccugucugguuagcucacaaagucgcgagcgaagggaucaaauauaccgacagaaagugguguuuugauggucaacgcaauaaccaaauuuuagaagaaaacauggauguagaaauauggaccaaagaaggagaaaagaagaaacuacgaccucgaugguuagaugcaagaacuuacagcgauccacucgcccuuaaagaguuuaaggauuuugcagcgggaaggaaaaguauagcccuugaucugguaacagagauagguagagucccaucacaccuagcgcaucgaacaaggaacgccuuagauaacuuaguaauguuacacacaucagaacauggaggaagggcauacaggcacgcugucgaagaacuuccggaaaccauggagacgcuguuacuauuaggauugaugauacuccugacagggggagccauguuguucuuaauaucugguaaaggaauaggcaaaacaucgauuggauuaaucugcguaauagcuucaucaggaauguuauggauggcggaaauuccauuacaauggauagcaucagcuauaguauuggaauuuuucaugaugguccugcuaauaccugaaccugagaagcagagaacgccccaggauaaccaauuagccuauguagugaucggaauccuaacauuggccgcaauuauagccgcgaaugaaauggggcuguuagagacaacgaaaagagaccucggcaugaguaaagaaccaggcgugguaaguccaacaucauauuuagaugucgaucuacacccggcgagcgcguggacucucuacgccguggcaacaacagucauaacacccaugcucagacauacgauugaaaauucgacagcuaaugugucguuagccgcaauugcuaaucaagcagucgugcucaugggauuagacaagggguggccaauuucuaaaauggauuugggcgugcccuuacucgcacuaggaugcuacucccaagucaauccucucacucucacugcagcaguauugcuacuaauaacucauuaugcaaucauuggaccaggauuacaggcgaaagcaacgcgagaagcccagaaaaggacugcagccgguauaaugaaaaacccaacaguagaugggauuaugacgaucgauuuagauccaguaauuuaugacagcaaauuugaaaagcagcuuggucaagucauguuguuaguauuaugugcaguucaacuacuuuugaugagaacgucgugggcuuuaugugaagcauuaacauuagcaacgggaccgaucacaacccuaugggaagguucgccaggaaaguuuuggaacacuacuauagcgguauccauggcgaauauauuuagaggaucauaccuagcaggagcaggacuagccuuuuccauaaugaaaucaguagguacgggaaagagagguacuggcucucaaggugagaccuuaggagagaaauggaagaagaaacuaaaccaacuaucucgaaaggaguucgaccuauacaagaaaaguggcauaacagaagucgauagaacagaagcaaaggagggucuuaaacggggugaaauaacccaucacgcagucucuagaggaucugcuaaguugcagugguuuguugaaagaaacauggugaucccugagggacgagugauugaucuugguugcggaagaggcggauggaguuauuauugugcaggacucaagaaaguaacggaaguacguggauacaccaagggaggcccaggacacgaggaaccaguaccgaugucuacauacggauggaauauagucaaauuaaugucugggaaggauguguucuaccuuccacccgaaaaaugcgacacacuccugugcgacauaggagaaucaucaccuagccccacugucgaagaaagccggacaauucguguuuugaaaauggucgaaccguggcucaaaaauaaucaguucuguauaaaaguacuaaacccuuacaugccaacagucauugaacaucuagaacgucuacaaagaaaacauggcgguaugcugguaagaaauccauugaguagaaacucaacacacgaaauguacuggaucucaaauggaacaggcaauaucguugcuucaguaaauauggugucaaggcuuuuacuaaauagauuuacgaugacauauagaaggccaaccauugaaaaagauguugaucuaggugcaggaacacgacauguaaacgcagagcccgaaacacccaauauggacguuauaggagaacgaauuaaacggauuaaagaagaacauaacucuacauggcauuaugaugacgaaaauccauauaaaacaugggcauaucaugguaguuaugagguaaaagcaacaggaucugccaguagcaugauuaacggagucguaaaacuauuaacuaaaccuugggacguaguacccaugguuacgcaaauggccaugacagacacuaccccguucggucaacaacguguuuuuaaggagaaaguagauacuagaacaccacgaucaaugccaggaacgcgaagagucaugggaauaaccgcagaaugguuauggaggacuuuaggaagaaauaagaaaccuagauuguguacgcgagaagaguuuaccaagaaagucagaaccaaugcagcaaugggugcuguguuuaccgaagagaaccagugggauucggcuaaggcagcaguugaagaugaagacuucuggaaacuugucgacagagaaagagaauuacacaagcugggaaaaugcgguucuuguguauacaauaugaugggaaaaagagagaagaaacuuggagaguucggaaaagcaaaaggcucaagagccauaugguauauguggcucggggcccgauaucuagaguucgaggcguugggauuuuuaaaugaagaucauugguuuagccgugaaaacucuuauagcggaguagagggagaaggccuacauaaacugggcuauauacuuagagauauuaguaaaauaccggguggcgcuauguaugcagaugacaccgccggcugggauacacgaauaacugaagaugacuugcauaaugaggagaaaaucacgcagcagauggacccagaacauagacaauuagcuaaugccauauuuaaauuaaccuaucagaauaaagugguaaaaguccaacgcccaacaccaacuggaacaguuauggauauuauaagucguaaggaucaacgaggaaguggacaaguagggacauauggccuuaauaccuucaccaacauggaagcgcaacuuauucgacagauggaaggugaaggcguuuugaguaaagcagaccuugaaaauccucauuuacccgagaagaaaauuacacaauggcucgagacaaaaggggucgagcgccuaaaacguauggcuauuagcggugaugacugcgucguuaaaccaauugacgacagauuugcaaaugcacuucuagcacuuaaugauaugggaaaagucaggaaggauaucccgcaauggcaaccaaguaagggauggcacgauuggcaacaaguacccuuuuguucucaucauuuccaugaauuaaucaugaaagaugggagaaaauuagucgucccaugucgaccucaagaugaauuaauugggcgugccagaauaucacaaggcgcuggauggucccuucgugagacggcgugcuugggaaaggcuuaugcccaaauguggucuuuaauguauuuccaucgacgggauuuaagauuagcuucaaacgcaauauguucagcgguaccaguucacugggucccuacuagccggacgacauggucaauccaugcccaucaucaauggaugaccacagaagacaugcuuacuguuuggaaccgugucuggauugaagacaaucccuggauggaagacaaaacaccaguaacaacgugggaaaaugucccuuaucuggguaaacgcgaagaucagugguguggaagccuaauaggccuaacgagucgcgcaacgugggcucagaauauaccuaccgcaauacaacagguacgguccuuaauagguaaugaggaguucuuagacuauaugccaagcaugaaaagauuuagaaaggaggaagagucagaaggugcaauuugguag

SEQ ID NO: 23016 - RNA, 9873 nt, Artificial Sequence
  derived and/or modified CDS sequence (opt6) from DENV-3__KT726342__SS-prME
accagcuuaugcuuaaugaugauacucccagcagcacuugcuuuucacuuaacaagucgugacggagaaccuagaaugaucguagggaaaaacgaacgcggcaaaagccuccuauuuaaaacugcgaguggaaucaauaugugcacgcucauagcuauggauuuaggagaaaugugugaugacacagucaccuauaaaugcccacacauuacggaaguggagccagaagacaucgacuguuggugcaauuuaaccucaacguggguaacauaugggacgugcaaucaagcgggugaacauagaagagauaaaagauccguugcacuggcaccacacguugguaugggccuugauacuagaacacaaacuuggaugucggcagagggugcguggaggcaaguagaaaaaguggaaacaugggcacuucggcauccuggauuuacaauauuggcauuauuucuagcacacuacauaggaacuucauugacucaaaaagugguuauauuuaucuuacuaauguuaguaacaccuucuaugacaaugcgcugcgugggcgucgguaauagagacuuugucgaaggauuauccggggcuacguggguagauguagucuuggaacaugggggaugcguaacuacaauggccaaaaacaaaccuacacuagauauagaguuacagaaaacggaagcaacacaauuagccacucuaaggaaacuauguaucgaagguaaaaucacaaauauuacgacagacaguagauguccaacgcaaggcgaggcgguucugccugaagaacaagaucaaaacuacgucuguaaacacacguauguagaccgcggcugggggaauggaugcgguuuauuuggaaaaggaucacuggucaccugugcuaaauuucaaugccuagaaccaaucgagggaaaaguuguacaauaugagaaucugaaauauacagugauuauaacuguacauacaggagaccagcaucaaguagguaacgaaacccaagguguaacggcagaaaucacuccccaggcuucaacaacagaggcuauccugcccgaauaugguacgcucggccuagaauguucgccgaggacgggacuugacuuuaacgaaaugauacuauuaacaaugaaaaauaaggcuuggauggugcauaggcagugguucuuugaucuuccuuuaccauggacaaguggagcuacaacagaaacacccaccuggaaccguaaagaacuuuuaguaacauucaaaaaugcacaugccaagaaacaagaagucgucguacuuggaagucaagaaggugccaugcauaccgcacuaacaggugcgacugaaauucaaaauucagguggaacaaguaucuucgcaggccauuuaaaaugucgccuaaaaauggacaaauuagaacuaaaagguaugucauaugccauguguacaaauacauuuguauugaagaaagaagugagcgaaacccaacacgggacaauuuuaauuaaaguagaguacaaaggggaagacgucccguguaaaaucccuuuuuccacagaagaugggcaaggaaaagcgcauaauggacgacuaauuacggcuaacccgguugucacuaagaaagaggaaccaguaaauauugaagcugaaccaccauucggggaaaguaauauaguuauagggauuggagauaaugcacugaaaauaaauugguauaagaaagggucaaguauuggcaaaauguucgaagccaccgcaagaggggcucggagaauggcuauauuaggcgauacggcuugggauuucggaagcguuggcggcguauuaaauucuuugggaaaaaugguacaucaaaucuuugguucagcauauacagcacuuuucucggguguuaguuggguuaugaaaauagggauaggaguucuauuaacuuggaucggucucaacaguaaaaauacgucaaugaguuuuuccuguauugcaauagggauaauaacauuguaucuaggugcgguaguucaagcugauaugggauguguuauuaauuggaaaggaaaagaacuaaaaugcgguucaggaauauucguaacaaaugaaguucauacuuggacugagcaauacaaauuccaagcggauucgccgaagcgucuggcgacagcaaucgccggugcaugggaaaaugguguuugcggaaucagaucaacuaccagaauggaaaaucuauuauggaagcaaaucgcaaaugaauuaaauuacauucuaugggaaaauaauauuaagcucacuguuguaguaggagauauuauaggaguacucgaacaagguaaaagaacuuuaacuccgcagcccauggaacuuaaguauucauggaaaacuuggggaaaagcgaaaauaguaaccgcugaaacacaaaauucaucauuuauaaucgauggaccaaacaccccggaaugcccaucugccucgcgagcuuggaacguaugggaagucgaggauuauggauucggggucuucacaacuaauauuuggcucaaacuacgugaagucuacacccagcuuugcgaccacaggcucaugucugcggcugugaaggacgaacgcgcgguccacgcugauaugggguacuggaucgaaucacagaaaaacggaaguuggaaauuagaaaaagcaagccuuaucgaagucaaaacuuguaccuggccaaaaucgcacacauuauggucgaauggcgucuuagaaagugauaugauaauacccaaaagucuagcggguccgauuucucaacauaaccaucggcccgguuaucacacucaaacagcugguccauggcaucucgguaaacuagagcuggauuuuaauuauugugaagguacuacaguggucauuacggaaaauugcggaacccguggacccaguuuaaggacaacaacagucaguggaaaacuaauacaugaauggugcuguagaucgugcacccucccaccauugagauacaugggugaggaugguuguugguauggaauggagauaagaccaauaagugaaaaagaagagaauaugguaaaguccuuaguguccgcugguucaggaaagguugauaauuuuacaaugggaguucugugucuugcaauacuuuuugaagaggugaugagagggaaauuuggaaagaaacacaugauagcuggggucuucuuuacguuuguucugcugcuaucgggacagauaacauggcgagacauggcacauacgcucauaaugauuggcucaaacgcuucugacagaauggguauggguguuacuuacuuagcccuaauugcaacauucaaaauucaaccguuccuugcacucggauucuuucuaagaaaacuuaccucgcgagaaaaucuccuuuuaggaguaggucuagcgauggcaacaacucuacaacuuccugaagacauugaacaaauggcaaacggaaucgcuuuaggccuaauggcuuugaaauuaauuacacaguucgagacuuaucaguuauggaccgcucuaauaaguuuaacaugcucaaauacaaucuuuacucucaccguagcuuggagaacugcuacgcucauacuugccggggucucuuuauuacccguaugucaaucuucuuccaugcgaaaaaccgacugguuaccgauggcuguggcugcgaugggagugcccccucugccccucuuuaucuuuaguuuaaaggacaccuuaaagcggagauccuggccgcuuaacgagggugugauggcaguaggauuagugucuauauuggcaucuucauuauuacgaaaugauguaccuauggcuggucccuuggucgcuggaggacugcuaauagcaugcuauguaauuaccggcacauccgcagauuugacaguugagaaagcugcagacauuaccugggaagaagaggcagagcagacgggaguaagucauaacuuaaugauaaccguagaugacgacggaacuaugcgaauuaaagaugaugaaacugagaacauacuuacggugcucuuaaagaccgcauuguuaaucgugucaggcauauuucccuacucaauuccagcuacgcuauuaguauggcauaccuggcagaaacaaacgcaaagaucuggaguuuuaugggaugugccuucaccaccagaaacccaaaaggcggaacuggaagaaggcguguaccgcauaaaacaacaagguaucuuuggaaagacacaaguaggaguuggagugcaaaaagaagggguguuccauacgauguggcauguaacgagaggagcuguauuaacacauaauggaaaaaggcuagagccaaauugggccaguguaaagaaagaucugauuagcuacggcggcggguggcgucuauccgcccaauggcagaaaggagaagaagugcaagugauugcuguagaaccggggaaaaaccccaagaauuuucagacaaugcccggcacuuuccagacuacaacaggugagauaggggcuauugcgcuagacuucaaacccgguaccagcgguuccccaauuauuaauagagaaggaaagguggucggguuguacggaaacggcguaguaacuaaaaacggcggauauguuagcggaauagcacaaaccaaugcggaaccggauggccccacaccggaguuagaggaagagauguuuaagaaacgaaacuuaacaauuauggaccuccacccaggcucugguaaaacaagaaaguaucuacccgcuaucguuagagaagcuauaaagagacgccugagaacauuaauauuagcaccuacuagaguaguagcagcugaaauggaagaggcuuugaaaggucuuccgauucgguaccagacaacagcuaccaaaagugaacauacagguagagaaauaguagauuugaugugccacgcuacuuuuacuaugagacuuuuaaguccaguaagggugccaaauuacaaucuaauaauuauggaugaggcacauuuuacggauccugcgagcauagcagcucgaggcuauauaucaaccaggguuggaaugggagaagcagcggcgauuuuuaugacagcuacacccccuggcacggcagacgcuuuuccacaaucaaacgcuccaauucaagaugaagaacgagauauaccggaaagauccuggaacucaggaaaugaguggauuacagacuuugcgggcaaaacuguaugguucguccccucaauaaaggcuggaaacgauauagcaaacugucuuaggaaaaaugggaagaaaguaauucagcuaagucgaaagacauuugauacggaauaucaaaagacaaaacuuaaugauugggacuuugugguaacaaccgacauuuccgaaaugggugcuaauuuuaaagcagaccgaguaauagacccgagaagaugcuugaaaccgguuauacucacggacggaccugagcgagugauccucgcgggucccaugcccguaacagcagccucagcggcucaacgucgcggaagagucggcaggaauccccagaaggaaaaugaucaauauauauuuacaggacaaccucugaacaaugaugaagaucacgcacacuggacggaagcaaaaaugcuucuugacaauauaaacacaccagaggguauaauccccgcauuauucgaaccagaacgggaaaaaucagccgcuauagacggugaauacagacucaaaggggagucucguaaaacauucguugaauuaaugagaagaggugaucucccaguuuggcucgcccauaaaguugccagugaggguauaaaauauacagacaggaaaugguguuuugacgggcaacgaaacaaccaaauauuagaagaaaauauggacguagaaauauggacaaaagaaggugagaagaagaaauuaagaccaagaugguuagacgcuaggacauacucagacccauuagcucuaaaagaauuuaaggacuuugcggcaggaagaaaaaguauagccuuggauuuagugaccgaaaucggacgagucccgucacaccuggcacauaggacuaggaaugccuuagacaaccugguaauguuacauacaagugagcauggggguagagcauauagacaugcuguagaagaacucccagagacuauggaaacucuuuugcuauugggacuaaugauucuacuuacagggggagcgaugcucuuucuuauaucagguaagggaauagguaaaacgucuauaggucucaucuguguaaucgcuuccucagguauguuguggauggcagagauaccgcuacaguggauagcaagugcaauaguuuuagaguuuuucaugaugguucuucuaaucccggaaccagagaagcaaagaacaccacaggauaaucaauuagccuauguaguaauagggauacuuacauuggcugcuauaauagcagcaaaugagaugggccuccucgagacaacuaaaagggaccuuggaaugucgaaagaaccaggagugguaucaccaacgaguuaucuagaugucgacuuacauccggcaucagcuuggacguuguacgcaguggcuacaaccguaaucacgccgauguuaaggcauacgauagaaaauuccacugcaaauguaucguuagcugcaauagccaaucaagcugucguacuaaugggauuagacaagggguggccgaucaguaaaauggaucuaggagucccacuauuagcauuaggauguuauagucaaguuaauccacucacucugacagcagcuguacuacuacuaaucacgcauuaugcaauaauaggaccaggauuacaggcaaaggcaaccagagaagcgcaaaagagaaccgccgccgguauaaugaaaaauccaacgguugacgggauaaugacaauugaccuugacccuguuaucuacgauucaaaauuugaaaaacaauuaggucaaguaauguuacuuguuuuaugugcgguacaacuucuauuaaugcgcaccagcugggccuuaugcgaggcguuaaccuuggccacaggaccuauaacaacacuaugggaaggcucaccugguaaauucuggaauacgaccauugcaguuucuauggccaacaucuuucgcgggucauaccuagccggugcaggccucgcuuuuucuauaaugaaaagcguugguacgggcaaaaggggcacuggcucacaaggcgaaacucuaggcgaaaaguggaagaagaaacuaaaucaacuaucgagaaaagaauuugaucuauauaagaaaagcgguauaacagaaguagaccgcacugaagcgaaagaaggacuuaaaaggggagaaauuacgcaucaugccgucucacgcggaagugcaaaacugcagugguuuguugaaagaaacaugguaauaccggaagggagggugaucgaucuagguugcggcaggggaggcuggagcuauuacugugcaggacuuaagaaagucacagagguucggggcuacacaaaggguggcccaggacacgaggaacccguuccuaugaguacauauggauggaacauugugaaguuaaugucgggaaaagauguauuuuauuugccgcccgaaaaaugugauacgcuauugugugauauuggcgaaucaucaccaaguccuacuguugaagagucgcguacaauacgaguucugaaaaugguggaaccaugguuaaagaauaaccaguuuuguauaaagguacuaaacccauauaugccgacaguaaucgaacacuuagaacgauuacaacgcaaacauggaggaaugcuggugcguaaccccuuaagucgaaauuccacccaugaaauguauuggauaagcaauggaacgggaaauauuguggcgucgguaaacaugguaucuagacuuuuauugaacagguuuacuaugacccacaggcgcccaacaauugaaaaagacguggauuugggggcagguacgaggcacgucaaugcagaaccagaaacaccgaauauggacguaauaggagagagaauaaaaaggauaaaggaagaacacaauuccacauggcacuacgaugacgaaaacccuuauaaaacuugggcguaccaugguaguuacgaaguaaaagcuacaggcagugccucuucaaugauuaauggcguagugaagcuacuuacgaaacccugggaugucgugccaaugguaacgcaaauggcuaugacggauacuacaccauuuggacaacaaagaguguucaaagaaaaaguugauacaagaaccccaagaucgaugccuggaacuagacgaguuauggguauaaccgcugagugguuguggcgaacgcugggucgaaauaagaaaccuagacuaugcacuagagaagaguucacuaagaaaguaagaaccaaugcugcaaugggcgcgguuuuuaccgaggaaaaucaaugggacagugccaaagccgcuguggaagaugaggacuucuggaagcuaguagauagagaacgagaguuacacaaacuagguaaauguggaucuugugucuacaauaugaugggcaagagagagaagaaacucggcgaguuuggaaaagcaaaaggcucacgagcuaucugguacauguggcuuggggcaagguaucuugaguucgaagcauugggauuuuugaaugaagaucauugguucaguagggaaaauucauacagcggaguagaaggagaaggccuccauaaauugggauacauauugagggauauaucgaaaauuccaggcggcgcuauguacgcugacgauacagcagggugggacacacguauuacagaggaugaccuacauaacgaagagaaaauaacacaacaaauggauccagagcaccgucaacuugcaaacgcuauauuuaagcuaacuuaccaaaauaaagugguaaagguucaaagacccacaccgacagggaccgucauggacauaauaagcagaaaagaccaaagaggaagcgggcaagucggaaccuacggacucaauacauuuaccaacauggaagcacagcugauucgacaaauggaaggggaaggaguccuuucuaaggcagaccucgaaaacccacaucugccagagaaaaagauuacccaauggcuagagacaaaagggguggaaagguuaaaacggauggcgauuagcggugacgacugugucguuaagccaauagaugacagauuugcgaacgcuuuacucgcuuuaaacgacauggguaaaguacgaaaagacauaccacaguggcaaccaucuaaaggauggcaugauuggcaacaagugccguuuuguucucaucauuuccacgaauuaauaaugaaagacggucggaaauuaguaguaccgugucgaccacaggacgaguuaauugggagagcacggauaucgcaaggggcagguuggagccuacgcgaaacugcguguuuaggaaaagcauaugcacaaauguggucacuaauguauuuucauagaagagaucuacgguuagcaucaaacgccauauguucggcaguacccguacauuggguacccacgucuaggaccacuuggaguauacaugcacaccaucaguggaugaccacagaagacauguugacuguuuggaauagaguuuggauugaagacaauccuuggauggaagauaaaacaccggugacgacaugggaaaauguacccuacuuaggaaagagagaagaucaauggugcggguccuuaauuggguugacgagccgcgcaacaugggcucaaaacauaccuacggcaauacaacaaguaaggucuuuaauagggaacgaagaauuuuuggacuacaugccuucaaugaaacgauuuagaaaagaagaggaaucagagggagcaauaugguaa

SEQ ID NO: 23017 - RNA, 9873 nt, Artificial Sequence
  derived and/or modified CDS sequence (opt6) from DENV-3__KT726343__SS-prME
acgaguuuaugccugaugaugauucugccagcagcacuugcauuucaccuuacaucucgugacggagaaccaaggaugauaguggggaaaaacgaacguggaaaaucccuacuauuuaaaacagcaagcggaauaaauaugugcacauuaauugcuauggaccuaggggaaaugugcgacgacacagugacuuauaaauguccucacauuacggaaguugaaccagaagauauagacugcuggugcaauuugacaucgacuugggugacauaugguacuuguaaucaagcaggagaacauaggcgagacaaacgcuccgucgcccuggcaccacacgucgggaugggacuagauacaagaacucaaacuuggaugagcgcggaaggcgcuuggcgacaaguagaaaaaguagaaaccugggcccuaagacauccaggauuuacgauacuagcuuuauucuuagcacauuacauugggaccucuuuaacacaaaaaguaguuauuuuuauacuacuaauguuaguaacaccguccaugaccaugcgauguguuggggucggaaacagagauuuuguugaaggauugaguggcgcaacauggguggauguaguacuagaacaugguggauguguaacgacaauggcuaaaaauaaaccaacccuagauauagagcuacagaaaacagaagcgacacaauuagcaacauuacgaaaauuauguauagaggggaaaaucaccaauauaaccacugauagucgaugccccacccaaggggaagcaguauugccagaagaacaagaucaaaauuaugugugcaaacauacuuacguggacagaggcugggguaacgggugcggauuauucggaaaaggaucgcugguaacuugcgcgaaauuucaaugucuugaaccuauagaagguaaaguaguccaauaugaaaacuuaaaauauacuguaauaauaaccguccauacuggcgaccaacaucaggugggaaaugaaacacaaggcguaacagccgaaauaacuccucaagcuagcacuaccgaagcaauuuuacccgaauacgggacauuaggacuagaauguucucccagaacagguuuagacuuuaacgagaugauacuucuuacaaugaaaaauaaagcauggaugguccaccgucagugguuuuucgaccuuccgcuuccuuggaccagcggagcaacaacagagaccccgacuuggaaucgcaaagaacuauugguuacauuuaaaaaugcccacgcuaagaaacaagaaguggucguacuagguucgcaagagggagcuaugcacacugcgcuaaccggcgcgacugaaauacaaaauucuggagggacaucgauuuuugccggacaccuaaaguguagauugaaaauggacaaacuagaauuaaaaggaaugucauaugcuauguguacgaacacuuucgugcuaaagaaagaggucucagagacucaacacggaacaauacuuaucaaaguugaauauaaaggagaagacgcgccauguaaaaucccauucucaacggaagauggacagggaaaagcccacaaugguagauugauaacugcuaauccaguuguuaccaagaaagaagaacccguuaauauagaagcugaacccccuuucggugaaagcaacauuguaaucgguauuggcgauaaugcauuaaaaauaaacugguacaagaaaggcucaaguauagguaaaauguucgaagcaaccgcacgaggggcaagaagaauggccauacuuggggacacugcaugggacuuuggcucagucggcggcguguuaaauuccuuaggcaaaaugguucaucaaauauuuggaucagccuacacagcacuuuucaguggaguaucuugggucaugaagauaggaauuggaguucuucuaacauggaucggauuaaacagcaaaaauacuucuaugaguuucagcugcauagcaauuggaauaauaaccuuauaucuaggugccgucguucaagccgacauggguugugugauuaacuggaaagguaaagaauugaaauguggauccggaauauuuguaacaaacgaaguucauacauggacugagcaauacaaguuucaggcugauucaccuaaaagauuagccacggccaucgcaggagccugggagaacgguguuugcggaauacggagcacaaccagaauggagaauuuauuauggaaacagaucgcaaaugaacucaacuacauauuaugggaaaauaauauuaaacugacgguagugguuggugauauaauaggaguguuagaacaaggaaaacgaacgcuaacaccccaaccaauggaauuaaaauauagcuggaaaacuugggguaaagcuaagauuguaacugcggaaacacaaaacuccucauuuauaauugauggaccgaacacaccugaaugucccucugcgucccgggcauggaacguuugggaaguugaagauuaugguuuugggguauucacuaccaauauuugguuaaagcugagggaaguauauacgcaacuaugcgaucauagauuaaugagugcagcaguuaaggaugaaagggcuguacaugcagauaugggguauuggauagagagucagaaaaacggauccuggaagcucgaaaaagcaagccuaauagaagugaagacuugcacauggccaaaaucacauacuuuguggucuaauggaguacuagaaucugauaugauuaucccaaaaucucucgcugguccgauuucccaacauaaccaccgaccaggguaucacacucaaacugccggaccuuggcaucuugguaaauuggaacucgauuucaauuauugcgaaggaacuacaguuguuauaacugagaauugcggcacucguggcccuucacuaagaacaacaacgguaucaggaaaacuaauacacgaauggugcugcaggucaugcacacuaccacccuuacgauacaugggagaggacggaugcugguauggcauggagauacgaccaauuucggaaaaagaggagaauaugguuaaaaguuuagucucagcagguucgggaaaaguugacaacuuuacaaugggaguacucugucuagcaauacuguucgaagaaguaaugcgagguaaauuugguaagaaacacaugauagccgggguauuuuucacauuuguccuauuacuuucagggcaaauaaccuggcgggauauggcacauacacugauaaugauagggucaaacgcaucggauagaauggggaugggcguaaccuauuuggcucucauagcaacuuucaaaauacaaccguuucuggcacugggauuuuuccuacgaaaacuaacgagccgagagaaucuauuauuaggagucgguuuagccauggcaacuacguuacaacuuccugaagauauagaacaaauggcaaacggcauugcguuaggucucauggcacuaaaacuuaucacccaauuugagacuuaucaacuuuggacagcauuaauaucuuugacuugcucuaauacaauuuucaccuugacuguggcauggcgcacagcuacuuuaauacuugcugggguauccuuguuaccaguuugccaauccucgucaaugcgaaagacggauuggcugccaauggccguagcagcaaugggcguuccaccacuaccguuauuuauauuuucauugaaagauacucugaagagacguaguuggccacugaaugaagguguuauggcaguuggccuaguaucaaucuuagccucuagcuugcuaagaaaugacgugccgauggccgguccguuagucgccggaggacuauuaauugcaugcuacguaauuaccggcacaucagcagaucuaacuguugaaaaagcagcugacauaacaugggaagaggaagcggaacaaacuggagucucucauaauuugaugauaacuguagacgacgauggaacaaugcguauaaaagacgacgagacggaaaauauuuugacuguucuauugaaaacugcuuuguugauagucagugguauuuucccguauuccaucccugcgacauuauuaguauggcauacuuggcaaaaacagacacaaagaagugggguacuuugggacgucccuaguccuccggaaacacaaaaagcagaacuagaggaaggaguguauaggauuaaacaacaagggauauuugguaaaacgcagguagggguggguguacaaaaagaaggagucuuucauacuauguggcauguuacaagaggggcuguauuaacucacaacgggaaaagauuggaaccaaauugggcaagcguuaaaaaggauuuaauaucuuauggggguggguggagauuaucagcucaguggcaaaagggagaagaagugcaaguaauagcagucgaaccaggcaaaaauccgaaaaauuuucaaacaaugccaggaaccuuucaaacuaccacgggagaaauuggagccaucgcacuugauuuuaagccugguacuagcgggucaccgaucauuaaucgggaaggaaaagucgugggauuauauggaaauggaguagucaccaaaaacgggggauauguauccggaauugcgcaaacaaaugcagaaccugauggaccaacccccgaauuagaagaggagauguuuaagaaacgaaaccuaaccauaauggaucuacauccgggaucagguaagacuaggaaauauuuacccgcaauaguuagagaagcaauaaagaggagacuaagaacacuaauauuagcuccgacucguguaguagcggcugagauggaggaagcccuaaaaggacucccuauaagguaucaaacaacugcaacaaaaucggagcacacggggcgggaaauaguagauuuaaugugccaugcgacauuuacaaugcgacuacuuaguccgguccgaguaccaaauuacaaccuuaucauaauggaugaagcgcacuucaccgauccggccagcauagccgcacgagguuacauaaguacgcggguuggaaugggcgaagcagcagcaauauuuaugacggcaacaccuccaggaacagcugacgcauucccucaaucaaaugcaccaauacaagaugaagaacgagauaucccagaaagaucauggaauaguggaaaugaguggaucacugauuuugcuggaaaaacuguuugguucguaccaucuauaaaagcaggaaacgauauagcaaacugucuacguaaaaacgguaagaaagucauacaacuaucuagaaaaacuuucgacacagaauaccagaaaacuaaacuaaacgauugggauuuuguuguaacaacggauauaucagaaaugggagcuaauuuuaaggcagauagaguuaucgaucccagaagaugucucaaacccguaauauugaccgauggcccagaacgaguuauacuagcuggcccuaugccgguuacugcugcuagugcggcucagcguagagggagagucggucguaacccacaaaaggaaaacgaucaauauaucuuuacugggcaaccccuuaauaacgaugaagaucacgcgcacuggacagaagcgaaaauguuacuugacaacauaaacaccccugaagguauaauaccagcucuuuuugaaccugaaagagagaaauccgcugcuauagauggagaauauagauuaaaaggggaaucccguaagacauucguugagcucaugagacguggugaccuaccagucuggcuagcacauaaaguggcuagugagggcaucaaauauacugaucgcaaauggugcuuugacgggcaaaggaacaaucaaaucuuagaagaaaacauggauguugaaauauggaccaaggaaggggagaagaagaaacuccguccaagaugguuagacgccagaacuuacucagacccacuagcucuaaaggaauuuaaagauuuugcugcggggcgaaaaucuauagcacucgacuuaguaacugaaauaggacgggugccaucucaucuugcacacagaacaagaaacgcucuagacaacuuaguuauguuacacaccuccgagcauggaggcagagcauauagacacgcuguagaggaauuaccugaaacaauggagacucugcuauuacuuggacuaaugauauuauuaacuggaggugcuaugcuauuucuuauaucaggaaagggcauugguaaaacaaguauaggucuuauauguguuauagcaucaagcggaaugcuuuggauggcagaaauaccguuacaauggauagccuccgcaauugugcuagaguucuuuaugaugguucuacuaauuccugaaccggaaaaacaacguacaccacaagacaaucaauuggcguauguaguaauugggauauuaacacucgcagcgauuauagcggcaaacgaaaugggacuauuagaaacuacaaaacgcgauuuaggcaugucuaaagaaccaggagugguuagcccuacaaguuaccuggacguugaucugcaccccgcaucagcauggacccucuaugcuguggcuacuacaguaauaacgccgauguuacgucacacgauugagaacucuacagcuaauguuucuuuagcugcaauagcaaaucaagcaguaguacuaaugggcuuagauaagggauggccuauauccaaaauggaccuuggagugccacuacuugcucuaggauguuacucacagguaaauccucucacauugacagccgcgguacuucugcuaaucacacacuaugccauuaucggcccgggguuacaagcaaaggcuacucgugaagcgcagaaacggacagcugccggaauuaugaagaauccuacaguggacggaauaaugacaauagauuuggaccccguuauuuacgauaguaaauuugaaaaacaacuaggucaaguuaugcuccuaguccuaugcgcaguacaacugcuauuaaugagaacaagcugggcuuuaugcgaagcguuaacacuugccaccggcccaaucacaacccuuugggagggaucaccagguaaauuuuggaauacuacuauagcaguauccauggcuaacauauuuaggggcagcuaucuagcaggcgcaggacuagcauucagcauuaugaaaucaguaggaacugguaaacgagguacggggucgcaaggagaaacgcuaggggaaaaauggaagaagaaacucaaccaacuaagcagaaaagaguucgaccuuuacaagaaaucaggaauuacagaaguugauaggacagaagcaaaagagggauuaaagagaggugaaauuacucaucaugcagugucucgagggucggcuaagcuacagugguuuguggaaaggaacauggugaucccugaggggcgcguaauagaccuagguuguggaagaggcggcuggaguuauuauugugccggacucaagaaaguuacagaggucaggggcuacacaaaaggugguccgggucaugaagaaccuguaccgaugucaacguauggauggaauaucguaaaauuaaugagcggaaaagacguguuuuaccuucccccagagaaaugcgauacauuacuuugcgacaucggugaauccaguccaucacccacuguagaagaaagccguacaaucagaguucuaaaaauggucgaaccguggcucaaaaauaaucaauucugcauaaaaguuuugaacccauauaugccgacuguuauugaacaucuugagcgacuacaaagaaaacacggagggauguuaguacgcaauccccuaucgaggaacucaacccacgaaauguacuggauaagcaacggcacaggaaacauaguggccagcguaaauaugguaucaagacuacuacuuaaccguuucacaaugacgcaucggcguccgacgaucgagaaagacguagaccucggcgcgggaacacgacauguaaacgcugaacccgaaaccccuaauauggacgucaucggagaacgaaucaaacgaauaaaagaagaacauaacucaacguggcacuaugaugacgaaaauccauauaaaaccugggcguaucauggaucguaugaggugaaggccacuggcucagcaagcaguaugauuaacggggucguaaaacuuuuaacaaaaccaugggaugucgucccuaugguaacacaaauggcgaugacggacacaacgccguucggacaacaacgagucuucaaagaaaaaguagauacuagaacucccagaucgaugcccggcacgagaaggguuaugggcauuacggcagaauggcuguggagaacuuuaggaagaaauaagaaaccccguuuaugcacacgugaggaauuuacaaagaaagugagaaccaacgcagcaaugggcgcggucuucacugaggaaaaucaaugggauucugcaaaagcugccguagaagacgaagauuucuggaaauuggucgacagggaaagggaauuacacaaguuaggaaaauguggcucgugcguauauaauaugauggguaaaagagagaagaaacuaggugaguuugguaaagcaaaaggaucaagagcuauaugguacaugugguuaggagcuagguaccuugaguuugaagcacucggauuucugaaugaggaccauugguuuagucgagagaacagcuauagugguguagagggggaaggauuacacaaacuuggauauauucuaagagacaucuccaaaauucccggaggugcaauguaugcagacgauaccgcaggcugggauacuaggauuacagaagacgaccuccauaaugaagagaaaauaacacaacaaauggacccugaacauaggcaguuagccaaugcgauauucaaauuaacauaucagaauaaaguuguaaaagugcaaagaccaaccccuacugggacaguaauggauauaauuagcagaaaagaucagcggggaagcggacaaguuggaaccuacggacuuaacacauuuaccaacauggaagcacaacuaauuaggcaaauggagggugaaggcguguuaucuaaagcagacuuagaaaauccacaucugccagagaagaaaauaacacagugguuggaaacuaaagguguagaacgucuuaaaagaauggcaauuucaggagacgauugcgugguuaagccaauagaugaucgcuuugcaaaugcguuauuggccuuaaacgauauggguaaaguacgcaaagauauaccucaauggcagccaucaaagggauggcaugacuggcaacaaguacccuucugcagucaccacuuccaugagcuaauuaugaaagaugguagaaaacugguaguaccaugccgaccacaggacgaauuaauaggaagggcaaggauaucacaaggagcgggauggagccuacgagaaaccgcgugcuuaggaaaagcauaugcccaaauguggucauuaauguauuuucauagacgugauuuaagauuggcaucaaacgcaauuugcucugcaguacccguacauugggugccuacuucucgaacgacuuggaguauccaugcucaccaccaauggaugacuaccgaagauauguuaacaguauggaaccgaguuuggauagaggacaacccauggauggaagauaagacgccgguaacaacaugggaaaacguccccuaccuaggaaaaagagaggaccaaugguguggguccuuaauaggccuaaccucucgugcaacaugggcgcaaaacaucccgacagcaauacaacaaguccgaucauuaauuggaaaugaagaauuucuggauuauaugccuaguaugaaaagauuccgaaaagaagaagagagugaaggagcgaucugguga

SEQ ID NO: 23018 - RNA, 9873 nt, Artificial Sequence
  derived and/or modified CDS sequence (opt6) from DENV-3__KT726351__SS-prME
acgagucuaugcuuaaugaugauuuugcccgcagcacuagcauuucauuuaacuucaagagacggagaacccaggaugaucguaggcaaaaaugaaagagguaaaucacuacuuuuuaaaacugccucagggaucaauaugugcacucuaauagcuauggaucuaggagaaaugugcgaugacacugucaccuacaaauguccccauaucaccgaagucgaaccugaagacauugauuguugguguaauuuaacgucuaccugggucacuuacggcaccuguaaucaagcgggggaacaucggcgcgauaaacguucuguugcuuuagcaccucaugucggcaugggucucgauacaagaacccaaacauggaugucugcugaaggagccuggagacaaguugaaaaaguugaaaccugggcauuaagacauccagguuuuacuauacuugcacucuuucucgcacacuauauaggcaccagucuaacccaaaaaguuguuauauuuauacuauuaauguuagugacaccaucuaugaccaugagauguguuggugucggaaaucgcgauuucgucgaagguuugucaggcgcaacauggguagauguagucuuagaacauggcgguuguguaaccacaauggccaaaaauaaaccgaccuuggacauagaauugcagaaaacugaagcuacucaauuagcuacuuuacguaaauuauguauugaaggaaaaauaacaaauaucaccacggauaguaggugccccacccaaggcgaagcgguacuucccgaagaacaagaucaaaauuacguauguaaacauacauauguagaucgugguuggggaaacggcugcggguuguuugggaaagguagccugguuacaugcgccaaauuucaauguuuagaaccaauagaaggaaaagucguacaauacgaaaaccuuaaauacacagucaucauuacaguacauacaggagaucaacaucagguugguaaugaaacacagggcguuacagcagaaauaacgccgcaggcuucaacaacagaagcaauacuaccagaauacgguacacuuggacuagaaugcaguccaagaacagggcuugauuucaaugaaaugauccuacuaacaaugaaaaauaaagcauggaugguacacagacaaugguucuuugacuuaccguuaccauggacgucaggagcgacaacagaaacaccuacauggaauaggaaagaauuauuagucacauuuaaaaaugcccacgccaagaaacaagagguuguaguccuagguagucaggaaggagcuaugcacacagcacuaaccggugccacggaaauacaaaauucaggaggaacuucaauauuugcagggcacuuaaaaugccggcuaaaaauggauaaacuagaguuaaaaggaaugagcuaugcaauguguacaaacaccuucgugcucaagaaagaaguaagugaaacacaacacggaacaauacucauaaaaguagaauacaaaggugaagaugucccguguaaaauacccuucagcacagaagacggccaaggcaaagcccauaauggcagauuaauaacugcgaaccccgugguaacuaagaaagaggagccagucaauauugaagcugaaccacccuuuggcgaaagcaacauaguuauagguauaggagauaacgcguuaaaaauuaacugguacaagaaagggucgucuauugguaaaauguuugaagcaacagcucgaggugcacggagaauggcaauucuaggugauacagccugggacuucgguagcguaggaggaguacucaauucucugggaaaaaugguacaucaaaucuuuggaucagcuuacacugcauuauucucagguguaagcugggucaugaaaauaggaauaggaguguuauuaacguggauaggacuaaauucgaaaaauacgaguauguccuucaguuguauugcaauagguauaauaacuuuauaccuaggagccgucguacaagcagauaugggauguguuauuaauuggaaaggaaaagaauugaaaugcggcagugguauuuucgugacaaaugaaguucacacuuggaccgaacaauacaaauuucaagcagauucaccuaaacgucuugcgacggcuauugcuggagcaugggaaaacggggucugcgguauuagaagcacuacccgaauggaaaacuuacuauggaaacagaucgccaacgaacuuaauuauauuuuaugggaaaacaauauaaaacuuacaguaguaguaggcgauauaauugguguacuugaacagggcaaaaggacacugacuccccaaccuauggaauuaaaauacuccuggaaaacguggggaaaagccaaaauugucacagcggagacucaaaauaguaguuuuauaauugaugguccgaacacacccgaguguccaucagcaagcagggcguggaauguaugggaaguggaggacuauggauucgguguauucacaacgaauauuuggcuuaaacucagagaaguguauacccagcuaugcgaucauaggcucaugucugcagccguaaaagacgaaagggccgugcaugccgauauggguuauuggaucgagucacagaaaaaugggucauggaaacuagaaaaagcauccuuaaucgaagucaaaaccugcaccuggccuaaaagucauacgcuauggagcaauggaguacuggaaagugauaugaucauaccaaaaagucuggccggaccuauaucccaacacaaucaccgcccaggauaucauacacaaacagcaggaccauggcaccuugggaaauuagaacuugacuuuaacuauugcgaggguacuacgguaguaauuaccgagaacuguggcacacguggaccaaguuuaaggacuacaacuguaucagguaagcugauacaugaaugguguugucguucuuguacuuuacccccacucagguauaugggugaagaugguuguugguacggaauggaaaucaggccaauaagugaaaaagaggaaaauaugguaaagucccuagucucagcugguagcggaaaaguggacaauuuuacuauggguguucuuugucuggcaauacuauuugaggaaguaaugcgugggaaguuuggaaagaagcacaugaucgcgggcguuuucuuuacuuucguucuauuacuaucgggccaaauaacuuggagagacauggcucacacauuaauaaugauagggagcaaugcaagcgaccgcaugggaauggggguaaccuaucuugcacugauugcgacuuuuaaaauccagccauuuuuagcccucggauucuuucucagaaaacuuacaucgagagaaaaccuucuccuaggaguagguuuagccauggcgacaacacugcaacuucccgaggacauugaacagauggcaaacgguaucgcuuuagggcugauggcacuaaaauugauaacucaauuugaaacguaucaauuguggaccgcccuuaucaguuuaacuuguagcaacacuaucuuuacacuuacuguagcuuggagaacugcaacacugauauuagccgguguuuccuuacucccggucugucaaaguagcaguaugcggaaaacugauuggcugcccauggcgguagcugcaauggggguaccacccuuaccuuuguucauuuucucccuuaaagauacucugaaaagacgcucguggccauuaaacgaaggaguuauggccguuggauuaguaucaauucuagcaaguucauuacugcgaaaugauguaccgauggcugggccgcuagucgcaggaggacuauuaauagcaugcuauguaauaacaggaacgucagcagaucucaccguugaaaaggcggcagauauuacaugggaagaggaagcugagcaaacaggagugucgcauaauuuaaugaucacuguggacgacgacggaacuaugaggauaaaagaugacgaaacggaaaauauauuaacaguccuccuaaaaacugccuuauuaauaguaaguggaauauucccguauaguauuccugccacucugcuugucuggcauacauggcaaaaacaaacucaacguucagguguacuuugggauguacccucuccacccgagacucagaaagcugaacuggaagaagguguguaccgaauaaaacaacaaggaauauuuggaaaaacacaagucggaguaggaguucagaaagaagguguuuuccacaccauguggcauguuacaagaggcgccgucuugacacacaauggaaaaagacuggaaccaaauugggccagugucaaaaaggauuugauuucuuauggcggaggcuggagauuaucagcacaauggcagaaaggagaagaaguacaaguaaucgcaguagaacccggaaagaaucccaaaaacuuccaaacaaugccugguaccuuucagaccacaacuggggaaauaggcgcaauagcguuagauuuuaaaccggguacgucuggaaguccgauuauaaauagagaagguaaagugguaggauuauacggcaacggugucgugaccaaaaauggaggauacguaucaggaauagcacaaacaaaugcagaaccggauggcccuacuccugagcuggaggaagaaauguucaagaaaagaaaucuaacaauaauggaucuucacccagguucaggaaagacaaggaaguauuuacccgcaauaguaagggaagccauuaaacgaagacuuaggacucucauauuagccccuacccguguaguggcugcagaaauggaagaagcccuaaagggucucccaaucagauaccaaacaacagcaacuaaaucugaacauaccggccgagagauuguugacuuaaugugucaugcaacguucacgaugcggcuacugaguccugugagaguaccaaauuacaaucuaauaauuauggaugaagcgcacuucacagauccggcuagcauugcagcacgaggcuauauaucaacucgcguaggaaugggggaggcggcagcaauauuuaugacagcaacuccuccaggaacugcugacgccuucccucaauccaacgcuccaauacaagaugaggaaagagauauuccugaaaggagcuggaacuccggcaacgaauggauuacggauuuugcaggaaaaacaguaugguuugucccaucaauuaaggcugggaacgacauugcuaauuguuuacgcaagaauggaaagaaaguaauacaacuuuccagaaaaacauuugacacugaauaucagaaaacgaaacuuaacgacugggacuucguagugacgacugauauuagugaaaugggugcaaacuuuaaagcagauagaguuauugacccgagacgaugcuuaaaaccaguuauacuuacggacggaccugagcgagugauacucgcaggaccuaugccagucacagcagcaagugcugcacagagaagaggaagaguagggcgcaauccacaaaaagaaaacgaucaauauauuuuuaccgggcaaccacucaauaaugacgaagaccaugcacacuggacggaggcuaaaauguuauuagacaacauaaauacgccagaagguauaauacccgcacuauuugagccugagagagaaaaaucugcugcgauagauggcgaauaucgcuuaaaaggugaaagccguaaaacauuuguugaguuaaugcgucgaggagaucuuccuguuuggcuggcacacaagguagcuuccgaagguauaaaguauacagauagaaaauggugcuucgacggacaaagaaacaaucaaauauuagaagagaauauggacguagagauauggaccaaagagggcgagaagaagaaauugagaccacgauggcuagaugcccguaccuacucagauccucuagcccuaaaagaauuuaaagauuucgcugccgggcguaagucgauagcccucgaucucgucacagaaauagggcgaguucccucucaucuagcacacagaacaaggaacgcuuuagacaauuugguaaugcuacauaccucugaacauggcggcagagcuuaucgacacgcgguggaagaauuaccagaaacuauggaaacauuacuacuauuaggccuaaugauucuacuuacagggggagcgaugcuuuucuuaauuaguggaaaaggaauugggaaaacaucaauagggcuuauuugcgucauagccaguuccggcauguuguggauggcugaaauuccguugcaauggaucgcuagugcaauaguguuagaauuuuucaugaugguauuacugauaccagagccggaaaagcaaaggacaccacaggauaaucaauuggcauauguagugauaggaauacuaacucucgcugcgauaauugcagcuaaugaaaugggacuacuugaaaccacaaagagagacuuggggaugucaaaagaaccaggaguaguuucaccaacgucauaccuggauguagaucuucauccagcuagcgcauggacacuauacgcaguggcuacuaccguaauaacaccgaugcugcgccacacaauagaaaauucgacugcgaauguuucauuagcagcaauagcuaaccaggccgucguucucaugggacuugauaaggguuggccaauauccaaaauggauuuaggagucccccuauuagcccuuggcuguuauagccaaguuaacccucuaacucuaacagcugcuguauuacucuuaauaacgcauuaugcaauaaucgguccuggcuuacaagcaaaagcaacuagggaagcucagaaacguaccgcggcaggaauaaugaagaauccuacaguagacggaauuaugacuauugaucuagauccggucauuuacgacagcaaguuugaaaaacagcuuggucaagugaugcuacuuguguuaugugccguucaguuauuacuaaugcguacaagcugggcccuuugugaagccuugacguuagcaaccgggccuaucaccacgcucugggaaggcucaccagggaaguuuuggaauacaacgauagcggucaguauggcaaauauauuuagggguuccuaucuggcgggagcaggcuuggcguuuaguauaaugaaguccguuggcacaggcaaacgggggacuggaucacaaggagaaacacuaggagaaaaauggaagaagaaacuuaaccagcucagcaggaaagaauuugaccucuacaagaaaagcggaauaacagagguagacagaacagaggcgaaagagggcuuaaaacguggugaaaucacgcaccacgccgucucuagaggaucggcaaaacuacaaugguucguagaacguaacauggucauacccgaaggacgugucauagaucuuggauguggaagaggaggauggucauacuacugugcaggccucaagaaagucacagaaguccgaggauauacgaagggugguccaggucaugaagaaccaguuccaaugaguacauacgguuggaauauaguuaaauuaaugagugggaaagauguauuuuauuugccaccagaaaagugcgacacuuuauuaugcgacauaggagaaucaucgcccagcccgacagucgaggagucacgaaccauaaggguauugaagauggucgaaccguggcucaaaaacaaucaguuuuguauaaaaguucuaaaccccuacaugccuacuguaaucgaacaccuggaaaggcuccaacgaaaacauggugggaugcuaguucggaauccuuuaucgagaaauucgacacacgaaauguacuggauuucaaauggaacuggcaauaucguggcuucggucaacaugguaaguagacuuuuauuaaacagguuuacgaugacucauagacgaccuacaauugagaaagauguagauuuaggugcagggacuagacacguuaacgcagaaccugaaacaccaaauauggacguaaucggcgaacgcaucaagcguaucaaagaagaacauaauucaacauggcacuaugacgaugaaaaucccuacaaaacuugggcauaucacggauccuacgaaguaaaagcaacuggaucagccucaaguaugaucaacggcguggugaaacuauugacaaagccuugggauguuguacccaugguaacgcaaauggcgaugacugacacaacaccuuucgggcagcaaaggguauucaaagaaaagguagauacacgaaccccacguucgaugccagguacacggaagguaauggguauaaccgcugaaugguuauggcgaacucuaggucgaaauaaaaagccgcgguuauguacgagggaggaauuuacuaagaaaguuagaacuaaugcggcaaugggugcuguuuuuaccgaggaaaaucaaugggauucagcaaaagcugcagucgaggaugaagauuuuuggaagcuaguugacagagaaagagaguuacauaaacucggaaagugcgggaguugcguuuacaauaugaugggaaaacgcgagaagaaauugggggaguucgguaaagcaaaaggaagucgcgcuauaugguauauguggcucggcgcacguuauuuggaguucgaggcgcuuggauuuuuaaaugaagaccacugguucucucgugaaaauucauacucaggcguagaaggagagggauugcauaaacuggguuauauucuuagggacauaaguaaaauacccggcggagccauguaugccgaugacacagcagguugggauacaagaauuacugaggaugaccuacacaaugaagagaaaauaacccaacagauggauccagaacaucgacaacuagcuaacgccauuuuuaaacuaacauaucaaaauaaaguggucaaaguacaaaggccaaccccgaccggaacaguaauggauauaauaaguagaaaagaucaacguggcucagggcaagugggaacauacggguugaacacuuucaccaauauggaagcacagcuuauccgucaaauggaaggcgagggugucuuaucgaaagcagacuuagaaaauccgcauuugccggaaaagaaaauaacccaauggcuggaaacaaagggaguggaaagacuaaaaagaauggcaauaaguggugaugauuguguaguuaaaccuauagaugacagauuugccaaugcauuguuagcacuuaacgauaugggaaaaguucgaaaagauauuccacaguggcaacccucuaagggguggcacgacuggcaacaaguuccuuuuuguucacaucacuuucaugaacucauaaugaaagauggacgaaagcugguaguaccaugucgaccacaagaugaauugaucgguagggcacgaauuucacaaggugcuggauggucuuuacgggaaacugcauguuuagguaaggcuuaugcucagauguggucacugauguacuuucauaggagagacuuaagguuagcaagcaaugcaauauguagugcaguuccugugcauugggugcccacaaguagaacgacuuggaguauacaugcacaucaccaauggaugacaacggaagauaugcucacaguuuggaaucgaguuuggauugaagacaauccuuggauggaagauaaaacccccguaacaacaugggaaaacgugccauauuuagguaaaagggaggaccaauggugugguucucuaaucggacuuacaucuagggcuacaugggcgcaaaauauaccaacggcaauacaacagguaagauccuuaauuggcaacgaagaauuuuuagacuacaugcccuccaugaaacgauucaggaaagaagaagagagugaaggagcuaucugguaa

SEQ ID NO: 23019 - RNA, 9873 nt, Artificial Sequence
  derived and/or modified CDS sequence (opt6) from DENV-3__KT726360__SS-prME
acuagcuuguguuuaaugaugauucucccagcagcauuggcuuuucaccuuacauccagagacggagaaccaagaaugaucgucgguaaaaaugaacgaggaaaaucuuuauuauuuaaaacugcuaguggaauaaacauguguacgcucaucgcuauggacuuaggagaaaugugcgaugauacugucacauauaaaugcccacacauaacagaaguagaaccagaagacauagauuguugguguaaucuaacgaguacgugggucacuuauggaacauguaaucaggccggugaacacaggcgugauaaacguucuguugcauuagcaccgcaugugggaaugggccuagacacacguacacagacauggaugucugccgaaggcgcauggaggcaaguagaaaaaguagaaacgugggcguuacgacauccgggauucacuauucuagcauuguuucucgcgcacuauauuggaacgucacuaacacaaaaaguaguaauauuuauucuacuuaugcuaguuacgccaaguaugacuaugagaugugucggagucggcaaucgcgacuuuguugaaggccuaagcggggccacauggguagauguaguacuagaacauggaggguguguaacaaccauggcgaaaaacaaacccacauuagauauagaacuucagaaaacugaggcgacacaauuagcgacucuucguaaauuauguaucgagggaaaaaucacaaacauuacuaccgacucaaggugccccacucagggcgaagcaguauuacccgaggaacaagaucaaaauuacguauguaaacacacguacguagaccgaggauggggaaauggcuguggacuauucggaaaaggcagcuuaguaacaugugcuaaauuucaaugccuggaacccauugaaggaaaagugguccaauacgaaaaccuaaaauacacagucauuauuacgguucacacaggagaucagcaccaagucggaaacgagacgcaaggaguaacagcugaaauuacaccacaagcuaguacaaccgaagcaauauuaccagaguaugggacauugggacuagagugcaguccucgaacaggucucgauuuuaacgaaaugauucuucucacaaugaaaaacaaagccuggaugguucaucgccaaugguucuucgaccugccacucccauggacguccggagcgacaaccgaaacuccaacuuggaauagaaaagaacuuuuaguaacauuuaaaaacgcucaugcaaagaaacaagaagugguaguauuagguagucaagagggagcaaugcauacagcgcuuacuggggcaacagaaauacaaaauagugggggcacaucaauauuugcuggucaucugaaaugccgacuaaaaauggacaaacuggaacugaaaggaaugaguuaugcaaugugcacaaacacuuuugugcuuaagaaagaggucucagaaacccagcauggaacuaucuugaucaaaguagaauacaaaggcgaagacgugccauguaaaaucccauuuagcaccgaagauggacaaggaaaagcgcauaauggcagauugauuacagcaaacccagugguaaccaagaaagaggagccaguuaacaucgaagccgaaccaccguuuggcgagucaaauaucgucauagguauaggugauaacgccuuaaaaauaaacugguauaagaaaggaucauccauagggaaaauguuugaggcaacagcuagaggggcccgcagaauggccaucuuaggagauaccgcaugggacuucgguuccgucgggggaguacuaaacagucucgggaaaaugguacaucaaauuuucggaagugcauauacagcucucuucagcgguguuucguggguaaugaaaauaggaauaggaguauugcucacuuggauagggcuuaauucgaaaaauacgagcaugucguuuaguuguaucgcgaucggcauuauuacuuuauauuuaggagcaguaguacaagcugauauggguugcguaauaaacuggaaagguaaagagcuaaagugcggcucaggcaucuuugugacuaacgagguccauaccuggacggaacaauacaaauuucaggccgacucacccaaaagauuagcaacggcaaucgcgggugccugggaaaacggugucugcggaaucagaaguacuacucgaauggaaaaucuccuuuggaaacaaauagcaaacgaacuaaauuacauacuuugggagaacaacauaaagcugacgguaguuguaggggauauaauuggaguauuagaacagggaaaaaggacacuuacuccgcaaccuauggaauuaaaguauagcuggaaaaccuggggaaaagcuaaaaucgugaccgcagaaacgcagaauagcucauucauuauugauggaccaaauacacccgaaugcccgagugccaguagagcuuggaauguaugggaaguagaagacuauggguuuggaguguucacaacgaauauuuggcuaaaacuucgagagguguacacacaacuaugugaccaucgacugauguccgcugccguuaaagaugaacgagcaguacacgcagauaugggauauuggauagaaucccagaaaaacggaagcuggaaguuagaaaaagcguccuuaauagaaguaaagacaugcacguggcccaaaagucacacccuauggaguaauggcguauuagaaagugauaugauaauaccuaagaguuuagcagguccaaucagccaacacaaccauagaccgggauaucacacucaaacggcaggaccuuggcaucuaggcaagcuagaacuugacuuuaacuauugugaagguacgacaguaguuauaaccgaaaauuguggcacgagaggcccaaguuuacguacgacuacuguaagcggaaaacuuauacaugaauggugcugcagaucaugcacauuacccccacuacgauauaugggugaggaugggugcugguacggaauggaaauaagaccuaucucagagaaagaggaaaauaugguuaagagucuaguaucugccgggucggguaaggucgauaauuuuacaaugggaguacucugucuugcgauuuuguuugaagaaguuaugagaggaaaauucgguaagaaacacaugauugccgguguauuuuucacguuuguucuucuauuguccggccagaucacuuggagagacauggcacauacauuaaucaugauaggguccaaugcaagugacagaaugggaaugggaguuaccuaccuagcucuaauugcuacauucaaaauacaaccauuccuagcuuuaggauuuuucuuaagaaaacuaacaucccgugagaaucucuuacugggcgugggccuagcaauggccacgacacuacaacucccagaggauaucgaacaaauggcaaacgggauugcacuugggcuuauggcauuaaaacuaaucacucaguucgaaacguaucaacuauggacugcucugauuucgcucacuuguucgaacaccaucuuuacucucaccgucgccuggaggacugcaacuuuaaucuuagcuggggugucccuacuaccgguuugucaaaguucauccaugcgaaaaacggacugguuaccaauggcuguggccgcaaugggaguuccaccccuccccuuguucauuuucucucuuaaagauacacucaagaggcgaucguggcccuugaaugaaggagucauggcaguuggcuuaguaucuauucuagcaagcucauuacuccgaaaugauguacccauggccggaccccuaguugcagggggacuacucauagccuguuacgugaucacgggaaccucagcagacuuaacgguggaaaaggcugcugacauaacaugggaagaagaggcggaacagaccggaguaagccauaaucuaaugauuaccguagaugaugauggaacaaugcguauaaaagaugaugaaacggagaauauacucacuguacuguugaagacggcauuacuaauaguaucuggaauuuuccccuauaguaucccagcgacucuauuaguauggcauaccuggcagaaacaaacacagcguuccgguguauuaugggacguaccaucaccaccagaaacacaaaaagcugaguuagaggaaggaguauauagaauaaagcaacaaggaauauucggaaaaacgcaaguaggagucggaguacagaaagaaggaguuuuccauacaauguggcauguaacuagaggggcugugcuaacgcauaacgggaaacgacuagagccaaauugggcguccguuaagaaagaucuaauaucauauggaggaggauggcgauuaucagcacaguggcaaaagggagaagaaguucaggucauugcgguggaaccagggaaaaacccuaaaaauuuccagacaaugccuggaacauuucagacuacaacuggugaaaucggugcaauugcauuagacuuuaaaccagguacgucaggguccccaaucauaaacagggaaggaaaaguagucgggcuuuauggcaauggugucgugacaaagaacgguggcuauguaucggguaucgcgcaaacaaacgcagagccggacggcccaacaccagaacucgaggaagaaauguuuaagaaacgaaauuugacgauuauggaucuacacccagguagugguaagacucguaaguaucucccugcaaucgugagggaagccaucaaaagaagacuuagaacacuaauacuggcaccuacaagagucguugcagcagaaauggaagaggcccugaaaggacucccaauaagauaucagacuaccgcaacaaagagcgaacauaccgggagggagauaguggaccucaugugucacgccacauuuaccaugagacuuuuaaguccuguuagaguuccuaauuauaaucuaauuauaauggacgaagcccacuucacugauccugcauccauagcggcaagggguuauauuucaaccagaguugguaugggagaagccgcagcaaucuuuaugacugccacaccuccagguacugcggacgcuuuuccgcagagcaacgcuccuauacaggaugaagaacgagauauacccgaaaggucauggaauaguggaaaugaauggauaacagauuucgccggcaaaacugucugguuuguuccuucaaucaaggcaggcaaugauauagccaauugccuucguaaaaaugggaagaaaguuauucaacugagccgaaaaacuuuugauacagaauaucagaagacgaaauuaaacgauugggauuuuguaguuacgacagauaucagugaaaugggugcaaauuucaaggcugacagaguaauagacccaagacgauguuuaaaaccggucauauugacagacggaccggagcgaguaauccuagcaggaccaaugccuguaaccgcagcuagcgcagcacaacgaagaggccguguaggacgcaacccacaaaaggaaaaugaccaauacaucuucacaggucaaccacuaaauaaugaugaagaucaugcucauuggacagaggcaaaaauguuauuggauaauauaaacacuccagaagguauuaucccagcgcuauucgaacccgaacgugaaaaaucagcugcaauugauggcgaauaucgccuuaaaggagaaucuagaaaaacauucguagaacugaugcggcguggggacuuaccaguauggcuagcacauaaaguugcuucggaaggaaucaaguacacugaucgaaaaugguguuucgauggccaaagaaacaaucaaaucuuagaagaaaacauggauguagagauuuggacaaaagagggagagaaaaagaaacugcguccuagauggcuagacgcuaggacguauagugacccgcuagccuugaaagaauuuaaagauuucgcagcugguagaaaaaguauugcauuagauuuagugacagaaauaggaagaguaccuucacacuuagcacauagaacacguaaugcguuggauaaccuagucaugcuacauaccuccgaacaugguggucgcgcauaucggcaugcaguugaagaacuaccggaaacaauggaaacccuauuacuuuugggguugaugauacuauugacaggaggugcuauguuguuccugauuagugguaaaggaaucgggaaaaccucaaucgguuuaauuugugucauagccucuaguggaauguuauggauggcagaaauaccucuucaauggauagcaucagcaauaguccuagaguucuuuaugaugguauugcucauuccugagccugaaaaacaaaggacaccccaagacaaucagcuagcuuauguuguuaucggcauauuaacucucgcagcgauaauagccgcaaacgaaaugggacuguuagagacuacuaaaagagaucugggcaugucaaaggauccaggcgucgugucacccacgaguuacuuggacguggaccugcacccugccucugcuuggacauuauacgcaguagcgaccacuguuauaacacccaugcucagacacacaaucgaaaauucaacggcgaacgucagccuggcagcaauagcaaaucaagccguaguguuaaugggguuggauaaagguuggccuauuaguaaaauggauuuaggcguaccgcuccuagccuuaggaugcuauucgcaaguuaacccgcuaacucuaaccgcagcuguuuugcuuuuaauaacacacuacgcaauaauuggaccgggucuacaagcgaaagcuacaagagaagcacaaaagaggacagcggcuggaauuaugaaaaacccaacaguagauggaauuaugacgaucgacuuagauccaguaaucuaugacucaaaauucgagaagcaacugggucaaguaaugcuccuaguucuaugcgccguacaauuauuauuaaugaggaccagcugggcacuaugcgaagcacuaacacucgcgacaggcccaauuacuacuuugugggaaggaucaccgggaaaguuuuggaauacaacgaucgcgguuaguauggcaaacauauuucggggaaguuauuuagcgggugcaggauuggccuucaguauuaugaaaagcguagguacugguaaaagagggacaggaagccaaggagaaacuuuaggagaaaaauggaagaaaaaguugaaccaacuuucccgaaaagaguuugaucuauacaagaagagugguauaacggaaguugauagaacggaagcaaaagaagguuuaaaacgaggagagauuacucaucaugcagucucgagaggcucagcaaaacuccaaugguucguugagcgcaacauggucauuccugaggggagggugaucgacuuaggauguggccguggugguugguccuacuauugugcaggucuaaagaaggucacagaaguacguggcuauacaaaaggcgggccaggacacgaggaaccggucccgaugagcacuuauggguggaauauuguuaaacuuaugagugggaaggauguguuuuauuuaccaccggaaaaaugcgauacacuguuaugcgacauaggcgaaagcaguccuaguccaacaguagaagaaagccgaacgauuagaguucuuaaaauggucgagccuuggcucaagaauaaucaguuuuguauuaagguccucaauccauacaugccgacaguaauagaacaccuagaacgacuacaacgcaaacauggagguaugcuugugcgaaauccuuuauccagaaauuccacucaugaaauguauuggauaucgaacggaaccgguaauauaguugcaucuguaaauaugguuagucguuuacuccuaaauagauuuacgaugacucaucggcgaccuacaaucgaaaaggaugucgaucuuggcgcaggcaccagacacguuaaugccgaaccggaaacaccaaauauggaugucauaggagagagaauaaaaagaaucaaagaagaacacaauaguacuuggcauuacgaugacgaaaauccauauaaaacaugggcguaccauggaucauacgagguaaaagcgacagguagugcuucuuccaugauaaauggcguggucaaauuauuaacaaagccaugggaugucgugccaaugguaacgcaaauggcaaugacagacacaacaccuuuuggacagcaaagaguuuuuaaggaaaaaguagauacucguacuccccgaucaaugccaggcacacgcagaguaaugggaauaacugcagaaugguuauggagaacauuaggaaggaauaagaaaccccgucuauguacgcgagaagaguucaccaagaaagucaggacaaaugcagcaaugggugcuguguucacagaagagaaccagugggauucagcgaaggccgcuguagaagaugaagauuucuggaaacuuguggacagagaaagggagcuacauaaauuaggaaaaugugguucauguguauacaacaugaugggaaagcgagagaagaaauuaggcgaauuugggaaagccaagggcucacgcgcuaucugguauauguggcuaggugccagauaccuagaauuugaagcauugggguuccuaaacgaggaucauugguuuaguagagaaaauucauauucaggaguugagggagaagguuuacauaaacuugguuauauucuccgugacauuucgaaaauccccgguggagcaauguacgcagaugacacagcuggaugggauacccggauuacagaagaugauuugcacaaugaggaaaagaucacgcaacaaauggauccagaacauagacaacuggcaaaugcaauauuuaaauugacuuaucaaaauaagguugugaagguacaaagaccuacuccaacagggacugugauggacauaauaaguagaaaagaucaaagaggauccggacagguugguaccuauggacuuaauacuuuuacaaacauggaagcgcaguuaauacgccaaauggaaggcgaaggggucuugucuaaagcagauuuggagaauccucaucugccggagaagaaaauuacgcaguggcuagaaacgaaagguguugaaagauugaaacggauggcuaucagcggggacgacuguguaguaaagccaauagacgauagauucgcaaacgcacuauuagcacuaaaugauaugggaaagguaagaaaggauauaccccaauggcaaccaucuaaggguuggcaugauuggcaacaagugccguuuuguagucaucacuuccaugaguuaauuaugaaggauggacgcaagcuagugguaccuuguaggccccaggacgaauuaauuggccgagcacggauaucacaaggugccggcuggucguuacgugaaacggcuugccugggaaaagcauaugcccaaauguggucguuaauguauuuccaucggagagaccuuagacuggcauccaacgccaucugcucugccgucccagugcacuggguaccaaccucacgaacaacuuggaguauacaugcucaucaucaguggaugacaacugaagacaugcuaacaguauggaaccgcguauggauugaagauaauccguggauggaagauaaaacuccaguaacaacaugggaaaauguaccauaucuaggaaaaagagaagaucaauggugcgguucucuaauaggcuuaacuuccagagcgacgugggcucaaaacauaccaacagcaauccaacaaguccgcucauuaauaggcaaugaagaguuucucgacuacaugcccucuaugaaacgauuccgaaaggaagaagaaucagaaggugccauaugguaa

SEQ ID NO: 23020 - RNA, 9873 nt, Artificial Sequence
  derived and/or modified CDS sequence (opt6) from DENV-3__KF041259__SS-prME
accucacuaugcuuaaugaugauacugccugcggcgcuggccuuccaucuuacuucaagggauggugaacccaggaugauuguugggaaaaacgaaagggguaaaucucuacuauuuaaaaccgcgagcggaauaaacauguguacacuaauagcaauggaccuaggagaaaugugcgaugauacaguaaccuacaaaugcccccauauaaacgaagucgaacccgaagauaucgauuguugguguaacuugacauccacauggguaacauauggaacaugcaaucaagcaggagaacacaggagggauaaaagaagcguagcauuagcaccgcauguaggaaugggacuagauacaaggacgcaaacguggauguccgccgaaggagcuuggcgacaaguagaaaaaguggaaaccugggcuuuacgucauccuggauuuacuauauuggcccuguuucucgcacacuauauugguacaaguuuaacucaaaaaguuguuaucuucauccuauuaauguuaguaacaccuucaaugacaaugcgauguguaggaguaggaaaucgugauuuuguugaagggcuuuccggagcgacuuggguugauguuguucucgagcaugguggcugcguaacgacaauggccaaaaauaaaccuacauuggacauugaacuacagaaaacugaggcaacgcaauuagcuacccucaggaaauuaugcauagaagguaaaauuacaaauauaacgacagacuccaggugcccgacacaaggagaggccguacuccccgaggaacaagaucaaaauuacguuugcaaacauacauacguggauagaggauggggaaacggauguggccucuucggaaaaggcucucuaguuacaugugccaaauuccagugucuugaacccauugaaggaaaaguggugcaauaugaaaaucuaaaauacacaguuauaauaacuguacauacaggugaccaacaucaaguuggcaaugaaacucaagggguuacugcagagauaacaccgcaagcuagcacaacugaagccauacuaccugaauauggaacgcucggauuagagugcucaccaagaacaggucuagauuuuaaugaaaugauucuccuaacaaugaaaaauaaagcauggaugguucaccgacaaugguucuuugaucucccccuaccuuggacaaguggcgcuacuacagaaacuccaacguggaaucgaaaagagcuucucguaacauuuaaaaacgcucaugcuaagaaacaagaggucguaguccuaggaucgcaagaaggagcaaugcacacggcauuaacaggcgcuacagaaauacaaaauaguggcggaacaucaauauuugcagggcauuugaaaugucgccucaagauggacaagcuagaacuaaaaggaaugaguuacgcuaugugcacaaacaccuucguacucaaaaaggagguaagugaaacacagcauggaacaauacuuauuaaaguagaauacaagggggaagaugcgccauguaagaucccauuuucaaccgaggacggucaaggcaaagcccauaaugggcgccugauaacugccaaucccguagugacgaagaaagaggaaccuguaaauauagaagcggaaccgccauucggagaaucaaauauaguaauugguauaggugacaaugcguugaagauuaacugguacaagaaaggcucuaguaucggaaagauguuugaagccacugcaagaggagccagacgaauggcaauacuuggagauacggcuugggauuuuggaucaguaggagguguacugaacucauuagggaaaaugguacaccaaauauuuggcucagcauauacugcgcucuuuucagguguaagcugggucaugaaaauuggaauaggcguucuccucacguggauagguuuaaauucuaaaaauacuucuaugaguuuuagcuguaucgcuauagguaucauaacccuauauuuaggggcuguagugcaagcggacauggguugcgucauuaacuggaagggcaaagaauugaaaugcgguagcggcauauuuguaacuaacgaaguacacacuuggacggaacaauauaaguuucaagcggauucccccaagagacuagccaccgcuaucgcuggugcgugggaaaacggaguaugcggcauaagaucaacaacuaggauggaaaauuuacuauggaagcagaucgcaaacgaauuaaauuauauuuuaugggaaaacaacauuaaacuuaccguaguuguuggggauacgauagggguucuugaacaaggaaagagaacacuaacaccccaaccaauggaauuaaaauauucauggaagacaugggggaaagcuaaaauaguaacugcugagacucaaaauucaaguuuuaucauagauggaccuaauacuccagaauguccaucugcaucgcgagcguggaaugugugggaaguugaggacuauggcuuuggaguauuuacaacaaacauauggcuaaaacuucgagaaguauauacucaaaugugcgaucaucgccugaugagugcagccgugaaagaugaaagagcuguacacgcugacaugggauauuggauugagagucagaaaaauggcagcuggaaacuagaaaaagcuaguuuaauugaggucaaaacauguacguggccuaaaucccauacucucuggagcaauggaguacuugaaagugacaugauaauuccaaaaagccuugcuggucccauuagccaacacaauuaccgaccuggauaccauacccaaacggcuggaccauggcauuuaggaagauuagaguuggauuuuaauuauugcgaagguaccacaguaguuaucacggaaaauugcggaacgagaggcccaucccuacgcacuacgacuguuuccggaaagcuaauucaugagugguguugcagaagcugcacacuaccaccccuuagauauaugggagaagauggguguugguacggaauggaaauuagacccaucagugaaaaagaggaaaacaugguaaagagcuugguuucugcuggcucugggaagguugauaauuucacaaugggaguucucugucuugcuauauuauucgaagagguuaugcgagguaaauucggcaagaaacauaugauugcugguguguucuuuacauuuguguuguugcuaaguggucagauaacguggagagacauggcacauacacuuauaaugaucggaaguaaugcaagugaccgcaugggaaugggggugaccuaucuggcucucaucgcuacauuuaagauacagccauuucuugcguuagguuucuuucuaaggaaauuaacgucacgagaaaauuuguuacugggcguaggcuuagcaauggcaacaaccuuacaacuucccgaggacauugaacagauggccaacggaauagcuuuaggacuaauggcccucaaacuaauaacucaauuugaaaccuaccaauuauggacagcgcuuauuucacuaacuuguucuaacacuaucuuuacacuaaccguagcauggcguacugcuacacugauucuagcuggaguuucacuuuuacccguaugccaauccucuuccaugagaaaaacugacugguugccgaugacaguagcugccauggguguaccaccucuacccuuauuuauauucucgcuaaaagauacccuuaaacgacgaagcuggccauuaaaugagggugucauggccguaggcuuagugucgauacuugcaaguagucuucuaaggaaugauguuccaauggcuggacccuugguugccgggggccuccugauagccuguuacguaaucacaggcacgucagcugaucuuacugucgaaaaagcagccgauguaacuugggaagaagaggcagagcaaacaggcgucucucacaaucuaaugauaacggucgacgaugacggaaccaugagaauaaaagacgacgaaacugagaacauacuaaccguauuauugaaaacagcucucuuaaucguuucagguauuuuuccuuauucaauucccgcaaccuuacucgucuggcauaccuggcaaaagcaaacacagagaucaggaguccuuugggauguuccuucaccacccgaaacacaaaaagcugaauuagaagaagguguauaucguauuaaacaacaaggaauccuaggaaaaacucagguaggugucggaguccaaaaagaagggguauuccacaccauguggcauguuacccgaggagcgguucuuacucauaacgggaaaagacuagagccaaacugggcaucggugaagaaagacuugauuaguuauggagggggauggagauugucggcacaauggcaaaagggugaagaaguacaaguaauugcaguugaacccggcaaaaacccuaaaaacuuccaaacuaugcccggcacuuuucaaacaacuacaggagagaucggagcaaucgcguuagauuucaaaccgggcacuucaggaucuccuauuauaaauagagaagguaaaguggugggauuauauggaaauggaguggugacuaaaaauggaggauaugugaguggcauagcccaaacuaaugcagaaccugauggucccaccccagaacuggaagaagaaauguuuaagaaacgaaaccuuacaauaauggaccuucauccggggagcggaaaaacgaggaaguaccuuccagcuauugucagagaggcuauuaaacggaggcuuagaacacuuauacucgcacccacacgagucguggcagcggaaauggaagaagcucuaaaagguuuaccuauaagguaucaaaccacagcaacaaagucagaacacacaggaagagaaauaguagauuugaugugucacgcaacauucacgaugagauuauuauccccgguaagggucccaaauuauaauuuaaucauaauggaugaggcucauuuuacugauccagccucuauagcagcgcgaggauauauuuccacccguguuggaaugggggaggcagcugcaaucuucaugacugcgacaccaccagguacggcggaugcguuuccacaaagcaacgcucccauccaagaugaagaacgcgauauccccgaacgaucuuggaacuccgggaaugaauggauaacggacuuugcaggaaaaacagucugguucguaccgucgauaaaggcuggaaacgauauagccaauugccuaaggaagaauggcaagaaaguaauucaacucaguagaaagacuuuugacacggaauaucagaaaacuaaguugaacgauugggauuuuguuguuaccacagauauaagcgaaaugggagccaacuuuaaagcugaccgaguaauagauccucgucgaugcuugaaacccguaauacuaacugauggaccagaaagaguuauccucgcgggaccaaugcccguaacagcagcaagugcugcacaaagaagagggagaguaggucguaacccccaaaaagaaaaugaccaauauauuuuuacgggccaacccuuaaauaaugacgaagaucaugcacacuggacagaagcaaaaaugcuccucgauaauauuaauacuccagaagguaucaucccagcgcuauuugagccagagcgcgaaaaaucagcggcuauugacggagaauaucgauuaaaaggugaaagucgcaaaacauucguagaacugaugagaagaggugauuuaccgguuuggcucgcgcauaaaguugcaucagaagguauaaaauauacagauagaaaauggugcuuugauggacaacgaaacaaucaaauacuagaagaaaauauggaugucgagauuuggacuaaagaaggggaaaaacgaaaauuacguccuaggugguuagacgcuagaacuuauuccgacccccuugcacuaaaagaauuuaaggacuuugcagcaggccguaagucuaucgcauuagaucuuguuacagaaauugguagggugccaucgcaucuggcucaucguacucgaaaugcucucgacaaucucgugauguuacauacgucagaacacggugggagagcauacagacaugcuguagaagaauugcccgaaacaauggaaaccuuguugcuccugggcuuaaugauccuauuaacagggggagcaaugcucuuuuugauaaguggaaaaggaaucggaaaaacgaguauuggcuuaauaugugugauugcgagcucugguaugcuauggauggcugagaucccccugcaguggaucgcaucggcaauaguacucgaauuuuucaugaugguccuauugauccccgaaccugagaaacaacgaacaccccaggacaaucaauuagcguauguaguuauagguauacuaacucucgcagcuauaauugcagcuaacgaaaugggauuauuagaaacaacuaagcgagaucuggggaugaguaaggaaccaggagugguaucuccgacuucuuacuuagauguugaccuacacccagcgagugcuuggacucuauacgccguagcaacuacaguaauuaccccaaugcugagacauacuaucgaaaauaguaccgcaaauguaagccucgcagccauugcaaaccaagcaguuguauuaaugggauuggacaaagguuggccgauauccaaaauggaccucggcgucccccuauuagcauugggauguuauucacaggucaacccccuaacauuaacggcugcaguguuacuucugauuacccacuaugcaauaauugguccagggcuacaagcaaaagcuaccagggaagcacagaaaagaaccgcagcaggaauaaugaaaaacccgacaguugacggcauaauaacgauagaucucgacccuguaaucuacgacucgaaguucgaaaaacaacuaggacaggucauguuacuuguuuuaugugccguacaacuccuauuaaugcgcacaucuugggcuuugugugaagccuugacauuagcaacgggaccaauaacuacuuugugggagggcagcccagguaaguuuuggaauacuacaauagcaguuucuauggcaaauauuuuccgaggauccuaucuagcaggagcggguuuagcauuuaguaucaugaagucggugggcacugggaagagaggcaccggaagucaaggagaaacuuuaggggaaaaauggaagaagaaauuaaaccagcuaagucgcaaagaguuugacuuauauaagaaaucaggaauuacugaagucgacagaacagaggcaaaggaaggauuaaagagaggcgaaacaacacaucaugcugucucgcgagguagcgcaaaauugcaaugguucgucgaaaggaacaugguuaucccagaaggcagggucauagauuuaggcuguggcagaggaggguggucauacuacugcgcagggcucaagaaaguaacagaaguaagaggauauaccaaagguggaccaggccaugaagaaccuguaccaaugucaacauacggauggaauauaguaaaacuuaugagcgguaaggauguauuuuacuuacccccugaaaaaugugauacguuacuaugcgauauaggggagucuaguccaucaccaacaguagaagaaagcaggacaauaaggguccugaaaaugguggagccguggcugaaaaacaaucaguucugcauaaaagugcuaaauccauauaugccugcaguaauagagcauuuagaaagacuacagagaaaacaugggggaaugcugguucggaauccauugagucgaaauucaacacacgaaauguauuggauaucaaauggcacaggcaauaucguaagcucaguuaacauggucagccgacuucuccucaaucguuuuaaaaugacgcaucggagaccaacgauagaaaaagauguggacuuaggagcagggacacgacacguaaacgcugaacccgagacgccuaauauggauguaauuggugaaaggauuaaacggauaaaagaggagcauaauucuacauggcauuaugacgacgagaauccauauaaaacuugggccuaucacgguucguaugaaguuaaggcuacaggcucugcuucaagcaugaucaauggaguaguuaaacuucuaaccaagccaugggacguaguaccaaugguuacgcaaauggcuaugacugauacaacaccauuuggucaacaaagaguauuuaaagaaaaaguugauacacguacgcccagaccaaugcccgguacacgaaaaguaauggaaaucaccgcagaauggcuuuggagaacacuuggucgaaacaaaaggccaaggcuauguacucgagaagaguucacuaagaaagugagaacaaaugcugcuaugggagcgguauuuacagaagaaaaucaaugggauucggcaaaggcggccguagaggacgaagaguucuggaagcuaguagaucgagaaagagaauuacacaaauuaggcaaauguggaucaugugucuacaacaugaugggcaagcgcgagaaaaagcugggggaguucgggaaggcuaaaggaucccgugccauuugguauaugugguuaggagcucgauaucuggaauuugaagcacuuggcuuccuaaaugaagaccauugguucucacgugaaaauagcuacucugguguugagggagaaggacuacauaaacuuggauauauacuaagggacauaaguaaaauuccaggaggggcaauguaugcugaugauacggccggcugggacacaagaauuacugaagacgacuuacauaacgaggagaaaauaacacaacaaauggaucccgagcaccguuuauuagcuaacgccauauuuaaauugaccuaucaaaauaaaguagugaaggugcaacgcccgacccccacagggaccgucauggacaucauaucaagaaaggaucaacgggguucuggucagguugguacauacggacugaauacuuucacaaacauggaagcgcaauugguacgucaaauggaaggugaagguguacuaaguaaagcagaccucgaaaacccccacuuaccagagaagaaaaucacacaauggcuugaaacuaagggcguugagcgccuaaagcguauggcaauaagcggugacgauuguguagugaaaccuauugaugaccgauucgccaaugcacuuuuggcccuuaaugacauggggaaagugagaaaagauauaccccaauggcagccaucaaaaggauggcaugacuggcaacagguuccauuuuguucacaccauuuccacgaacuaauaaugaaggaugguaggaaacucgucguaccaugccguccacaggaugagcuaauagggcgagcaagaaucagucaaggggcaggguggagccuaagagagacagcaugcuuaggcaaggcuuacgcgcaaauguggucacuuauguauuuucauagacgcgaucuuagacuagcaagcaaugcaauuuguuccgcaguaccgguucauuggguaccaaccucacgcacaacauggucuauacaugcccaucaucaauggaugacaacugaagacauguuaacugucuggaacagggucuggauugaagauaauccuuggauggaagauaaaacuccagugacuacuugggaaaauguaccauaucuaggcaaacgagaagaccaaugguguggaaguuuaauaggacucacaagucgcgcaacaugggcccaaaauauuccaacagcaauacaacaagugcguucccucauugggaacgaagaguuccuugauuauaugccuaguaugaaacgcuucagaaaagaagaggaacucgaaggggcuaucugguag

SEQ ID NO: 23021 - RNA, 9873 nt, Artificial Sequence
  derived and/or modified CDS sequence (opt6) from DENV-3__KF041258__SS-prME
acuuccuuguguuuaaugaugauacucccagcugcuuuagcauuucauuuaacgucacgcgauggggaacccagaaugaucguuggcaaaaacgaacgcgguaagagcuuauuguuuaaaacugcgucugguauaaacauguguacuuuaauagcgauggacuuaggcgaaaugugcgacgauacuguaacauauaaaugcccacauauaacagaaguagaaccagaagacauagauuguuggugcaacuuaacaaguacuugggucacuuacggaacuuguaaccaagcaggcgaacaucgacgugacaagagaaguguugcuuuagcgccacauguaggaauggguuuggacacacgaacacaaacguggaugagcgccgagggggcauggagacaaguugaaaaaguugaaacaugggcauuacgucauccaggauucacuauauuagcccuauucuuagcucacuacauuggaaccaguuuaacccaaaaagugguuauauuuauacuacucaugcuaguuaccccgucaaugacuaugcgguguguuggcguagguaaucgcgacuuuguagaaggacuaaguggcgcaacauggguagacguaguacuggaacacggcggcugcguuacaacaauggccaaaaacaaaccuacgcuagauauagagcuacagaaaaccgaagcaacccaacucgcaaccuuacgaaaacuuuguauagaaggaaaaauaaccaacauaacaacugacagcagaugcccaacgcaaggagaggcaguguugccggaagaacaagaccaaaauuaugucuguaaacauacauacguugacagaggaugggguaacgguugcggcuuauuuggcaaagguucuuuaguaacgugugccaaauuucaaugucuugaacccauagaaggcaaaguuguacaauaugaaaaccuaaaauauacugugauuauuacaguacacacgggggaucaacaucaagucggaaacgaaacccaaggcgugacggcugaaauaacaccccaggcuucgacuaccgaagcaauucuaccggaauaugggacacuaggacuagaguguucgccccguacuggccuugauuuuaacgaaaugauauugcuaacaaugaaaaacaaagcauggaugguacacaggcaaugguuuuucgauuugccguuaccauggacaaguggggcaacaacugaaacucccacauggaaucguaaagagcuguuaguaaccuucaaaaacgcgcaugccaagaaacaagaaguaguugucuuagguagucaagaaggagcaaugcauacagcguugacaggugcuacggagauacaaaauaguggaggaacuucuauuuuugcgggacaccuaaaaugcagauuaaaaauggacaagcuagaacuaaaaggaaugucauaugcaaugugcacuaacacauucguacugaaaaaggagguuucagagacacagcaugguacuauccugauuaaaguugaauacaaaggcgaagaugcucccugcaaaauuccguuuucaacugaagacggacaaggaaaagcacacaacggacgacuuauaacagcgaauccuguaguaacuaagaaagaagaaccagucaacauagaagcagaaccacccuucggagaaucgaacauaguuaucggcauaggugauaacgcacuaaagauaaauugguauaaaaaggguagcucuauuggaaaaauguucgaagccacggcaagaggugcuagaagaauggcaauauuaggagacacugccugggacuucgguagugucgguggcgucuuaaauucucuaggcaaaaugguccaucagaucuuuggaagugcuuauacagccuuauuuucggggguaagcugggucaugaaaauuggaauaggcguacuauuaacuuggauaggccuuaauucgaagaacacaagcaugucauuuucuugcauugcgauagggaucaucacuuuguaucuaggagcggucguacaagccgauaugggaugcgugauaaacuggaagggaaaagagcuuaaaugcggaagugguaucuucgucacaaaugaagugcacacguggaccgagcaauacaaguuucaagcagauucaccgaaacgccuugcaacagccaucgcaggagcuugggaaaacgggguauguggaauaagaucuacuacuagaauggaaaaucucuuauggaaacaaauugccaaugaguuaaauuacauacucugggaaaacaacauuaagcucacgguuguagucggagacacaauaggcguauuagagcagggcaagagaacguuaacgccacagccaauggaacuaaaguacucauggaaaacauggggcaaagcgaaaauagucacagcggagacccaaaauucuagcuucauuauugauggaccuaauacgccagaauguccuucagcaaguagggcuuggaauguaugggaagucgaagauuacggauuugguguauuuacaacgaacauaugguuaaaacuaagggaaguuuacacacagaugugcgaucaucgauugaugagcgccgcagucaaagacgaaagagccgugcaugcagacaugggauauuggauagaaucccaaaagaauggcucauggaaauuagaaaaagcaucauuaauugaaguaaaaacguguaccuggccgaaaagccauacccuauggucuaauggaguacuagaaucagacaugauaauaccaaagagucuagcgggaccaauaagucagcauaacuauagacccggcuaucauacucaaaccgccgguccguggcaccuuggcaaacuggaacuagacuucaacuauugugaaggcacaacagugguaauaacagaaaauugcggcacaaggggaccgucuuuaagaacuacuacuguuagugggaagcuaauacacgaaugguguuguagaagcuguacgcuucccccauuacgcuauaugggagaagaugggugcugguacggaauggaaauuagaccuauaagcgaaaaagaggagaacauggugaaaucccuaguuucugccggauccgguaaaguugauaauuucacuaugggaguacucugucucgcaauauuauuugaagaaguuaugcgagguaaauuugguaagaaacauaugauugcggggguauucuuuaccuuuguuuuguuauugucuggacaaauaaccuggcgugauauggcucauacuuuaauaaugauuggaucaaaugcguccgaucggauggggaugggcguuacauaucuggcauuaauagcaacauuuaaaauacagccuuuccuugcucuaggauuuuuccuaagaaaacuaacuagccgcgagaaccuucuacugggcgugggacuggccauggcaacuacgcuacagcuaccagaagacauagagcaaauggcgaauggcaucgcucuagggcugauggcauugaagcucaugacacaauuugaaacuuaucagcuauggaccgcauuaauaucauuaacuuguuccaauacuaucuucacgcuaacaguggcuuggcgaacugccacacucauuuuggcaggcguaucguuauuaccuguaugccaauccucaaguaugcguaaaacagauuggcugccaaugacugucgcugcaaugggaguaccuccacuuccguuguuuaucuucuccuugaaagauacucuuaaacgcagaucauggccucuaaaugaggggguuauggcugugggccucguaaguaucuuagcgaguagcuuacucaggaaugacgucccaauggcgggaccauuaguagcaggcggacuuuuaauugcaugcuauguaaucacagguacgagugcagauuuaacaguggaaaaagcagcagacguaacaugggaagaagaagcugaacaaacaggaguaucgcauaauuuaaugauaacagucgaugacgauggcacaaugaggauuaaagaugaugaaaccgagaauauauugacgguucuacuaaaaacugcucuuuuaauuguaaguggaauuuuuccuuauucaauacccgcgacauuauuaguuuggcacacuuggcagaaacaaacgcaaagaucuggcgucuugugggauguaccaaguccuccugagacacaaaaggcggaacuugaggagggaguauaucguauaaaacaacaaggaauacuaggaaaaacucagguaggagucggcguacagaaagaaggcguauuucauacuauguggcauguaacuagaggagcaguucuaacacacaauggaaaaagauuagaaccuaacugggcaucuguuaagaaagaucuaaucuccuauggaggaggauggcgucucagcgcgcaauggcagaagggagaagagguccaaguaauugcugucgaaccagguaagaaucccaaaaauuuccaaacaaugccugguacauuucaaacaacuacgggcgaaauuggugcgauagcuuuagauuuuaagccuggaaccuccgguucaccuauaaucaaucgagagggaaaaguuguuggacuguacggaaacgguguaguuacgaaaaacggcggauauguaagugguauugcucaaacgaaugcugagccugaugggcccacuccagaguuagaagaagaaauguucaagaaaagaaaucucacaaucauggauuugcauccuggauccggaaagaccagaaaauaucuaccagcuauaguucgugaagcaauaaaacgaaggcuacgaacacuaauauuagcccccacgagagugguagccgcagaaauggaagaggcccuaaaaggacuuccaauaagguaucagacuacagccaccaaauccgaacacacuggcagagagauuguugauuuaaugugccaugcuacguucacuaugagauuacuuucgccaguacgcgugccuaauuacaaucuaauuauuauggacgaggcucacuuuacagacccagcaucaauugcugcuaggggcuauauaucaacgagaguaggcaugggugaagcagcugcaauuuucaugacggcuacaccgccggguacugcugaugcuuuuccccaauccaaugcaccaauacaagaugaggaaagagauaucccagagcgcucuuggaacucaggaaacgaguggauuacagauuuugcgggcaaaacuguaugguucgugccuuccauuaaggccggaaaugauauugcgaacugccuaaggaaaaacggcaagaagguaauacagcuuucaagaaaaacauuugauacggaauaucagaaaaccaaguuaaacgacugggacuuuguuguaacuacagauaucagugaaaugggggccaauuucaaagcggauaggguaauagauccccgacggugucuaaagcccguuauauuaacugacggaccugagagggugauauuagcgggcccuaugccgguaacggcugcaagugcagcacagcguagggggagagucggaaggaacccgcaaaaggaaaaugaccaauacauauucaccggacaaccauugaacaaugacgaagaucacgcacauuggacagaagccaaaauguuacuagacaauaucaacacaccugagggaaucauaccugccuuauuugagccagaacgagagaaguccgccgcgauagacggagaguauagacuuaaaggcgagagccgcaaaaccuucguagaauugaugcgcagaggugaucuaccgguuugguuagcacauaagguggcuagugaaggaauaaaguauacugacagaaaaugguguuuugauggacaaaggaacaaccaaauacuagaagagaacauggacguggaaaucuggaccaaggaaggagagaaaaggaaacuuaggccacgauggcuggaugcgagaacauauucugauccgcucgcguuaaaagaauuuaaagauuucgcagcuggucggaaaaguauugccuuagaccuaguuacagaaauaggccguguaccaucgcacuuagcucauaggacuaggaacgcacuggauaaucuaguuaugcuccacacaagugaacauggaggccgagcguauaggcaugcaguagaagaacuuccagaaacuauggaaacauuauuacugcucggacucaugauauuacuaacaggaggagcuaugcuuuuucuaauaagugguaaaggaauaggcaaaacaaguauuggauugauaugcguuauagcaagcuccgguaugcuguggauggcagaaauaccacuacaauggauagcgucagcaauaguacuugaguucuuuaugauggugcuucuaaucccggaaccagaaaagcaacgaacuccacaggacaaucaacuugccuauguuguaauaggcauucuaacguuagcugcaauaauagccgcaaacgaaauggguuugcuugaaaccacuaaaagagacuuagguaugucuaaagaaccaggcguggucucgcccaccucauaucuugacguugauuugcacccugcgagcgcuuggacauuauaugcggucgcgacgacgguaauaaccccuaugcuaagacacacgaucgaaaauucgaccgccaaugugaguuuagcagcaauugcaaaucaagccgugguauugaugggucuugacaaagguuggccgauuucaaaaauggaccuuggaguaccccuacuggcauuaggguguuauagucaaguuaacccacuaacgcuaacagcagcagucuuauuacucauaacucauuaugcuaucauuggacccggacuucaagcaaaagcuacuagggaagcacagaaaagaaccgcugcgggcauaaugaaaaauccaaccgucgacggcaucauaacgauugaccuggacccagucauuuaugauucuaaguuugaaaaacaguuaggacaagugaugcucuugguacuaugcgccguucaacucuuacuaaugaggacaucaugggcucuaugcgaagcgcugacacuagcaaccgguccuaucacaacauuaugggaaggaucgccggguaaauuuuggaauacgacuaucgcagugucuauggcgaauaucuuuagaggauccuaucucgcaggcgcuggccuagcuuuuagcaucaugaagucagugggcacuggaaaacggggaacagggagucaaggagaaacauuaggcgaaaaauggaagaagaaauugaaucaacucucuagaaaagaauuugaucuuuacaagaaaucaggaaucaccgaaguggauagaacugaagcaaaagagggcuuaaaaagaggagaaacuacacaccacgcagucagucguggaucagcaaaauuacaaugguuuguugaacggaauaugguuaucccagaaggucggguaauugacuuaggaugcggaagaggugguugguccuauuauugugcuggccugaaaaagguuacugagguucgaggcuauaccaaaggagggccuggacacgaagaacccguuccgaugucaacauauggauggaauauagugaaacuaaugucaggaaaagacgucuuuuauuuacccccagaaaaaugugacacauuguuaugcgauauuggagaaagcucgccgagcccuacaguagaagaaagccgcacaauaaggguacuuaaaaugguagaacccuggcugaaaaauaaccaauucuguaucaaaguacucaaucccuacaugccagcuguaauagaacaccuugagcgacuacagcgcaagcauggcggaaugcuaguacgcaauccuuugucccgcaacucuacacacgaaauguauuggauaaguaacgggaccgguaauauaguuaguuccguaaauaugguaaguaggcuacuguuaaaucguuucacuaugacacaucgacguccaacaaucgaaaaagaugucgaucuaggagccgguacacgccacgugaaugcagaaccggaaacaccuaauauggacgucauaggugagaggauaaaaagaauuaaggaagaacacaauucaacauggcacuaugaugaugaaaaccccuacaaaacgugggcuuaucaugguucuuaugaagugaaagcaacugggucugccuccucuaugauuaacgggguugugaaacuccuaacaaaaccaugggaugugguaccaauggugacucaaauggcaaugacagauaccacccccuuugggcaacagaggguauuuaaggagaaagucgauacuaggacaccgcguccuaugccuggaacaagaaaaguaauggaaaucacagcagaguggcuguggcgcacucucggucggaauaagagaccucgauuaugcacucgagaagaauuuacgaagaaaguuagaacgaaugccgcaaugggugcuguauucacggaagaaaaccaaugggauagugcgaaagcagcagucgaagacgaggaauuuuggaagcugguagaccgggagagagaacuacauaaacuggguaaaugugggucaugcgucuauaauaugauggguaaacgcgaaaagaaacucggugaguucggaaaagccaaaggaucaagagccauaugguauauguggcucggagcacgauaccuagaguuugaagcucucggauucuuaaacgaagaccacugguucagucgagaaaacaguuacucuggcgucgagggggagggauuacauaaacugggauaugugcuaagagauauaaguaaaauacccgggggugccauguaugcugaugauacggcaggaugggauacaaggauuacagaagacgacuugcacaaugaggagaaaaucacccaacagauggauccagaacauagguuacuugcaaaugcaaucuucaaacuaacuuaccaaaauaaagugguaaaagugcaacggccaacacccacaggaacugucauggauaucauaucacgaaaggaucaacguggaaguggacaagucgguacauacggacuuaauacauuuacuaauauggaagcgcaauuaguaagacaaauggaaggcgagggaguucuaucaaaagcagacuuggagaacccacauuugccugagaagaaaauuacacaguggcuugagacaaaaggugucgaaagauugaaaagaauggccauuucaggcgacgauugugugguaaaaccgaucgaugaucgcuucgcgaaugcccuacuggcuuuaaacgacaugggcaaaguaagaaaagauaucccucaauggcaaccaucgaaaggcuggcacgacuggcaacaaguaccauuuuguagccaccacuuucacgaacuuauuaugaaagacggacgaaaguuagucguacccuguagaccccaagacgaacugauugggagagcucguauaucacaaggcgccggauggaguuuacgugaaacagcaugucugggaaaggcuuaugcacaaauguggaguuuaauguauuuccauagaagagaucuuagacuagccucuaacgccauaugcucagcgguaccaguacauuggguaccgacgaguaggacuaccuggaguauucaugcacaucaccaguggaugacuacugaggauaugcuaacaguuuggaaccgaguauggauugaagauaacccuuggauggaggacaaaacacccguaacgacaugggaaaaugugccauauuugggcaagcgagaggaucaaugguguggaaguuugaucggauuaacaucucgugcaacuugggcgcagaacaucccuacugcaauacagcagguuagauccuugauugggaaugaagaauuuuuagacuacaugcccucgaugaagagauucagaaaagaagaagaguuggaaggggcaauaugguaa

SEQ ID NO: 23022 - RNA, 9873 nt, Artificial Sequence
  derived and/or modified CDS sequence (opt6) from DENV-3__KF041257__SS-prME
accucauuaugucugaugaugauauuaccagcggcacuggcauuucaccuaacuucaagagacggggaaccgcggaugauaguggguaaaaacgaacgugguaaaucgcuucucuuuaaaacggcaucugggaucaacauguguacgcuaauagcaauggaccucggagaaaugugugaugacacaguaaccuauaaauguccacauauaacugagguggaaccagaagauaucgacuguugguguaacuuaacaaguacauggguaacauauggaacuugcaaucaagcaggagaacaucggcgagauaaacgaaguguugcucuagccccgcaugugggaaugggauuagacacacggacacagaccuggaugagugccgaaggagcauggagacaaguugaaaaagucgaaacaugggcguuaagacauccagguuuuaccauuuuagcccuguuuuuagcccacuacaucggaacuucauugacgcagaaaguaguaauauuuauucugcucaugcugguaacuccaucuaugacuaugcguuguguaggagucggaaauagagacuucguugaaggacuuagcggggccacauggguagacguaguacuugagcauggagggugcguaacgacaauggcuaaaaacaaaccaaccuuagauaucgaauuacagaaaacagaggcaacacaauuagcuacauugagaaaauuauguauagaggguaaaauaacaaacauaacgacugacucucguugccccacacaaggggaggcugucuuaccugaggaacaggaucagaacuacgucugcaaacauacauauguagacagaggaugggguaacgguuguggcuuauuugguaaaggcucucuaguaacaugugcgaaauuucagugucuagaaccaauugaagggaaagugguacaauaugaaaacuuaaaauauaccguaaucauaacaguucauaccggagaucagcaucaaguuggcaaugaaacccaaggagucacggcugaaauaacgccgcaagcaaguaccacagaagcaauauuaccggaauaugggacguuggguuuagaauguaguccgcgaaccggacuagacuucaaugaaaugauucuauuaacaaugaaaaauaaggcuuggaugguucauagacaaugguucuuugaucuaccacuaccauggacgucgggcgcgaccacggaaacuccgacauggaaucgaaaagagcuccuaguaacauucaaaaacgcacacgccaagaaacaagaaguuguggugcuaggaucgcaagaaggggccaugcacacagcccugacaggcgcuacagaaauucaaaauucgggcggcacaaguauauuugccggacauuugaaaugucgacuaaaaauggauaaacuagaauuaaaaggaaugagcuaugcaauguguacgaauaccuuuguccugaagaaagagguaucugaaacgcagcacggcacaauauuaaucaaaguagaguacaaaggggaagaugcuccauguaaaauccccuucaguaccgaagauggccaggguaaagcacauaauggucgacuaauuacugcgaauccgguuguaacuaagaaagaggagcccgucaauaucgaagcagaacccccuuucggugaaucgaacaucguaauagguauaggugauaaugcauuaaaaaucaacugguacaagaaagguucgaguauaggaaaaauguuugaggcuacagcucggggagcaaggaggauggcuaucuuaggcgacacagcuugggauuuuggaucaguagguggagucuuaaauagccuuggaaaaaugguacaucaaaucuuugguagcgcauacacggcgcucuuuucugggguuucauggguuaugaaaauaggaauaggaguccuacuaaccuggauaggccuaaacagcaaaaauaccagcaugucuuuuaguugcaucgcgauaggaauuauuacauuauaucuaggagcugugguucaagcggacauggggugcguaauaaacuggaaaggcaaagaauuaaaauguggaagugggauauucguuacuaaugaaguucacacauggacugaacaauauaaauuccaagcggauaguccaaaaagacuugcgacggcaauagccggugcgugggaaaauggaguuugcgguauuagaucaacuaccagaauggaaaacuuauuguggaagcaaauugcaaacgaacucaauuacauacugugggaaaacaauauaaaauuaacuguaguuguaggagacacuauugguguauuggagcaagguaaaagaacucuuacgccgcaaccaauggagcuaaaauacaguuggaagacaugggggaaagcaaaaauagugacagcugaaacacaaaauucaucuuuuauaauagauggaccaaacacacccgaaugcccuagcgccaguagagcauggaauguuugggaagucgaggacuauggauuuggaguuuucaccacaaauaucugguugaaacuucgcgaaguuuacacacagaugugugaucacagacucaugucugcggcaguuaaagaugaacgagcuguacaugcggacaugggauacuggauugaaucacagaaaaauggaucuuggaaauuggaaaaagccagcuuaauugaaguuaagacuuguacguggccgaaaagucauacuuuguggucgaauggaguacuugaaagugauaugauaauaccgaagucacuagcaggaccaaucucacaacauaauuaucgaccaggauaucauacacaaaccgccgguccuuggcaccucgggaaacuggaacuggauuuuaacuacugcgaagguaccacaguagucauaacggaaaauugcgguacucgggggccaaguuuaagaaccacuacaguaucaggaaagcucauacacgaaugguguuguagaagcuguacguuaccaccgcuacgguauaugggagaagacgguuguugguacggcauggagauucgaccuauuucagaaaaggaagaaaauaugguuaaaucuuuaguuucggccggcucaggcaaggucgacaacuuuacaauggguguucuuugcuuagcuauucuauucgaggaaguaaugagaggaaaguucggcaagaaacacaugauagcaggaguauucuucacauuuguguuauuauuaucaggccaaauuacauggcgagauauggcacacacauugauuaugaucggaaguaaugcgagcgaucgaaugggaaugggcgugaccuaucuagcauuaauagcaaccuuuaaaauccaaccauuucuugcacuaggauucuuucuuagaaaauuaacuuccagagaaaaucuauuguugggggucggauuggcuauggcgacaacacuucaacuucccgaggauauagaacagauggcaaauggaauugcucucggacuaauggcucuuaaauugaucacacaauucgaaacuuaccaauuauggacggcacugauaagucuuacaugcucaaauacuauauuuacacuuacaguagccuggagaacagccacucugauacuugcaggcguaaguuugcucccaguaugccagucaucuuccaugcguaaaacagacugguuaccaaugacuguagcagcuauggggguuccaccacuaccgcuauuuauuuucaguuuaaaagacacucuuaagcgacguagcuggcccuuaaaugagggcgugauggcgguuggcuuaguauccauuuuagccaguagcuuacugaggaaugacgugccaauggcaggaccccugguagcgggaggccuccugauagcguguuauguuaucacaggaaccucggcagaccugacuguagagaaggcagccgaugucacuugggaagaagaggcagaacaaacuggagugucacauaauuuaaugauaacgguagaugaugaugggaccaugagaauaaaagacgaugagacagaaaauauauuaacgguccuacuaaagaccgcacuguuaauugugucggguauauuuccauauucaauaccagcaaccuuauuaguauggcacacauggcaaaaacaaacucaaagaucaggaguauuaugggacguaccgaguccaccggaaacucaaaaggccgaauuagaggagggcgucuaucgaaucaagcaacaaggaauacuaggaaaaacccaagucggaguuggcgugcaaaaggaaggagucuuucauacaauguggcacguuacaagaggcgcgguacuaacgcauaacgguaaaagacuugaaccgaacugggcgucaguaaagaaagaccuuauuucguauggaggaggauggcgucuaucagcacaguggcagaaaggggaagaaguucaagugaucgccguugaaccgggcaaaaaucccaaaaacuuucaaacgaugcccgguacauuccagacuacuacaggagaaauuggagccauagcauuagauuuuaagccaggaaccaguggaucaccaauaauaaauagggaaggcaagguaguuggauuauacggaaauggagucguuacuaaaaacggaggcuacguuaguggcaucgcucaaacaaaugcagaaccagacgguccgacgccggaguuagaagaagagauguucaagaaacgaaaccuaacuaucauggaccuucauccgggcucgggaaaaacuaggaaauaccucccugcaauuguaagggaagcaauuaaacgaagauuacgaacacucauauuagcucccacuaggguagucgcagcggaaauggaagaagcacuaaaaggcuuaccuauaagauaucaaacaacagcaacaaaauccgaacacacaggacgcgagaucguagaccuuaugugccaugcgacuuuuaccaugcgauuauuaagccccguucgaguaccaaauuauaauuugauaauuauggaugaagcacacuuuacugacccagcaaguauagcagccaggggcuauauaagcacacgaguaggcaugggggaagccgcagcuaucuuuaugacagcaaccccaccuggcaccgcugaugcuuuuccacaaucuaaugcaccaauucaggacgaggaacgagauauaccagaaagaaguuggaacucaggaaaugaauggauuacggacuucgcugguaaaacugucugguucguucccuccauuaaggcuggaaaugauauagcuaauugcuuaaggaagaacggcaagaaaguaauucagcuaagcagaaagacauucgauacagaguaucagaaaacuaaacugaaugacugggacuucguaguaacgacagauauuagcgaaaugggggcaaauuucaaagcggaccguguaauugacccuagaaggugucuuaaaccaguuauauuaacagacggaccugaaaggguaauucuagcaggaccuaugccuguaacagcagcaucugcagcacaaagacgagggagaguugguagaaacccgcaaaaagaaaaugaucaauauauuuuuacagggcagccacuuaacaacgacgaagaccaugcgcauuggacugaggcgaaaauguuauuagacaauauaaacaccccagagggcaucaucccggcguuauuugaaccagagagggaaaagucagcggcaauugacggcgaauaucgguuaaaaggcgaaucgcggaagaccuuuguugaguuaaugagaagaggugauuugcccguauggcuggcccacaaaguagcgucagaaggaauaaaguacacggacaggaaauggugcuucgacgggcagcggaauaaccaaauucucgaggaaaauauggauguugaaauauggaccaaagagggugagaaacgcaagcucaggccuagauggcuugacgcccgaacguauucggauccccucgcucuaaaagaauuuaaggacuuugcagcuggaagaaaaaguauugcauuagauuuaguuacagaaauaggaagaguaccgucucaucuagcucaccgcacuaggaacgcauuagauaaucugguaaugcuacauacuucugaacauggcggaagggccuauagacaugcaguagaggaauuacccgagacuauggaaacuuuacuacuucuaggacugaugauccuauuaaccgggggugcaauguuguuucuaauaucggguaaaggaauaggaaaaacgagcauugggcugauauguguaauagcuucuagcggaaugcuauggauggcagaaaucccacugcaauggauugcaucugcaauuguacucgaauuuuucaugaugguguuauugaucccagaaccagaaaagcaacggacuccacaagauaaucaauuggcauauguuguuauaggcauacuaaccuuagcagcaauaauugccgcaaacgaaaugggccugcuggaaacuacaaaaagagacuuaggaaugucaaaggagcccggcguaguuagccccacuagcuauuuagacguggaucuacauccagcuagcgccuggacacuauaugcagucgcuacaacagucaucacaccuauguuaagacauacgauagagaauaguacagcuaaugucucucuagcugcaauagcaaaccaggcgguugucuugaugggguuagacaaagguuggccaaucucgaagauggaccuuggaguuccuuuguuagcacuaggcugcuacucccagguuaauccgcuuacccuuacagccgcugugcuguuacugauaacacauuaugcaauaaucgggccugguuuacaggcgaaagcaaccagggaagcccaaaaacggacugcugcagguauaaugaaaaaucccacaguugaugggaucauuacgauagauuuggauccagucauuuacgauagcaaguuugaaaaacaacucggucaaguaaugcuauuagugcuaugcgcugugcagcuauuacuuaugagaacaagcugggcgcuuugugaagcguuaacauuagcuacagguccaaucacuaccuugugggaaggaucaccaggaaaguucuggaacacaacgaucgccguaucgauggcuaauauauuccgggguaguuaucuagcuggggcugguuuagcuuuuuccauuaugaagucagucgguacaggcaaaagagguacggggucacaaggagaaacucuaagagaaaaguggaagaagaagcucaaccaauuaucccggaaggaauuugauuuauauaaaaagucuggaauaacagagguugaccggacagaagcgaaagagggucuaaaaagaggggagacaacgcaucacgcgguaagccgaggaucggcuaaacuucaaugguucguagagagaaacaugguuauaccagaaggaagagugauagauuuaggaugcgguagaggugguuggagcuacuacugugcgggccucaagaaaguuacagaggucagaggauauacaaaagguggcccaggccaugaagaaccaguuccaaugagcacauacggguggaauaucgugaaauuaaugucaggaaaagauguauucuaucuaccuccggagaaaugugauacucuacuaugcgauauaggagagucaaguccgucaccaacaguagaagaaucgagaacuauaagaguacugaaaauggucgagccuuggcuuaaaaacaaucaguuuuguauaaaaguuuugaacccguacaugcccgcagucauagaacaccuagaacguuugcaacgcaagcauggagguaugcucguuagaaauccguuaagucgaaacucuacacacgaaauguauuggauuucgaauggcacugggaauauuguuaguucaguaaauaugguaucucgccuuuuguuaaaucgguucacaaugacccaccggagaccaacaauagaaaaggauguagauuuaggagccggaacaaggcacguaaacgcugaaccugaaaccccaaauauggauguaauuggagaacgaauaaagagaaucaaagaggaacauaauaguacuuggcauuaugaugaugaaaaccccuauaagacaugggcguaucacggaagcuaugaaguuaaggccaccgguucugcaaguucgaugauuaaugguguggugaaacuccuaaccaaaccaugggacguagucccgaugguuacgcaaauggcuaugacggauacgacuccauuuggucaacaacgaguauucaaagaaaaaguugacacgagaaccccaagaccaaugccagguacucguaaaguuauggaaauaacugccgagugguuauggagaacuuuaggucgaaauaagagaccccgcuugugcacucgagaagaauuuacaaagaagguuagaacaaaugccgcgaugggggccguuuuuacagaggaaaaucagugggacagugcaaaggcagcaguagaagaugaagaauuuuggaaacuuguugaccgugaacgagaauugcauaaauugggaaagugcggaaguugcguauacaacaugauggguaaacgugagaagaaauuaggggaauuugguaaagcgaaggguucgcgcgcaauuugguauaugugguugggugcuagguaccucgaauuugaagcauuaggguuuuugaaugaagaccacugguuuucucgcgaaaacucuuacagcggaguggagggagaggguuuacacaaacuaggguauauauuaagagauauaucuaaaauuccagggggagcuauguaugcagaugacacagcagguugggacacccgcauaacagaggaugaucuacauaacgaagaaaagauaacucaacaaauggauccugagcacagauuauuagcuaaugcgauauuuaagcuaacauaucagaacaaaguuguuaaaguacagagacccacgccuacagguacaguaauggauauaauuucacgcaaggaccaaaggggcaguggacaaguaggaacauacggucucaauacuuucacgaauauggaagcucaauuagugagacagauggaaggagaaggagucuuaucgaaagcggauuuagagaauccacauuuaccggagaagaaaauaacucaauggcuagaaaccaagggcguugaaaggcuaaaacgaauggcuaucucaggcgaugauugcguuguuaagccuauugacgauagauuugcuaaugcguugcuagcuuuaaacgauaugggcaaggugagaaaagauauuccgcaauggcaaccaaguaaagguuggcacgauuggcaacaaguuccauuuugcucccaccacuuucacgaauuaauuaugaaggacggacgaaaauuaguagucccuugccgaccgcaagacgaacugauagguagagcccguauaucgcaaggagcggguuggucacuaagagagaccgccugcuuaggaaaagcguaugcucaaaugugguccuuaauguauuuccaucguagagauuuaagguuagcuucgaaugcuaucuguagcgcuguuccuguacacuggguaccaacaaguagaacaaccuggucgauacaugcacaccaucaguggaugacaacugaagauauguuaacuguuuggaaucgugucuggauugaggauaauccguggauggaagauaaaacacccgugacgacgugggaaaacguuccguacuuagguaagcgagaagaucaauggugcgguucuuuaaucggccucacgucuagggcaacaugggcacagaacauacccaccgcuauccaacaaguaaggucucuaauaggaaacgaggaguuuuuagacuauaugccuagcaugaaaagauuucgcaaagaggaagaauuagagggagcaauaugguaa

SEQ ID NO: 23023 - RNA, 9873 nt, Artificial Sequence
  derived and/or modified CDS sequence (opt6) from DENV-3__KF041255__SS-prME
accucacuguguuuaaugaugauccuacccgcagcucuggcuuuccauuuaacuucaaggaauggugaaccacgaaugauaguuggcaaaaaugaaaggggaaaaucacuacuuuucaaaacugcgucagggauaaauauguguacuuuaauagcaauggacuugggagaaaugugugacgacaccgugacuuacaaauguccacauauaacggaaguggaacccgaagacauugauugcuggugcaaccucacguccacuugggucacauacgggacauguaaccaagcaggagaacauagaagagauaaaagaucuguagcacuggcgccucacgugggaaugggauuagacacucgaacgcaaaccuggaugagcgcagaaggagcauggaggcaaguggaaaaagucgaaacuugggcacuuagacauccuggguuuacaauacuugcuuuauuucucgcgcauuacaucggaacaaguuugacgcaaaaaguaguaauauucauacuucucauguuaguaaccccuucgaugacgaugaggugugugggaguuggaaacagggacuucguagaaggauuaucuggagcgacuuggguugacguagucuuagaacauggaggauguguuaccacuauggcuaaaaacaaaccaacguuagauauagaacuccagaaaacugaagcaacccaacuagcaacacuacguaaacugugcauagaaggaaaaauaaccaacaucacgacagauaguaggugucccacacaaggugaagcgguauuaccggaagaacaggaccagaauuauguguguaaacauacguauguagacagaggaugggggaacggcugugggcucuuugguaaagggagcuuagugacuugugcaaaauuucaaugcuuagaaccgauagaagguaaaguugugcaauaugagaauuuaaaauauaccguaauuauuacagugcauaccggagaucaacaccaagucggaaaugaaacccaagggguuacagcagagauaaccccacaagcaagcaccacggaagcuauacuuccggaauauggaacucucggacucgagugcagcccaaggacuggucuggacuucaaugaaaugauauuauugacuaugaaaaauaaagcauggauggugcaucgucagugguucuuugauuuaccuuugcccuggacuuccggagcuaccacugagacaccuacauggaauagaaaagaacuuuuagugacauuuaaaaaugcgcaugcuaaaaagcaagaagucguagugcuaggaagucaggagggugcaaugcauacagcuuugaccggugcuacagagauacaaaauuccgggggcacuagcauuuucgccgggcacuuaaaguguagguuaaaaauggauaaacucgaauuaaagggaaugucuuaugcaauguguacgaauacuuucguucuaaagaaagaaguaucugagacucaacaugggacaauauuaauuaagguugaauacaagggagaagaugccccuugcaaaauaccauucucuacugaagauggucaagguaaagcucauaauggaagacuaauaacagcaaaccccguuguuacuaagaaagaagaaccaguaaauauagaagcugagccgccuuuuggcgagucaaacauuguaauaggaauuggggauaacgcgcucaaaauuaauugguauaagaaaggaagcucaauaggcaaaauguucgaagcaaccgcuagaggugcgagaagaauggcaauacugggagacacugcuugggacuucgggucugucggaggaguucuuaacucacuugggaagaugguacaucaaauuuuuggcucggccuacacggcuuuauucucggguguaucaugggucaugaaaauugguauagggguccuauuaacguggauaggacuaaauucuaaaaauacaaguaugucauuuucaugcaucgcaauaggaauaauaaccuuguacuuaggugcugucguucaagccgauaugggaugugugauaaauuggaagggaaaggaauuaaaauguggguccggaauauuugugacuaacgaaguccauacauggaccgaacaauauaaguuucaagcugauuccccuaaacgauuagccaccgcaauagcaggagcgugggaaaacggcguuugugguauaaggagcacuacuagaauggaaaaucugcucuggaaacaaaucgcuaacgaguuaaauuauauauuaugggaaaauaacauaaaacuuaccguggucgucggagacaccauuggcguacuggaacaaggaaagagaacccuaacaccucaaccaauggagcugaaguacucguggaaaacuugggguaaagcaaaaaucgucacugcagagacucaaaauucaaguuucauuauagauggcccgaacacaccagaaugucccagcgcaucacgggcuuggaacguaugggaaguagaagauuacgguuucggaguuuucacaacuaauauauggcuaaagcugagagaaguuuacacacaaaugugugaucaccgucuaaugucagcagcaguuaaagaugagagagcugugcaugccgauauggguuacuggaucgaaucacagaaaaacggaucauggaaacuagagaaggccagcuugauagagguaaaaacguguacuuggcccaaaucacauacucucuggucgaacggcguauuagaaagcgauaugauaauaccaaaaagucuggcaggaccaauuagucaacauaacuaucgcccaggauaucauacacaaaccgcuggcccauggcauuugggaaaacuagaacuggauuuuaauuauugugaaggaaccacagugguaaucacagagaacuguggaacaagagggcccucauuacgaacuacaacuguaucagguaaacuaauacacgaaugguguugccgauccuguaccuuaccgccccuuagauacaugggagaagauggcuguugguacgggauggaaauaagaccaauuagcgagaaagaagaaaauaugguaaaaagccucgucucagccggcagcggaaaaguagauaauuucacuauggguguacuaugcuuagccauucucuucgaagaaguaaugagagggaaauucgguaagaaacacaugauugcaggcguauucuucacauuuguccugcuacugucaggacaaauaaccuggcgagacauggcccacacguuaaucaugauaggaaguaaugcuucagaccgcaugggaaugggugugacauauuuagcccuaauugcuaccuucaaaauacaaccauuucucgcauuaggauuuuuccuucgaaaacucacgucgagagagaaucuuuuauuaggcgucggacuggccauggcuacgacccuucaauuaccagaggacauagaacaaauggcaaauggaaucgcguugggacugauggcccugaaacuuaucacucaauuugagacauaccaacuguggaccgcauuaauaagccuuaccuguagcaauacaauauucacgcuuacaguggccuggaggacugcgacuuuaauauuagcuggaguaagccuuuugccuguuugucagucuucauccaugagaaaaacagacugguuacccaugacaguagcagcgaugggcgugccaccccuaccacuuuucauauucagucuaaaagacacuuugaaacggcgaaguuggccauuaaaugaaggagugauggcagucgggcuagugucaauauuagcauccucucuccuaagaaacgacguaccuauggcaggaccgcucgucgccggaggccuacugauagcgugcuaugugauaacuggcacaagugcugacuugacuguagaaaaggcagcugauguuacuugggaagaagaggcagagcaaacuggaguuucacauaacuuaaugaucacuguggacgaugacgguacaaugaggauaaaagaugaugagacggaaaauauauugacugucuuguuaaagacagcccuacuaauaguuagugggaucuuccccuauucaauucccgcaacacugcucgucuggcauacauggcaaaagcaaacacagagaaguggcguacuaugggacgucccaucaccacccgagacgcagaaagcagaacuagaagaaggggucuaccguauuaagcaacaagggauauuaggcaaaacucaagucggaguaggaguacagaaagaaggugucuuccacacaauguggcauguuacucgaggggcagugcucacucauaacgguaagcgcuuggaaccgaacugggccuccgugaaaaaggaccucauaaguuacggcggcggguggagacugucagcacaauggcaaaaaggagaagagguacaaguaaucgcaguagaaccagguaagaaucccaaaaacuuccagacaaugccaggaacauuucaaacaacuacaggugaaauaggagcaauagcacucgauuucaaaccgggaacgagcggaaguccgauuauaaaucgagagggcaaagucguaggccuauacggaaacgguguuguuacuaaaaauggaggauacgucagcggaauugcucagacaaaugcggaaccagaugguccaacuccagaauuagaagaagaaauguuuaagaaaagaaaccuuaccauaauggaucuacauccaggaagcggcaaaacgcgaaaauaucucccagcaauaguacgugaagcaaucaaaaggcgacuucgaacguuaauacuugcuccaacaagaguaguagcugcugaaauggaagaggcucuaaaagguuuaccaauuagauaucaaaccacagccaccaaaagugaacauacgggcagggaaauaguagauuuaaugugucacgcaacguuuaccaugcgucugcuuucgccaguccgagucccaaauuauaacuuaauuaucauggacgaagcucauuucaccgacccggcgucuauugcagcucguggauacauaucaacacgaguaggcaugggcgaagccgcagcaauauuuaugaccgcuacaccuccggggacagcugaugcuuuuccucagucaaaugcucccauacaggaugaagaaagagauauuccggaacgcaguuggaacucuggaaaugaauggaucacugauuuugcaggaaaaacaguuugguuugugccaaguauaaaagcagguaaugacauagcuaauugcuuaagaaagaacgguaagaaaguuauacaauugucgcggaagacauucgacacagaauaucaaaagacgaaacuuaaugacugggacuuuguaguaacuaccgacaucagugaaaugggagcuaauuucaaggcagauagaguaauugauccacgaagguguuuaaagccuguuauacuaacggauggucccgaacgcguuauauuggcaggaccaaugccugucacugccgcguccgccgcacaaaggcgaggaagagucggacguaauccucaaaaagagaacgaucaguauauuuucacgggacaaccauuaaauaacgacgaggaucaugcacacuggacagaagcuaaaaugcuacuagauaacauaaauacacccgagggcauuauuccagcacuauuugaaccugaacgagaaaaauccgcagcgauugacggagaauaccgauuaaagggcgaauccagaaagacuuuuguggaguuaaugaggcguggugaucugccuguuugguuagcccacaaaguugcuuccgaaggcaucaaauauacugacagaaaauggugcuuugauggacaacgcaauaaucaaauauuagaagaaaacauggacgucgaaauauggaccaaggagggugaaaagaggaaguugcguccuagauggcuagacgcgagaacuuacagugacccacuggcacucaaagaguuuaaggauuucgcagcagguagaaagagcauugcucucgauuuggucacagagaucgggagaguacccucucaccuugcacauagaacgcggaaugcacuagacaacuugguaaugcuucauacuucugaacauggcggucgagcuuaccgucaugcaguagaggaauuaccagaaacaauggagacacuccuauuacuaggucuaaugauccuguugacagguggagcaaugcuauuccugauaucaggaaaaggcauagggaagacaucaauugggcugauauguguaaucgcaucgucaggaauguuguggauggcagagauaccacuacaauggauugcaucagcuauaguacuagaguucuuuaugaugguccuccuaaucccagaaccagaaaaacaaaggacuccucaagacaaucaauuagcauaugugguaaucggcauacugacacuugcagccauaauagcagcuaacgaaaugggucuccucgaaaccacaaagcgagauuuaggaaugucaaaagaaccagguguaguaucuccuacuucauauuuagauguugaucuacauccagcaucagcauggacucuuuacgcgguugcuacuacaguaauaacaccuauguuacgacacaccauagaaaauagcacugcuaacguaucgcuggcggcgauugccaaccaggcaguaguguuaaugggucucgacaaaggcuggccaauaagcaaaauggauuugggaguucccuuauuagcccuuggauguuauucucaaguuaauccuuugacuuugaccgccgcuguacuguuauuaauaacucauuacgcaauuaucggaccuggauugcaggccaaagcgacaagagaagcacaaaaacggacugcagcugguauaaugaaaaacccaacaguugauggaauuauuacgauagaucuagauccagugauauacgacucuaaauucgagaaacaauuggggcaaguaaugcuacugguguuaugcgcuguacagcuacuuuuaaugaggacuucaugggcucuuugugaggcacuuacauuagcgacaggcccgauaacaacauuaugggaggggagcccggggaaguuuuggaacacaaccauugccgucagcauggcuaacauuuuccgaggaucauaccuggccggugcaggacuagccuuuagcaucaugaaaagcguagggacagguaagagaggaaccgguagccaaggagagacacucggcgaaaaauggaaaaagaaguuaaaccaacucucacgaaaagaauuugauuuguacaagaaauccggaaucacagaaguagauagaacagaggcaaaagaagggcuaaagagaggcgaaacuacccaccacgcaguaucacgcgguagcgcaaaauuacagugguuugucgaaagaaacaugguaauaccugaaggaagagugauugauuuaggcugcggacgaggcgguuggucuuacuauugugccggccucaagaaagugacugaaguacgaggauacacuaaaggagggccaggacaugaagaaccaguacccaugucaacuuauggguggaauauagugaaacuaauguccggcaaagacguguucuaucuaccgccagaaaaaugcgauacauuacuaugugacauuggagaaagcaguccgucuccgacuguagaggaaucaagaacgauccguguacuuaaaaugguagaaccuuggcugaaaaauaaccaauucugcauaaaaguucuaaacccguauaugccagcuguaauugaacaucuggagagauuacaacguaaacauggagguaugcuugucagaaauccgcugaguagaaacucaacucaugaaauguauuggauauccaacgguaccggcaauauugugucaagcguaaacauggucucaagauuauuguuaaauagguuuaaaaugacgcaccgucgaccaacaauagaaaaagauguagauuuaggggcaggcacucgucacguuaaugcagaaccagaaacaccaaauauggaugucauuggagaacguauaaagagaauaaaggaggaacacaauagcacauggcacuacgaugaugaaaauccauauaaaacaugggcauaccauggaucauacgaaguaaaggcuacuggcucagcuuccucaaugaucaauggggugguaaagcuacuaacaaagccgugggacguaguaccgaugguaacgcagauggcuaugacagacaccacaccguuuggccaacagagaguauucaaggagaaaguggauaccagaacuccaaggccaaugcccggaacccgaaagguaauggaaaucacugcagaaugguuauggcguacacuaggucggaacaagcguccuagauuguguacccgugaagaguucacgaaaaaggucaggacaaaugcggcuaugggcgcaguauuuacggaagaaaaucagugggacagcgccaaagccgcagucgaagacgaagaauuuuggaaacucguagacagagagagagaacuacauaaauuaggaaaguguggcucaugcguauacaacaugauggguaaaagagagaaaaagcuaggcgaauuugguaaagcaaaaggaucucgggcgauuugguauaugugguuaggagcuagguacuuagaguucgaagcucucggauuucuaaacgaggaccacugguuuagucgcgaaaauagcuauagcgggguggaaggugaggguuuacacaaauuaggauauauacuuagggauaucucaaaaauuccggguggagcaauguacgcagacgauacagcgggaugggauacacgaauaaccgaggaugaucuacauaaugaagagaaaauaacccaacaaauggauccugaacacagauuguuggcuaacgcaauuuucaaauuaaccuaucaaaauaagguaguuaagguucaaagaccaacgcccaccggcacggucauggauauuauaucacguaaggaucaaagaggaucuggccaaguaggcacauauggauuaaauacauuuacaaauauggaagcucagcuaguuagacaaauggaaggugaaggagucuuaucuaaagcagacuuagaaaacccccacuuaccggagaagaaaauaacccaguggcuugagacuaaaggcguagagagacuuaaaaggauggcuauaaguggagacgacuguguugugaaaccuauagaugauagauuugccaaugcguuacucgcuuuaaaugacauggggaaaguaagaaaagauauaccacaauggcaaccuuccaagggauggcaugauuggcagcaaguacccuuuugcagucaucauuuucacgaauuaauaaugaaggauggaaggaaguuaguuguaccgugcagaccccaagaugaguuaauaggacgagcgcgaauaagccaaggagcugguuggaguuuaagggaaacagcaugccuaggaaaggccuaugcacagauguggucauuaauguauuuccaucgccgagaccuucgacuagcaaguaacgcaaucugcagugcagucccuguccauuggguaccuacuucgcggacaacguggucgauacaugcucaucaccaguggaugacuaccgaggauaugcuaaccguuuggaaccgcguauggauagaggauaacccauggauggaggauaagacuccuguaacaacaugggaaaauguuccauaccuugguaaacgagaagaucaauggugcggcagcuugauuggauuaacaaguagggcaacgugggcacaaaauauacccacugcuauacaacaaguuagaucacuuauugguaaugaagaauuucuagauuauaugccuuccaugaaaagguuucgcaaagaagaagaacuugagggugccauuugguag

SEQ ID NO: 23024 - RNA, 9873 nt, Artificial Sequence
  derived and/or modified CDS sequence (opt6) from DENV-3__KF041256__SS-prME
acgagcuuaugucucaugaugauacuuccagcugcauuagcuuuccauuuaacuucucgagauggggaacccagaaugauaguaggcaaaaacgaaagagguaaaucucuacuauucaaaacagcaucaggaaucaacauguguacacuaaucgcaauggaccugggugaaaugugcgacgacacuguaacguacaaaugcccucauaucacggaaguagaaccagaagauauugauugcuggugcaaccuaacaucaaccuggguaacuuauggaacaugcaaccaagcuggugaacauagaagagauaaacguucaguagcacuagcuccccacguaggaaugggacuagacacaagaacccaaacuuggaugucugcagaaggagcauggagacaagucgaaaaaguagaaacuugggcacuuaggcacccaggauuuacgauuuuggcauuauuccuugcucauuauauaggaacauccuugacucagaaaguaguuauuuucauuuuguugauguuaguaaccccaucaaugacuaugcgcuguguaggagucggaaauagagacuucguagaaggauuaucaggagcuacuuggguugauguaguacuugagcauggagggugcgugacaacaauggcuaaaaacaaaccaacucuugacauagaauuacagaaaacugaagcaacucaacuagcaacguugagaaaacuuuguauagagggaaaaaucaccaacaucacgacagacagcagaugcccuacccaaggagaggccguacuaccagaggaacaagaccaaaacuauguauguaaacacacauauguagaucgaggauggggaaauggauguggauuauuugggaaaggaucucuagucacuugugcuaaauuucagugcuuggaaccuauagaaggaaaaguaguacaauacgagaauuuaaaauacacaguaaucauuacaguacacacaggagaucagcaucagguaggaaaugaaacucaagguguaaccgccgaaauuacaccacaagcuaguaccacagaggcaauacuuccagaauacgggacucucggauuagaguguaguccaagaaccggauuagacuucaaugagaugauauuacuaacgaugaaaaauaaagcguggaugguacaccgacaaugguuuuucgaccuaccacuccccuggaccaguggagcuacaacggagacacccacuuggaaccgaaaagaacuccuaguaacuuuuaaaaaugcgcaugcgaagaaacaagaaguaguaguuuuagggucacaggaaggagcgaugcauacugcacuaaccggugccaccgaaauacaaaacucuggugggacaaguauuuucgccggccaccuuaaaugucgacugaaaauggacaaacuagagcuaaaaggaaugagcuaugcaauguguacaaauacuuuuguucuaaagaaagaagucucagagacgcaacacggaacaaucuugaucaaaguagaauauaaaggggaagaugccccuugcaaaauucccuuuucaacagaagaugggcaggguaaagcgcacaauggaagacuaaucaccgcgaaucccgucgucaccaagaaagaagaaccaguuaauauagaagcagaaccuccauucggagaaucgaacauaguaauaggaauuggcgauaaugcacugaaaauuaauugguauaagaaaggaucuaguauagguaaaauguucgaagcaacugcacgcggggcucgcaggauggcuauuuugggcgauacagccugggacuuugguuccguaggagguguucuuaacaguuuagggaaaaugguacaccaaauuuuuggaucagcuuacacugcacuguucucuggggucucauggguaaugaaaauagguaucggcguucuacucacauggaucggucuaaauuccaaaaacaccucaaugucuuuuucauguauugcaauugguauaauaacuuuauaccuuggugcaguuguucaagcugacaugggcuguguuauuaauuggaaaggaaaagaauuaaaaugcgguucgggaauuuuugugacaaaugaaguacacaccuggacggaacaguauaaauuucaagccgacagcccaaaacguuuagcaacugcaauagcgggagcaugggaaaaugggguauguggcauccgaagcacuacgcgaauggagaacuuacuauggaagcaaaucgcaaaugagcucaauuacauauuaugggaaaacaauaucaaacuaacugucguagucggcgauacaauuggaguuuuggaacagggcaaaagaacgcuaaccccacaaccgauggaacuaaaauacucuuggaaaacauggggcaaagcaaagaucguuacagcagaaacccaaaauucaucauuuauaauugauggacccaauacaccggaaugucccuccgccucucgagcuuggaauguaugggaaguggaagacuaugguuuuggcgucuucacuacaaacauauggcucaagcuaagagaaguuuauacucagaugugugaucaccguuuaaugucugccgcuguuaaagaugaacgggcgguacacgcggauauggguuauuggauugagagucagaaaaacggcucuuggaaguuagaaaaggcaagccuaauagaagucaaaacaugcacauggccaaaaucacauacauuguggaguaaugggguucucgaguccgauaugauaauccccaaaagucuagcuggaccuauaagucaacauaacuauaggccaggauaucauacccaaacagccgggccauggcaccuuggcaaacuggagcucgauuuuaauuacugcgaaggaacuacaguaguaauaacagaaaacuguggaacacgcgguccgucacuaagaaccacgacuguaagugggaaacucauacacgaaugguguuguagaucuugcacccuaccaccucuuagauauaugggagaggaugguuguugguacggcauggaaauucgaccuauuagugaaaaagaagaaaauaugguaaaaaguuuaguaucggcaggcagcggcaaaguugacaauuucacuaugggaguacuuugccuugcaaucuuguucgaggaagucaugagaggcaaauuuggaaagaaacauaugauagccgguguauucuuuacuuucgugcuucuauuaaguggacaaauaacauggagagauauggcacauacacuuauaaugauaggaucaaaugcgagugaccggaugggaaugggcguaacguauuuagcacuaauagccacauucaaaauucaaccguuuuuagcuuugggcuucuuuuuacguaaauuaacaaguagagaaaauuuacuucuaggcguugggcuugcuauggcaacaacacuacaauugccagaggauauugaacaaauggccaacgggauagcacuuggauuaauggcccuaaaacuaaucacacaauucgaaacuuaccaguuguggacggcccuuauaucacuuacauguuccaauacaauuuuuaccuuaaccguagccuggcgaacugcgaccuuaauuuuggccgguguaaguuuacuuccggucugccagaguucguccaugagaaaaacagacuggcuuccuaugacaguagcagcaaugggagugccaccgcugccauuauucaucuuuucucuaaaggauacucucaaaagaaggucuuggccauuaaaugagggaguaauggcuguaggauuaguuaguauauuagcaucgucauuauuacgcaaugacguaccaauggcuggaccguuagucgcugguggccuacuuauagccuguuaugugauaacaggaacaucagcugacuuaaccguugaaaaagcugcggauguaacuugggaagaagaagcugagcaaacugguguuucucauaauuuaaugauuacaguagaugaugacggcacaaugcgaaucaaagaugaugagacagaaaauauuuuaacaguccuauuaaaaaccgccuuauugauugugaguggaauuuucccauauucaauaccggcaacgcuauugguauggcauacuuggcaaaaacagacacaacggucuggcguccugugggauguaccuagcccgccagagacacaaaaagcagaguuagaggaagggguauaucgcauuaaacaacaagggauauuaggaaaaacacaaguagggguaggcguacaaaaggaagguguuuuucauacuauguggcaugucacgagaggagcgguccuuacacacaauggcaaaagacuagaaccaaacugggcuucaguaaagaaggaucucauaaguuaugguggcggauggaggcuaucagcucaguggcaaaaaggagaagaaguucaggugauugcaguggaaccugguaaaaacccaaagaauuuccagacuaugcccggcacauuccagacuacaacuggugaaauuggggcuauugcguuggauuuuaaaccagguacgucugggaguccaauaauaaacagagaaggcaaaguuguagggcuauacgguaacggagugguuacuaaaaacgguggguacgucuccgggaucgcacagacuaacgccgagccugacgggccaacaccugaguuagaagaagaaauguucaagaaaaggaacuugacaauaauggaccugcauccugguucaggaaaaacgaggaaauacuuacccgccauaguaagagaagcaauaaaacggcgauugcgcacccucauccuugccccaaccagagugguugcugcggagauggaagaagccuugaaaggcuuacccauacguuaccaaacgaccgccacuaagagugagcacaccggacgugaaaucgucgaccuaaugugccaugccacccuaacaaugcgguuacuuagccccguucgggugccuaacuauaaucuuaucauaauggaugaggcacauuuuacggaccccgcaucaaucgcagcucgaggcuauauaagcacccgaguuggcaugggagaggccgccgcuaucuuuaugacagcaacuccgccagguacagccgaugccuucccucaaucaaaugcgccuauacaggacgaggaacgcgauauacccgagaggaguuggaauagugguaacgaauggauuacagauuuugccgguaaaacuguaugguucgugccaaguauaaaagcaggaaaugauauagcaaauugccuaagaaagaauggcaagaaagucauacaauuaucccgaaaaaccuuugacacagaauaucagaaaacaaaacucaacgauugggauuucgugguaacaacagauauaagugaaaugggagcaaauuuuaaggcagaucgcguaauugacccaagacguuguuuaaagccagucauccuuacagacggcccagagcguguuauuuuagccggaccuaugccaguaacagccgcuagcgccgcacagaggaggggccgagugggaagaaauccacaaaaagagaaugaccaguauaucuuuacagggcagccacuuaacaaugaugaggaucaugcacauuggacggaagcuaagaugcuauuagauaauauaaacacuccugaagguauaauuccagcuuuauucgaaccugaacgggaaaaauccgcagccauugacggagaauauagguuaaaaggcgaaucacgcaaaaccuuuguggagcuuaugagaagaggagauuuaccuguauggcuugcccauaagguagcaagcgaagggaucaaauauaccgaucgaaaaugguguuuugacggccagcguaauaaccaaaucuuggaagaaaauauggauguagaaauauggacaaaggagggggagaaaagaaaacuucgcccgagauggcuugaugcacggaccuauucagacccauuggccuuaaaagaauuuaaagauuuugcagcagggagaaaaagcauugcucuagacuuagugacggagauugggagagugccaagucaucuugcgcauaggacccgaaacgcuuuagauaaccuuguaauguuacacacaucagaacacggagguagggccuaucgacaugcaguagaggaacuuccggagaccauggaaacccuacuacuauuaggauugaugauucuuuuaacugguggggcgauguuauucuugauaucaggcaaggggauugguaaaacaaguauaggauugauaugcgucauugccagcaguggaaugcucuggauggccgaaauuccauuacaguggauugcaagugcaauaguacuagaguucuucaugaugguuuuacuaaucccugaaccagaaaaacaaaggacgccccaagauaaucaauuagcuuauguagucauagggauacuuacacuggcagcaauuaucgcagccaacgaaauggguuuguuagaaacuacaaaaagagaccuaggaauguccaaagaaccaggaguuguuaguccaacaucauacuuagauguggaucuucauccggcuucggcauggacacuauacgccguggcuacuacuguuauuacacccaugcuuagacacaccauagaaaacagcaccgcaaaugucucccuggcggcaauagcuaaccaagcuguaguuuugaugggucuagauaaaggauggcccauaucaaagauggaccuagggguuccauuauuagcacuuggauguuacucucagguaaauccauuaacacuaaccgcagcuguucuuuuacuuauuacacauuaugcaauaaucggaccgggcuuacaggcgaaagcaacucgggaagcacagaaacgaacggcugcuggaaucaugaaaaauccuacagucgauggcauaauuacaauugaucuagaucccguaauauaugacagcaaauuugagaagcaacuuggucaaguaaugcuccuaguuuuaugugcuguccaauuauuacuaaugaggacgucaugggcucuuugcgaagcccucacauuggcuacagggcccaucacgacauuaugggaggguucuccaggcaaauuuuggaacacaacgauugccguaaguauggcgaacauuuuucgaggaagcuaucuugcaggagcgggauuagcguuuucuauaaugaaaucaguaggaaccgggaaaagagggacgggaucacaaggagaaacgcuuggagagaaauggaagaagaaauuaaaucagcugucaagaaaagaguuugaccuauauaagaaaucgggcauaacugagguagaccgaacggaagcaaaggaaggacucaaaagaggagagacaacucaucacgcgguuucuagaggaagugcuaaacuccaaugguuuguagaaagaaacaugguaauuccagagggucgagugaucgaccuaggauguggacgcggaggcugguccuauuauugugcaggacucaaaaagguaacggaaguacgaggcuauacaaagggaggaccaggccaugagaaacccgugccaaugucgaccuacggauggaauauaguuaaauuaaugucagguaaggauguguucuaucugccuccagaaaaaugugacaccuuauuaugcgauauaggcgaauccaguccuagcccaacuguagaggaaucacgaacuauccggguccuaaagaugguagaacccuggcuaaagaacaaucaauuuuguauaaaaguguugaauccuuacaugccugcgguaauagaacauuuagagagacuucaacggaagcacggaggaaugcuaguucgcaauccacuaucaagaaauagcacacacgagauguauuggauaucgaacggaacaggaaacauagugucgucagucaauaugguuaguagauuguuguuaaaucgauucaaaaugacgcaucgacggccuaccauugaaaaagaugucgaccuaggugcugggacacgacauguaaaugcugaaccagaaacuccgaauauggauguaaucggggaacgaauaaaaagaauaaaggaagaacauaauaguacuuggcauuacgaugaugaaaacccguauaaaacgugggcuuaccacgguagcuacgaagucaaagccaccggcagugcuaguucaaugauaaacggaguaguaaaguuacuaacaaaaccuugggaugucguuccaauggucacacaaauggcaaugacagauacuaccccauucgggcagcagagaguuuucaaggaaaagguugauacacgaacaccuagaccuaugcccgguacaagaaagguaauggaaauaacagcagagugguuauggagaacucuaggacgcaauaaaaggcccagguuguguacacgcgaagaauuuacuaaaaaggucaggacaaacgcagcuaugggcgcugucuuuaccgaagaaaaccaaugggauagugcaaaagcagcuguggaagaugaggaauuuuggaagcuaguagaccgagaaagagaacugcacaaacuaggaaaauguggaaguugcguguacaauaugauggguaagagagagaagaaacuuggagaauuugggaaagcuaaagguagucgcgcaaucugguacaugugguuaggggcaagauacuuggaauuugaagcucuaggguuucuaaaugaagaucacugguuuagucgagaaaauucguauuccggcgucgagggagaagggcuucauaaauuaggauauaucuuaagagacauaagcaaaauucccggaggagcaauguaugcagaugauacggcaggcugggacacucgaauaacugaagacgaccuacauaacgaagagaaaauaacacagcagauggauccugaacauagauugcuagcuaaugcaaucuuuaaacuuacguaucagaauaaaguugucaagguucaaaggccaacaccgacagggacuguaauggauaucauaucccgaaaagaccagaggggcucuggucaaguagguacguacggcuugaauacauucacgaacauggaggcgcaauuaguucgucagauggaaggggagggaguauugucaaaagcggaucuugaaaacccgcauuuaccugagaagaaaauuacucaaugguuagaaacaaaaggugucgaaagacucaaacgcauggcgaucuccggagacgauugugucgucaagccgauugaugaccgauuugcuaaugcuuuauuagcuuuaaaugauaugggcaaaguaagaaaagauaucccacaauggcaaccaucuaaaggauggcacgauuggcaacagguuccuuucuguucacaucauuuccacgaacugauuaugaaagacgggagaaagcuagugguuccauguagaccacaggaugaacuuauugggagagcaaggaucucacagggggcagguugguccuuaagagaaacagcaugucuaggcaaggcguacgcucaaauguggucuuuaauguacuuucaccgucgugauuuaagacuugcuucuaaugcuauauguagcgcaguaccuauacauuggguaccaacaucacgaacaacuuggucaauucaugcacaucaucaauggaugacuacagaagacaugcuaacugucuggaauaggguauggauagaagauaaccccuggauggaggacaaaacaccaguaacuacuugggagaacguccccuacuuggggaagagagaagaccaguggugcggaaguuuaauuggacuaacaucaagggccacuugggcucaaaauauaccaacagcuauacaacaagugaggaguuuaauugguaaugaagaguucuuagauuauaugccaucaaugaaaagauuucguaaagaagaagaacuagaaggagcgauuugguaa

SEQ ID NO: 23025 - RNA, 9873 nt, Artificial Sequence
  derived and/or modified CDS sequence (opt6) from DENV-3__KF041254__SS-prME
acuucauuaugcuugaugaugauacuuccugcagcacuagcauuucaucuaacuucaagggacggugaaccccgcaugauuguaggcaaaaaugaaaggggaaaauccuuauuguuuaaaacagcaaguggaaucaauauguguacucuaaucgcaauggaucuaggagaaaugugugacgacacagucacuuacaaauguccacacauaacagagguggagccagaagacauagauugcugguguaaucuuacaaguacguggguaacauauggaacauguaaccaagcaggggaacauagaagggacaaacgaaguguggcacuagcaccucauguaggcaugggauuagauacgcguacacagacauggaugagugcagagggagcguggcggcaaguagagaaagucgaaacuugggcgcuucggcauccaggauuuacaaucuuagcacuauuuuuggcacacuauauuggaacaucauuaacgcaaaaaguaguaauauucauucuauugaugcuaguuacgccaucaaugacaaugcgcuguguaggggugggaaacagagacuuuguagaaggguuauccggggcaacauggguagaugucgucuuagaacauggagggugcguuacaacaauggccaaaaauaaacccacauuagauauagaguuacagaaaacagaagcuacucaacuagcuaccuuacgaaaacuaugcauagaaggcaaaauaacuaauauuaccacggacaguagaugcccaacgcaaggugaggcaguauuaccggaagaacaagaccaaaacuacguauguaaacauacauacguugauaggggauggggaaaugguuguggacuuuuuggcaaagggagucuaguaacaugugcaaaauuucaaugucuagaaccuauugaagguaaaguuguucaguacgaaaacuuaaaauacacaguaaucauaacgguccauacaggagaccaacaucagguaggaaaugaaacacaaggugucacugcugagaucacuccgcaagcaucaacaacugaagcuaucuuaccagaauaugggaccuuaggauuagaguguaguccuagaacgggauuggauuuuaaugagaugauccuucugacaaugaaaaacaaagcauggaugguccaucgucagugguucuuugaucuaccucuaccuuggacaucgggugcaacgacggaaacaccgacguggaauagaaaagagcuccugguaaccuucaaaaaugcgcaugccaagaaacaagaagucgugguccuaggaucucaggagggugcaaugcacacagcucuaacuggagcuacggagauucaaaauaguggggguacaucaauuuuugcaggccaucucaaaugcagacuuaaaauggacaaacuagaauuaaaaggaauguccuacgcaaugugcacaaacacauuuguauugaagaaagaaguuucagaaacacaacaugguacaauauuaauuaaaguagaauauaagggagaagaugcgccguguaaaauuccuuucucuacagaagacggacaggggaaagcacauaauggcagacuaauuaccgcaaaccccguugugaccaagaaagaagaaccaguuaauaucgaagcugagccacccuuuggugaaaguaacauaguaaucggaauaggugacaacgcccuaaaaauaaacugguacaaaaaggguucgucaauaggaaagauguuugaagcgacagcgcggggcgcaaggaggauggcuauacuuggagacacggcaugggacuuugggaguguggguggaguccuaaauucucuuggaaaaaugguccaccagauauucggaucagcauauacggcauuauuuucaggcgucaguuggguaaugaaaaucgggauaggaguauuacugacuuggauuggauuaaauuccaaaaacaccucaaugucauucucauguauagccauagggauaauaacgcuuuaucuuggcguugugguacaggcugacaugggcugcgugauuaacuggaaagguaaagaacuuaaaugugguagcgguauuuucgugacaaacgaaguacacaccuggacagagcaguacaaauuucaagcagacucaccgaaacgacucgcaacugcaauagcaggagcaugggaaaauggugugugcgggauaagaaguaccacgcgaauggaaaauuuauuauggaaacaaauagcaaaugaauugaauuacauucuaugggaaaauaauauaaaauuaacuguuguagugggagacacgauaggaguucuagaacaaggaaaaagaacguuaacaccucaacccauggaacuaaaauacucauggcggacuugggguaaagcaaagauaguaacugcugaaacgcaaaacagcucguucauaaucgacggcccaaauaccccugagugcccuucggcaucccgggccuggaauguaugggagguggaggauuauggauuuggaguauucacaacgaacauaugguuaaaauugagagaaauguauacacaaaugugugaucauagacugaugagcgccgcaguaaaggaugaaagggcaguucaugcagacaugggcuauuggauugaaucacagaaaaaugguucuuggaagcuagaaaaagccagucucauagaaguuaagaccuguacauggccuaagucucauacacuauggucgaaugguguuuuagagucagacaugauuauaccuaaaucguuagcuggaccaauaucucagcacaauuauagaccugguuaucacacacaaacggcagguccuuggcaucuaggaaaacucgaacuugacuuuaacuacugcgaaggcacuaccguuguaauaaccgagaauugcggcacgcgaggucccucacuacgcacaacaacaguuucaggaaaguuaauucaugaaugguguuguagaucauguacuuuaccaccauuacgguacaugggcgaagaugguugcugguaugggauggaaauacgaccuaucagugaaaaagaagaaaacauggugaaaagucucguuagugcgggaucugguaagguggauaacuuuacaaugggaguucuaugccuagcuaucuuauucgaagaagugaugcgugggaaauucggaaagaaacauaugauugcugggguauucuuuacguuuguccuacuccuaucgggucagaucacguggagggacauggcgcauacccuuauuaugauugguucaaaugcaucggaucggauggggaugggcguaacuuaccuggcccuuauagcuacguuuaagauacaaccauuccuugcacuaggauuuuucuuaagaaaacucacguccagagaaaaucugcuuuuaggggugggcuuagcaauggcaacgacgcuccaguuaccggaagauauugaacagauggcaaacggcauugcccuuggccuaauggccuuaaaacucaucacacaauucgaaacauaucagcucuggacggcucuaauuucauugacuuguaguaauaccauuuuuacauuaaccgucgcuuggagaacugcgacuuugauucuggccgguguaaguuuauugccagugugucaaaguuccaguaugcguaagaccgacuggcucccaaugacggucgccgcgaugggaguaccuccuuugccuuuauucauauuuucacuuaaagacacacuaaaaaggcgaucuuggccauuaaaugagggaguuauggcagugggauuaguuaguauucuugcgagcucccuccucagaaaugauguaccaauggcaggaccgcuuguagccggcgguuugcuaauagccugcuacgugauuacaggaacaagcgcugauuuaacagucgaaaaggcagcugacguaacuugggaagaggaggcagagcaaacugguguaucacacaauuugaugauuacuguagaugacgaugguacuaugcggauuaaggaugacgaaaccgaaaacaucuuaaccguucugcugaaaaccgccuugcuaauagucucagguauuuuuccauauaguauaccggcuacauuauugguuuggcauacauggcagaaacagacacaaagaucaggaguauugugggacguuccgaguccaccugaaacucaaaaagcggaauuagaagaaggaguuuaucguauuaaacaacaggggauccuuggaaaaacgcaaguugggguuggcgugcaaaaagagggaguauuucauacaauguggcacguaacuaggggagcuguacuaacacacaaugguaaacgucuugaaccaaauugggcaucaguuaagaaagauuuaauuucuuacgggggaggauggagauugucggcacaguggcaaaaaggugaagaaguacaaguaauagcaguagagccgggcaaaaauccuaaaaauuuucagacaaugccuggaacuuuccaaacaaccacaggagaaaucggcgcaauugcccuagauuuuaagccugguacaucuggaagcccaauaauaaaccgcgaagguaaaguaguaggccuauauggaaacggcgugguuaccaaaaauggggguuacgugagcggcauagcucaaacaaacgcagagccagacggcccgaccccagaauuggaggaagagauguucaagaaacgaaaucuuacgaucauggaccugcacccugguucaggcaaaacacggaaauauuuaccugcuauugucagagaggcgauaaagcguaggcucagaacuuuaauccuagcaccgacucgugugguggcagcagaaauggaagaagcacucaaaggacuaccaauacgguaucaaacgacugcaacaaaauccgaacauacuggacgggaaauaguagaucuaaugugccacgcaacuuucacaaugcgccuguuaagucccguccgcgugccgaauuauaacuuaauaauaauggaugaagcacacuuuaccgacccugcgagcauagccgcgagaggauauauuucaacacgcguaggaaugggggaagcugcagcuauuuucaugaccgcaacuccuccaggaacagccgacgcuuucccucaaaguaaugcaccaauccaggaugaagaacgggauauaccugaaagguccuggaacucggggaaugaauggauuacagauuucgcaggaaaaacuguaugguuugugcccucaauuaaagcuggcaaugauauugcaaacuguuuacguaaaaaugguaaaaagguuauccaguuaaguagaaaaacauuugacacugaauaucagaaaacuaaauuaaaugacugggacuucgugguaacaacagacauuagcgaaaugggugcaaacuucaaagcggauagagucauagacccuagaaggugcuuaaaaccuguaauacuaacagaugguccggaaaggguaauacuugcggguccuaugccaguaaccgcagcuucugcugcucagagaagaggacguguaggaagaaauccgcagaaagaaaaugaucaauauaucuucaccgggcagccucuaaauaacgacgaagaucaugcucacuggacagaagccaaaaugcuccucgacaauauaaacacaccggaaggaauuauuccggcauuauucgagccggaacgugaaaagagcgcggcaauagacggugaauaccgacuaaagggugaaucacgcaaaaccuuuguugaguuaaugaggaggggagaucuaccagucuggcuggcacauaaaguugcgucugaaggcauuaaauauacagauagaaaauggugcuuugacgggcaacgaaacaaccaaauuuuagaggaaaauauggacguugaaauuuggacaaaggaaggugaaaagagaaaacuacgaccgagaugguuagaugcacggacguauucagauccacucgccuuaaaggaguucaaggacuuugcagcaggccguaagagcauugcacuugaucuugugacagaaauuggacgugucccaucucaucuugcacauagaacaaggaaugcacuagauaaucuaguaaugcuacacacuucagagcacggaggcagagcuuaucgacaugcaguugaggagcuaccagagacaauggagacccuucuuuuacuaggacuuaugauacuacugacgggaggagcuacucuauuuuuaauaucuggaaaaggaauagguaaaacuucuauaggauuaaucuguguaauugcuuccuccgguauguuauggauggcagagauuccgcugcaauggauagcauccgcuauaguucuagaguucuuuaugaugguacuuuuaauaccugaaccagaaaaacaaagaacuccucaagauaaucaauuagcauauguugucauuggaauauuaacacuagcggcaauaauagcugcaaaugaaaugggccugcuugagaccacaaaacgcgacuuagguauguccaaagagccaggcguggucucaccaaccaguuaucuggacguugauuuacacccagcuuccgcuuggacucucuaugcagucgcaacgacaguaauuacgccaaugcuuagacauacaauagaaaauucaacagcgaacguaaguuuagcugcaauagcgaaucaagcaguaguccuuaugggauuagacaagggguggccaauaucaaaaauggaccuaggcguaccauuauuagccuuaggcugcuacagucaaguaaauccacuuacacucacggcugcuguuuuguuauugauuacgcauuaugccauaauagggccagguuugcaagcaaaggcaacaagagaagcgcaaaagaggacagcagcaggcaucaugaaaaaccccacaguagaugggauuauuacaaucgaccucgauccagugaucuacgauagcaaguucgaaaaacaguuagggcaaguuaugcuguuaguuuuaugugccguucaacuuuuacuaaugcgcacgucaugggcuuugugugaggcacuaacgcucgcaacagguccuaucaccacucuuugggaggggaguccagguaaguuuuggaacacuaccaucgcuguaucaauggcaaauauuuucagagggucauaucuggcucgcgcaggcuuagccuuuagcauaaugaaaucaguaggcacaggaaagcgcgguacaggcagccaaggagagacacuaggagaaaaauggaagaagaaauuaaaccaacucaguagaaaagaauuugaucuauacaagaaaagugguauaacugaggucgauaggacagaagcaaaagaaggacuaaagcgaggcgaaacaacucaccaugcuguuucacgcgguucugcaaagcuccaaugguuuguagagagaaauaugguuauucccgaaggacgagugaucgauuugggaugugguagaggagguugguccuauuacugugcaggccugaagaaaguaacagaaguuagaggguacacgaaaggcggaccuggacacgaagaaccugucccuaugaguaccuacggauggaauauagugaaacuaaugucaggcaaagacguguuuuacuugccaccagagaaaugugauacauuacugugcgauauaggugagaguucuccaucaccaacaguagaagaaucccgaacuaucagaguauuaaaaaugguggaaccuugguugaagaacaaccaguuuuguauaaaagugcuaaauccauauaugccugcuguuauagaacauuuggaaagacuucaaagaaagcacggcgguaugcuaguaagaaauccauuaaguagaaacucuacgcacgagauguacuggauuucaaauggaacgggaaauaucguaagcucugucaacaugguuucgaaguuauuauugaacagguuuacaaugacucauagaaggcccacuauagaaaaggaugucgaucucggugcaggaacccgucacguuaaugccgagccugaaacucccaauauggacguuaucggagaaagaauaaaacguauaaaagaagaacacaauaguacguggcauuacgacgaugagaacccguauaaaacuugggcauaccacggcaguuacgaagucaaggcaacuggaagugcuucaagcaugauaaauggagugguaaaauuauuaacgaaacccugggacguuguuccaaugguuacgcaaauggcgaugacugauacgacaccuuucggucagcaaagagucuucaaagaaaaaguugauacaagaacgccgagaccuaugccagguacaagaaaaguuauggaaauaacagcagaaugguuguggagaacacuuggcaggaauaagcgacccagacuuugcaccagagaagaauuuaccaagaaagucagaacgaaugcugcaaugggggcagucuucacugaggaaaaucagugggauagcgcaaaggcagcaguagaagaugaagaauuuuggaaauuaguagacagagagagggaacuacacaaacugggcaaaugcggaucauguguauauaauaugauggguaaaagggagaagaaacucggcgaauuugguaaagccaaaggauccagagcgauaugguauaugugguuaggugcuagauaucucgaguucgaagcacucggauuuuuaaaugaggaucauugguuuaguagagaaaacucauauucggggguggaaggugagggacuacauaaacuaggauacauccuaagagacauaucuaaaauccccgggggcgcaauguaugcugacgacaccgcaggaugggacacccgcauuacggaagaugaccuacauaaugaagagaaaaucacucagcaaauggaccccgaacacagacuccuagcgaacgcaauuuucaagcuaacauaccagaauaaaguaguaaaaguccaacguccgacaccaacggguacaguaauggacauaauuagcaggaaagaccaaagaggaucaggacaaguuggaacauacggguuaaacacauucaccaacauggaagcacaacuuguacgccagauggaaggggaagggguauuaagcaaggccgaucuagaaaacccucauuuaccagagaagaaaauuacacaauggcuagaaacuaaagguguugaacgauuaaaacgaauggccauaucaggugacgauugcguagugaagccaaucgaugauagguuugccaaugcauuacucgcgcugaaugauaugggaaaaguaaggaaagacauaccacaauggcagccaagcaagggcuggcaugauuggcaacaagugccuuuuugcucgcaucacuuccaugagcuaauuaugaaagacggucggaaauuaguaguaccuuguagaccacaagaugaguuaaucggacgcgccaggauuucccaaggagcaggguggucauuacgugagacagcuugcuuagguaaggccuacgcucagauguggucacuuauguauuuccaccgaagagauuuacgacuagcuaguaaugcuauuuguucagcgguaccaguucacuggguuccuacaucuagaacaacauggagcauccaugcacaccaucaauggaugaccacagaggacauguugacuguuuggaauagaguauggauugaggauaauccauggauggaagacaaaacaccaguaacaacuugggagaauguccccuaccugggaaaaagagaagaucaauggugcggaucacuuauuggccuaacaagccgugcuacuugggcacaaaauaucccaacagcgauucaacaggugagaucgcugauagguaaugaagaauuuuuagacuacaugccuaguaugaagcgcuucagaaaagaagaagaauuggaaggugcuauaugguaa

SEQ ID NO: 23026 - RNA, 9873 nt, Artificial Sequence
  derived and/or modified CDS sequence (opt6) from DENV-3__KX380841__SS-prME
acgucacucugucuuaugaugauccucccugcggcacucgcuuuccaccucacgucccgugacggugaaccuagaaugauuguuggcaaaaaugaacgcgggaaaaguuuacucuuuaaaacggcaucaggaauuaacaugugcacguuaauagcaauggaccucggagaaaugugcgaugauacagucaccuacaaauguccucauaucacagaaguggaaccugaagacauugacugcugguguaaucuuacuagcacaugggucacauauggaacuugcaaccaagcuggggaacaucguagagauaaacgaucgguagccuuagcuccgcauguagguauggguuuagacacgaggacacaaacuuggaugucagcugaaggagccuggagacaagucgaaaaaguugaaacaugggcauugcggcauccgggauuuacuauuuuagcacucuuccucgcacacuacauaggaacgucauuaacucaaaaagucguaauauucauuuuacuuauguuaguaaccccaucuaugacaaugagguguguugguguaggaaacagggacuucguagaaggucucaguggagccacuuggguugacguaguuuuggaacauggaggaugcguuacaacgauggcuaaaaauaaaccaacgcuugacaucgaauuacagaaaaccgaagccacacaacuugcuacgcuacggaaacuauguauugaaggaaaaauaaccaacauaacuacagauucacgaugcccaacacaaggagaagcuguauuaccugaagaacaagaucaaaauuacguuugcaaacacacguacguugacagagguuggggaaauggaugcggcuuauucggcaaaggaucauuaguuacaugugcaaaauuucaauguuuagagccuauagaagguaaagucguucaguaugaaaaucuaaaauauacagucauuauuacuguacacaccggugaucagcaucaaguaggaaaugaaacacagggaauaacugcagaaauaaccccucaggcuucgacuacggaagcuauucugccugaguauggaacacucggucuggaauguaguccgagaacgggucuagacuucaaugaaaugauccuacuuacaaugaaaaauaaggcuuggaugguacaccgucagugguucuuugaucugccacuaccauggacuucuggcgcaacaacggaaaccccaacauggaaucggaaagaacuauuaguaacuuuuaaaaaugcucacgcgaagaaacaagaaguugucguauuaggaucgcaagagggggcgaugcauacagcucucacgggagcgacugaaauucaaaauagugguggaaccucaauauuugcuggacaccuuaaaugccgacuaaaaauggauaaauuagaauuaaaagggauguccuaugcuaugugcacaaacacguucguacuaaagaaagaggugucagaaacucaacaugggaccauacugaucaaagucgaguacaaaggagaagacgcgccaugcaaaauaccuuuuaguacagaggauggacaagggaaagcucacaauggaagacuuauaaccgcaaauccuguuguaacgaagaaagaagaacccguaaauauagaggccgaacccccguucggugaaucaaacauaguuauuggcauuggagacaacgcucugaaaauaaauugguauaaaaagggaucuucaauagggaagauguuugaagcuacggcaagaggagcucgcagaauggcuauauuaggugauacggcuugggauuucgguaguguaggagguguucuaaauucacucgggaagauggugcaucaaaucuucgguucagcauauacugcacuuuuuagcggaguaucaugggucaugaaaauuggaauagguguuuuacuaaccuggauaggacuaaauagcaaaaauacaagcauguccuucucauguauugcuaucggaauaauuacucuauauuugggggcaguuguucaagcagauaugggaugcgucauaaacuggaaggggaaagaacucaagugcggaucgggaauuuuugucacuaaugagguccauacuuggacugagcaauauaaauuucaagcagauucaccuaaacguuuagcgacggcgaucgcaggggcgugggaaaacggaguaugcggcauaagaagcacaaccagaauggagaaucugcucuggaaacaaauagcuaacgaauuaaauuacauacucugggaaaauaacauaaaacugaccguaguuguaggagauacuauagguguguuagaacaaggcaaacgaacucuaacaccacaaccgauggaguuaaaauacucauggaagacauggggaaaagcaaagauaguuacggcagagacucaaaacagcucguucauuauugauggaccuaauacuccugaguguccuagcgccucaagagccuggaauguuugggaaguagaagauuauggguucggaguauucacgacaaauauuuggcucaaauuacgagaggucuacacgcaaaugugugaccaccgacucaugagugcagcaguaaaagacgaacgagcaguacacgcugauaugggauauuggauagaaagucagaaaaaugguaguuggaaauuagaaaaagcgagccugauugaaguuaaaacauguacuuggccuaaaagucauacccuauggaguaaugggguccuggagagugacaugaucauaccuaaaucauuggcuggaccaauaucucaacauaacuauagacccggauaccauacacaaaccgcagguccauggcacuuagguaaacuggaauuagacuuuaauuauugugaagggacaaccguggucauaaccgagaauugugguacgcguggaccauccuugagaacaacaaccguauccggaaaacuuauccaugaaugguguugucgcucgugcacauugccaccauugagguauaugggcgaagacgguuguugguacgguauggaaauaagaccaauaagcgaaaaagaagagaacaugguaaaguccuuaguuagugcagguuccggaaaagucgauaacuucacaaugggaguucuuugccuugccauacuguucgaggaagugaugagagguaaauuugguaagaaacauaugaucgcuggaguauucuuuacauuugucuuauuacugucuggccaaauuacuuggagagauauggcacauaccuuaaucaugaucgguagcaacgcuucugaucggaugggaauggggguuacuuacuuggcucuaauugccacuuuuaaaauucagccauuucucgcauugggcuuuuucuuaagaaaacucacaucccgugaaaacuugcuucuaggaguaggccuagccauggccacgacguugcaacuuccggaggacauugagcaaauggcaaauggaauugcucuuggccugauggcucuaaaauuaauaacucaauuugaaacuuaccaauuguggacagcucugauaucucuaacuuguucaaauacaauuuuuacauuaaccguagcuuggaggacggcaacguuaauauuagccggagucucucuacuaccuguuugucagucuagcucaaugagaaaaacugauugguuaccuaugacaguagccgcaaugggggugccgccucuuccauuauucauauuuucuuuaaaagacacauuaaaaagaagaucauggcccuuaaaugaaggagucauggcaguuggguugguuagcauacuggcuucaucacucuuacgaaaugaugugcccauggcgggcccccuagucgccggaggguuacucauagcauguuacgucauaacgggaacuagcgcugaccucacaguggagaaggcagcagacguaacaugggaagaggaagccgaacagacggguguaagccauaauuugaugauaaccguggaugaugacggaaccaugcgcaucaaagacgaugagacagaaaacauauuaacaguguugcuuaaaacggcuuugcuaauaguauccggaauuuuuccuuacucaauacccgcaacucuuuuaguauggcauacuuggcaaaaacagacccagcgcagcggaguccuuugggacguaccuaguccaccagagacucaaaaagcggagcuagaagagggcgucuacaggaucaaacaacagggaauacuaggaaaaacacaaguugguguagguguucaaaaagacgggguauuucacacgauguggcacguaacaaggggugcuguauuaacacacaaugggaaaagacuugaaccuaauugggcgucagucaaaaaggacuugauaagcuaugggggaggguggagacuuagugcgcaauggcaaaagggagaggaaguacaagucaucgcaguagaaccaggcaaaaauccgaaaaacuuccaaacuaugcccgguacuuuccaaacgacaacuggugaaauaggagcaauagcucuagacuucaagccaggaacuuccggaucaccaauaauuaauagagagggaaaagugguuggucuguacggaaacgguguggucacuaaaaaugguggauaugucagcgguauagcgcaaacaaacgcugaaccagauggacccacaccggaauuagaagaagaaauguuuaagaaacgcaacuuaacuaucauggaucuccauccgggaucaggcaaaacgaggaaguacuuaccugcgauaguacgagaagcaauuaaaagacgauuacguacauuaauucuugcucccacacgaguuguggcggccgaaauggaggaggcuuuaaagggcuuaccgauaagauaucaaacaaccgccacuaaaucugagcauacaggaagagagauaguugacuuaaugugucaugcaacuuucacgaugcgacuuuuaucucccguaagaguuccaaacuauaaucuuauuaucauggaugaagcgcacuuuacagacccugccucuauagcagcaaggggauacauuucaacccgcguaggaaugggugaagccgcagcaauauucaugacagcaacacccccagguaccgccgaugcauucccccaaaguaaugcacccauccaggaugaagaacgugauauaccagaacgaaguuggaacucggggaacgaauggauuacagauuucgcuggaaaaacgguuugguuuguuccaaguauuaaggcuggcaaugacauugcgaauugcuuaagaaagaacggaaagaaagugauacaauuaucucgcaagacuuuugacacagaauaucagaaaacuaaauuaaaugauugggauuuuguuguaacgacagauaucagcgagaugggagcgaauuucaaggccgaucgaguaauugaccccaggaggugcuuaaaaccaguuaucuuaaccgacggaccggaacguguaauucuugcuggcccaaugcccguuaccgcagcuagcgcggcccaacguagagggcgagugggccguaauccucaaaaagaaaaugaccaguacaucuucacaggucaacccuuaaauaaugaugaagaucacgcacacuggaccgaagcaaaaauguuauuagauaauauuaauacuccagaggguauuauuccugcauuguuugagccugaaagagaaaagagugcagccaucgacggugaauacaggcucaaaggagaaucacguaaaacauucguagagcuuaugagacgaggagaccugcccguaugguuagcucauaaagucgcaucagaaggaauuaaauauaccgaucgaaaaugguguuuugacggccaacgcaauaaucaaauuuuagaagagaauauggauguagaaaucuggacaaaggaaggcgagaaaaagaaauugaggccacgguggcuggaugcaagaacauauuccgauccccuagccuuaaaagaauuuaaagacuuugcugcaggcagaaaauccauugcccuugauuugguuacggagauaggaagaguaccuucgcaucuugcgcauagaacucggaaugcacuagauaaccuagucauguuacacacaucagaacacggugggcgagccuauaggcaugccguagaagaguuaccugaaacaauggaaacgcucuuauuacucggucuaaugauacuacucacaggaggagccauguuauuuuuaauuaguggaaaagguaucggaaaaacgucgauaggauugauuugcgugauagcaucuucggguaugcuguggauggcugaaauaccucuucaauggauagcaagugcuaucguacuggaguucuucaugaugguacuccucauccccgaaccagagaagcaaaggacuccccaggacaaccaacucgccuacguaguuaucgguauccuaacaauggcugcaauuaucgcugccaaugaaaugggcuuauuagaaacaacgaagagggaccuagguaugucaaaggaaccuggaguaguuucuccaacgagcuaccuagauguagauuuacauccagcaagugcauggacucuguacgcgguugcaacuacgguuauaacaccuauguuacgacacacuauugaaaauucaacagcaaauguuagccucgccgcuauugcaaaucaggcagugguccuuaugggcuuagauaaagguuggccaaucucuaaaauggaucuaggagucccauuacuugcauuggggugcuauagucaagugaauccuuuaacccuuacagcagcuguacuucuccuagugacgcacuaugcgauaauuggaccuggacugcaggcaaaagcaacuagagaagcacaaaaacgcacagcagcgggcauuaugaaaaacccuacgguagacggaauuauaaccauugaccuagauccaguuauuuaugacuccaaauuugaaaagcaauugggucaaguaaugcuacuuguauuaugugccguucaacuucuccuaaugcgaacaaguugggcuuugugugaagcacuaacucuugcuaccgggccgaucacuacgcuaugggagggcucgccaggcaaguuuuggaauacuacaauugccguaucaauggcaaacauuuucagagguaguuacuuagcaggcgcagguuuagcuuuuagcauuaugaaauccguuggcacagguaaacguggaacugggagucaaggggaaacccugggagaaaaguggaagaagaaauugaaucaacuaucuagaaaagaauuugaucuuuacaagaaaaguggaauaacagagguggauagaacagaagcaaaagagggacuaaaacgaggggaaacuacacaucaugcagugagucguggauccgcuaaauuacaaugguuuguagaaaggaauaugguuauaccggaaggucguguuaucgaccuaggcuguggacguggcggauggaguuacuauugcgcaggucuuaagaaagugacggaggugagagguuauacuaaaggagggccuggucaugaagaaccaguucccaugaguacguauggguggaauauagucaaguuaaugaguggcaaggauguuuucuacuuaccgccagaaaagugcgacacauuguuaugugauauaggagaaagcucaccuagucccacgguagaagagucccgaaccauacgcguuuuaaaaaugguugaaccaugguugaaaaauaaucaauuuuguauaaaaguccuaaauccuuauaugccagccguaauugaacaucuagaaagacuacaaagaaaacaugggggaauguuaguaagaaacccucugucgagaaacucaacacaugaaauguauuggauuucuaacgguacaggaaauauagucucuagcgucaacaugguaucacgauugcuacugaauagauuuacuaugacacacagacgacccacgaucgaaaaggauguugaccuaggcgcugguacgcgucaugucaaugccgaaccagaaacgccaaacauggauguuauuggcgaacguauaaagcggaucaaagaagaacauaauagcacauggcauuacgaugacgagaauccauacaaaacaugggcauaucauggaucguaugaaguaaaagcaaccgguucugcuucaucaaugauaaacgguguaguuaaacuucuaacuaaaccuugggacguuguuccgaugguaacccaaauggcaaugacggauaccaccccuuucggacaacaacgaguauuuaaggaaaaaguagauacacgaaccccuaggccgaugccugggacuagaaaagugauggagauaacagcugaauggcuauggagaacacuugguagaaauaaaagaccacgauuguguacgagagaggaguuuacuaagaaagucagaacaaaugcagcuaugggagccguauuuaccgaagaaaaucagugggauagcgccaaagccgcuguugaagaugaggaauuuuggaaauuaguagaccgagaacgagaacuacauaaguugggcaagugcggcucaugcguguacaauaugauggggaaacgcgagaagaaacuaggggaguucggcaaagcaaaagggucgcgugcaauaugguacaugugguugggagcacgguauuuagaauuugaggcuuugggauuuuuaaaugaggaucacugguuuucucgagaaaacucuuacuccggcguagaaggcgaaggacuacacaaauuaggauauauacuacgagauauuuccaaaaucccagggggcgcgauguacgcagacgacacggccggaugggauacucgaauaacagaggaugaccuacauaacgaagagaaaauaacgcaacaaauggauccagaacaccgacuuuuagccaacgcuauauuuaaacuuacauaccaaaauaaagugguuaaagugcaacguccaacaccgacagguacagucauggauauuaucucucguaaagaccaaaggggaucaggacaaguaggcacuuacggacugaauacauuuacaaacauggaagcacaacuuguacgucaaauggaaggugaagguguucuuaguaaaacagaucuugaaaauccacauuuaccggagaagaaaaucacacaguggcucgaaacuaaaggcgucgagagacugaagcgaauggcaauaagcggggacgauuguguaguaaaaccuaucgaugauagguuugcuaaugcucuuuuagcauuaaacgacauggguaaaguaagaaaggacauuccucaguggcagccaaguaagggauggcacgacuggcaacaaguuccauuuugcucacaucauuuucacgaguuaauaaugaaagauggacguaaguuaguaguccccuguagaccucaagaugaacuaaucggucgcgcaagaauaucacagggugcagguuggagucuacgcgaaacugcauguuuagguaaggcuuacgcccagauguggagucuaauguacuuucacaggcgugacuuaagguuagcaaguaacgcgauaugcagcgcaguaccgguccauuggguaccaaccaguagaacgacauggucaauucacgcccaucaucaauggaugacaacagaagauaugcuaacaguuuggaacagaguauggauugaagacaauccuuggauggaggacaaaacaccaauuacuacuugggaaaauguucccuaucuugguaaacgugaagaccaauggugcggaagucuaauaggacuaacaaguagagcaacaugggcucaaaauauucccacggcaauacaacaaguaaggucacugauaggcaaugaagaauuucuugauuauaugcccucuaugaagcgauuucgcaaagaagaagagagugaaggagcaauaugguaa

SEQ ID NO: 23027 - RNA, 9873 nt, Artificial Sequence
  derived and/or modified CDS sequence (opt6) from DENV-3__KX380842__SS-prME
accagucucugcuugaugaugauauuaccagcggccuuggcuuuucacuuaacgucuagagauggggaaccgcggaugauaguagguaaaaaugaacgagguaaaucucuauuauuuaaaacugccaguggaauaaauauguguacucugauugccauggaccucggugaaaugugcgaugauacuguaacauauaaaugcccucauauaacggaaguugaacccgaagauauugauuguuggugcaaucuuacaagcacuuggguaacauacgggaccuguaaucaagcaggggaacacagacgcgauaaaagaaguguagcacuggcuccacacguagggauggguuuagauaccagaacacaaaccuggaugucggcagaaggggcuuggcggcaaguggaaaaaguagaaacaugggcacuuaggcauccagguuuuacaauucucgcguuauuucuagcacacuauauuggcacaucgcuuacgcaaaaaguuguuauauucauccuacuuaugcuagugacuccaaguaugacaaugaggugcguugggguuggaaaucgcgacuuugucgaaggguuaucaggugcaacuuggguagauguaguauuagaacacggcggcuguguaacuaccauggcuaaaaacaaaccaacacuugauauagaauuacagaaaaccgaagccacacaauuagcgacgcugagaaaacuuuguauugaaggcaaaauaacaaacauaacaacagacucacguugcccgacacagggugaagcuguauuacccgaagaacaagaucagaacuacguauguaaacauacauauguugauaggggguggggcaauggaugugguuuauuugguaaagguaguuuagugacgugugcgaaauuucaguguuuggaaccuauagaaggcaaaguuguacaauaugaaaacuugaaauacacagugauuauuacuguccacacgggcgaccagcaccaaguagguaaugaaacgcaggggauaacagcggaaaucacaccacaggcaucuacuacugaagcuauuuuacccgaauaugguacuuuagggcuagaauguaguccacgcacaggucuagauuuuaacgaaaugauucugcugacaaugaagaacaaagcauggaugguacauagacagugguucuuugacuuaccucugccauggacuagcggggcaacuaccgaaacucccacauggaaucgaaaagaacuuuuaguaacauucaaaaacgcacacgcgaagaaacaagaagucgucgugcuggguucacaggaaggagccaugcacacagcuuugacaggagcaacugaaauacaaaauagcggaggcacaaguauauuugcaggucauuuaaaauguagacuaaaaauggacaaacuagaauugaaagguaugagcuacgcuaugugcacaaauacauucguacuuaagaaagaagugagugaaacgcaacauggaacaauacuuaucaagguagaauauaaaggcgaagaugcaccuugcaaaauuccauucaguacagaggauggacaggguaaagcacauaaugguagacugauaacggcgaacccaguaguaacuaaaaaggaagaacccgugaacauugaagccgaacccccuuuuggcgaaagcaacaucgugauugguauaggugacaaugcauuaaaaaucaacugguacaaaaaggguaguucaauuggaaaaauguuugaggcgacugcaagaggagcaagacgcauggcaauuuuaggggacaccgcgugggauuucgggucaguuggagguguuuuaaauucacucggaaagaugguccaucaaauauucggaucagcguauacagcucuguuuaguggagucucaugggugaugaaaauagguauuggcguguuacugacauggauuggacuaaauuccaaaaauacaaguaugucauuuucuuguauagcaaucggcauaauaacuuuauaccuaggggcgguugugcaagccgauaugggcuguguaaucaacuggaaagggaaggaacucaagugugguucaggaauauuuguaacgaacgaaguacacacguggaccgaacaguauaaguuucaagcagauagucccaaacgccuugcgacagccauuguaggugccugggaaaauggugucugugggaucagaucgacaacacgaauggagaaucuacucuggaaacaaauagcaaaugaacuaaauuauauacuaugggaaaacaauauaaaacuaacgguaguggugggcgauacaauugggguacuagaacaagguaaaagaacucuaacaccccagcccauggaacugaaauauaguuggaaaacauggggcaaagcaaaaauaguaacggcagaaacacagaauagcucuuuuauaaucgacggaccaaacacuccagaaugccccucagcaucgcgagcauggaaugucugggaaguagaggauuauggauuuggaguuuuuacaacuaauauuugguuaaaauuacgggaaguauauacacagaugugugaccaccgccuaaugucugcagcagugaaagaugaaagggccgugcacgcagauaugggauauuggauagagagucagaaaaauggcucauggaaacuagaaaaagcauccuugauagaaguaaaaaccuguacguggccaaaaagucacacacuuugguccaaugguguacuagaaucugauaugauaauaccuaaaucucuggcugguccaauaucucaacacaacuauaggccagguuaccacacacaaacggcaggccccuggcaucuagggaaacuugaguuagacuuuaauuauugugaagggacuacaguggucauaaccgagaacugugguacaagagggccuagccuuagaacgacuacgguuucuggaaaguuaauacaugaaugguguuguagaagcugcacccuuccgccucuucguuacaugggagaagacggauguugguaugguauggaaauccgaccuaucucugaaaaagaagaaaauaugguaaaaaguuugguuagugccgguucagguaagguagacaauuucacaaugggaguuuuaugucuagcaauauuguuugaagaggugaugcguggaaaguuugguaagaaacauaugauagcuggaguauucuuuacuuucguucuacucuuauccggacaaauaaccuggagagacauggcacacacauugaucaugaucgggucaaacgcaagugauagaaugggaaugggagucaccuacuuagcauugauagcgacuuuuaaaauacaaccauuucucgccuuaggguuuuuccugcgaaaauuaacaucgcgugaaaaccucuugcuugguguuggacuugcaauggcaaccacguuacaauugcccgaggauauagaacaaauggccaauggaaucgcacuuggauuaauggcacuaaaacuuauaacgcaauucgaaacuuaccaacuauggaccgcauuaauaaguuuaacaugcucuaacacaaucuuuacccuuaccguagcguggagaacggccacacuuauccucgcuggaguuucgcuuuugccaguaugucagagcuccucuaugagaaaaacugauugguuacccaugacagucgcagcaaugggggugcccccauugccgcuauuuauauuuucguuaaaagauacgcugaagagaagaucuuggccccuuaaugaggguguaauggcaguuggacucgucucaauguuagcgaguucucuucuuaggaacgauguuccuauggcaggaccuuuagucgccggcggguuauuaauagcgugcuauguaauaacaggcacgucugcugaccucacaguagaaaaagcagcagacguaaccugggaagaagaagcagaacaaacaggcguaucacauaauuugaugauaacuguugacgaugauggaacaaugcgaauuaaggacgaugaaacagaaaacauacucaccguacuccuuaaaacggcauuguuaauaguuaguggaauuuuuccauauucuauacccgccacgcuauuaguuuggcauacuuggcaaaaacagacacaaaggucuggcguuuuaugggacguuccuuccccacccgaaacucaaaaggcugaauuagaggaaggcguuuaucggaucaaacaacagggcauauuaggaaaaacucaagucggcguagguguccaaaaggauggagucuuccacacgauguggcauguuacaagaggagcuguauuaacacacaaugggaaaagauuagagccuaacugggccucaguaaagaaggaccuuauuucauauggaggugguuggagauuaucggcacaguggcaaaaaggcgaagaaguacaagugauagcaguugagccggguaaaaauccuaaaaauuuucagacuaugccuggaaccuuucagacaacuacaggugaaauaggcgccauugcucucgauuuuaagccgggcacauccggcaguccaaucauaaaccgagaagguaaaguuguuggauuguaugguaacgggguuguuacuaaaaacggaggauacguaucuggaauagcacaaaccaaugcagaaccggauggacccacacccgaauuagaagaggaaauguuuaagaaaagaaacuuaacgauuauggaccuucauccuggaaguggaaagacacgaaaguauuuaccagcaauaguacgcgaagcaaucaaaagaagacuaagaaccuugauuuuagcuccaaccagagugguggcggcagaaauggaagaagccuuaaaggggcuaccuauaagauaccaaacaacugccacaaaaagugaacacacaggaagagaaauuguagauuuaaugugccaugcaacauuuacaaugcguuuauuaagucccguacgaguacccaacuacaaucuaauuauaauggaugaagcucacuuuaccgauccagcaucaauagccgcacgcggauacauaucaacuagagucggcaugggggaagccgcagcaauauucaugacggcuacuccaccaggaaccgcugaugccuucccacaaucuaaugcccccauucaagaugaagaacgcgacauaccggaaaggagcuggaauagcggaaacgaauggauuaccgauuucgcugguaagacugucugguucguccccaguauuaaagcaggcaaugauauagccaauugucuccgcaaaaauggcaagaaaguuauccaacugaguaggaaaacguucgauaccgaauaucagaagacaaaacugaaugauugggacuuuguuguaacaaccgacauaagcgaaaugggagcuaauuuuaaagcagauagaguaauagaccccagacgaugccugaagccagugauucucaccgacgggccggaaagaguaaucuuagcuggcccuaugccuguuacagcagcaucugcagcacaaaggagagggagaguagguagaaauccccagaaagaaaaugaccaauauauuuuuacggggcaaccuuugaacaaugaugaagaccaugcacacuggacugaagcaaaaauguuauuagacaauauaaauacaccagaaggaauaauacccgcuuuguuugagccagaacgagagaaaagcgcagcaauugacggugaauaccgacucaagggugaaucuagaaaaacuuucgucgaauugaugaggagaggcgaccuaccaguaugguuagcgcauaaaguagcaucagaagguaucaaauacacagacagaaaaugguguuucgauggucagaggaacaaucaaauccuagaagaaaauauggauguagaaauuuggaccaaggaaggugagaagaagaaacugaggccgcgcuggcuagaugcaagaaccuacucagauccguuagcuuuaaaagaauuuaaggauuucgcagcgggcagaaaaagcauagcacuggaucuaguuacagaaauaggcagaguaccaucucaucuggcccaucgaacacguaacgcauuggacaaucuaguaauguugcacacaucggaacacggagggcgagcauacagacacgcaguggaagaacucccagagaccauggaaacgcuccuacuauugggucuuaugauauuguugacaggcggcgccaugcuauuucugauuucaggaaaaggaauugguaaaacaucaauaggacuaauuugugucauagcaagcuccggaauguuguggauggcagagauaccauuacaguggauagcaucggcuauuguucuugaauuuuucaugaugguacuauuaauuccagagccagaaaaacaaagaacgccgcaggauaaccagcucgcauacguuguaauaggaauuuuaacuauggcagcaaucauugcagccaacgaaaugggguuguuagagacuacuaaacgagauuuagguaugucaaaggaaccggggguuguuagcccgaccucuuauuuagauguagacuuacauccagcguccgcauggacgcuguaugcuguugcaacaacuguaauaacacccauguuacgucacacaauugaaaacucgacugcaaacguuaguuuggcagcaauugcaaaccaagcagugguauugauggguuuagacaaaggguggcccauaucaaaaauggacuuagguguuccacugcuagcauugggaugcuauagucaggugaacccauugaccuuaacagcagcaguguuacuacucgugacucacuaugcgaucauaggaccggggcuacaagcgaaagcuacccgggaggcucaaaaacguacugcggccggaaucaugaaaaauccaacugucgaugguaucauuaccauugaucuagacccaguaauuuaugauagcaaguuugaaaaacaacuuggucagguuauguuauuaguauuaugcgcaguacaauuauugcucaugagaacaagcugggcccuaugcgaagccuuaacccucgcgacuggucccauuacaacacugugggaagggucgccugguaaauuuuggaacacuacgauugcaguaucaauggcaaacauauucagaggaaguuacuuagcgggcgccggacuggcauuuaguauuaugaaauccguagguacggguaaaagagggacaggaagucaaggagagacguuaggagaaaaauggaagaagaaauugaaucaguugucaagaaaagaauuugauuuauauaagaaaaguggaaucacggaaguugaucgaacagaagcaaaagaaggauuaaaaagaggcgaaacuacucaccaugcaguuagucgaggaagugcaaaacuccaaugguucguagaaagaaacauggugauucccgaaggccgaguuauagauuuagguugcgggagaggcggcuggucguauuacugugcaggccuaaagaaaguaacagaaguuagagguuacaccaaaggaggaccaggccacgaagaaccuguuccaaugucuacguacggcuggaacauugugaagcugaugagcggaaaggacgucuuuuaccuaccacccgaaaaaugugacacacuacuaugcgauaucggcgaaucuaguccuucaccaacuguggaagaaagucgcacuauaagagugcuaaaaaugguggaacccuggcugaagaauaaucaauucugcauaaaaguccucaacccguacaugccugcaguaauagaacaucucgagagacuacaaagaaagcacggagguaugcuugugagaaaccccuugucgcgaaauuccacacacgagauguauuggaucuccaacggaacugguaacauagucucuaguguaaauauggucaguagauuguuguugaauagguuuaccaugacucacagaaggccuacaauagaaaaggauguggacuuaggugcaggaaccagacauguaaaugcagaaccagagacaccuaauauggacguaauaggcgaacgaauuaaaaggauuaaagaagaacacaauucaacguggcacuaugacgaugagaacccauacaaaaccugggcuuaccacggaucauaugaggucaaagcuacuggcucugcaucgucuaugauuaacgguguuguaaagcuauuaacgaagccuugggacgucgugccaauggucacacagauggcaaugacggacacaacaccuuuuggccaacaacgaguuuuuaaagaaaagguagauaccagaacaccaaggccaaugcccggaacgagaaaagugauggaaaucacagcagagugguuauggaggacacugggacgaaauaagagaccacgcuuaugcacuagggaagaguucaccaaaaagguccgcacuaacgccgcaaugggcgcugucuuuacagaagaaaaccagugggauagugccaaagcugcagucgaagaugaagaguucuggaaacucguagauagagaaagagaguuacacaaacucgguaaauguggcaguuguguauacaacaugaugggaaagagagagaagaaacucggggaauuugggaaggcaaaaggcagucgugcuauaugguauauguggcucggggcucgguauuuagaauuugaggcauuaggauuuuuaaacgaagaccacugguucagucgagaaaacucguauucuggagucgaaggcgaaggauuacauaaacuagguuacauccuaagagacaucaguaagauuccgggaggagcaauguaugcagaugauacugcugggugggauacccgaauuacagaagaugaccuacacaacgaagagaaaaucacccagcaaauggauccugaacaucgacuccuggcaaaugcaaucuuuaaauuaacauaccaaaauaaagucgugaaaguacaacggccaacgccaacgggaacaguaauggauauuauaucacgcaaagaucaacgugguagcggucaaguagguaccuaugguuuaaauacauuuacuaauauggaagcgcagcuuguaaggcagauggaaggcgagggcguacuaucaaagacagaucuagaaaacccucaucuaccagagaagaaaauuacgcaaugguuagaaacaaaggguguugaacgccuaaaaagaauggccauuuccggagacgacugcguuguaaagccgauagacgauagauuugcaaacgcccugcuugcucuaaacgauaugggaaaggucaggaaagacauaccccaauggcagccaucuaaaggguggcacgacuggcaacaagugccauucuguucccaucacuuucaugaacuuauaaugaaagacggccgcaaguuagucgugcccugucguccgcaggaugaacuaauagggagagcccgaauuucucaaggugccgguuggaguuuacgcgaaacagccugucuagguaaagcauacgcucaaauguggucauugauguauuuucauaggcgugauuuaagauuggcaucgaaugcaauuuguagugcuauaccaguacacuggguuccaacaucacguacgacaugguccauacaugcucaccaccaguggaugaccaccgaagauauguugaccguauggaauagaguauggaucgaagauaacccguggauggaagauaaaacucccauaacaacgugggaaaaugucccuuauuugggaaaaagagaagaucaaugguguggaucucucauaggacucacgucaagagcaacaugggcucagaacauccccacggcaauacaacagguccguucgcugauaggaaacgaggaguucuuagacuauaugccgucaaugaagcguuuucguaaagaagaagagagugaaggagcaaucugguga

SEQ ID NO: 23028 - RNA, 9873 nt, Artificial Sequence
  derived and/or modified CDS sequence (opt6) from DENV-3__KX380839__SS-prME
acaaguuuaugcuuaaugaugauguugccugcaacacuagcauuucauuugacaucaagagacggugaaccaaggaugaucguagguaaaaacgaacgaggaaaaucgcuacuuuucaaaacugcaagugguauaaauauguguaccuuaauagcuauggaucucggagaaaugugugacgacacgauaacuuauaaauguccgcuaaucacagaagucgaacccgaagauaucgauugcugguguaaccuuaccucaacuuggguaacauacgguacuuguaaccaagcaggagaacaccgccgagauaaacggaguguugcucuagcuccccauguuggaaugggacucgauacaagggcccaaacauggaugagugcggaaggagcauggaggcaaguagaaaaaguagaaacuugggcuuuccgccacccaggauuuacaauauuagcacuuuucuuagcgcacuacauagggacaucucuaacucaaaaagucguuaucuucauccuauugaugcuugucacgccuuccaugacgaugaggugcguugguguaggcaauagggacuuuguugaaggguuaaguggagcaacguggguagacgucguauuagaacacggagguuguguuacaacgauggcuaaaaacaaaccaacauuggacauagaauuacagaaaacggaagcuacucaacuggcaacauuacggaaauuauguauagaagggaaaauuacaaacguaacgacagacucaagguguccgacacaaggagaagcgaccuugccugaagaacaagaccaaaacuacguuuguaaacacacauauguggacagaggaugggguaaugguuguggcuuauuuggaaaaggaucacugguaacuugugcaaaguuucaaugccucgaacuaacugaagggaaaguuguacaacaugagaacuuaaaauauacgguaauaauuacuguacauacaggugaucaacaccagguaggaaaugaaacucaaggggucaccgcagaaauaacaccacaggcuucaacuguugaagcaauauucagaucuuaugggacauuaggccuagaauguuccccacggacuggacuagacuuuaaugaaaugauuuuguuaacgaugaaaaauaaagcguggaugguacauagacaaugguucuuugaccuccccuuaccauggacaucuggggcuacaacugaaacacccacauggaacaagaaagaacuucucguuacauuuaaaaaugcccacgccaagaaacaagaagugguaguacugggaucucaagaaggagccaugcauacugcucucacuggugcaacggaaauccaaacaucuggagggacgucuauuuuugcaggucaccugaaaugcagacucaaaauggacaaacuagaacuaaaagggaugucguacgcaauguguucaaaugcguuuguauuaaagaaagaagugucggaaacccaacaugguacuauucuuauaaaaguagaguauaaaggcgaagacgccccaugcaaaauaccguuuucaacugaggauggacagggaaaagcccauaacggcagacuaauaaccgccaacccaguagucacgaagaaagaggaaccaguaaauaucgaggcagaaccgccguuuggugagucgaauauuauaauuggaauuggugauaaagcacuaaaaauaaauugguauaagaaaggaucaaguauugggaaaauguucgaagcaacggcaagaggggcucguagaauggcuauucugggugauacagcaugggacuuugguucuguaggaggcguucuuaauagcuuaggaaagaugguucaucaaauauuugguucugcauacacagcucucuucucagguguauccuggauaaugaaaauaggcauaggaguacuacuaacauggauagggcucaacagcaaaaauaccucaaugucguuuaguugcauugugauugggauaaucacgcucuacuuaggggcugucgugcaagccgauaugggcugcguaauaaauuggaaaggaaaagaacugaaaugcgguagugguaucuuugucacaaaugagguacauacauggacugaacaauacaaguuccaagcagauuccccgaaacgacucgccacagccauugccggcgccugggaaaacggcguauguggaauccgcaguacgacaagaauggagaaccuauuauggaagcaaauagcaaaugaacugaauuauauauuaugggagaauaacauaaaacuaacagugguuguuggagacauaauaggcauacuagagcagggaaaacguacauugaccccacaaccaauggaauuaaaguacucguggaagacaugggguaaagcaaaaaucgucacugcagaaacacaaaacucuucauuuauaauagacggaccaaacacaccagaauguccuaaugcuagucgcgcauggaacguaugggaggucgaggauuacggcuucggaguauucacgacaaacauaugguuaaaauuaagagaaauguauacacaauuaugcgaccacagguuaaugucagcagcuguuaaagacgaaagagcaguucaugcugacaugggauacuggauagagucccagaaaaaugguaguuggaaguuggaaaaggcaucgcuuauagagguaaagacguguacauggccuaaaucacacacauuguggagcaacgguguauuggaaucugauaugauuauucccaaaucguuggcgggacccauaucacagcauaauuauagacccggauaucauacacaaacagcagggcccuggcaccuaggaaaacuagaguuagauuuuaacuacugcgaagggacaacgguaguuauaacagaaaauugcggcacaaggggcccaagccuaagaacaacaacugucucugggaaauuaauacaugaauggugcuguagaucauguaccuuaccgccauuaagauauaugggagaggauggaugcugguaugguauggaaauuagaccuauaaacgaaaaggaggaaaacaugguaaagucacuuguaagugcggggucggggaaaguugacaauuuuacaauggguguucuaugcuuggcaauacuauucgaagaaguaaugaggggcaaguucggcaagaaacacaugaucgcaggaguguuauuuacuuucgucuuguuguuaucuggacagaucacguggcgagauauggcgaggacacuaauuaugauagguagcaaugcgucggauagaauggggaugggagucaccuauuuagcucucauagcaaccuuuaaaauucaaccauuccuugcauugggauuuuuccuucguaaacuaacauccagagagaacuuacugcuagguguaggacuagcuauggcaacuaccuuacaacucccagaggauauagaacagauggccaacgggauagcuuuaggucuuauggcacuuaaacuaauaacacaauucgaaacguaucaacuaugggcagcucuaguaagucugauguguucaaacaccauauuuacucugacuguugcuuggaggacggccacauuaauccuagcagggauuucauuauuacccaugugucaauccucaaguaugcguaagacugacuggcuacccaugaccguagcagcaaugggaguuccaccgcuuccgcuauucauauuuucccuuaaggacacacucaagcgcaggucauggcccuuaaacgaaggcguaauggcagucgguuugguaucaauucuagcaucgucgcuucuaagaaaugauguaccaauggcagguccucuuguagcuggcggcuugcugaucgccuguuauguuauaacaggaacgucggcggauuuaacuguagaaaaagcagcagauguuacgugggaagaagaagccgagcaaacaggcgucucacauaaucugaugauaacaguggaugaugacgguacaaugagaauuaaagaugaugaaacggaaaacauauuaacuguccuguugaaaaccgcauuacugauaguguccggaauauuucccuauaguauaccugccacguuauugguauggcauacuuggcaaaaacaaacccaacgcagcggaguucugugggaugugccuucuccaccagaaacacaaaaggcagagcuagaagaagguguuuaccgaaucaaacaacaggggauauuuggaaaaacacaagucggcguaggcguucaaaaggaagguguuuuccacacaauguggcauguuacucgaggagcagugcucacacauaauggaaaacgauuagaaccaaauugggcuagugucaagaaagaucugauuucauauggaggcggauggcgccucucggcacaauggcagaaaggugaagaaguacaagucauagcaguugaaccuggcaaaaaccccaaaaacuuccaaacaaugccgggcauauuucaaacaacuacuggugagauaggugcuauagcauuagauuuuaaacccgguacauccgggucgccuaucauaaacagagaaggaaaaguaguuggucucuauggcaacggggucguuaccaaaaauggcggauacguaagcggaauagcacaaacaaaugcugagccggauggaccuacuccagaauuggaggaagaaauguucaagaaacgaaauuugacaauaauggauuuacaucccgguucagguaagacaaggaaauaucugcccgcaauagugcgugaagcaauaaaacgaagacuuagaacauugauucuugcaccaacaagaguaguagcugcugaaauggaagaggcguuaaaaggauuaccaauaagauaccagaccacugcaaccaaguccgagcacaccggaaaagaaauuguagauuuaaugugccacgcuacuuuuacuaugcgacucuuaagcccuguaagaguccccaacuacaaucucauaaucauggaugaggcgcauuucacagaucccgccucaauagcagcgagagguuauaucucuacacgcguaggaaugggagaagcggcugccaucuuuaugaccgccacuccucccggaacugccgaagcauuuccccaaaguaaugccccaauacaagaugaagaacgcgacaucccugagagaucuuggaacucugggaaugacuggaucaccgauuuugcuggaaagacuguaugguucgugccuucaauaaaagcggguaaugauauugcuaacugucuaaggaaaaacggaaagaagguaauacaauugucuaggaaaacguucgauacagaauaucaaaagacaaaauugaacgauugggacuucguaguaacuacggauauuucugaaaugggggcuaauuuuaaagcugauaggguuauagauccuagaagaugucuaaagccaguaauacugacagaugguccugaaagaguuauacuugcgggccccaugccggugacuguagcaagcgccgcccaaagacggggacguguugggcgaaauccccaaaaggaaaacgaucaauacauauucacaggacaaccucuaaacaaugaugaagaccacgcccauuggacggaagcaaaaaugcuacuagacaauauuaacacuccggaagguauaauacccgcacucuucgaaccagaaagagagaaaagugcggcuauagacggcgaguauagauugaagggagaaaguagaaagacauuuguagagcuaaugcguaggggagaucucccugucuggcuugcucacaagguggcgagugagggaauaaaauauacagauagaaaaugguguuucgacggagaacgcaauaaucaaauacuugaagaaaacauggauguggagauauggacuaaagaaggagagaagaagaaacuucggccacgauggcucgacgcuaggaccuacucagaucccuuggcuuuaaaagaauuuaaagacuucgcugcaggaagaaaaucaauagcauuagaccuagugaccgagauagggcguguaccaccucaccuagcacaccggacuaggaaugccuuggauaaucuagucauguugcauacaagugaauaugggggucgcgcguaccgacacgcaguagaggaacuuccagaaacgauggaaacucuauuauuacuagguuuaaugauacuacuuacagggggagucaugcuuuucuugaucaguggcaaaggugucggaaaaacuuccauaggauuaauuugugugguggcaucaucgggcauguuguggauggcugauauaccucuccaguggaucgcgagcgcaauaguauuggaguucuucaugaugguacuacugauaccagagcccgaaaaacaacggaccccacaagacaaccaauuagcguauguaguaauaggcaucuuaacguuagcggcaauaguggccgcaaacgaaauggggcuacuugaaaccaccaaaagagauuugggaaugagcaaagaaccgggaguuguaagccccacuucauauuuagacguggaccuucauccagccucugcauggaccuuauaugcaguagcuacuacuguaauaacuccaaugcuucgacauacaauagagaacagcacggcuaauguaucguuagcggcgaucgcuaaucaagcugugguauugaugggcuuagauaagggguggccuauuaguaaaauggacuuaggaguuccgcuacucgcucugggaugcuacucucaaguuaauccucuaacuuuaaccgcagcaguucuuuugcuaguaacacacuaugccauaaucgggccuggccuacaagcaaaagcgaccagagaagcucagaaaagaacagcugcugggauaaugaaaaauccaacugucgacggaaucaugacuauugaucuugauccaguuauuuaugacagcaaauucgaaaaacagcuaggucaaguaaugcuauuaguuuugugugcaguacagcuacuccugaugagaacauccugggcauuuugcgaggcauuaacauuagcaacaggaccaauuacuacguugugggaaggaucaccaggaaaauuuuggaauacuacuauagcaguauccauggccaauauauuucgagggucuuaucuggccggugcaggcuuagcguuuaguauuaugaaaucaguaggaaccgguaaaaggggaaccgggucacaaggugaaaccuugggagaaaaguggaaaaagaaauuaaaccaauuaucacgaaaagaauuugacuuauacaagaaaucggguaucacagaaguagaccguacugaagcgaaagagggacuaaaacguggagaaauaacgcaucaugccguaucucgaggaagugcgaaacugcaaugguuuguagaacgaaauauggucauaccugagggaagagucaucgauuuaggaugcggaagagguggauggucauacuauugugccggucuaaagaagguuacagaaguacgaggguauacaaagggagggccgggccaugaagaacccguuccgaugucaacauaugguuggaauaucguaaaacuaauuucgggaaaggauguauuuuaccuaccaccagaaaaaugugauaccuuguugugugauauaggagaaucuucgccgaguccuacuguugaagaguccaggacaauccguguucucaaaaugguagaaccuuggcugaaaaacaaucaauuuugcauuaagguacuaaacccauacaugccagcuguuauugaacauuuagagagauuacagagaaaacauggugguauguuaguacguaaccccuuaagcaggaacaguacucacgaaauguauuggauuucgaauggaaccgguaauauuguuuccagcguaaacaugauaucuagacuguuauuaaauagauuuacuaugaccuauagaagaccuaccauagagaaagauguugauuuaggagcagggacaagacacguaaaugcggagccagaaacaccuaacauggacguaauaggagagagaauaagaaggauuaaagaagaacacucaucgacuuggcauuaugaugaugagaauccauacaaaacaugggcauaccauggaagcuaugagguaaaagcaacaggauccgcguccucaaugaucaauggcguagucaaguuacugacgaaaccuugggaugucguaccaacagugacucaaauggcaaugacugauaccacaccauuuggccaacaacgggucuuuaaagaaaaaguagauacacguacaccaaaaccaaugccaggaaccagaaagguaauggaaauuacagccgaaugguuauggagaacccugggacguaacaaaagaccuagacuauguacaagagaggaauuuacaaagaaaguaagaaccaacgcugccaugggugcgguauuuacugaagagaaucaaugggauagugcgcgugcugcaguugaggacgaagaguucuggaaauuaguagacagagagagagaauuacauaaacuagggaaaugcgguucuuguguauauaauaugauggguaaaagagagaagaaacucggagaguucggaaaagcaaaagguucacgugcaauaugguacauguggcuaggggcgagauauuuggaguuugaggcacuagguuuccuaaaugaggaucacugguucagucgugaaaacaguuauaguggaguugagggggaaggacuccauaaacuaggauauauacuaagggauauaaguaagauaccgggaggugcuauguaugcagacgauacggcaggaugggauacucgcauaacggaagacgaucugcauaacgaagagaaaauaacucaacagauggauccugaacaucgacaacuagcgaacgcuauauuuaaacuaacauaucagaacaaagugguaaagguacaaagaccaacuccaaaagggacuguuauggacauaauuuccaggaaggaucaaagaggcaguggccaaguggggacauauggccucaauacauuuaccaauauggaggcucaauuaauaaggcaaauggaaggagaagguguacuuaguaaaacggaccuugagaacccucauuuacuagagaagaaaauuacacaaugguuggaaacaaaaggaguagagagacuuaaaagaauggcaauaucaggugaugacuguguaguuaaaccuauugacgacagauuugcgaacgcuuuacuugcacuaaaugauaugggaaaagucagaaaagacauuccgcaguggcaaccuucgaagggauggcaugauuggcagcagguuccauucuguagucaucauuuccaugagcucauaaugaaagacgguagaaaauuaguaguaccuugccgaccacaagaugaacuaauaggcagagcgcgaauaucacagggggcaggguggucauuaaaggaaacagcauguuuggggaaagcguacgcacaaaugugggcccuuauguacuuucauagacgggaucuaagguuagcaucuaacgcaauuugcagugcuguccccguacacugggugccaacgucccgaaccacauggagcauucaugcacaucaucaguggaugacaacugaagacaugcuaacgguauggaacagaguguggaucgaagacaacccauggauggaagacaagacaccuguaacaacgugggaggacgucccguaucugggcaaaagagaagaucagugguguggaucuuuaauaggucuaacaucgcgagcgacgugggcccagaauauucucacggcaauccaacaaguuagaagccuuauaggaaacgaagaauuuuuggacuacaugccaucaaugaaacguuucagaaaggaggaggaauccgagggugcgaucugguga

SEQ ID NO: 23029 - RNA, 9873 nt, Artificial Sequence
  derived and/or modified CDS sequence (opt6) from DENV-3__KX380840__SS-prME
acaagucuuugcuugaugaugaugcugccggcaacacuagcuuuucaucugacaagcagggauggggaacccagaaugaucguugguaaaaaugaaagagggaaaucucuguuguuuaaaacagcauccgggauuaauaugugcacccuaauugcaauggaccuuggugaaaugugugaugacacaauaaccuauaaauguccccuaauaacagaaguagaaccugaagacauugauuguugguguaaucugacaagcacuuggguaacuuaugggacaugcaaccaagcaggagaacauagaagagacaaaagaucuguugcacuagcgccccaugucgggaugggacuagacacuagagcucaaacauggaugagugcggaaggugcauggagacaaguugaaaaaguagaaacaugggcuuuuagacauccugguuuuacaauucuagcucucuuuuuagcgcauuacaucggaaccagccugacucaaaaaguugugaucuucauacuacugaugcucguaaccccaagcaugacaaugcguugugugggagugggaaauagggauuucguggaaggucucucaggugcuacuuggguggaugugguguuggagcacggugguugugugacgaccauggcuaaaaauaaaccuaccuuggacauagaauuacagaaaacggaggcaacacaauuggccacgcuacgcaaauuauguauagaaggcaaaauaacuaauguuacaacagacucaagaugccccacacaaggugaagcaacucuuccggaggagcaagaucagaauuacguauguaaacacacauacguagaucgaggauggggaaacggaugcggauuauuuggaaaaggaucgcuuguaacaugugcgaaauuccaauguuuagaacucacagaaggaaaaguaguccaacaugagaaucucaaauauaccguaauuauaacaguacacacgggugaucaacaccaaguuggaaacgaaacgcaaggcgugacagccgaaauaacaccucaagcgucuacaguagaagccauauucagguccuauggaacauugggucucgagugcucaccacgcacgggauuagacuucaaugaaaugauacuucuuaccaugaaaaacaaagcauggaugguucaucggcaaugguucuuugauuuaccauugccguggacgaguggggcaacaacagagacuccaacauggaacaagaaagaacucuuagugacauuuaaaaaugcccaugccaagaaacaagaaguagucguucugggaucacaggaaggcgcaaugcacacggcguugacuggagcaacagagauccaaacuagcggagguacaaguauuuucgcaggacaucuaaaaugucgacuaaaaauggauaaauuagaauuaaaagguauguccuaugcaaugugcagcaaugcguuuguucuuaaaaaggaagucagugaaacacagcauggaacuauacuaauaaaagucgaauacaaaggagaagaugcuccauguaaaaucccauucagcacagaagauggccaaggcaaggcgcacaauggaagacuaaucaccgccaauccaguagucacuaaaaaggaagaaccaguaaacauagaggcggaaccaccuuuuggagaaucaaauauaauaaucggcaucggagacaaggcgcuuaaaauuaauugguauaaaaaggggucgagcauagggaaaauguucgaagcgaccgccagaggugcaagaagaauggccauccucggggauaccgcgugggauuuugggucaguaggggguguacuuaacucucuaggaaaaaugguucaucagaucuuugguucugccuacacggcccucuucaguggagugagcuggauaaugaaaauagggaucgggguacuacuaacuuggauaggguugaacucaaagaacacaucuaugucguucucauguauuguaaucggaauuaucacacuuuauuuaggcgcuguugugcaggcugauaugggcugcgugauuaauuggaaaggaaaagaacuaaaauguggcucaggcauauuuguaaccaaugaagugcacacauggacggaacaauauaaauuucaggcggauaguccaaaacgauuagccacagccauugcuggggcaugggaaaauggagucuguggcauacgcuccacaaccagaauggaaaaucuacuauggaaacaaauagcaaacgaauuaaauuauauacuaugggaaaauaauauaaagcuaacugugguagucggagacauaaucggcauucuggaacaagggaaacgaacacuaacaccacagccaauggagcuaaaguacucguggaaaaccugggggaaagcuaaaauagucaccgcagagacacaaaauaguucauuuauuauagacgggccgaacacuccggaauguccuaaugcacuacgugcguggaauguaugggaaguagaggacuaugguuucggaguguuuacaacaaauaucugguugaagcuccgggaaauguauacgcaauugugugaucaucgacuuaugucugcggcgguuaaggacgagagagccguacaugcggacauggguuacuggauugaaucgcagaaaaauggaucauggaaauuggaaaaagcauccuuaauagaaguaaaaacauguaccuggccgaaaagucauacuuuauggaguaaugguguguuagaaucugacaugauaauaccaaaaucacuagcaggcccaauaucucaacacaauuacaggccaggauaucauacacaaacggcaggccccuggcaucuuggaaaguuagaauuagauuuuaauuauugugaaggcacaacgguagucauaacagaaaauugugggacuagaggacccagucuaagaacuacgacagucucagguaaacucauacaugaaugguguuguagaaguuguacuuuaccaccauuacgauacaugggugaagaugguugcugguacggaauggagauuaggccaauuaaugaaaaagaagaaaauaugguuaagucccucguuagugcagguucuggaaagguugacaacuucacgaugggaguccugugcuuagcaauacuuuucgaagaaguuaugcgaggcaaguuuggcaagaaacauaugauagcaggagucuuauuuacuuucguacuacuacuaagcggucaaauaacuuggagagauauggcccgcacacugauaaugauaggcucaaacgcaagugacagaauggguaugggaguuacauacuuagcuuugauugcuacuuuuaaaauucaaccauuucuugcguuaggauucuuucuuagaaaauugaccaguagagaaaaucuacuauuaggagucggccuugcaauggcaacaacucuucaauuaccagaagacauugaacagauggcgaauggcaucgccuuaggacuaauggcuuugaaacuuaucacucaauucgaaacauaucaauuaugggcagcucuaguaagucucaugugcucuaacacuaucuuuacucuaacuguagccuggagaacagccacccucauccuggccgguauaucccuuuuaccuaugugccaaucgagcaguaugcgaaaaacagacuggcugcccaugacaguagcggcaaugggugugccuccacucccccuuuucauauuuaguuuaaaagacacauuaaaacgcagaaguuggccucuaaacgagggaguaauggcuguaggacugguaaguauccucgcuaguucuuuguuaaggaacgacguaccaauggcuggaccacuuguagcgggagguuuguuaauagcguguuaugugauuacaggcacuucugcagaccugaccguagaaaaagcggccgauguaaccugggaggaagaggccgaacaaacaggugugucgcacaaucucaugauuacaguggaugaugacggaaccaugagaauuaaagacgaugaaaccgagaacauauuaacaguguugcuaaaaacugcccuacucauugucagugguauauuccccuauaguauucccgcaacauuacugguauggcacaccuggcagaaacaaacucagcgaaguggaguauugugggauguaccaucgccucccgaaacacagaaagcagaacuagaggaggguguauauagaaucaaacaacaagguaucuuuggaaaaacucaagucgggguaggaguacaaaaggagggagucuuucauacuauguggcauguaacgagaggggcuguccugacacauaaugguaaacgacuagagccgaauugggcuagugucaagaaagaccuuauaucauacggagguggauggagacuaucggcccaauggcagaaaggcgaagaaguccaagugauagccguggagccaggaaagaauccuaaaaacuuucaaaccaugccuggcauauuucagacaacuacgggggagauuggagccaucgcucuggauuucaaaccuggaacaaguggaagucccaucauuaacagagaggguaaagugguuggauuauacggcaauggugugguaacuaaaaauggaggguauguaucugggauagcgcaaacuaacgccgagccagacggacccacacccgagcuagaagaagaaauguucaaaaagcgcaauuuaaccauaauggauuuacauccaggaucaggcaaaacuagaaaguaucuaccugcgauaguuagagaagcuauuaaaaggagacuaagaacacucauacuggcaccuacucgggugguggccgcggaaauggaagaagcacugaagggccucccgauucgauaucagacaacggcuacaaaaagugagcauacggguaaagagauaguagaccuaaugugucaugcaacauuuacgaugagacuacugagucccgugagagucccuaauuacaaucuaaucauaauggaugaagcacauuuuacagauccagcaucaaucgcugcaagaggcuauauuucaacuagaguagggaugggcgaggcggcugcaaucuuuaugacagcgacaccuccagguaccgcagaagcauuuccacagucuaacgcaccaauucaggacgaggagagagauauaccagaacgaaguuggaacucuggaaacgacuggauuacagauuucgcggguaaaacuguaugguuuguaccaagcauaaaggcuggaaaugauauugcaaauuguuugaggaagaauggcaagaaagugauccaauuaagucgaaaaaccuucgauacagaauaccaaaagacgaaauugaaugauugggauuuugucguaacuacagauauaucggagaugggugccaacuuuaaagccgauaggguaauagacccccgacgauguuuaaaaccgguaaucuuaaccgacgggccagagcgaguuauacuagccggccccaugcccgugacgguugcuagugcggcacaacggcggggucgcguuggacgaaacccacaaaaagaaaaugaucaauauauauuuacugggcagcccuugaauaacgacgaggaucaugcgcacuggacagaggcaaaaaugcuucuugacaauauuaauacuccagagggaaucauaccggcacuauuugaaccagagcgggagaaaucggcagcaauugacggagaauauagacuaaagggagaaucacgcaaaacuuucguugaauugaugcgaagaggagacuuaccuguaugguuagcucauaaaguagcauccgaagguauaaaguacacugaucguaaaugguguuuugauggcgaaagaaauaaccagaucuuagaagaaaacauggacguugaaaucuggacuaaagaaggagagaagaagaaacuuagaccaagauggcuggacgcucgaaccuacagugauccgcuagcuuugaaagaguucaaagacuuugcggcaggaagaaagaguauagcguuagaucuggucacugaaauagggcgaguaccaccacauuuagcacaucgaaccaggaaugccuuagauaaccuaguuaugcuucacaccucagaauaugggggccgagcuuauagacaugcuguagaagaacuuccugagacuauggagacguuacuacuacuuggccuuaugauucucuugacuggaggaguaaugcuauuuuuaauaucgggaaaagguguuggaaaaacguccauuggucugauauguguugucgccucaagcgggaugcuauggauggcugauauaccuuugcaauggaucgcuagugcuaucguucuugaguucuuuaugauggucuuauuaauaccugaaccagaaaaacagagaacuccacaggacaaucaacucgcauacguaguuauagggauuuuaacacuagcagcuauaguagcugcuaacgaaaugggccuacuagaaacaacaaaaagagaccucgguaugucuaaggaaccagguguuguuucgccaacaucauaucuagauguugaucuacacccagcgagugcauggaccuuguaugcuguugcuacaacagugauaacucccauguuaagacacaccauugaaaacagcacggccaacguuucuuuagccgcaauugcuaaucaagcagugguacuaaugggucuggauaagggcuggccuauaucaaaaauggauuuagguguaccacuauuggcguuggggugcuacucacaaguaaauccucuaacuuugacagcugccguucugcuguuaguaacacacuacgcuaucauagguccuggauugcaagcaaaagcgacaagagaggcacaaaaacgaacggcggcuggaaucaugaagaauccgacggucgaugggauuaugaccauagaccuagauccgguuauauaugacucaaaauucgagaaacaacucggucagguaaugcuauuaguauuaugcgcaguacaacuacuacugaugcgaacgucaugggcuuuuugugaggcgcucacacuugcaacagggccaaucaccacauuaugggaggguucaccaggcaaauuuuggaacacgacuauagcuguuaguauggccaacaucuuccgcggaaguuaucuagcaggagcagggcuagcauucaguauaaugaaauccguugguacaggaaaaagaggaacaggaucccaaggugaaacuuuaggcgaaaaguggaagaagaaacuaaaucagcucuccagaaaagaauuugaucuauauaaaaagaguggaauuacagaaguagaccggacagaagcuaaggaaggucuaaaaaggggagaaauaacacaucaugcuguuucacggggcucugcaaaauuacaaugguuugucgaaagaaauaugguaauaccagagggaagaguaauugauuugggaugcggucgaggugguuggaguuauuauugcgcaggauuaaagaaagucacugagguaaggggcuacacaaagggugggcccggacacgaagaaccugucccgaugagcaccuacggguggaacauuguuaaacuuauuucagggaaagauguauucuacuuaccgccugaaaaaugugauacauuacuaugugauauuggagagucaucaccaucucccacaguagaagagucaagaacaauuagagucuuaaagaugguagaaccauggcugaaaaauaaccaauucuguauaaaaguacuaaauccauacaugccugcaguaauagaacacuuagagcguuugcagaggaagcaugggggaauguuggugagaaauccauuaucgagaaacuccacacaugaaauguauuggauuuccaacggcacaggaaacaucguuagcucggucaauaugauuucccgucuccuacucaacagauuuaccaugaccuaccggagaccaacgaucgaaaaagaugucgaucugggggcaggaacacgucaugucaacgcagaaccugaaacucccaauauggacguaauuggagaaagaaucagacgaauaaaggaagaacauucgaguacauggcauuacgaugaugagaaucccuauaagacaugggcauaucauggaaguuaugaaguaaaagcuacagggucggcaucaucaaugauaaacggaguggucaaacuucuaacaaagccaugggauguuguaccaacaguaacucaaauggcuaugacagauacaaccccauucggccaacaaaggguauucaaggaaaaagucgauacacgaacucccaaaccuaugcccggcacgagaaaggugauggaaaucacugccgaaugguuauggcgaacauuaggaagaaacaaacgaccccgacugugcaccagggaagaauuuacuaagaaaguuagaaccaaugccgcaaugggcgcuguauuuacggaagaaaaucaaugggauucggcaagagcagcgguggaagaugaagaauuuuggaaguuaguugacagagagcgggaauuacauaagcuagguaaaugcggaucaugcgucuacaauaugaugggaaaaagggagaaaaaguuaggugaguucgguaaagccaaaggguccagagcaauaugguacaugugguuaggugcacgauaucucgaguuugaagcguuaggauuucuuaacgaagaucauugguuuagcagagaaaauucauauucuggaguugaaggagaagguuuacauaaacuuggcuauauauuaagagauaucucaaaaauccccgguggagccauguaugcggacgacaccgcuggaugggacacaaggauuacagaggaugauuuacauaaugaagaaaagauaacgcagcaaauggauccagagcaccgacaacucgccaacgcgauuuucaaauuaacauaucaaaacaaaguuguaaaagugcaaagaccuacgccaaagggcacgguaauggauauuauuucaagaaaggaucaacgaggaaguggacaagugggaacguacggucuuaauacuuuuacaaacauggaagcacaguuaauaagacaaauggagggugaaggaguccuaucaaaaacagacuuagaaaauccccaucuacuagagaagaaaaucacucaaugguuagaaacaaaagguguugaaagguuaaaacguauggcuaucagcggggacgacugcguaguaaaaccaaucgacgacagauucgcaaaugccuuacucgcacuaaacgauauggguaagguuaggaaagacauuccgcaguggcaaccuaguaaggguuggcacgacuggcaacaaguacccuuuuguagucaucacuuccaugaacucauuaugaaggacgggcgcaaguuaguagucccuuguagaccucaagacgaauuaauagggagggcuaggauuucacaaggagcgggauggagccucaaagaaacugcaugcuugggaaaagcauaugcccagaugugggcuuugauguacuuccaccgaagagaucuucgcuuagccagcaaugcgauauguucagcugucccaguacauugggugccgacaaguagaacuacauggaguauacaugcccaucaucaauggaugaccacggaagauauguugacgguauggaacagaguauggauugaagacaauccauggauggaggauaaaacacccguaacaaccugggaagauguaccauauuuaggcaagagggaagaccagugguguggauccuuaauuggcuugacuucuagagcaacaugggcucagaauauauugacugcuauucaacaaguaaggucacucauaggaaacgaagaauuuuuagauuauaugccaucaaugaaaagauuuaggaaagaagaagagucugaaggagccaucugguaa

SEQ ID NO: 23030 - RNA, 9873 nt, Artificial Sequence
  derived and/or modified CDS sequence (opt6) from DENV-3__JF808121__SS-prME
acgucgcugugccucaugaugauucugcccgcagcuuuagcauuucaccuaacaucucgagauggggaaccaagaaugauagucgggaaaaaugaacgcgggaaaucgcuauuguuuaaaacagcauccgguacaaacauguguaccuugauugccauggaucuaggagaaaugugugacgauacaguuaccuacaaauguccgcauauuacagaaguugaaccggaagauauagacugcugguguaaucugaccagcacuugggucaccuacggaacuugcaaccaagccggagaacggcgcagagauaaacggucuguggcucuggcaccucaugucgguaugggacucgauacucguacacaaacguggaugucugccgaaggggcauggaggcaagucgaaaaagucgaaacaugggcuuuacgucaccccgguuucaccauucuagcuuuguuuuuggcacauuacauuggaacaucuuuaacacaaaaaguaguuauuuucauauuguuaaugcuagugacaccauccaugacgaugcguugugugggaguaggcaacagggauuucguugaagguuuaagcggagccacuuggguagacgugguucuugaacacggugguugcguuacuacaauggccaaaaacaaaccuacccuagacauagaacugcagaaaacggaagcaacucaacuagcgacgcuccgcaaauuaugcauugaagguaaaauaacuaauauuacaacugauaguagaugucccacacaaggcgaagcuguacuuccagaagaacaagaucaaaacuacgucugcaaacacacuuauguggauagaggaugggguaauggcuguggucucuuugguaaaggcucauugguaaccugugcaaaauuucagugccuugaacuaauagaagguaaaguugugcaauaugaaaauuugaaauacaccguaauaaucacagugcauacaggugaccagcaccaaguaggaaaugaaacgcagggcguaacagcugaaaucacaccccaggcuucgacaaccgaagcaauacuuccugaguaugguacacucggacuagaauguaguccccgcacuggucuggacuuuaacgaaaugauacuccugacuaugaaaaacaaggcguggaugguccaucgacaaugguucuucgaucuaccgcugccauggacaaguggagcaaccacagagacuccuacauggaaccguaaagaacugcuagugaccuuuaaaaacgcacacgccaagaaacaggagguuguuguacugggcucucaggaaggagcaaugcauacggcucuaaccggugcgacggagauacaaaauaguggaggaacgucuauauuuucuggacauuuaaagugucgacuuaagauggacaaauuggaacuuaaaggaauguccuaugcuauguguacaaauacauuugucuugaaaaaggaggucagugaaacacagcacggcaccauucuuauaaaaguugaauauaagggggaggaugcaccauguaaaauacccuucagcacugaagauggacaaggaaaagcccauaacggaagacuuauuacagcaaacccagucguuaccaagaaagaagaacccguuaacauugaagcugaaccacccuuuggcgagucaaacauugucaucggaaccggggauaaugcuuuaaaaaucaauugguauaagaaaggaagcaguauagggaaaauguuugaagccacugcaagaggagcccgucgaauggcuauccucggagauacagccugggauuuugguaguguaggagggguucugaauagucucgguaaaauggugcaccagauuuucgggucagcauauaccgcgcuuuucagcggagugucguggguaaugaagauagguauaggaguccucuuaaccuggauaggcuuaaauaguaaaaauacuagcaugucauucucaugcauagcaaucggaauaauaacacuuuacuuaggugcaguuguacaggcggauaugggcugcgugauaaauuggaagggcaaggaacuaaaaugugguucaggcauauucguaacgaaugaaguacacacuuggacugaacaauauaaauuucaagcagauucuccaaaaagauuagcaacugcaaucgcaggagcgugggaaaauggagugugcggaaucaggucuaccacccgcauggaaaauuugcuuuggaaacaaaucgcaaaugaacuaaacuacauauuaugggaaaacaauaucaaacuaacaguaguaguaggcgauaucaucggugugcuggaacaaggcaaacgaacauuaacaccucaacccauggagcuuaaauacucuuggaaaaccugggguaaggcuaagauaguaacugccgaaacacaaaacagcucauuuauaauagauggcccaaauacacccgaauguccuucggcuaguagagcuuggaauguaugggaaguugaggacuacggguuuggugucuucacgacgaauauaugguuaaaauuacgcgaaguauacacccaacuuugugaucaucgacucaugucagccgcgguaaaagaugaaagggcuguacaugcagauaugggauacuggauagaaagccagaaaaacggcagcuggaaacucgaaaaggcgucacuaauugaaguuaagacauguacauggccaaaaagucacacacuauggucaaauggcgucuuagagagugacaugaucauccccaagaguuuggcaggcccaauaagccaacacaaucacagaccgggauaucacacacaaacagcugguccuuggcaucucgggaaacucgaacuugacuucaacuacugugaaggaacaacggucguaauaacugagaacugugguaccagaggacccucccuacggacaaccacaguaagugguaaacugauccaugaaugguguugucgaagcugcacacucccaccgcuaagauauaugggugaagaugguuguugguacggcauggaaauccggccuauaucagaaaaagaagagaauauggucaaaaguuuaguaucagcagggagcggcaaggucgacaacuuuacaaugggcguacucugucuagcaauucuuuuugaagagguaaugcgaggaaaauucgggaagaaacauaugauugcagggguauucuuuacuuuuguucuguuauuaagcggacaaaucacauggagggacauggcccauacccuaacaaugaucgggucgaacgcuucggauaggauggguauggguguaacauaucuagccuuaauagcaacuuuuaaaauacaaccauuuuuagcucuuggauucuuucuuagaaaguuaacauccagagaaaacuuguuacuagguguagggcuugcuauggcaaccacucuccaauuaccagaagauauugaacaaauggcuaauggcauugcacuagguuuaauggcucuaaaguugauuacccaauuugaaacuuaccaacuauggauugcucuuauaucuuugacaugcaguaauaccauguucacacuaacuguagcuuggcguacagcaacuuuaauccuugcaggagucucacuauuacccguaugucaauccaguaguaugagaaagacagauuggcuuccaauggccguagcggccauggggguaccuccacuaccguuguuuauauuuucucuuaaagacacauuaaagcgcaggucuuggccacucaaugaaggaguaauggcggugggacucgucagcauauuggcaaguagucuauuaagaaaugauguaccaauggcggggccacugguagcugguggacuucucauagcauguuauguaauuacugggacaagcgcagacuuaacaguagaaaaagcagcagacauaaccugggaagaagaagcggagcaaacggggguuucgcauaaccuaaugauuacagucgaugaugauggaacgaugagaaucaaagaugaugaaacagaaaacauauugacaguacuauuaaagacugcacuguuaaucguaucagguguuuuuccuuauucuauacccgcaacuuuguuaguuuggcacacauggcagaaacaaacccagcggucaggcguucucugggacguuccaaguccgccugagacgcagaaagcggaauuagaggaaggcguauauagaauuaagcaacaagguauuuuugggaaaacccaaguaggugucggaguucaaaaagagggagucuuucauacaauguggcauguuacuagaggagccguauuaacauauaauggaaaaagguuggaacccaauugggccagcguuaagaaagacuuaauuucuuacggcggaggguggcgccucucagcacaauggcaaaagggagaggaaguccaagugauugcaguugagccugguaaaaauccaaagaauuuccaaacaaugccaggaacauuccaaaccacaaccggugaaauuggugcaauagcauuggauuuuaaaccuggaacaaguggaucgccuauaauuaauagagaagggaaggucgucggacuuuaugguaauggaguaguuaccaagaauggugguuauguaaguggcaucgcacaaacuaaugccgagccagauggacccacgcccgagcuagaagaggagauguuuaagaaacgcaauuugacgaucauggacuugcauccgggauccgggaaaacuagaaaguaucugccagcuauaguuagggaagcuauuaaaaggagacuacgaacacucauucuugcaccuacuaggguaguagcagcagagauggaagaagccuuaaaaggacugcccauaagauaucaaacgacugcuacaaaaucugaacauacaggucgagaaaucguugaccuuaugugccaugcuacuuuuaccaugcgcuuauuaagcccaguucgaguaccuaacuauaacuugauuauaauggaugaggcgcauuucacugacccggccucgauagcggcgagagguuauauuucuacucgagucggcaugggagaagccgcugcaauauucaugacagccacgccacccggaacagcagaugcguuuccgcagaguaacgcacccauacaagacgaagaacgcgauauaccggagcggucguggaacuccggcaaugaauggauaacugauuuugcugguaaaacugugugguuugugcccaguauuaaagcaggcaaugauaucgcaaacugccugcgaaagaauggcaagaaaguaauacaauuaucuagaaagacguuugauacagaguaccagaaaacuaaacuaaacgauugggacuuuguagugacaaccgauaucucugaaaugggcgccaauuuuaaagcagauagagucauugauccacgacgauguuuaaagccugugauauuaaccgauggcccugaaagaguaauccuagcuggucccaugccggucaccgcugccucugcagcucaaagacgcgggagagugggacgaaacccccaaaaagagaaugaucaguacauauucaccggucagccccuaaacaaugaugaagaucacgcucacuggacagaagcaaaaauguuauuggauaauauaaacacucccgaggggauaauaccugcacuauuugagcccgaacgcgagaaaagugcagcaaucgauggugaguaccgucucaagggagaaucgagaaaaacuuuuguagaauugaugaggcgaggcgaucuuccuguuuggcuagcccauaaaguagcaagugaggguauaaaauauacugaucggaaaugguguuuugauggucagaggaauaaccaaauucucgaagaaaacauggacgucgagaucuggacgaaggaaggagagaaaaagaaauuaaggccaaggugguuagaugcuagaacauacagugauccgcuugccuuaaaagaauuuaaagauuucgcagccgggcggaaaaguaucgccuuagauuuaguaacggaaauaggaagagugccaucccaucuagcgcauagaacaagaaaugcccuggacaaucuugucaugcuacauaccucugaacauggaggccgugcguacagacaugcaguagaagaauugccagagacgauggagacuuuauuacuguuaggcuuaaugaucuuauugacuggaggagccauguuauuucuuauaagcggcaaaggaauagguaaaaccaguauaggacucauaugcgugauagccagcagcgguaugcuuuggauggcagaaauacccuuacaguggauugcaagugcaauaguauuagaguucuuuaugauggucuuacuuauuccagaaccugaaaaacaacguaccccacaggauaaccaacuggcauacguuguaauaggaauccucacacuagcagcuauuauagccgccaaugaaaugggacucuuagagacaacuaagagagaccuuggcaugucaaaagaaccgggagucgugucuccaacgucauaucuggauguugaccuccacccugcuucagcauggacauuauaugcagucgccacgacaguaauuacacccaugcuacgacacacaauugaaaacuccacggcuaacgucucucuugcugcuauagccaaccaagcaguaguguugaugggacucgauaaaggguggccgaucuccaaaauggauuuaggugucccucucuuagcacuggguuguuauagucagguuaauccguuaacauugacugcugcaguguuauuauuaauaacacauuacgcaauaauuggccccgguuuacaggcuaaagcgacaagagaagcgcagaaaagaacggcggccggcauaaugaaaaauccgacaguggacgguauaaugacgauagauuuggaccccguuaucuacgacucaaaauucgaaaaacagcuuggucaaguaaugcuauuaguucucugugcaguacaacucuugcugaugagaaccaguugggcacuaugugaggcuuuaacucuugccacagguccgaucacaacacuuugggagggcucuccagguaaauucuggaauacaacaauagcaguuagcauggcgaacauauuucgaggaucauaucuagccggugcagggcuagcuuuuucaauaaugaaaucuguaggcacuggaaaaagagguacaggaucacagggagaaacacuuggagaaaaauggaagaagaaauugaaucaguuaagcaggaaagaauuugaucuauacaagaaaucggguauaaccgaaguggaccgaacagaggcgaaagaagguuuaaaaagaggagaaauaacccaucaugccgugaguagaggaucagcaaaacuccaaugguuuguugaacggaauaugguaauucccgaaggaagaguuauugaccuaggcugcggaagaggagguuggucauauuacugugcagggcucaagaaagugaccgaaguaaggggauauacuaaaggagguccggggcaugaagaaccgguuccuaugaguacuuacggauggaauauuguaaaauuaaugucaggaaaagauguauuuuaucuaccgccagaaaaaugugacacuuuauugugugauauaggcgaaucaucucccucaccaacgguagaagaauccaggacaauaagaguauugaaaaugguagaaccaugguugaaaaacaaucaauucuguauaaaaguccuuaacccuuauaugccaaccguuauagaacauuuggagcgauuacaacgcaaacauggagguauguugguacgcaauccccuaucuagaaauucuacacaugaaauguauuggauuagcaacgguacagguaauauagucgcuagcgugaauaugguuaguagauuauuauuaaaucgauucacaaugaagcauagaaggcccacgauagaaaaagauguugaccuaggugcggguacucgccacguuaaugcagaaccagagacuccaaacauggauguaauaggcgaaagaauaaagagaaucaaagaggagcacaauaguaccuggcacuaugacgacgaaaacccauacaaaacaugggcuuaccacggguccuaugaaguuaaagcuaccggcucugccucaaguaugauaaauggaguuguaaaauuauuaacaaaaccuugggacguaguaccuaugguaacucaaauggcuaugacagacacaacuccauucgggcaacaaaggguauucaaagagaaaguagauacacgaaccccgcgauccaugccaggaaccagaagaguaauggguauaacagcugaauggcuuuggaaaacauuggggagaaauaagaaaccucgacuauguccaagggaagaauuuacuaagaaagugagaacuaaugcggcaaugggagcagucuucacugaagaaaaucaaugggauucagccaaagcagcuguggaagaugaagacuucuggaaacuuguagaccgugaaagggaauuacauaaguuaggcaaauguggaaguugugucuauaacaugauggggaaaagggagaagaaacugggagaauuugggaaagcaaaaggaagccgugccauaugguacaugugguugggagcgcgcuauuuggaguucgaggcacuaggauuuuuaaacgaggaucauugguuuagucgagaaaauagcuauucuggaguagagggggaaggguuacauaaacuagguuauauccuaagagauaucucuaaaauaccaggaggcgcaauguaugcagacgauacugcgggaugggauaccagaauuacagaggaugaucuacauaaugaagagaaaauuacacaacaaauggacccagagcacagacaauuagcaaacgcuaucuucaaguuaacauaccagaacaagguugucaagguccaaagaccuacaccaaccggcacaguaauggauauuauaucgcgaaaagaucaaaggggcagcggacaaguugguacauauggacuuaauacguuuacgaacauggaagcucaacuaauuagacaaauggaaggagaaggugugcuuucuaaagccgaccuugagaauccgcauuuaccugagaagaaaauaacgcaauggcuagagacuaagggaguagaacgcuugaaacgaauggccauaucuggugaugacuguguugugaagcccaucgacgacagauuugcaaacgcauuauuagcucuaaacgacauggguaaaguuagaaaagauauuccucaauggcaaccuucgaaggguuggcaugacuggcaacaagugccauuuuguucgcaucauuuccacgaguuaauaaugaaagauggaaggaagcuagucguuccuugccgcccucaagaugaacuaaucggacgugcccguauaucacaaggcucaggauggagcuuacgggaaacugcauguuuaggaaaagcguaugcucagauguggucacuuauguacuuucacagacgagauuuaagauuggcaucaaacgccauauguagcgcaguuccuguucacugggucccgacuucaagaaugacauggaguauucaugcccaccaccaauggaugacaacagaagacaugcuuacaguauggaauagaguguggauagaggacaacccuuggauggaggauaagacaccagugaccacgugggaaaauguuccauaucuugggaaaagagaagaucaguggugcgguucacuaaucggcuuaaccuccagggcuacgugggcacaaaauaucccgacagccauccagcaaguucguaguuuaauuggaaaugaagaauuuuuggacuauaugccuucuaugaagcgcuuucgaaaagaagaagaaucagagggcgcgauuugguaa

SEQ ID NO: 23031 - RNA, 9873 nt, Artificial Sequence
  derived and/or modified CDS sequence (opt6) from DENV-3__JF808120__SS-prME
accagcuuaugccuaaugaugauacucccugcugcacuagcauuccauuuaacaucccgagauggagaacccaggaugauuguuggcaaaaaugaacgcggaaaauccuuguuauuuaaaacagcaucagguauuaacaugugcacccuuaucgccauggaucuuggagaaaugugugacgacacugucacguauaaauguccgcauauaacagaaguagaaccagaagauaucgauuguugguguaaccuuacuucuaccugggucacauaugguacauguaaucaagccggagaaagaagacgcgauaaacguuccguagcuuuggcuccccaugugggaauggguuuagacacaaggacacaaaccuggaugucagcugaaggugcauggagacaaguggaaaaaguagaaacuugggcacuuaggcauccagguuuuacaauucuggcauuauuuuuggcacauuauauugggacaucacugacacaaaaaguagucauuuucauauuacuuaugcucguaacgcccuccaugacaaugagaugcguagguguuggaaaccgcgacuuuguugaaggauuaaguggagcaacaugggucgacguaguauuagaacaugguggaugcgugaccacaauggccaaaaauaaaccaaccuuggacauagaacuacagaaaacagaagcgacacaacuggcuacacucagaaaacuaugcaucgaagguaaaauaacgaauauuacuacugacucuagauguccaacucaaggugaagcaguacuaccagaagaacaagaucaaaauuacguauguaaacauaccuauguggacagagguugggggaaugggugcggacuguuuggaaaaggaucacucguuacaugugccaaauuccaaugccuugaauuaauugaagguaaaguaguccaguacgaaaacuuaaaauauacuguaauuauuaccguacacaccggagaucaacaccagguggguaacgaaacucaagggguaacagcugaaauuacuccucaagcgucgacuaccgaagcaauucuuccugaauauggaacacuuggguuagaauguucaccuagaacagguuuagacuuuaacgaaaugauuuuguuaacaaugaaaaacaaggcuuggaugguucaucgacaaugguuuuucgauuuaccuuugccauggacaagcggugcaacuacugaaacacccacguggaaccgaaaagaacuccuaguuacauucaaaaaugcccaugcgaagaaacaggaaguaguugucuuagggagucaagaaggugccaugcauacugcacuuacaggagcuaccgaaauccaaaauucagguggaacgaguauauuugcagggcaccucaaaugucguuuaaaaauggacaaacuagaauuaaaagguaugagcuaugccauguguacgaauacauuuguucuuaagaaagaagucagugaaacacaacauggaacuauacuuaucaaaguagaauacaaaggcgaagaugcccccuguaaaauaccuuuuaguacagaagauggucaaggaaaagcucauaacggcagauuaauaacugccaaucccgucguaaccaagaaagaggagccugugaauauagaagcagagccaccguucggugaauccaacaucgugauagggacaggagauaacgcccuaaaaauaaauugguacaagaaaggaucaagcauagggaaaauguuugaggcuacggcaagaggugcuagaagaauggcaauucuuggugacacugcuugggauuucggaaguguggguggaguccuaaacucacucgggaaaaugguccaucaaaucuuuggcucagcauacacugcguuauucagcgguguaaguuggguaaugaaaauugguauaggagucuuacuaacuuggauaggcuuaaacagcaaaaauacaucuaugucuuucucgugcauugcgauaggaauuauuacauuguauuuaggagccguaguccaagccgauaugggcuguguuauuaacuggaaagguaaagagcuuaaaugcggaucggggauauucguuacaaaugaaguacauaccuggaccgaacaauacaaauuucaggccgauucuccaaaaagacuugcuacagcuauugcaggggcuugggaaaauggcguauguggaauccgcucuacuacucguauggaaaaucuauuauggaaacagauugcaaacgaacugaauuauauccuaugggaaaacaauaucaaacuuacaguaguaguuggugacauaauagguguauuaaaacaagguaagcgaacgcucacaccccaaccuauggaacuuaaauacucuuggaagaccugggggaaggcaaaaaucgucacagcagaaacucaaaauucaucauucauaaucgauggacccaauacaccagaauguccauccgccucgagagcuuggaacguaugggagguggaagauuacggauucggaguuuuuacuacuaacauuuggcuaaaguuaagagaaguauauacacaacugugugaccauagauuaaugucagcggcggugaaagaugaaagagcuguacaugcugauaugggguauuggauagagucccagaaaaacggaucuuggaaauuagaaaaggcuucucuaauagaaguaaaaacuugcacuuggccgaaaucacacacucucuggaguaauggcgucuuagaaucugacaugauaauaccaaagagcuuagcgggacccaucagccagcauaaucaucgaccaggcuaccauacacaaacggcagggccauggcauuuagguaaguuggaacuggacuuuaacuacugugagggcacgaccguaguaauuacagagaacugcggaacacgagguccgagccuacgcacgacaacagucagcggaaaauuaauacaugagugguguugcagaucauguacccuaccaccccugcgauauaugggcgaagacggguguugguaugguauggaaauaagaccaauaucugaaaaagaggaaaacauggugaagucuuuaguuucagcgggaucaggaaaaguggacaacuuuacaauggggguauugugccuagcgaucuuguucgaagaagucaugagaggcaaguuuggaaagaaacauaugauagccgguguuuucuucacauuugugcuguuguuguccggacagauaacauggagagauauggcacauacccuaauaaugauugguucuaacgcgagcgaucgaaugggaaugggagugacauaccuagcgcuaaucgcuacauuuaaaauccagccguuucucgcucuuggcuucuuccugcguaaacuuacuuccagggaaaaucuauuauugggaguggggcuagcaauggcgacgacauuacaacuuccagaagauauagaacaaauggcaaauggaauagcucuaggacuaauggccuuaaaauugaucacacaauuugaaacuuaucaauuauggacugcguuaauuagccuaacaugcucaaacacuauguucaccuuaacuguugcguggaggacugcuacguuaauacuagcugguguaucacuguugccuguaugccaaaguaguucuaugagaaaaaccgacuggcucccuauggcgguagcagcaaugggaguaccuccuuugccccuuuucauauucaaccuaaaagacacacugaaacgacggucauggccauugaaugaagggguaauggcuguaggacugguaaguauccuagcaagcucauuacuacgcaaugaugucccuauggcagguccgcuaguagcugguggacuuuuaaucgcgugcuacgucauaacaggaacgucagcagaucuaacuguagagaaagccgcggauauuacaugggaggaggaagcagagcaaacagggguaucucauaauuuaaugauuacuguagacgacgaugggacaaugcgaauuaaggaugaugaaacagaaaauauuuuaacaguccuauuaaaaacagcccuucuaauagucagcggcguauuccccuauuccaucccugcuacgcuccuuguuuggcacacuuggcaaaaacaaacucaacgaucgggcguacuuugggaugucccaucuccuccugaaacucaaaaagccgaguuagaagaaggaguuuacagaauuaaacagcaagguauauuggguaaaacucaagucggaguagguguccaaaaagaagguguauuucacacgauguggcacguaacucgcggcgcaguauuaacuuauaacgguaaaagacuugaaccuaacugggcgucagucaagaaagaucugauaucauauggagggggauggagguugucagcgcaguggcaaaaaggggaggaaguacaaguaauagcuguggagccgggcaaaaauccgaaaaauuuucaaacaaugccuggaacguuccaaacuacaacaggugaaauuggagccauagcacuagacuuuaagccuggaacaucggguagcccuaucaucaacagggaaggcaaaguuguaggucuuuacggaaacgggguagucacaaagaauggaggguauguuagcggaauagcacaaacaaacgcugagcccgacggcccuacaccagaacuugaagaagagauguucaagaaacggaaucucacgaucauggacuuacacccaggaucgggaaaaacuagaaaauaucuuccugcaauagucagagaagcaaucaagaggagauuaaggacauuaaucuuagcaccuacuagggucgucgcagcggaaauggaagaagcgcucaaaggccugccaauaagauaucaaaccacugcgacuaaaucugagcacacaggcagagaaauuaucgaucuuaugugucacgccacauucacaaugcgucuuuugagccccguacgaguaccaaauuacaacuuaauaauuauggaugaagcucauuucacggauccugcgaguauugccgcuagaggauacaucucaacaagggucgggaugggugaagcagccgcaaucuuuaugacagcuaccccaccuggcacugcugaugcuuucccucaaucuaacgcaccuauccaagaugaggagagagauauaccagaaagaucuuggaacucagggaaugaauggauuacugacuucgcaggaaaaaccgucugguuugugccguccaucaaagcuggcaaugauauugcuaauuguuuacgaaagaauggcaagaaagugauccaacucaguaggaaaacauuugauacugaauaucaaaagacuaaacuaaaugauugggacuucgucgucacuacggacauuucagaaaugggagcaaauuuuaaagcagauagaguaauagaccccagacgcuguuuaaagccuguuauacuaacagauggacccgaaagaguuauacuagcaggaccgaugccggucacugcggcaagugcagcacagcguagaggacgagugggccggaauccgcaaaaagaaaaugaucaauauauuuucacaggccaacccuugaauaaugacgaagaccacgcccauuggaccgaagcaaagaugcucuuagauaacauaaacacucccgagggcaucauuccugcuuuauucgagccggaaagagaaaaaucugcugcuauagacggagaguaucgucucaaaggcgaaucaagaaaaacauuugucgaauuaaugagaagaggggacuuacccguuuggcucgcucacaaaguugcgucugagggaauuaaauauaccgaucgaaaaugguguuucgauggacagcgcaauaaucaaauacuagaagagaacauggauguagaaauauggaccaaggaaggagagaagaagaaacugcgaccgagauggcucgacgcccgaacuuacagcgauccauuggcauuaaaagaguucaaagauuuugcugcaggaaggaaaucaaucgcacucgaucuuguaacugagauaggaaggguaccuagucaucucgcacacaggacccgaaaugcucuggacaauuuaguaauguuacauaccucugaacauggaggccgagcauauaggcaugcgguggaagaacuuccggaaacuauggaaacuuuauugcuauuaggauuaaugauucuuuuaacuggaggagcaauguuauuucuaauuucuggaaaggggaucgguaaaacaucaauaggucuaaucuguguaaucgcgucaagcgguauguuauggauggcggaaauaccucugcaauggaucgcaucagccauagucuuggaguucuuuaugaugguacuacucauccccgaaccugaaaagcaaagaacaccccaggacaaucaauuagcauacgucgucauaggaauauuaacacuggccgcuauuaucgcagcuaacgaaaugggauuguuggaaacaacuaaaagagauuugggcaugaguaaagaaccaggcguugugagcccaacuucauaucuugacgucgacuuacacccugcgucugcuuggacguuauaugccguagcuacuacgguaaucacgccaaugcuacgucauacaauagaaaauuccaccgcgaacguaagccuagcagcuauagcaaaccaagccguaguacucaugggucuggacaaaggauggccuauaagcaaaauggaccuaggaguaccccuccuagcauuaggaugcuauagucaagucaauccucugacacuuaccgcagcuguauuacuauugauuacgcauuacgccaucauuggcccaggucugcaagcaaaagcaacgagggaagcucaaaaacguacugcagcuggcauaaugaaaaauccuacugucgauggcaucaugaccauagaccuagauccuguuauuuaugacaguaaauuugaaaaacaacuuggucaaguuaugcuauuaguccuuugugccguccagcuccuucuuaugagaacuucgugggcgcucugugaagcccuaacauuagcuacugggccaauuacgacacuuugggaggguucaccaggaaaguucuggaauacaacgaucgcagucagcauggcuaauaucuuuagaggaucauaucuagcgggagccggacucgcuuuuaguaucaugaaaagcguggggacaggaaagcgugggaccggaucccaaggugaaacucuaggagaaaaauggaagaagaaacuaaaucagcuaucaagaaaagaauuugaucuauauaagaaauccggaauaacagagguagaccggacagaagcaaaagaaggguuaaaacgaggugaaauaacacaccacgcaguuagcagaggaucagccaaacugcaaugguuuguagaacgaaauauggucauuccagaggguaggguaaucgaucuagggugcggaagaggcggauggagcuauuacugcgccggcuuaaagaaagugacagaagucagaggcuauacuaaaggugguccuggccacgaagaaccuguuccuaugacgacauacggcuggaauaucgucaagcucaugucgggcaaggauguauucuaccugccaccugaaaaaugugauacauugcuaugugauauaggagaaucaagcccguccccaacaguagaagaauccaggacuauacguguucuaaaaaugguagagccauggcucaaaaauaaucaguucuguaucaaaguauuaaaucccuauaugccuacgguuauagaacaucucgaacguuuacagcgcaaacauggaggaaugcuuguaagaaacccacuauccagaaacaguacucaugaaauguauuggauaucgaaugggacuggaaacauaguagccucaguuaacaugguaagucgucuacuucuaaaucgguuuacaaugacgcauagaagaccuacaauugaaaaagauguagaucuaggagcaggcacaagacauguaaaugcggaaccagagacuccuaacauggacguuauaggagaacgcauuaaacgaauuaaggaagaacauaauucgaccuggcacuaugacgacgagaauccauacaaaacaugggcauaucacggaucguaugaaguaaaagcaacagguucagcaucaucuaugauaaacggaguagucaaacuauuaacuaaaccgugggacgucguaccgaugguuacucagauggcuaugacugauaccacaccauucggacaacagagggucuuuaaagaaaagguugauacaaggaccccucguucaaugccagggacaagaagaguuaugggcauaaccgcagaguggcuauggaggacgcucgggcguaacaagaaaccuagauuguguacaagagaagaauuuacaaagaaaguacguaccaaugcagcaaugggagcaguauucaccgaagagaaucagugggacagugccaaagcugcaguugaagacgaagauuuuuggaagcuaguugaucgugaacgggaauugcauaaacuaggaaaauguggcucauguguauauaauaugaugggaaaaagggagaagaaauugggugaguucggaaaagcaaagggaagcagagcuauaugguauauguggcucggugcgcgcuaucuagaauuugaagcauugggcuuucucaaugaggaucauugguucagucgagaaaacucauauucagggguagagggcgaaggucuccauaaauugggauauauucucagagacaucucuaagauaccgggaggagcaauguacgcagacgacacagccggcugggacacgcgcauaacugaggacgauuuacacaaugaagaaaagauuacucaacaaauggacccugaacauagacaacuagcuaacgccauauuuaaguuaacauaccaaaauaaagugguaaagguacagcguccaacaccaacagguacgguaauggauauuauuagcaggaaagaucaaagaggaaguggacaagucggcacguacggucuaaauacuuucacuaacauggaagcgcaacugauaagacaaauggaaggagagggaguccuaagcaaggcugaccuagaaaauccucaccuuccagagaagaaaauuacacaguggcuugaaacaaaaggcguggaacgccuuaaacguauggccauuaguggggaugauuguguggugaaaccgauugaugaucgauucgccaaugcacuccuagcacuuaacgacaugggcaaaguaagaaaagauauaccgcaauggcaaccaaguaaaggguggcaugauuggcaacaagugccauuuugcucucaccauuuccaugaauuaauaaugaaggacggaagaaaguuaguaguacccuguagaccgcaagaugaacucauaggacgugcucguauuucucaggguagcggcuggucauuacgagaaacagcguguuuagguaaggcuuacgcccaaauguggucucucauguacuuccauaggcgugaucuucgacuagcaagcaaugcuaucugcagugcgguacccguacacuggguuccaaccaguagaacaacauggucgauacacgcucaucaccaguggaugacaacggaggauauguuaacggucuggaaucgaguguggauugaagauaacccuuggauggaagacaaaacgccugucacuacuugggaaaacguaccauaccuuggcaaacgugaggaucaauggugugggagucuuauaggacuaacaaguagagccaccugggcccaaaauauacccacggccauacaacaaguaagaagucucaucgguaaugaggaguuccuagauuauaugccuucuaugaagagguuuagaaaggaagaagagucggaaggugcaauaugguaa

SEQ ID NO: 23032 - RNA, 9873 nt, Artificial Sequence
  derived and/or modified CDS sequence (opt6) from DENV-3__JF808119__SS-prME
acuucauugugccuuaugaugauucuuccaacagcacuggcuuuccauuuaacuucacgagacggagaaccuagaaugauuguggguaaaaaugaacggggaaaaucuuuacuuuuuaaaacagcaagcggaauaaauaugugcacuuuaaucgcaauggacuugggagaaaugugugacgauacaguuacauacaaaugcccgcacaucacugaagucgaaccggaagacauugacuguuggugcaauuuaacgucgacauggguuacauauggaacauguaaucaggcuggugaacaccgacgugauaaaagaaguguagcuuuagcaccccaugugggaaugggguuagauacacguacgcagacauggauguccgcggaaggcgcauggcgucagguagagaaaguagaaacuugggcgcuaagacauccaggcuucacgauacucgccuuauuucuugcacauuacaucggaacaucccucacucaaaaagugguuauuuucauacuguugauguuaguaacaccaucgaugacuaugaggugcguaggaguaggcaacagagacuuuguagaaggauugucaggugcgacuuggguugacguaguccucgaacaugggggauguguaacaacgauggccaaaaauaaaccaacuuuagacauagagcuucagaaaacagaagcaacacaacuagcaacuuugcgaaaauuauguauagaagggaaaauuacuaauauaaccacagacucucgcuguccaacucaaggugaagccguucuucccgaagaacaagaucaaaauuacgugugcaaacacacuuacguagauaggggguggggcaacggcuguggucuguucgggaaaggaucucuagugacaugugcuaaauuucaauguuuagaaccgauagaggguaaaguaguacaguaugaaaaccuaaaauauacagucauaaucacgguacacacgggggaccaacaucagguagggaaugaaacccaaggcguuaccgcagagauuacaccccaagcaucaacaacagaagccaucuugccagaauaugguacauuagguuuagaauguaguccucggacaggcuuagacuuuaacgaaaugauucuuuuaacaaugaaaaacaaagcauggauggugcauagacaaugguucuuugaucucccucuaccguggacgucgggcgcaacaacagaaacgccuacauggaaccggaaagaauuacuuguaacauucaaaaaugcgcacgccaagaaacaagagguagugguacucgguagccaggaaggagcgaugcacacugcgcuaacuggagcaacagagauacagaacuccggagguacaucaauauucgcaggucaccugaaauguaggcuaaaaauggauaaacucgaauuaaaaggaaugagcuaugcaauguguacaaauaccuuuguucucaagaaagaaguuucggaaacucaacacgguacuauauuaauaaaaguagaauacaaaggagaagaugcuccuugcaaaauaccguucucgacugaagacgggcaagggaaagcacauaacggaagauuaauaacagcaaacccaguggugaccaagaaagacgaaccgguaaacauugaagcugaaccaccuuuuggggagucuaauauuguaauuggaauaggagauaaugcauuaaagauuaauugguacaagaaaggcucauccauuggcaagauguuugaagcuacagccagaggagcuagacgaauggcuauccucggggacacagccugggauuuuggaagcguaggcggaguccuaaauucuuuaggaaagaugguucaccaaauuuucgguucagcguacacugcauuauuuucgggaguaucuuggguaaugaaaauagguauagguguacuucuuacuuggauaggauuaaacuccaaaaacaccucaaugucauucucauguaucgcuauuggaauaaucacacuuuaucucggagcaguaguacaagcagacauggggugugucauaaacuggaaagguaaagaacuuaaaugcggaucaggaauuuuuguuacgaaugagguacauacuuggacagaacaguacaaauuucaagcagauuccccaaagagauuagcgacugcgauugcaggcgcuugggaaaauggaguuuguggcauaaggagcacgacucgaauggaaaaucuguuauggaaacaagucgcuaaugaauugaauuacauucuaugggaaaacaacauaaaauugacaguuguuguuggagacaucaucggagugcucgaacaagguaaaagaacuuuaacgccacagcccauggagcuaaaauacagcuggaagacauggggaaaagcaaaaauugucacagcagaaacacaaaauucaucauucauuauagaugggccgaacacuccagaaugucccagugcaaguagggccuggaacguaugggaaguggaggacuauggauucgggguauuuacaaccaacauauggcuuaaacuaagggaaguuuauacgcaacucugugaucacaggcuaauguccgcagcuguaaaggacgaacgcgcuguacaugccgauaugggauauuggauugaaucacagaaaaacgguucauggaaacucgaaaaggcuucacucauugaaguaaaaacuuguacauggccuaaaucucauacacuuuggucgaaugguguguuagaaucagauaugauaauaccaaaaagucuugcugguccaauaagucaacauaaucaucggccagguuaccauacucaaaccgcagguccauggcacuuagguaaacuagaguuagauuuuaauuacugcgaaggaacaacaguuguaauaaccgaaaacugcgguacucgagguccaucucuaagaacaacaacaguaucaggaaaacuuauacaugaauggugcuguagaagcuguacacugccaccgcuuagauauaugggagaagacggauguugguacggaauggagauccguccuauuucugagaaagaggaaaauauggucaagucuuuagucucggccggauccggaaaagucgacaacuuuacaaugggaguauuaugucuagcuauauuauucgaagaagugaugcgagggaaauuuggcaagaaacacaugauagcuggcguuuucuucauguuugucuuauuauuaucgggacaaauaacuuggcgagacauggcccacacacuuaucaugauugguaguaaugcgucggaucguaugggaaugggaguaacauaucuugccuuaauagcaacauuuaaaauacagccauucuuagcacugggauucuuuuuaaggaaauuaacgagccgagaaaauuugcuacuuggcguaggacuugcaauggccacuacacugcaacuuccagaggacauagaacaaauggccaacgguauagcacuagguuugauggcauuaaaacuuauaacacaauucgagacguaccaacuguggacggcacuaauaagccucacuuguaguaauacgauguuuaccuuaacaguagcauggagaacagcaacacuuauucuugcgggagucucacuacuaccgguuugccagucuucuucaaugagaaaaacugacuggcuaccgauggcaguagcugcaauggguguaccacccuuacccuuguucauauucucacucaaagauacucuuaagagaagaaguuggccauuaaaugaaggagucauggcuguaggguuggugucaauauuagcaucaucauugcuacgaaacgacgucccgauggcaggaccgcuuguagcaggaggucuucuaauugcaugcuauguaauaacaggcaccuccgcagaccuaacuguagaaaaggccgcugauauaacaugggaagaggaggcagaacaaacugguguaucacauaaucuaaugauuaccguagacgaugaugggacaaugagaauuaaagacgacgaaacugaaaauauccuuacgguccuucuuaaaaccgcauuacuaauaguuuccgguguauuuccuuauucaauaccugcaacacuuuuaguguggcacacguggcaaaaacagacucaaagaucuggaguucuaugggacguucccaguccuccggaaacucaaaaagcugaacuugaggagggagucuauagaaucaaacaacaagggauauucggaaaaacacaaguagggguaggaguacagaaggaggggguguuccauacuauguggcauguaacacgcggagcaguucuaacauacaauggaaaacgauuggaaccaaauugggcuucggucaagaaagaucuuauaucguacggcgguggcuggcgauuauccgcgcaguggcaaaaaggggaagaaguccaaguaauugcuguggaaccggguaagaaucccaaaaauuuccagaccaugccagggacuuuucagacuacuacaggggaaauaggagcuauagcguuagacuucaaaccuggaacaucuggcucucccauaauuaauagagaggguaaaguaguaggccuauacgggaauggagucgucaccaaaaauggugguuacgucucagguaucgcacaaacgaacgcagaacccgacgggcccacuccagaauuagaagaagaaauguuuaagaaaagaaaucuaacaaucauggaccuacacccugguucuggcaagacucguaaauaccugccagcgaucguaagagaagcaaucaaaagaagacuaagaacauugaucuuggcuccaacuagagucgucgcggcagaaauggaggaagcucuuaagggacuaccaauaagauaccaaaccaccgcaacaaaaucagaacauaccggaagggagaucguagacuugaugugucaugcgacauucacaaugcgccucuugaguccgguccgaguaccaaauuacaaccuaauaauaauggaugaagcgcacuuuacugauccggcuuccauugcugcgagaggauauauaucuacaagaguugggaugggggaggcagcggcuauauuuaugacugcuacaccaccagggacugccgacgcguucccacaaaguaacgcaccuauccaggacgaagaaagagacauaccggagagaaguuggaacucaggcaaugaauggauaacagacuuugcaggaaaaacgguaugguucgugccuuccaucaaagcuggcaacgacauugccaauugcuugaggaaaaauggcaaaaagguaauacaauuaucccguaagacauuugauacugaauaccagaagaccaaauuaaaugacugggacuuuguaguaaccacagacauaagugaaaugggagccaauuuuaaagcggacagaguuauugauccucgcagauguuuaaaaccaguaauucuuacugauggaccggagagagugauacuagcaggcccaaugccaguaacagccgcgagcgccgcgcaaaggcggggucgaguugggcggaacccacagaaggagaaugaucaauauauuuucacaggucaaccguuaaacaaugacgaagaccaugcgcacuggaccgaagcaaaaaugcugcuagauaacauaaauacucccgagggcaucauuccagcacuuuucgaacccgaacgagagaagagugccgcgauagauggggaauacagacuaaaaggagaaucuagaaagacguucguagagcuaaugcgacgaggugaucuaccgguaugguuagcucacaaaguggcauccgaggguauaaaguauacagauagaaaauggugcuucgacggucaacgcaacaaccaaauacuagaagaaaauauggauguagaaaucuggacuaaagagggcgagaagaagaaacuuagaccaagauggcuggacgcuaggacauacucugauccccuagcucuaaaagaguucaaagauuucgcagcuggaagaaagaguauagcguuagaccuugucacagagauuggacgaguaccgucccauuuagcgcauaggacccgcaacgcuuuagacaaccuuguaauguugcacacgucugagcaugguggcagagcuuacaggcaugcgguggaagaacuaccugaaacaauggaaacauuacucuuauuggguuuaaugauacuccuaacgggcggggcuauguuauuccucauuagugggaaaggcauaggcaagacgaguaucgggcuuauauguguuaucgccucaucaggcaugcuauggauggcagagauuccguuacaauggauagcuuccgcaauaguacuagaauuuuucaugaugguacuccuaauaccagagccggaaaaacaacgaacgccucaggauaaucaacucgcauauguaguuauaggaauccuaacucuagcugcaauaauagcagcgaaugagaugggcuuacuggaaacuacaaaaagagacuuaggaaugagcaaggaaccaggugugguaagcccgacgaguuaccuagacguggauuuacauccagccagugccuggacacuuuacgcuguggcaaccacugugauaaccccaaugcuaagacauacaauagaaaacucaacugcaaaugucucucuggccgccauugcaaaucaagcaguuguauuaaugggauuagacaaagguuggccuauaucuaaaauggaccuaggaguaccccuucuagcacuagguugcuauagccaagugaauccccuuacacuuaccgccgcgguucuauuguuaauaacacacuacgccauaauuggaccaggacuacaagccaaagcaacaagagaagcgcaaaaacggaccgccgcuggcaucaugaaaaacccuacaguggaugguauaaugacaaucgacuuagacccuguaauauacgacucaaaauucgaaaaacaacuuggacagguuaugcuacucgugcuuugugccguacaacuauuguuaaugaggaccucaugggcacuaugugaagcucucacguuagcuacuggaccaaucacuaccuuaugggaaggaucacccggaaaguuuuggaauacgacaauagcagugagcauggccaauauauucagaggaucauauuuagcaggcgcgggcuuagcauuuucaauuaugaaaagcguaggaacgggaaaacguggaacaggcagccagggggaaacguuaggugaaaaauggaagaaaaagcuaaaccaacuaagccgaaaagaguuugaccuauauaagaaauccgguauuacagaaguugauagaacugaagcuaaggaaggucuaaaacgaggcgaaacaacccaccaugcagugagucgagguagcgcgaaauugcaaugguucguagaacgaaauaugguaauaccugaaggaagaguaauagaccuaggaugcggucguggugguuggucauacuauugcgcugggcucaagaaggugaccgaggucaggggauauacuaaggguggacccggccacgaagaacccguaccaaugucgaccuauggguggaauauuauuaaacucaugucgggaaaagauguauuuuacuugcccccggagaaaugugacaccuuguuaugugacaucggagaaucaaguccgaguccuacagucgaagaaaguagaacaauucggguauuaaagaugguggaaccguggcuuaaaaauaaccaauuuuguauaaagauccuaaaccccuacaugccuacugugauagaacaucuagaacgucuacagcguaagcauggugguaugcuaguaagaaauccacugucuaggaacagcacucacgaaauguauuggauaucuaacggaacggguaacauugucgcuuccgucaauaugguaucaagauuacuucuaaacagauuuacgaugacccaucguagaccuacaauagaaaaggauguugauuuaggcgcggguacccgacacguuaaugcggagcccgaaacgccaaacauggacguaauaggggagagaauaaaacgaauaaaggaggagcacaacaguacuuggcacuacgaugacgagaacccauauaagacaugggcuuaucacggcucauaugaggugaaagcaacugguuccgccucaaguaugaucaauggcguugugaaauuauuaaccaaacccugggaugugguaccaaugguaacacaaauggcaaugacagacacaacaccuuucggccaacaaagaguauuuaaagaaaaagucgauaccagaacgccgagauccaugccugguacucgacgcgucaugggcauuacugcggaauggcuauggcguacguuaggacgaaauaagaaaccucguuuaugcacacgagaagaauuuaccaagaaaguaagaacaaaugcagccaugggagcaguuuucacugaagaaaaucaaugggauagugccaaggcugcaguugaagacgaggauuucuggaaauugguggauagagaacgcgaauuacauaaacuaggaaagugugguucuugcguauauaacaugaugggaaagcgugaaaagaaauuaggagaguucgggaaagcaaaaggaucccgagcaauaugguauauguggcuaggggccagguaucucgaauuugaagcauugggauuccuuaacgaagaucacugguucagccgagaaaauucguauucaggagucgaaggugaaggacuacauaagcuaggauauauuuuaagagacauaucaaaaauucccgguggcgcaauguacgcugacgauacagcaggaugggacacaaggauaacagaggacgaucuacacaacgaagagaaaauaacgcagcagauggacccagaacacagacaauuagcaaaugcuauuuuuaagcucaccuaucaaaauaaaguaguaaaggugcaacguccaaccccaacuggaacuguaauggacauaauuucuagaaaagaccaacgugggagcggacaagucggaacguauggacuuaacacauucacaaauauggaggcgcaauuaauacgucaaauggagggcgaaggaguacuaaguaaagcugaucucgagaauccacaucuaccagagaagaaaauuacgcaguggcuugagacaaaaggaguugagcguuuaaaacgcauggcaauuucaggagaagauugcgucuuaaaaccaaucgaugacagauucgauaacgcauuguuggcccugaaugauauggggaagguaagaaaagauaucccacaguggcaacccagcaaaggguggcaugauuggcagcaggucccauucuguucccaucauuuccaugaacugauuaugaaggacgggcgaaaauuagucguacccuguagaccucaagacgaauuaauaggaagggcacguaucagccaaggagcaggauggucucugagagagacagcaugccuagguaaggcauaugcucaaauguggucucucauguauuuucaucgaagagauuugcgacuugcaaguaacgccauuuguuccgcuguucccgugcauugggugcccacuucaagaaccacuugguccauccacgcgcugcaucaauggaugacgaccgaagacaugauaacaguauggaacagaguguggauagaagauaauccauggauggaggacaagacaccaguaacaacaugggaagauguuccuuaucucgggaaacgagaagaccaauggugcggcucuuugauaggacuaacaucacgagcaacaugggcacaaaauaucccaacagcaauacagcaggucagaagucuaauugguaacgaggaguucuuggauuacaugccaucuaugaagagguuuagaaaggaggaagaaagugaaggagccaucugguag

SEQ ID NO: 23033 - RNA, 9873 nt, Artificial Sequence
  derived and/or modified CDS sequence (opt6) from DENV-3__JF808118__SS-prME
accucacuuugcuuaaugaugauucucccugcagccuuggcauuucauuuaacuucaagagauggugaaccuaggaugauaguugggaaaaacgaaagaggaaaaucacuacuuuuuaaaaccgccagcgggauuaauauguguacacuuauagcgauggaucucggagaaaugugugaugacacuguuaccuauaaauguccccacauuacggaaguugaacccgaagacauugauuguugguguaauuuaacaucaacaugggugacauauggaacuuguaaucaagcgggggaacggagaagagauaaaaggucaguagcauuagcuccgcauguaggcauggggcuugauacccguacccaaacauggauguccgcagaaggggcauggcgacaaguagaaaaagucgaaaccugggcgcuuagacaccccggauucacuauccuagcuuuguuuuuagcacacuacaucgguacuucacuuacgcaaaaaguuguaauauuuauucuacugaugcucguaacacccaguaugaccaugagauguguaggagugggaaauagggacuucguugaaggauuaagcggagcgaccuggguggauguaguguuagaacacggaggauguguaacaaccauggccaaaaacaaaccgacucucgacauugaauuacagaaaacagaagcuacucaauuggcgauauuacgaaaacuguguauagaaggaaaaaucacgaauauuacaacagauucaagguguccaacucaaggugaagccguacuuccugaagaacaagaucagaacuauguaugcaaacacacuuacguagacagagguugggguaaugggugcgguuuguucggcaaagggagcuuggucacaugugccaaauuucaaugcuuagaaccgauugaaggcaaaguaguucaauacgaaaaccuaaaauauacuguuauuauuacaguacauacuggagaucagcaucagguaggaaaugaaacacagggaguaaccgcugaaauaacuccacaagccagcacuacagaggcuauacuaccagaauacggaacucuaggacuagaguguucaccgagaacgggcuuagauuucaaugaaaugauccuccucacuaugaaaaacaaagccuggauggugcauagacaaugguuuuucgaucucccguuacccuggacgucuggugccacaacagaaacucccacuuggaaccgaaaagaguugcuggugaccuucaaaaaugcucaugccaagaaacaagaaguugucguucuugguucacaggagggcgccaugcauacagcgcuaacgggggcgaccgaaauucagaacucuggagggacaaguauauuugccggacaccuaaaaugcagauuaaagauggauaaacucgaauuaaaaggcaugagcuaugcaaugugcacgaacacauucgugcuuaagaaagaaguaucugaaacucagcauggaacaauuuuaauaaaaguugaauacaaaggcgaagacgcgccuuguaaaauuccuuuuaguacugaggauggccaagggaaagcucauaauggaagacucauaaccgcuaacccuguaguuacgaagaaagaggagccagugaauauagaagcggaaccaccauuuggcgaaagcaauauagucauaggaauuggagacaaugcacuuaagauuaacugguauaagaagggaagcaguauugggaaaauguucgaagccacagcgagaggagcuaggagaauggccauuuuaggcgauacagccugggacuuugguuccguaggagguguacuaaauagucuagguaagauggugcaccagauauucggauccgcauauacugcucuguuuucugggguaucaugggugaugaaaauagguauaggaguucuuuuaacuuggauaggucuaaacagcaaaaauacaagcaugucauuuucaugcaucgcaauaggcaucaucacuuuauauuuaggggcagugguucaagccgauauggggugcgucauaaauuggaagggaaaagaacuaaaaugcggaucuggcauauuuguaacaaacgaaguacacacauggaccgaacaauacaaauuucaagcagauaguccaaaaagacuugcaacugcuaucgccggagcaugggaaaauggugugugcggaauaaggagcacuaccaggauggaaaacuuacucuggaagcaaauagcuaaugaacuaaauuacauccuaugggaaaauaauaucaaacuuacgguuguuguaggggacauaauaggaguucuagaacaagggaaaagaacgcuuaccccacaaccgauggagcuaaaauacagcuggaaaacauggggaaaggcuaaaauagucacagcagagacacaaaacaguucauuuaucauagacggacccaacacgccagaaugcccaucugcaucucgugcuuggaacguaugggagguagaagacuacgguuucggagucuucacgacaaacauauggcuaaaauugagggaagucuauacccaacuuugcgaucacagauuaaugucggcagcugucaaagacgaaagagccgugcaugcagacaugggauacuggauagaaucgcagaaaaauggaaguuggaaacuagaaaaggcgucguuaaucgaaguuaaaaccugcacauggccuaagucacauacacuguggucaaauggaguccucgaaucagacaugauaauuccuaaauccuuggcaggaccuauaagucaacauaaucauagaccaggguaucauacccaaacugccggcccauggcauuuaggaaaacuggagcuagacuuuaacuacugugaagguacaacaguaguaauuacugaaaauugugguaccagaggcccuucauugaggacuacaacggugucaggaaaacuaauucacgagugguguuguagauccuguacauuaccacccuuaagauauaugggagaggauggguguugguacggaauggagauacgaccaaucuccgaaaaggaagaaaauauggucaaaucguuagugucagcgggaagugguaaaguagauaauuuuaccaugggcguucuaugccuagcaauuuuauuugaggagguuaugagagguaaauuugguaagaaacacaugaucgcugguguauucuuuacguucguauuguuacuauccggucaaauaacauggagagauauggcacacacacuuauaaugauaggaaguaacgccucugaccgaauggguaugggugucacuuaucuagccuuaauagcgacuuucaaaauacaaccguuucuagcacuuggcuucuuuuuaaggaaacuaacaagcagagaaaaucuucuacugggagucggucuggcaauggccacuacacuacaauugccugaagacauagaacaaauggcaaaugguauagcucuuggucuaauggcccuaaagcuaauuacacaauuugaaacuuaucaauuauggaccgcccuaaucucauuaacaugcaguaauacaauguucacucuuacgguagcauggaggaccgcuacauuaauuuuagcuggaguaucauuauuaccaguuugucagucaaguucuaugagaaagacagauugguugccaauggcaguugcagcuaugggugugcccccauugccacuauucauauuuucauuaaaagauacgcugaaacguagguccuggccucuaaacgaaggugugauggcugucggauugguaucaauccuugcaucuucauuacuccgaaaugacgugccuauggcaggccccuugguagcugguggcuuacuaauagcguguuacgugaucaccgggaccucugcugaccuaacaguggagaaagcagcagauauuacaugggaagaggaggcggaacaaacaggcgugagucacaauuugaugauaacuguagacgacgauggaacaaugcguauaaaagaugaugaaacugaaaauauauugacuguauugcuuaagacggcccuccucaucgucucgggggucuuuccauacucuaucccggccacauuauugguuuggcauacauggcagaaacaaacgcaaagaucgggggugcuaugggacguaccuaguccaccugaaacacaaaaggcagagcucgaagaaggcguguacaggauaaagcagcaagggaucuucggaaaaacacaaguaggugucggaguacaaaaagaagggguauuucauacgauguggcacgugacaagaggggcaguucuuacuuauaaugguaaaagauuagaaccuaauugggcuagcguuaagaaagaccuaauaagcuauggcggaggcuggcgauuaagugcccaauggcagaaaggggaagagguccaaguuauugcggucgaaccagggaaaaauccgaaaaacuuccaaacaaugccuggaaccuuucaaacgaccacaggcgaaauaggagcgauagcucuagacuucaagccuggcacuucagggagcccaauaauuaacagagaaggaaagguagucggacuauauggcaacggaguaguuacgaaaaacggaggauacguaagcgguaucgcucaaaccaaugcggaaccugacggaccgacuccagaacuugaggaagaaauguucaagaaacgaaaucuuacaauaauggaucuccacccaggcucggguaaaacccgaaaauauuuaccagcuauaguacgggaggcaauaaaaaggagacuuagaacauuaauauuggcaccuacaagaguuguugcagcagaaauggaagaagccuugaaaggacuaccuauaagauaccaaacaacggcuacaaaaucagaacacacugguagagaaauuguugauuuaaugugccaugcuacauucaccaugagacuacuuucaccgguaagaguaccaaacuacaaccuaauaaucauggaugaagcacauuuuacggacccggcuucuauugcagcucgaggauacauuaguacaagaguggguaugggggaagcagcagcuauauuuaugacagcuacuccuccaggcacggccgaugcauucccacaaucaaacgcgccuauacaagaugaagaaagagacauaccugagcgaucauggaacuccggaaaugaguggauuacagauuuugcugggaaaacaguaugguucgucccuaguaucaaggcaggaaacgauauagcgaauugcuugaggaagaauggcaagaaaguaauccagcucagccgaaagacauuugauaccgaauaccagaaaacuaaacuaaaugauugggauuuuguaguuacaacagauaucucugaaaugggugcgaacuuuaaggcggaucgaguaauagauccccgacgaugucuaaaaccagugauuuuaacagacggcccggaacguguaauuuuggcagggccaaugccugucacagcugccuccgccgcgcaaagacgaggcagaguuggaagaaauccacaaaaggaaaaugaccaauauauauuuaccgggcaaccccucaauaacgacgaggaucaugcacacuggacggaagccaagauguuacuggacaacauaaauacacccgaaggaauuaucccugcauuauuugagccagagagagagaaaagugcugcaauugacggagaauaucgucuaaaaggagagucaagaaagacauuuguagaacuuaugcgcagaggugaucuacccgugugguuagcacauaaaguggcaagcgaagggauuaaguacacagaucgaaagugguguuuugauggacaacgcaauaaccaaaucuuggaagagaauauggacguagaaauuuggaccaaagagggugagaagaagaaauuaaggccacgaugguuagacgccagaacuuauucugauccuuuagcgcuuaaagaauuuaaagacuucgcagcuggucggaaaucuaucgcauuagaccuaguaacagaaaucggaagaguaccaagucauuuagcccaccguacaagaaaugcacuagacaaucuaguaauguuacauacuuccgaacacggagggagagcauaccgucacgccguagaggaacuuccugagacaauggaaacccuguuauuauugggacugaugauauuguuaacgggaggagcaaugcuauuuuugauuuccgggaaaggaauaggaaaaacuucaauaggacuaauuugugugauagcuaguucaggaaugcuuuggauggcugaaauuccccugcaauggauagcaagugcaauuguucuagaguucuuuaugaugguacugcuaauaccagaaccggaaaagcaaaggacaccucaagauaaccaguuggcauacgucguaauuggcaucuugacacuggcugcuauaauagcugcaaaugaaaugggccuacuagaaacuacgaaaagagauuuaggaaugucaaaagaaccugguguaguuuccccuacgucguaccuagacgucgaucugcauccugcuucagcauggacuuuguacgcaguagcgacaacgguuauaacaccaauguuacggcacacgauagaaaacucaacagcuaaugucuccuuagcagcgaucgccaaucaagcuguaguauuaaugggucucgacaaagguuggccaauuucuaagauggaccuaggagugccacuccuagcauuaggguguuauagucaaguaaaccccuuaacccugacagcugcuguguuacuauuaaucacacacuacgcaauaauuggaccuggacuucaagcaaaagccacaagagaggcccagaaaagaacggcagcaggaauuaugaaaaauccaacuguagacggaauaaugacaauugaucuagauccagugauauacgauagcaaauuugaaaagcagcucggucagguaaugcugcucguacuaugcgcuguacagcuacucuugaugaggacaaguugggcacuaugcgaagcucuaacuuuggcgacaggaccaaucacaacguuaugggaagggagucccggaaaguuuuggaacacgacgaucgcaguuagcauggcuaacauauuccgaggauccuaucucgcuggagcaggucucgcguucucuauuaugaaauccguaggcacaggaaaacgagggaccggaagccagggcgagacccuaggagaaaaauggaaaaagaaacucaaucaguuaaguagaaaggaauuugacuuguacaagaagucaggcaucacagaaguagaucgcaccgaagcgaaagagggcuuaaaaagaggagaaacaacucaccacgcgguaucgagagguagcgcuaaacuacaaugguucguggaacguaauauggugauaccagaaggccgaguaaucgauuugggcugcggaagaggaggcuggucguauuauugugcaggacuaaagaaaguaacagaaguaagagguuauacgaaaggagggcccggacaugaagaaccgguaccgaugaguacguauggguggaacauuguaaaacuaaugucuggaaaggacguauuuuaucuuccuccagaaaaaugcgauacccuccucugugacaucggcgaaaguucaccaagcccuacgguagaggaaaguagaacuauaagaguuuuaaagaugguggagccaugguugaagaauaaccaguuuugcauaaaaguacuaaacccauauaugccaacugugauugagcaccuugaacgccugcagaggaagcauggagguauguuagugagaaauccauugucuagaaacagcacacaugaaauguauuggauauccaacggaacuggaaauauaguagccagcguaaauaugguuucaagauuacuacucaaucgauuuacaaugacacaccguagaccgacuaucgagaaagacguugaucugggcgcagguaccagacacguuaacgccgagccggagacuccuaauauggauguuaucggugaaaggauuaagcguauaaaagaagaacauaauuccacauggcacuacgaugacgagaauccuuauaaaacuugggcauaccacggaucuuacgagguuaaagcuacaggcucugcaucgucgaugauaaacggaguugucaaacuucuaacaaaaccaugggauguaguaccuaugguuacacagauggcuaugaccgacacuaccccuuucggacaacaaagaguauuuaaagaaaaaguagacacucgaacaccaagaucaaugccaggcacacgaagaguaauggggauaacggcagagugguuauggagaacgcucggacgaaacaaaaagccgcgauuauguacaagagaggaauuuacaaagaaaguucgaacgaaugcugcaaugggagccguguuuacggaagaaaaccaaugggacucagcaaaagcggcaguugaggacgaagacuucuggaaauuaguugacagagagagagaauuacacaaauuaggcaaaugcgggucguguguguauaauaugaugggaaagagggagaagaaacuaggggaauuuggcaaagcgaagggaagccgagccauuugguacaugugguuaggcgcaagguaccucgaguucgaagcacugggcuucuuaaacgaagaucauugguucucgagagagaacucuuacagcggaguagaaggugaaggccugcauaagcuagguuacauuuugcgggacauaaguaagauccccgguggugccauguacgcugacgauacagccgggugggauacuaggauuacagaagacgaucuccauaacgaagagaaaauuacacaacaaauggaucccgagcauagacagcuugccaaugcaaucuuuaaguuaaccuaucagaauaaagugguaaaggugcagcggccaacaccuacugggacugugauggacauuauuucaaggaaagaccaacgagguaguggucaaguaggaacguauggucuuaauacauuuacuaauauggaagcacaauugauaagacaaauggaaggugaaggaguauuaagcaaagcagaucuugaaaauccucaucuacccgagaagaaaauaacacaaugguuagaaacaaaaggaguugagcgcuuaaaacggauggcaauuagcggugaugacugcguaguaaaaccgauagaugauagauuugccaaugcguuauuagcuuugaacgauauggguaaagugcguaaagauauaccucaguggcagccaagcaaagguuggcacgauuggcagcagguaccuuuuugcagucaccacuuucacgaacuuauaaugaaggacggacgaaaauuaguggugccauguagaccucaagaugaacuaauagguagagcaaggauaucccaaggagccgguuggucuuuacgugagaccgcuugucuuggaaaggcguaugcgcagauguggagucuuauguacuuucaucgccgagacuugagacuagccuccaaugcuauaugcagugcuguaccuguacacuggguuccaaccucgagaacuacguggagcauacaugcucaucaccaauggaugacuacggaggauauguuaacaguauggaacagaguauggaucgaggacaacccuuggauggaagacaaaacuccuguaaccacuugggaaaauguaccguaucuaggaaaacgcgaagaucaguggugcggcagcuugauaggauugacuucaagggcuacaugggcgcaaaauaucccaacugccauacaacaaguaagaucucuaauaggcaaugaggaguuuuuagauuauaugcccucaaugaaaagauuccguaaagaagaagaaagcgaaggagccauuugguga

SEQ ID NO: 23034 - RNA, 9873 nt, Artificial Sequence
  derived and/or modified CDS sequence (opt6) from DENV-3__JF808127__SS-prME
acaucccuaugucuaaugaugauuuuaccugcugcacuagcauuucacuuaacaucgagagauggugaaccaaggaugauaguagguaaaaaugaaagaggaaagagcuugcuguuuaaaacagcuucaggaauuaauaugugcacauugauagccauggaucugggugaaaugugcgaugauacuguaacguauaaaugcccacacauaacagaaguagaaccagaagacauagauuguugguguaacuuaacuucuacaugggucacauacggaacauguaaccaagcaggcgaaagacgucgagauaaaagaucuguggcgcucgcaccucacgugggaaugggauuggauacucguacacaaacauggauguccgcagaaggugcuuggcgacaaguugaaaaaguagaaacgugggcauuaagacacccaggauuuacaauauuggcacucuuucucgcgcauuauauagguaccucuuuaacacaaaaagucgugauauuuauacugcuaaugcucguuacuccaucucuaaccaugcgcuguguagggguaggaaaucgagauuucguggaaggguugaguggagcaaccuggguugacguuguuuuagaacacggaggaugcgugaccaccauggcgaaaaauaaacccacauuggauaucgaacuacagaaaaccgaggcuacacaauuagccacauugagaaaauuauguauagagggaaaaaucacuaauaucacaacugacucgagauguccaacgcaaggagaagcuguucuacccgaggaacaagaccaaaauuaugucuguaaacauacguacgucgauagaggauggggaaacggauguggauuauuuggaaaaggaucauuagugaccugcgcaaaguuucaguguuuagagccaauagaaggcaaaguaguacaauaugaaaaucugaaauauacuguaauaauuacaguccacaccggagaccagcaccaaguaggaaaugaaacgcaaggugucacggccgaaauaacgccccaggcuucuacaacagaggcuauauuaccggaguacgggacucuaggucucgaauguucaccacgaacugggcuugauuuuaacgaaaugauauuacugaccaugaaaaauaaagccuggaugguucauagacaaugguucuuugauuugccucuuccauggacuucaggcgccacuacagaaacgccaacguggaauagaaaagaacuacuuguaacauuuaaaaaugcucaugcuaaaaagcaagaaguuguaguucuaggcucacaagagggagcaaugcauacagcguuaacuggagcgacagaaauacaaaauucugggggaacaagcauauucgcaggacaccucaagugucgucuaaaaauggacaaauuggaauuaaaggguaugucauaugcaauguguacaaauaccuuuguucucaagaaagaggugucagaaacacagcaugguacuauacucaucaaaguggaguauaagggugaagacgcuccauguaaaauuccauuuuccacagaggauggacaagguaaagcacauaacggacgucucaucacagcaaaccccgucguaaccaagaaagaagaaccuguuaauauagaggcagaaccacccuucggagaaucgaacauagucauuggaacaggggauaaugcacuaaaaauaaauugguauaagaaaggaagcucaauugggaagauguucgaagccacugcgaggggagcacgucgaauggcuauuuuaggggauacagccugggauuuugguagugucgguggcguuuuaaauagucuggguaagauggugcaccaaauauuuggaagcgcauacacagcucuguuuagcggaguaucauggguuaugaaaaucgguauaggggucuuacugacauggaucggguuaaauucuaaaaacacaucaaugagcuucagcuguauugcaaucggaauaaucacuuuauacuuaggugccguaguccaagcggacaugggaugugucaucaacuggaaaggcaaagaacugaaaugugggagugggaucuuuguuacaaaugaagugcacacguggacagaacaauauaaauuucaggcugacucaccaaaacgacuugcuacagcaauagcuggcgcuugggagaauggaguuugcgguauucgaaguacuacgagaauggaaaacuuacuuuggaaacagaucgcuaaugaauugaacuacauucucugggaaaacaauauaaaacuaacugugguaguaggagauauaauuggggugcuagaacaagguaagaggacauugaccccacaaccaauggaacucaaguacucauggaagacauggggaaaagcuaagauaguaaccgccgaaacccaaaauagcaguuucauuauugacggaccaaacacgccagaauguccgucagcuaguagggcguggaauguaugggaaguagaagauuacggauucggaguuuucaccacaaauauauggcuaaaacuucgugaaguauauacacaacugugugaccauagguuaaugucggcagcaguuaaggacgaaagagcaguacaugcagacauggguuauuggauugagucacaaaagaauggcagcuggaaauuggaaaaggcgucauuaauugaagucaaaaccugcacauggccaaaaagucacacuuuguggagcaacggaguacuagaguccgauaugauuauaccuaaaucauuagcaggaccgauuagccaacacaaucaucgaccgggcuaucauacucaaaccgcugggcccuggcauuuagguaaacuugaauuagauuuuaauuauugugaaggaaccacgguugucaucaccgaaaauuguggcacucggggaccuaguuuacggacaacgacuguaaguggcaaauuaauucaugaaugguguuguagaucgugcaccuugccgccauugagauacaugggggaagacggcuguugguauggcauggaaauuagacccaucagugaaaaagaagagaacaugguuaaaucauuaguaucagcaggcucagguaaaguagacaacuuuacaaugggcguacuuugucucgcgauucucuuugaagagguaaugagaggaaaauucggcaagaaacacaugauagcuggaguguucuucacuuuuguacucuuacuaucaggacaaaucacguggcgagauauggcacauacuuuaaucaugauagguagcaaugcaucagauagaauggguaugggagugacauaucuggcauuaauugcaacguucaagauucaaccuuuccuugcccuugguuucuuuuuacgaaagcuaacaagcagggagaaucuauugcuugguguaggccuagcuauggcaaccacguuacaacuuccugaagauauagaacaaauggccaacggaauugcacuaggacuaauggcucucaaauugauaacucaguuugagacuuaucaauuauggacggcacugauaucauugacaugcucaaacacuauguuuacccuaacaguagcauggagaacagcaacguugauacuugcuggagucagucucuuaccaguuugucaaaguagcucuaugagaaaaaccgacuggcuaccaauggcaguugccgcaaugggaguucccccauuaccucuauucauauucucauugaaggacacuuuaaaacgccgaagcuggcccuuaaacgaaggcguuauggcaguuggacuuguuaguauauuagcaaguagcuuacuaagaaaugauguccccauggcaggcccccuuguugcgggaggacuucuaauugccuguuaugucauaacagguaccagcgccgaucuaacuguagagaaagcagcugauauuacaugggaagaggaagcagagcagacgggcgucucacauaaccuaaugaucacuguggacgaugauggaacuaugaggaucaaggaugacgaaacagaaaauauauuaacagugcuguugaaaacagcacuauugauugugucugggguauucccauauagcaucccugcaacguuauuaguauggcacacuuggcaaaagcaaacucagcggaguggaguguuaugggaugucccuucacccccugaaacucaaaaagcagaguuggaagaaggaguauaccguauuaagcagcaagguauauucgguaaaacucaaguaggaguagggguucaaaaggaaggaguauuucauacuauguggcacguuacaagaggagccguacuuacauauaacgguaagagauuagaaccuaauugggccucuguuaagaaagaccuaauuaguuaugguggagguuggagacucagcgcucaauggcagaaaggggaagaggugcagguuauagcuguagaacccgguaaaaaccccaaaaauuuccagacuaugccuggaaccuuucagacgacuaccggggaaauaggagcaaucgcucuugauuuuaagccgggaaccagcggcucccccauaaucaaucgagaagggaaggucguaggacuauacgggaaugguguaguuacgaaaaauggcggauacgugucuggaauagcacaaacaaacgcggaaccugauggcccgaccccggaacucgaggaggagauguucaaaaagagaaaccuaacaauuauggaucuacauccaggaagcgguaaaacucgaaaguauuugccagcuauaguucgcgaagcaaucaaacggaggcuacgcacccuaauauuagcuccaacaagaguaguagcagccgaaauggaggaggcucuuaaagguuuaccuauacguuaucagacaacagccacaaagagugaacauacuggucgcgaaauuguagaucucaugugccacgcaaccuucacuaugaggcuauugagcccuguaagaguuccaaacuauaacuuaauuaucauggaugaagcgcauuuuacugauccagcuucaauagcggcuagagguuauauuagcaccagaguuggaaugggugaggcagcggccauauucaugaccgcaacaccaccugguacugcagaugcguucccccagaguaacgcaccgauacaagacgaagaacgcgacaucccagaaagaucguggaacucggggaaugaauggauuacugacuuugcagguaaaacaguaugguucgugccaagcauaaaagcagggaacgacaucgcaaacugccuaagaaagaacgguaaaaagguuauacaauuaucgaggaaaacauucgauacggaauaccagaaaacaaaauuaaacgauugggacuucguuguaacgacugacauaagcgaaaugggugcuaacuuuaaagcagacaggguaauagauccgagaagaugccuuaagccggugauccucacugacggaccagagagaguuauauuagcugaaccuaugccgguuacugcagcaucugcugcccagagaaggggaagagucgggagaaacccucaaaaagaaaacgaucaauacauauuuacaggacaacccuugaauaacgacgaagaucaugcgcacuggacggaagcaaaaaugcuguuagacaauaucaacaccccugaggguauuauaccugcacucuuugagccugagagagagaaaagcgccgcgauugauggugaauacagauuaaaaggagaaucaagaaaaacuuucguagagcuaaugaggagaggagauuuacccguaugguuggcacauaagguagcauccgaaggaaucaaguauacugauagaaaauggugcuuugauggccaacggaacaaccaaaucuuagaggagaauauggauguagagauuuggacuaaggagggagagaaaaagaaacuacgaccuagguggcuagaugcucgaacauacuccgacccucuugcgcugaaagaguucaaagauuuugccgcaggcagaaaaagcauagcucuugaucuagugacagaaauuggucgaguuccaucgcaucuagcucauaggacuaggaaugcgcuugacaauuuaguuaugcuacauacguccgaacauggcggucgugcuuauagacacgccguagaagaguugccggagacuauggaaaccuuacuacugcuaggauuaaugauacuucuuacugguggcgcuaugcuauuuuugauaaguggcaaagguauagggaaaacaaguaucggcuuaaucugcguaauugcaaguagcgguaugcuguggauggccgaaauaccauugcaguggauagcgucugcuauaguuuuagaguuuuucaugaugguccuccuaauuccugaaccugagaaacaaaggacuccccaagacaaccagcuagccuacgucgucauagggauuuuaacacucgcggcaauuauugcagcaaacgaaauggguuuguuagaaacaacaaaacgggaccucgggaugucaaaagaacccggaguagugaguccaacaaguuacuuagacguugacuuacauccagcuucagcauggacauuauacgccguugcuacaaccguaauuaccccaaugcuaagacacaccauagaaaacaguacugcaaauguaucacuagcggccauugcuaaucaagcaguagugcuuauggggcuagauaagggcuggccaauuaguaaaauggacuuaggugucccucuauuagcacuggggugcuauagccaagucaauccuuuaacucuaacggcagcaguguuauuauuaauaacacauuacgcuauuauaggcccuggcuuacaggcgaaagcaaccagagaagcucagaaaagaacagcagccggaauuaugaaaaacccaacaguugacggaauuaugacuaucgaucuggauccgguuauauaugauuccaaauuugaaaagcaguuaggucaaguaaugcuauugguuuuaugugcuguccaauuauuauuaaugcgcacgucuugggcucuaugugaagcacuaaccuuagcaaccggccccauuaccacucuuugggaaggaagucccgggaaguuuuggaauacaacuaucgcgguuucgauggcaaauauauucagaggaucuuaccucgccggggcuggacuggcguuuucuauaaugaagucaguugguacggguaaaagaggcacggguucacaaggagaaaccuuaggugaaaaauggaagaagaaacucaaucagcuaagcaggaaggaauuugauuuaaauaagaaaaguggaauaaccgaaguggaucggacggaagcuaaagagggucuuaaaagaggagaaaucacacaucacgccgucucaagaggcucagcaaaacuacaaugguucguagaaagaaacaugguuauucccgaaggccgagucauugaccuuggauguggucgaggcggguggaguuacuauugugcaggucugaaaaagguuacggaaguucggggcuauacuaagggaggaccugggcacgaagaaccaguaccuaugaguaccuacggauggaacauugugaaacuuaugucaggaaaagacguauuuuaucuaccgccugaaaaaugcgacacccuuuuaugugacauaggugagucaaguccaucacccacuguagaggagagcagaacgaucaggguacucaaaauggucgaaccauggcugaaaaauaaucaauucuguauaaagguucuaaacccuuauaugccaacaguuauagaacaucuagaaagacuccaacguaaacacgguggaaugcuuguacgaaauccguuaucgaggaauagcacgcaugaaauguacuggauaucaaaugguacgggaaauauaguggccucgguuaaaaugguuucgagauuacuuuuaaauagguuuacaaugacgcacagacgacccacgauagaaaaggauguagauuuaggcgcaggaacaagacacguaaaugcagaaccggaaacgccaaacauggacguaauaggagaaagaauaaaaagaauaaaagaagaacacaauucuacguggcauuacgaugacgaaaaucccuacaagacgugggcauaucauggaagcuacgaaguuaaagcaaccgggucagcaucgucuaugaucaauggaguuguaaaauuacuaaccaaaccaugggauguggugccaauggugacacaaauggcaaugacugacacaacuccguucggucaacaacggguauucaaagaaaagguggauacccggacaccacgcucaaugcccgggacacggagaguaaugggcauaacugcagaaugguuauggagaacucugggaagaaacaagaaaccgaaacuuugcacaagagaggaauuuacuaagaaagugagaacaaaugccgcuaugggggccguauucacugaagagaaccaaugggauagugcaaaggcugcaguugaggacgaggauuuuuggaaacucgucgaccgcgagcgagaauugcauaagcuggguaaaugcgguagcugcguauacaacaugaugggaaaaagagagaagaaacuaggugaguucggaaaagcaaaaggaucaagggcaauaugguauaugugguuaggagcuagguaucuagaguuugaggcucuuggguuucuaaacgaagaucauugguuuucgagagaaaauaguuauuccggagucgaaggugagggccuucacaaacuagguuauauccuccgagauauaaguaaaaucccugguggagccauguacgcugacgauacagcaggcugggauacucgcauaacagaggaugauuuacauaaugaagagaaaauuacacagcagauggacccagaacauagacaacuggccaaugcaauuuuuaaauuaacuuaucaaaauaaagugguaaaagugcaacgacccacgccgacuggaacaguaauggauauaauaucacgcaaagaucaaagagggaguggccaaguaggaacuuauggcuuaaacacauucacaaauauggaagcucaauuaauaagacaaauggagggggaaggcguuuuaucgaaagcggaccuagaaaacccucaucugccagagaagaaaauaacccaguggcuggaaacgaaagguguagaaagguuaaaaagaauggcaauuucaggagacgauuguguggugaaaccaauugacgauagauuugcaaaugcacuucuagcauuaaacgauaugggaaaaguaagaaaagacauaccgcaauggcagcccaguaaagguuggcacgacuggcaacaaguuccauucuguucacaccauuuccaugaacuaauaaugaaagauggucguaaguuaguuguaccuugcaggccgcaagaugagcugauaggcagagcaagaaucucacagggugcgggcuggaguuugagagagaccgcauguuugggaaaagcauaugcucagauguggucucugauguauuuucacaggcgugaccuuagacuugcaucuaaugcaauauguagcgcgguaccaguccauuggguaccuacuagcagaacuacuuggucuauacaugcacaccaucaauggaugacaacggaggacaugcucacaguguggaauagaguauggauagaggauaauccuuggauggaagauaaaacgccugugacuacaugggagaacgucccguaccuagguaagagagaggaucaguggugcggcagcuuaauuggacuaacgucaagagcgacaugggcgcaaaauauuccgaccgcaauacaacaaguaaggagucuuaucgguaaugaagaguuucuugauuacaugcccaguaugaagcguuuuagaaaggaagaagaauccgaaggugcaaucugguaa

SEQ ID NO: 23035 - RNA, 9873 nt, Artificial Sequence
  derived and/or modified CDS sequence (opt6) from DENV-3__JF808124__SS-prME
accuccuuaugccuaaugaugauauuacccgcagcacuggcauuucaccuaacuucacgagauggagaaccgcgaaugauuguagguaaaaaugaacgagguaaaagucucuuauuuaaaacugcgucaggaaucaauauguguacuuugauugccauggauuugggugaaaugugugacgacacuguaaccuacaaauguccacacauaacugaaguugaaccagaagacaucgauuguuggugcaaucuuacuagcacuuggguaaccuauggaacuugcaaccaggcaggagaaagacgucgagauaaacggucaguagcauuagcaccacauguagguaugggacuagauacuaggacccagacuuggaugucugccgaaggggcuuggcggcaggucgagaaaguagaaacuugggcucuacgacauccuggauucacaauauuagccuuauuccuagcucauuacauagggacaaguuuaacgcaaaaaguugugauuuuuauauuacucauguuaguaacaccaagcaugacuaugcguugcgugggaguaggaaacagagauuuuguugagggauuaaguggugcuacauggguugauguaguguuagagcacgggggaugcgugacaacaauggcuaaaaauaaaccgacccucgauauagaacuacagaaaaccgaagccacacaauuagcaacacuucgaaaauuaugcauagaaggaaaaauuacaaauaucacaacugacaguaggugcccaacgcagggagaagcaguguuaccugaagaacaagaucaaaauuacguuugcaaacauacguacgucgaucggggauggggaaaugggugcggauuguuuggaaaaggcagcuuaguaacgugcgcuaaauuucaaugccuggaaccaauagaagguaaaguaguacaguaugaaaaccugaaauauacggugauuauaacagugcacacaggugaucaacaucaaguagguaaugaaacacaaggugucacagcugagauuacaccgcaagcauccacaacugaagcuauacugccggaauacgguacauucggcuuagaauguaguccacgcacuggucucgauuuuaaugagaugauacuacuuacaaugaaaaacaaagcauggaugguccauagacagugguucuuugacuugccccuaccauggacaucaggcgcaacgacagaaacuccaacuuggaacagaaaagaauuacucgugaccuuuaaaaaugcacaugcuaaaaagcaagaaguaguaguuuuaggcagucaagagggagcuaugcauacggcccuaaccggugcgacagagauucaaaacagugguggaacuucaaucuuugccggacaucugaaauguagacugaaaauggauaaauuggaacuuaaagggauguccuaugcaauguguacaaacacuuucguauuaaagaaagaagugagcgaaacccaacaugguacuauauugauuaaagucgaauauaaaggggaagacgcaccuuguaaaauccccuucucgaccgaagacgggcaaggaaaagcacacaauggacgacucauaacagcgaaucccgucguuacaaagaaagaggagcuaguuaacauugaagcugaacccccauuuggugaaagcaauauaguaauugggauuggugacaacgccuuaaaaauaaacugguauaagaaagguucgucgaucgggaagauguuugaagcuaccgcucguggggcuagaagaauggcuauauuaggcgacacugcgugggacuucgggucggucgggggcguucugaacucuuuaggaaagaugguacaucaaauuuucgguagugcauauaccgcucuuuucaguggagucucuuggguuaugaaaauagguauaggaguacuacuaacauggauaggacucaauuccaaaaauacaagcaugagcuuuucguguauagcaauagguauaauaacccuuuauuugggagcuguugugcaagcugauaugggcugcgugauuaauuggaagggcaaggaacucaagugcgguaguggcauauuuguuacaaaugaaguucauaccuggacugagcaauauaaauuccaagcagauucuccgaaaagauuagcgacugcaaucgcaggagcaugggagaauggaguuugugguauucgaucaacuaccagaauggaaaaccuacuuuggaaacaagucgcaaaugaacuaaacuauaucuuaugggagaacaacauaaaauuaaccgugguuguuggagauaucaucggaguuuuagaacaaggcaaaagaacacuuacaccucagccuauggaacuuaaguauagcuggaagacauggggaaaagcgaaaaucgugacugcagaaacacaaaacaguucuuucauaauugaugguccuaacacaccagaauguccgagcgcuaguagagcauggaacguuugggagguugaagauuauggguuuggcguuuucacaacaaauauauggcugaaacuacgugaaguguacacacaacuuugugaccacagacuaaugucggcggcuguaaaagaugagagagcuguacaugcggauaugggcuauuggauagaaucacagaaaaacgguucguggaaacuagaaaaggcgagcuugauagaaguaaaaacuugcacuuggccuaaaucccauaccuuguggaguaacggaguauuagaaagugacaugauuauaccaaagagcuuagccgggccgauaucacaacacaaccaccgaccuggguaucacacucaaacagcuggaccauggcaccucggcaaacuagaacucgacuucaauuauugugaaggaacgacugucguaauaacugaaaauuguggaacucgagguccauccuuaagaacgacaacggugagcgguaaacucauacaugaaugguguugcagauccugcacccuuccaccuuugagguacaugggcgaagacgguuguugguaugguauggaaauuagacccauuucagaaaaagaagagaauaugguuaaauccuugguaucagcugguucaggaaaaguugauaacuucacgaugggggucuuguguuuggcaauacuauucgaagaaguuaugcgaggcaaauucggaaagaaacauaugauugcuggcguccucuuuacuuguguucuuuuacugaguggacaaauaacuuggcgcgauauggcucauacauuaauaaugauaggcuccaacgccucugauagaaugggaauggggguuacguaucuagcucuaauagccacauuuaaaauacaaccuuuccucgcacuuggcuucuuccuucgaaaacuuacaucucgggaaaauuuauuacuaggaguuggauuggcuauggcuacgacuuuacaacucccagaggauauugaacaaauggguaauggaaucgcguuaggguuaauggcacuuaaacuaauaacacaauucgagaccuaccaauuauggacagcuuuaaucucccucacauguucaaacacuauguucacuuuaaccguagccuggaggacagcuacucuaauccucgccggcguaucccuacuaccaguuugccaauccuccucaaugcgaaaaacagauugguugcccauggcgguggcagcuauggguguuccuccacucccgcuauuuaucuuuucccuuaaagauacucucaaaagacgcucauggccguuaaaugagggugugauggcaguaggucuaguuagcaucuuggcuuccagccucuuacguaacgaugucccaauggcagggccauuggucgcaggcggauuguugauagcauguuaugucaucacaggaacaucagcugaccucacaguagagaaggcggccgauauaacaugggaagaagaagcugagcaaaccggcguaagucacaaccugaugauaacaguagaugacgacggcacaaugagaauuaaggaugacgagaccgagaauauucuuacuguccuauuaaaaacagcacucuugauacuuaguggaguauucccguauucgauaccugccacacuucuaguauggcauaccuggcaaaaacaaacucagagauccggaguccuaugggaugugccaucuccucccgaaacucaaaaggcagaacuagaagaagggguauaucgaauaaaacaacagggaauuuucgguaaaacccagguaggcguuggcgugcaaaaagaaggaguauuucacacuauguggcauguaacaagaggcgcaguguugaccuauaacgguaaaaggcuugagccaaauugggcaucuguaaagaaagauuuaauaaguuauggugguggauggcgucuauccgcucaauggcaaaaaggggaggaaguacaaguaauagcaguugaaccaggcaaaaaucccaaaaauuuucagacgaugccgggcacuuuccaaacuaccacgggggaaaucggagcaauagcacuagauuucaaacccgguacaaguggauccccuaucauaaaucgggaaggaaagguaguuggacuauauggaaacggcgucgugacuaaaaacgguggguauguuucaggaauagcccaaacaaacgcggagccugauggaccaaccccagaguuggaagaagaaauguucaagaagagaaauuuaaccauaauggaccuacacccuggcagugggaagacuagaaaauauuuaccggcaaucguccgcgaagccauuaaaagaagauugagaacauugauccuggcaccuacaaggguaguugcugcugaaauggaagaggcacucaaaggacucccaauuagauaccagacaacagcuacuaaaagcgagcacacagguagagaaauaguugaucuaaugugucaugcuacuuuuaccaugcgguuauuaucgcccguaagaguaccuaauuacaaccuuauaaucauggacgaagcacauuucacugaccccgcaucaaucggggccaggggauauauaagcacgcguguaggaaugggugaagcagccgcgaucuucaugacagccaccccuccuggcacagcagacgcuuucccacagucaaacgcaccuauccaggacgaagaaagagacauuccagaaagaagcuggaacucugguaacgaauggaucacggauuuugccggaaaaacaguaugguucgugccuucaauaaaagcaggcaaugauauagcaaacugccugcguaaaaaugguaagaaaguuauucaauuaaguagaaagacguuugauaccgaauaccaaaagaccaaacuuaaugauugggauuuugucgucaccacagacauauccgagaugggugcuaacuuuaaagccgauagagugauagauccaaggcguugucuuaaaccagugauauuaaccgacggcccagaacgugugauauuagcugguccgaugccugucacagcugcaucagccgcucaaaggcgcggucguguaggaaggaauccucagaaagaaaaugaccaauauauuuuuaccggacagccccugaauaaugaugaagaucaugcgcauuggacggaagcaaaaauguuacuggauaauauaaauacaccagaaggaaucauaccggcuuuguucgaaccggagagagaaaagagugcagccauugauggugaguauagguugaaaggcgaaucaagaaaaacuuucgucgaguuaaugcgacgaggggacuuaccagugugguuagcucauaaaguggcaucugaaggcauaauuuacacagauaggaaguggugcuuugacggucaaagaaacaaccaaauucuggaggaaaacauggauguugaaauauggacgaaagaaggugaaaagaagaaacuucgacccagauggcuugacgcgcgaacauauagugacccguuagcguuaaaagaauuuaaggauuucgcagcagggcgaaaauccaucgcacuugauuuaguuacagaaauagggagagucccaucacauuuggcucaccguacuaggaacgcucuagauaaccugguaauguugcacacaucagaacaugggggucgcgcauaccgccaugcugucgaagaauuaccagaaacaauggagacacuauuguuacugggucugaugauccugcucacaggaggugcaaugcuauuuuuaauuucaggaaagggaauaggaaaaacaaguauuggacugauauguguuauagcaaguucagggaugaguuggauggcggaaaucccccugcaguggauagcaucagccauaguacuugaguucuucaugauggugcuuuuaaucccagaaccagaaaaacaaagaacuccacaagauaaucaacuagcauacgucgucaucggcauccucacucuagcagcuauaaucgcagcgaacgaaaugggucuacucgaaacuacuaaaagagauuuagguaugaguaaagaaccgggaguagucagcccaacaaguuauuuagacguagaccuucauccggcuagcgcauggacucucuaugcuguggcaacaacggugauuacaccaauguuaagacauacaauagaaaauagcaccgcuaacgucagcuuagcugcaauagcuaaucaagcgguuguauugauggggcuugacaaagguuggccuauaucaaaaauggaccuaggaguuccacuauuggcauuaggaugcuauagucaaguaaauccauugacacuaacagcugcaguucuacugcuaauaacacauuaugcaauaauugguccuggacuacaagccaaagcuaccagagaggcccagaagcguacugcggcaggaaucaugaagaauccuacggucgauggcauaaugacaauugaucuugauccgguuaucuacgauaguaaauuugaaaaacaacugggacaagucauguuacugguacucugugccguacaacuucuacuaaugcguacaucgugggcccucugugaggcauuaacacuagcaacaggaccuauaacuacguugugggaagggucaccgggaaaauuuuggaauacaacgauagcgguguccauggccaauaucuuuaggggaucguaccuugcaggagccgggcucgcuuuuaguauuaugaaaucuguagguacaggaaaaagagguacaggcagccaaggggagacuuuaggcgaaaaguggaaaaagaaacucaaccaauuaucacgcaaagaguucgauuuauauaagaaaucuggaauaacugagguagacaggaccgaagcaaaagaaggauuaaaacggggugaaauaacccaucacgcuguaucucgaggaagugcuaaguuacaaugguuugucgaaagaaacauggugauuccagaaggacgagucauagaccugggcugcggaagagggggauggucuuauuauugcgcaggacugaaaaaggugacagaaguucguggauauacuaaagguggaccgggacaugaagaaccaguacccaugucuacauacgguuggaacauuguaaagcuaaugaguggaaaggaugucuuuuauuugccacccgaaaaaugugacacauuauuaugcgauauaggagagucaaguccaucucccacaguugaagagucucguacuauacguguccuaaaaaugguagaaccaugguuaaagaauaaucaauucuguauuaaaguacugaacccauauaugccuacugugauugaacaccuggagagacuacagaggaaacauggaggaaugcuaguacgaaacccauuaucacgcaacuccacgcaugaaauguacuggaucaguaacggaacaggaaacauaguugccucggugaauaugguaaguagauuguuguuaaaccgcuuuacaaugacccauaggcgcccuacaauagaaaaagacguggaccuaggugcgggaacaagacauguaaacgccgaaccggagaccccaaacauggacguaaucggugagcgcaucaaacgaauaaaagaagaacauaauucuacauggcacuacgaugacgagaauccauauaaaacuugggcguaucacggaucuuacgaaguuaaagcuacagggucagcaagcucuaugauuaauggcgucguaaaguuacuaaccaagccaugggacgucguucccaugguaacacaaauggcaaugacggacacaacaccauucggacaacagaggguauuuaaggaaaagguagacacacgaacuccaaggagcaugcccggaacucguagagucaugggaauaacugcagaguggcuauggagaacauuaggucgcaauaagaaaccuagacuaugcacucgagaagaguucaccaagaagguacguacuaaugccgcuaugggagcaguuuuuacagaggagaaccaaugggauucagcuaaagcagcaguagaggacgaagauuuuuggaaacugguugauagagaaagagaguugcauaaacugggcaagugcgggucauguguauacaauaugauggggaaacgagagaagaaacucggugaguucgguaaagcaaagggaaguagagcaauuugguauaugugguuaggagccagauacuuagaguuugaggcuuugggcuuuuuaaaugaagaccacugguucucuagagaaaacuccuacucaggcguagagggagaaggauugcacaaacugggcuacauacuacgagauauaaguaaaauaccuggcggagcaauguacgcugaugacacagccgguugggacacaagaauaacugaggacgaucuccauaaugaggagaaaaucacccagcaaauggaccccgaacaccgucagcuugcuaacgcgauuuucaaauugaccuaccaaaacaaaguuguuaaaguacagagaccgacacccacaggaacugucauggauauaaucaguagaaaagaucaaagaggaucugggcaaguuggaaccuauggacuaaauacuuuuaccaauauggaggcacaacuuauacgacaaauggagggggaaggagucuuaucaaaagccgaucuagagaauccccaucugcccgagaaaaagauuacccaauggcuugaaacgaaagguguugagcgacugaaaagaauggccauaaguggugacgauuguguaguuaaaccaauagaugacagauucgcuaaugcacuacucgcauuaaaugauaugggaaaaguucgaaaagauauaccccaauggcaaccuucgaaggguuggcacgauuggcaacagguaccauucuguagucaccauuuccaugagcucaucaugaaagaugguagaaagcuaguagucccaugcagaccacaggaugaauugaucggacgcgcuagaauaucacaaggagccggauggucacuacgagaaacagccuguuugggcaaagcguacgcacaaauguggaguuugauguacuuccaccgaagagauuuacgucuugcuucaaaugcaauuuguagugcaguuccaguucauugggugccgacgucacgaaccacuuggucuauacaugcacaucaccaauggaugacuacugaagacauguuaacgguuuggaacagaguuuggauugaagauaaucccuggauggaggauaaaacgccuguaacaacuugggagaaugugccuuaccuggguaaaagagaagaucaauggugugggaguuuaauaggacucacaucaagagccacuugggcacaaaacauaccuacugccauccaacaaguuagaucauuaauuggaaaugaagaguucuuagauuauaugcccaguaugaaacgauuccguaaagaagaggaaagugaaggagcgauaugguaa

SEQ ID NO: 23036 - RNA, 9873 nt, Artificial Sequence
  derived and/or modified CDS sequence (opt6) from DENV-3__JF808126__SS-prME
acuagcuugugccuuaugaugauucuaccugcagcgcucgcauuucauuugacaaguagagauggugaaccgcguaugauaguagggaaaaaugaaagagguaaaucacuguuauuuaaaacagccucuggaauuaacaugugcacauuaauagcaauggaccucggugaaaugugugacgauaccguuacauauaaauguccccacaucaccgagguggaaccagaagacaucgauugcuggugcaauuuaacgaguacauggguaacguacgguacauguaaccaagcaggagaacacagaagggauaaaagaucgguugcccuagcaccacauguagguaugggacuagauaccagaacgcaaaccuggaugagcgcagaaggagcuuggcgacaaguagaaaaaguagaaacgugggcccuucggcauccagguuucacaauacuagcuuuauucuuggcucacuacaucgguacaagucuuacccaaaaagucguaauauuuacacuucuaaugcuuguaacccccaguaugacgaugagauguguuggaguaggcaauagagacuuuguggaaggucuuucaggagcaacauggguggauguugucuuggaacauggaggguguguaacaaccauggcuaaaaacaaaccgacccuagacauagaauuacagaaaacugaagcaacucaacuagcgaccuugcgcaaacuauguauagaaggcaaaauuacaaacaucacaacagauaguagaugcccaacccagggcgaagcgguacugccagaagaacaagaucaaaauuacgucugcaaacauaccuauguagaccgaggaugggggaauggaugugguuuauuugguaaagggagcuuaguuaccugugcaaaauuucaaugucuagaaccgauugaaggaaaaguuguacaauaugaaaaucucaaauacaccgugauaauaacaguucauacuggagaccaacaucaaguugguaacgaaacucaagggguuaccgccgaaaucaccccucaagcgucuacuacggaagcuauacugccggaauacggaacccuuggcuuagaaugcaguccucguacgggucuagacuucaacgaaaugauccuauugacaaugaaaaauaaggcuuggaugguccaucgucaaugguuuuuagacuuaccauuaccauggaccaguggugcgacaaccgaaacuccgacguggaacagaaaagaauuguuaguaacauucaaaaacgcgcacgcaaagaaacaggagguaguuguauuaggaucccaagaaggcgccaugcauacugcgcuaaccggugcaacugagauucagaauagcggugggacaucuauauuugcaggacauuugaaaugcagguugaaaauggauaaauuagaauugaaaggaaugaguuaugcaaugugcaccaacaccuucguauugaagaaagaaguaagugagacacagcaugguacgaucuugauaaaaguugaauacaaaggcgaggacgccccuuguaaaauuccuuucucgacagaagacggccaaggaaaagcacauaauggucgcuuaauaacugcgaauccuguuguaacuaagaaagaagaaccgguuaauauagaagcagagccuccguucggagaaaguaacauaguuauuggaaucggagacaaugcuuuaaaaauaaacugguacaagaaaggcagcucaauagggaaaauguuugaagcgaccgccagaggugcgagaagaauggccauauuaggugauacggcuugggauuucggcagcguaggaggcguguuaaacucacuagguaaaaugguacaucaaauauuuggaucggcuuauaccgcuuuauuuucuggaguguccuggguuaugaaaauaggcauaggaguacuguuaacguggauaggucuaaacucuaaaaacaccucuauguccuucucuuguauagcuauuggaauaauaacauuauaucucggugcuguaguacaagcagacauggguugugugauaaauuggaaaggaaaagaacucaaaugcggaagcggaauuuucguuaccaacgaaguacauaccuggacagaacaauauaaauuucaagcagauuccccgaagcgacuagcaaccgcuauagccggugcaugggaaaaugguguaugugguauaagguccacuacaagaauggagaaccuacuauggaaacagauugcaaacgaacucaacuauauauuaugggagaauaauauuaaauuaacggucguagucggagauauaauuggaguauuagaacaaggaaaacguacccuaacaccucaaccgauggagcuaaaauacagcuggaagacgugggggaagucaaagauuguaacagcugaaacucaaaauuccucauuuauaauugauggaccgaauacaccggaaugcccaagugcaucuagagccuggaauguaugggaaguagaagauuacgguuucgggguauuuacaacaaauauaugguuaaaacuuagggagguauacacccaacucugugaucaucgacugaugucagcagcaguaaaggaugagcgcgcuguacacgcagacaugggauacuggauugaaagucaaaagaacgggaguuggaaacuggaaaaagcaagucuaaucgaagucaaaacuugcacauggcccaaaucucauacacuauggucuaaugguguacuugagagugauaugaucauaccaaagucacuagcgggaccuauaagccaacauaaucauagaccaggauaucauacacagacagcaggucccuggcaccuuggaaaacuugaguuagacuucaauuauugcgaagguacaacugucguaaucacugaaaauugugggacucgaggaccggcccuuagaacaacuacaguuucggguaaguuaauacaugaauggugcugucgaucgugcacccuacccccucuacgauacaugggugaagacggauguugguaugguauggagauuaggccuauaucagaaaaagaagaaaacaugguuaaaagucuaguauccgcugguaguggaaaaguagacaacuuuacaaugggaguguuauguuuagccauucuguuugaagaaguaaugagagguaaauucgguaaaaagcauaugauugcuggugucuucuucacuuucguuuuauuguuauccggacagauaacuuggcgagauauggcccauacucuaaucaugauagggucaaaugcauccgauaggauggguaugggaguaacauacuuagcacuaauagcaacauuuaaaauacaacccuuuuuggcauuaggauucuuuuuacgaaaacuaacgagucgugaaaaucuauuguuagguguagggcuggcaauggccaccacgcugcagcuacccgaggacaucgaacagauggcuaaugguaucgcauuaggucucauggcacuaaaauuaaucacacaauucgaaacuuaccaauuguggacggcguuaauuucacuuacguguagcaacacuauguucacccuaacuguagcauggcggacagcaacauuaauacucgccggugugucguuauuacccgucugccaaagcucaucgaugcgcaaaacagacugguugccgauggccguugcagccaugggaguaccaccauuaccguuauuuauuuucagcuuaaaagacacucuaaaacgucguaguugcccauuaaaugaaggcguuauggccguaggccuagugagcauucucgcuucaucacuauuacgaaacgacguuccgauggcggggccauuaguagcgggaggacuucugauagcuugcuaugugauaacggguacgucagcugacuuaaccguugaaaaagcggcggacauaacaugggaggaagaagcugagcaaacuggagugagccauaaccuaaugauaaccguagaugacgacggaacaaugcgcaucaaagaugacgagacagaaaacauacuuacaguuuugcuuaaaacggcucuauuaaucguguccggcguguuucccuauaguauuccggcuacacuacucguauggcacacauggcaaaaacaaacacagcgaagcgguguuuugugggauguuccuagcccaccagaaacacagaaagccgaauuggaagaagguguuuauaggauuaagcaacaagguauauucggaaaaacgcaaguaggcgucggcguccagaaggagggcguauuccacaccauguggcaugucacucgcggugcaguuuuaacauauaaugguaagaggcuagagccgaauugggcgucugucaagaaagaucuaguaucauauggaggaggauggcgauuaagugcacaauggcaaaaaggagaggaaguacaaguuauagcaguagaaccuggcaaaaauccuaaaaacuuucaaaccaugccuggaacauuucaaacaacaaccggagaaauaggagcuaucgccuuagauuucaaacccgguacgaguggaucgccuaucauaaacagagaagguaaaguaguaggauuguacgguaauggaguaguuacgaagaauggaggauacgugucagggaucgcgcaaacuaaugccgaaccagacggaccuacacccgaacucgaagaagaaauguuuaagaaacggaauuuaacaauaauggauuugcauccagguagugggaaaacaagaaaguaccuuccagcuaucgugcgagaggcaauaaaaagacgauuacgcacuuugauucuugcuccgacgcguguaguugccgccgaaauggaagaggcauugaaaggauuacccauuagauaucagacaaccgcuacgaaaagugagcacacaggcagggaaauuguugaucuuaugugucaugcaacauuuaccaugagguuacuaucacccgugcgcguucagaacuacaauuugauaaucauggacgaagcucauuuuacagauccagcgucaauugcagcuagaggauauauuucuacgagaguggggaugggggaggcggcggcaauauuuaugaccgcgacaccacccggaaccgccgaugcuuuuccacaauccaaugcaccuauacaagaugaagagagagauaucccagaacggucauggaacagcggaaaugaauggauaacagacuuugccggaaaaacagugugguuugucccauccauaaaagcagggaaugacaucgcaaauugcuuacgaaagaacgguaagaaaguuauacagcugucucguaaaacauuugauaccgaauaccagaaaacuaaauuaaacgacugggauuuuguugugacaacagacauaucggaaaugggagccaauuuuaaagcugacagaguuauugacccucgucggugcuuaaaaccaguuauccucacagauggaccagagagagugaucuuggcgggaccuaugccuguaaccgcagcaucagcagcucaaaggcggggucgaguagguagaaacccacaaaaagaaaaugaucaguacauuuuuacaggucaaccauuaaauaaugacgaagaccaugcccacuggaccgaagcaaagauguuacuggauaauauaaauacuccugaagguauaauccccgcuuuauucgaacccgaacgggagaaaucagcagcaauugacggagaauacagacuaaaaggagaaucacguaaaacauucguggaauugaugagaagaggagaccucccuguaugguuagcucauaaaguugcaucggaggguaucaaguauacugauagaagaugguguuucgauggucaacgaaacaaucagauauuggaagagaauauggauguagaaauauggacgaaggaaggagagaagaagaaauuacggccacguugguuagaugcaagaacuuacucagaucccuuggccuugaaagaguuuaaagacuuugcagcgggacgaaaaucuauagcacuggacuuagugacugaaauugggagagugccuagucacuuagcucauagaacaagaaacgcacuugauaaccuagucaugcuucacacaagugagcauggcgggagagcauauagacacgccguggaggaacuacccgaaacuauggaaaccuuauuacuguuagguuuaaugauucuacuaacuggcggagccaugcuuuuucuaaucuccggaaaaggaauaggaaaaacaaguaucgguuuaauaugcguaauugcuucuuccggaaugcuguggauggcagaaauaccacuaccauggauagcgucagcgauuguucuggaguucuuuaugaugguauuacucaucccugaaccugaaaaacaacgcacgccacaagacaaucaguuagcauauguaguaauugggauucuuacucuugcggcaauuauagcggcgaacgaaaugggcuugcuugaaaccacuaaaagagauuuagguaugucuaaagaaccuggaguagugaguccaacgucauaucuugauguagaccuucauccugcuagugcguggacacuuuacgcaguggcaacaacugucauuacacccaugcuuagacacacuauugagaacagcacggcgaacguauccuuggcugcaauagcaaaucaggccgucguauuaaugggccuugacaaaggauggccgaucucaaagauggacuuggguguaccuuuacuagcauuaggaugcuacucucaaguaaauccguugacucuaacagcagcaguuuuacuccuuaucacacauuacgccauaauaggcccugggcuacaagcaaaagccacaagagaggcccagaaaaggacugcagcugggauaaugaaaaacccaacaguagacgguauaaugaccaucgaucuggaccccguaauuuaugacaguaaauuugagaaacaacucggacaaguuauguugcucgugcugugcgcaguccagcucuuguugaugaggacgagcugggcgcugugugaggcgcuuacucuugcaacuggcccuauaacuacuuuaugggaggguucucccggcaaauuuuggaacacgacuauagcugugucuauggcaaauaucuuucgggguucguacuuggcuggcgccgguuuggcguucaguauuaugaaaucaguaggaacaggcaaacguggaacagggucccagggggagacauuaggggaaaaguggaaaaagaaauuaaaucaguugucacguaaagaguucgaucuauauaagaaaagugguauaacagagguagauagaacggaagcaaaagaggguuuaaagagaggggaaaucacacaucaugcuguaucacgcggcucagcgaaguuacagugguuugucgagcgaaauauggugauuccggaaggaagggucauagaccuuggcugcgggcgagggggauggucauauuacugugccggacucaagaaaguuacagaagugagaggauauacaaaaggcgguccaggacacgaagaaccaguaccaaugaguacauaugguuggaauauagucaaacuaaugagugguaaagauguauucuaucucccuccagaaaaaugugauacauugcuuugugacauuggcgaaucgucuccuagcccuacaguagaagaaaguagaaccauucgaguacuuaagaugguagagccauggcugaaaaauaaccaauucugcauuaagguacuuaacccauauaugccaacuguaauugaacaccuagaacggcuacaaagaaagcauggagggauguuagugcguaauccccuaaguagaaauucgacccacgaaauguauuggauaucaaauggaacaggaaauauagucgcaucuguaaacauggugucgcgauugcuucugaauagauuuacgaugacccauagaaggccaaccauagagaaggaugucgaucugggcgccggaacucggcacguuaaugcagaaccugaaacuccaaauauggaugugaucggcgaaaggauaaaaagaauaaaagaagaacauaauuccacuuggcacuaugacgacgagaauccuuacaaaaccugggcauaucacgggucuuacgagguuaaagcaacaggguccgcaagcucaaugauaaaugggguagugaaauuacuaacaaagccaugggacgucguccccaugguaacacagauggcuaugacagacacaacuccuuuuggucaacaacguguauucaaggaaaaaguagauacaagaaccccacgcuccaugccuggaaccagaagaguuaugggcauaacggccgaauggcuauggagaacacuaggccguaauaagaaaccucguuuauguacucgugaagaauuuaccaagaaaguacgaacuaaugccgcgaugggugcaguauucacagaagagaaccagugggauagugcuaaggcugcaguggaagaugaggauuuuuggaagcuaguggaucgcgagagagaguuacauaaguuagguaaauguggaucauguguauacaauaugaugggaaagagagagaagaaauugggagaguucggaaaagcuaaaggaucaagagcuauuugguauauguggcucggagcacgguaucuagaauuugaggcccuagguuuccuuaaugaagaucauugguuuucacgagaaaacuccuacagugguguagaaggagaaggauuacacaaacucggauauauucuuagagauauaucaaagauacccgggggugcaauguaugcagaugauacagcuggcugggauacgcguaucacggaagaugauuugcacaaugaagagaaaaucacucagcagauggacccagaacauagacaacuggcuaaugcgauauucaaacugacauaucaaaacaaaguggucaaaguucaacguccuacaccuacaggaaccguaauggacaucauaagucgaaaggaucaaagagggucaggucaaguuggcacauauggguuaaauacauuuacaaauauggaagcacagcucauuaggcaaauggaaggagaagguguacuaaguaaagccgauuuggagaauccacaucucccugagaagaaaauaacacaaugguuagaaacuaaagggguugagaggcucaaacguauggcaauaucaggcgaugacugcguaguaaaaccaauagaugauagauucgcgaaugcccuguuggcucuuaacgacauggguaagguaagaaaagacauaccucaauggcaaccaucgaaaggauggcacgacuggcaacaaguuccuuucugcucacaucauuuccacgaacuuauuaugaaagauggacgaaagcuaguggugccuugucgaccgcaagaugaguugauaggucgagcaagaauaucgcaaggagcaggauggucauugagggaaacggcuuguuuagguaaagcguacgcucagauguggagucucauguauuuccauagaagggauuuaagauuagccucuaaugcuauauguucagcaguuccaguccacugggucccaacguccaggacgacauggagcauucacgcucaucaucaauggaugacaacagaggacauguuaacaguauggaacagaguguggaucgaagacaaucccuggauggaagauaagacacccgucacaacaugggaaaacguuccguaccuagguaaacgagaagaucaaugguguggaucauugauuggccuuacguccagagccacaugggcacaaaacauaccaacagcuauucaacagguuagaucccuuauaggaaaugaggaauuuuuagacuauaugccaagcaugaaaagguuucggaaggaggaggaaagugaaggggcaaucugguga

SEQ ID NO: 23037 - RNA, 9873 nt, Artificial Sequence
  derived and/or modified CDS sequence (opt6) from DENV-3__JF808125__SS-prME
acuucucugugcuugaugaugauauuaccggcugcacuagcauuucauuuaacaaguagggacggugaaccaagaaugauuguuggugaaaacgaacgaggaaaaagucuacuauuuaaaacggcuagugguauaaaucguagaacguuaauagccauggacuuaggagaaaugugugaagaaacugagaccuauaaauguccacauauuaccgaagucgaacccgaagauauagacugcuggugcaaucuaacaaguacuuggguaacuuacggaacaugcaaucaagcuggggagagaagaagagacaaacggagugucgccuuagcgccacacguggguaugggucucgauacacguacccaaacauggaugucggcugaaggugcuuggaggcaaguagagaaaguagaaacgugggcacucagacacccaggauuuacuauacuugcguuauucuuggcacacuauaucgguacaucucuaacacaaaaaguaguaauuuuuauucuuuuaauguuaguuacacccaguaugacaaugagauguguagguguuggaaacagagauuuugucgagggauuaucuggagcaacauggguggaugucguccuagaacacggagguugugucacaacuauggccaaaaauaaaccaacauuagauauugaauuacagaaaacugaagcuacccaguuagcgacacuacguaaauugugcauugagggaaaaauuacaaauaucacaaccgauuccagauguccuacccagggagaagcgguccuacccgaagaacaagaucaaaauuaugucuguaaacauacguacgucgauaggggauggggaaauggaugugguuuauuuggaaaaggaucgcuaguaacgugcgcgaaauuccaauguuuagagccaaucgaaggaaaagucguccaguacgaaaaccuaaaauauacuguaauaauaacuguacauacgggagaucaacaccaagucggcaaugaaacgcaaggagucacugcugaaauaacuccucaggcaaguacaacagaagcgauuuuacccgaauacgguacacucggccucgaaugcagcccuagaacuggguuagauuucaaugagaugauacucuuaacaaugaaaaacaaagcauggaugguacaucgucaaugguucuuugaccuuccucuucccuggacgagcggagccacggcagagaccccaacguggaaucgaaaagaacucuuaguaacauucaaaaacgcucaugcuaagaaacaagaaguagucgucuuagggagccaagaaggugcuaugcauaccgcccuaacuggagccacagaaauucaaaacagcggaggaacaucgaucuuugccggccauuugaaaugcagauugaaaauggacaaauuggaacuuaaaggaauguccuaugcaauguguaccaauaccuuuguacuuaagaaagaaguaagugaaacucaacacggcacuauuuuaaucaaaguugaguacaaaggagaagaugcuccuuguaaaauucccuuuucaacagaggauggacaagguaaagcacauaauggcagacugauuacggccaacccaguugucacaaagaaagaagaaccgguuaacauugaagcagaaccuccauuuggggagagcaauaucguaaucggaauuggugauaaugcucuuaaaauaaacugguauaagaaagguagcuccaucgguaaaauguuugaagcgacagcacggggugcacggcguauggcuauucucggcgauacggcaugggacuucggaaguguaggcggaguuuuaaauucacuggggaaaaugguacaucaaauuuuugguucagcauauacagcuuuauuuucaggaguaucuuggguuaugaaaauaggaauagguguacugcuaaccuggaucggucugaacuccaaaaauaccucaaugagcuucucaugcauagcuauagguauuaucacauuauauuuaggggccguugugcaagcagauaugggaugcgucauaaauuggaaagguaaagaauuaaaaugcgguagcggcaucuuuguaacuaacgagguacauaccuggacugaacaauauaaauuccaggcugauucuccaaaacgccucgcaacagcuauagccggagcgugggaaaauggcguuuguggaauuagaucaacaacuaggauggagaaccuauuauggaaacaaauagcaaaugaauuaaauuauauucugugggaaaacaauaucaaacuaacuguuguaguuggagacauuauagggguacuugaacaaggaaaaagaacuuuaacgccucagccuauggaauuaaaauauagcuggaaaacguggggaaaagcuaaaauuguuacagcggaaacccagaacucuuccuucaucaucgauggucccaacacucccgaaugcccuagcgcaucgagagcuuggaacguaugggaaguagaagauuaugguuucggagucuucacgacuaauauuugguuaaaguugagggaagucuauacacagcucugcgaccaccgucucaugucggcagcuguaaaagaugagagagcuguucaugcagauaugggcuauuggaucgaaucccagaaaaauggaucuuggaaacuagaaaaagccucucuaauagaaguaaaaacauguacuuggccaaagagucauacuuugugguccaauggugugcuggaauccgacaugauuauacccaagucacuagcaggcccaauaucacaacauaaucaccgaccgggcuaucauacgcaaaccgcgggaccauggcaucuuggcaaguuagaacuggacuuuaauuauugcgaggguacaacaguaguaauaacagagaacuguggcacuagaggacccagccuaagaaccacaaccguaaguggaaaacucauacacgaaugguguugcaggaguuguacacugccuccguuaagguacaugggagaggacggauguugguacggcauggaaauaaggccgauaagcgaaaaagaagaaaacaugguuaaaucacucguuuccgcuggaucuggaaaaguugauaauuucaccauggguguuuuaugccuagcgauacuauuugaggaagucaugcggggaaaauuuggcaagaaacauaugaucgccggaguauucuuuacuuuuguccuacuccuuucaggccagauuacuuggagagacauggcacacacgcuuauaaugauaggaaguaacgcaagcgauagaaugggcaugggaguuacauauuuagcauuaaucgccacauuuaaaauacaaccauuuuuagcccucggauucuuucuaagaaaauuaacauccagagaaaacuuacuacuugggguuggauuagcgauggcaacaacacuucaacuaccagaagacauagaacaaauggcgaaugguauagcauuaggacuaauggcacuuaagcuaaucacacaauucgaaacuuaucaauuauggacggcauuaauaagucucacuuguuccaauacgauguuuacguugacuguagcuuggagaacagcaacacuuauucuggccggugucucauugcugccaguuugucaaagcaguaguaugcgaaaaacagauuggcugccgauggcuguagccgcaaugggagucccaccauuaccacucuuuauauuuucccucaaagauacuuuaaaacgccggucauggccuuuaaacgaagguguaauggcagugggccuaguaucuauucucgcuaguucccuacuacgcaacgacguacccauggccggaccgcuaguagcaggaggacucuuaauagcuugcuauguuauaacuggcacguccgcagacuuaacaguagagaaagccgccgauauuaccugggaagaggaagcagagcaaacagguguuucacauaaucucaugauaacgguggacgaugauggaacuaugaggauuaaagacgacgaaacagaaaauauucuaacgguucuguuaaaaacugcgcuuuugauuguaagugguguauucccguauagcauuccagcgacacuguugguuuggcauacuuggcaaaaacaaacccaacggaguggaguacuaugggauguaccaucgccaccagaaacacaaaaagcugagcuugaagaagguguauaccgcaucaagcagcaagguauauuuggaaaaacgcagguagggguugggguacaaaaagaaggaguauuucauacaauguggcacguuacgagaggugcaguauugacauacaauggcaaacgguuggagccaaacugggcaucggucaagaaagaccugauaucaaguggcgguggauggagacuaucggcccaauggcaaaaaggggaagaaguccaagucauagccguggaacccggcaaaaauccgaaaaacuuucagacaaugccagggacauuccagaccacaacuggagagauaggagcuauagcccuagacuucaagccuggcacuagcgguaguccgauaauaaauagggaggguaagguuguagggcuauaugguaacggagucguuacaaagaaugguggauacguaucagguauagcacaaacaaacgcugaaccagauggaccaacuccggagcuugaggaggaaauguuuaagaaacguaaccucacaaucauggaccuucauccaggaagcgguaagacgagaaaauaucuaccggcaauugugagggaagcgauuaagagaagacuaaggacauuaaucuuagcuccgacacgcguaguggcagcagagauggaagaggcacugaaaggauuaccuauacgauaucaaaccacagccacaaaaagcgaacauacaggacgagaaauaguagauuuaaugugucaugcaacguuuacuaugcgucuacugucaccaguacgaguaccaaauuauaauuuaauaauuauggaugaggcucauuucacggauccugcaagcauagcagcuagaggguacauaucaacaaggguaggaaugggcgaagcugcagcaauauuuaugacagcaacgccaccaggaacggcagaugccuucccucaaucaaacgcaccaauacaggaugaggagagagauaucccagaaagaucauggaauaguggaaaugaauggaucacggauuuugcagguaaaaccgucugguuugugccaucgaucaaagcuggaaaugauauugcgaauugcuuaaggaaaaaugguaaaaagguuauccagcugagcagaaaaacuuucgauacagaauaccagaaaacuaaacuuaaugauugggauuucguuguuacuacugauauaucagaaaugggagcgaauuuuaaagcggacagaguaaucgauccacggagauguuuaaaaccaguuauucuaacggaugguccugaaagaguaaucuuagcuggacccaugccuguaacagcagcaagugcagcccaaaggcgagguaggguuggaagaaauccucaaaaagagaacgaucaguauauauuuacaggccaaccucuuaauaaugaugaagaucaugcgcauuggacagaggcuaaaaugcucuuggauaauaucaauacaccggaagggaucauuccagcucucuuugagccagaaagagaaaaauccgcggcaauagacggggaauaccgcuuaaaaggugaaucaagaaaaacauucguagaauuaaugagacgaggugauuugcccguaugguuggcucauaaaguagcuucugagggaauuaaauacacggauagaaaaugguguuucgacggacaacguaauaaucaaauccucgaggaaaacauggacguagagauauggacgaaagagggcgagaagaagaaauuacgcccgaggugguuagacgcuaggacuuacagcgacccauuagcacugaaagaauuuaaggauuuugcagccggaaggaaauccauagcacuagauuuaguaacugaaaucgggagaguccccagucauuuagcucaucgaacacgaaaugcgcuagauaauuugguaauguuacacaccucugagcauggaggacgugcuuauagacacgcaguugaggaacuuccagagaccauggagacacugcuacuuuugagauuaaugauucuacuuacagggggagcuaugcuauuuuuaauuucagggaaagggauaggcaaaacaaguauaggauuaauaugcguuauugcaucaagcggaaugcuuuggauggccgaaauaccauuacaauggauagcaucggcaauaguguuagaguucuuuaugauggucuuauuaauaccugaaccggaaaaacaaagaacuccgcaagacaaucaguuagcguacguuguaauaggaauuuugacccuagcagccauuauagcugcuaacgaaaugggacuuuuagaaacaacgaagcgagauuuagggaugagcaaggaaccugguguaguaagcccuacaucauauuuagacguggacuuacacccugcuagugcguggacauuauaugcaguagccaccacggucauuacaccaaugcuccgacacaccauagaaaacaguacugcuaaugugagucuagcagcaaucgcaaaucaagcagugguuuuaaugggacuugacaagggauggccuauaucaaaaauggauuuagguguccccuuacucgcacucgguugcuacagccaaguuaauccacuaacguuaacggcagcuguacugcuacuaauuacacacuacgcgaucauagggccaggacuucaagcaaaggcaacacgugaagcacaaaaacgcacagcugcugguauuaugaaaaacccgaccguagaugguauaaugacgaucgauuuggauccaguaauauaugauagcaaguuugaaaagcaacuuggacaggugaugcuauuaguacuaugugccguccaacuacuacuuaugcgaacaaguugggcgcuaugugaagcccucaccuuagcaacagguccuauaacgacauugugggaagggagcccgggcaaauuuuggaacacaacaauagcagugaguauggcaaauauuuuccgagguucauaccuagcgggcgcaggcuuagcauucucaauuaugaagucugucgggacuggcaaacgcggaacuggcagucaaggagaaaccuugggcgagaaauggaagaagaaauuaaaucaacucucaagaaaagaauuugauuuauauaagaaaagcgggauaacagaaguagauagaacugaagcuaaagaaggauugaaacggggagaaauuacacaccaugcaguuagucgaggcucugcaaaacugcaaugguuuguggaacggaauaugguaaucccagaagguaggguaauugaucuaggauguggaagaggggguugguccuacuauugugcuggccugaagaaagucacggaggucagagguuauaccaagggagggcccggacaugaggaaccaguuccgaugagcacguacggauggaauauaguaaaacuuaugagugggaaagauguauucuaccucccaccugagaaaugcgacacacuccuuugugauauuggagaaaguuccccuagcccaaccguugaagaaagccgaacgaucaggguccugaagaugguugaaccuuggcucaaaaauaaucaauucuguauuaagguauugaauccauauaugccuacaguuaucgaacacuuggaaaggcugcaaagaaagcauggaggaaugcuuguaagaaacccauugaguagaaacucaacccaugagauguauuggauaaguaacggcacaggcaacauuguagcuagugugaauaugguaucaagacuucuacuaaacagguuuacaaugacucaucgccggccaaccauagaaaaggacguugaucucggugcaggaacgcgucaugucaaugcugagccugaaacuccaaauauggauguaauuggcgagaggaucaagagaauaaaagaagaacacaauucgacguggcauuacgacgaugagaauccguauaaaaccugggcguaccauggaaguuacgaaguaaaggcaacuggcucggcgucgagcaugaucaaugguguuguaaaauuguuaacaaagccaugggacgugguucccauggucacucaaauggcgaugacugauacgaccccguuuggacaacagcgugucuucaaagaaaaaguagauacacgaacuccgagaaguaugcccgguacuaggcgaguuaugggaauuacugcagagugguuauggcguacuuugggacggaacaagaaaccaagauugugcacaagagaagaguuuaccaaaaagguacggacaaacgcagccaugggugcaguauucacagaggaaaaucaaugggauucagcgaaggcggcuguugaagaugaagauuuuuggaagcuaguagauagagagagagaguugcacaaacuaggaaaaugugguucaugugucuauaacaugaugggcaaacgcgagaagaaacuaggagaauuuggaaaggcgaaaggcucaagagcaauuugguacauguggcucggggcucgguaucuagaauuugaggccuuaggauuuuugaaugaagaccacugguucagccgugaaaacucauacaguggaguggaaggagaaggccuucauaaauuaggguacauauuaagggauauaucaaagauuccaggcggugccauguacgccgaugacacagcaggaugggacacgagaauaacagaagaugaucuacauaaugaagaaaagauaacccaacaaauggacccagaacacagacaauuggcgaaugcgauauuuaagcuaacuuaccagaacaaagucguaaagguacaaagaccuacuccaacugguaccguuauggauauaauaucacguaaagaucagcgcggauccggccaaguagguacauauggucuaaacacauucaccaacauggaggcacaauuaauaagacaaauggaaggcgaaggcguccuaucaaaagccgaccucgaaaauccgcauuuaccagagaagaaaauaacacaaugguuggaaacaaagggaguggaaagauuaaagaggauggcaaucagcggggacgauuguguuguuaaaccaauagaugacagguuugcaaaugcacuuuuagcauuaaaugauauggguaagguacguaaggacauaccacaguggcaaccaucaaaaggcuggcaugauuggcaacaagucccguuuuguucccaucauuuucaugaacuuauaaugaaagauggaagaaagcuaguuguccccugucgcccacaagaugaacuaaucggucgcgcucgaauaucucaaggagcugguuggucuuuaagagagacagcaugucugggaaaggcuuaugcucagauguggagucucauguauuuccaucgaagggacuuacgauuggcgucgaaugcaauuuguuccgcuguaccggugcauuggguaccuacgucuaggacaacuuggucaauucaugcucaucaccaauggaugaccacugaagacaugcuaacaguuuggaaccguguuuggauugaagacaacccuuggauggaagauaagacaccaguaacuacgugggagaacgucccauaucuagggaagcgggaggaucaauggugugggucauugaucggacugacuucacgcgcuaccugggcgcaaaauauccccacagccauacaacaggucaggucucugauaggaaacgaagaauuuuuagauuacaugccaaguaugaagcgcuuccgaaaagaagaagaaucugaaggagcuauaugguaa

SEQ ID NO: 23038 - RNA, 9873 nt, Artificial Sequence
  derived and/or modified CDS sequence (opt6) from DENV-3__JF808129__SS-prME
acuucccuuugucugaugaugauucuaccggcggcacuagcuuuccauuuaaccucacgagauggagaaccaagaaugauuguggguaaaaaugaaaggggaaaaucgcuauuauuuaaaacggcuucaggaaucaacaugugcacgcugauagcaauggaccuaggugaaaugugugacgacacugugacuuacaaaugcccccauauaacagaaguggaaccugaagauauagauuguuggugcaauuuaacgucaaccugggugaccuacgggacuuguaaucaagcaggagaacaucggagagacaaaaggagugucgcuuuagcaccucauguaggaauggguuuagauacaaggacccaaacauggaugucagcggaaggagccuggcgacaaguugaaaaaguggaaacuugggcauugagacauccgggauucacgauauuggcacuuuuucucgcacauuacauuggcacaaguuuaacacaaaaaguaguaauauuuaucuuacuaaugcuaguaacaccgaguaugacaaugagaugcgugggaguuggcaacagagauuuuguugaaggacucaguggugcaacauggguugacguuguacuugaacaugguggauguguuacuacaauggccaaaaacaaaccuacauuggacauagaguugcagaaaacagaggcaacacaauuagcaacucuaagaaaacuaugcauugaaggcaaaauuaccaauauuacaacugacucccguuguccaacacaaggagaagcaguccuaccugaagaacaagaucagaauuacguuuguaaacacaccuacgucgauagaggauggggaaacggaugcggacuuuuugggaaagguagcuuagugaccugugcaaaauuccaauguuuagaaccaauagagggaaaaguaguacaauaugaaaaucuaaaauacacggucauaauuacaguucauaccggagaccaacaucaaguaggaaacgaaacacaaggagugacagccgaaaucacaccccaagcaagcacgacagaagcuauacuaccugaauacggcacucuuggauuagagugcaguccacgaacagguuuagacuuuaacgaaaugauucuguuaacaaugaaaaauaaagcauggaugguccaccgccagugguucuuugaucuaccacuaccauggacuucaggagcuaccacagaaacuccaaccuggaauagaaaagaacuucuaguuaccuuuaaaaaugcacaugccaagaaacaagaaguuguuguucucggcagccaggaaggcgcuaugcacaccgcucuaacaggggcuacggaaauccaaaacuccgggggaacaucuauauucgcaggacaccuaaaaugccgauugaaaauggacaaacuagaacuuaaggggaugagcuaugcgaugugcacuaauacguuuguucucaagaaagagguaagcgaaacgcaacacgguacaauacuaaucaaaguugaauacaaaggagaagacgcuccguguaaaauaccauuuucaacggaagaugggcaaggcaaagcacauaauggacgacuaauaacagcaaaccccguagugacuaagaaagaagaaccgguaaauauugaggcagagccaccguuuggagaaaguaauauugucauaggaauuggagauaaugcauugaaaauuaacugguauaagaaagguucaagcaucgggaaaauguuugaagcaacggcaagaggagcucgucguauggcaauacuuggugauacugcaugggauuuugguagcgugggugguguacuaaauucauuaggaaaaaugguccaucaaauuuucgggucagcuuauacggcauuauucucuggagugucauggguaaugaaaauaggaauuggugugcuccucacguggaucggauuaaauuccaaaaauacaucaaugucauuuucaugcauagcaauaggaauaauaacucuauaucuaggagcuguagugcaagcagauaugggaugcguaaucaacuggaaagguaaagaauuaaaaugcggguccggcauauuugugaccaacgaaguacacaccuggaccgagcaauacaaauuccaagcagacucaccuaaaagauuagcaacagcaauagcgggagccugggagaacggaguaugcggaauacgcucuacaacaagaauggaaaacuuauuauggaaacagauugcaaaugaauuaaauuacauacugugggagaacaacaucaaacucacgguggucguuggagacauuacuggcguguuagagcagggaaaaaggacccuuacaccccaaccaauggaauuaaaguauagcuggaagaccuggggaaaggcuaagauugugacagcagaaacgcaaaauucaucauuuauaauugaugggcccaauaccccugaaugucccucagcaucgcgcgccuggaacguuugggaaguagaagauuacggauuugguguuuucacgacaaacaucugguuaaaauuacgugaaguuuauacccaacuuugugaucaucgucuaaugucugcagccguuaaagaugaacgagcaguacaugcagauauggguuauuggauugaaucccagaaaaacggaucguggaaacuggaaaaagccaguuuaaucgaaguuaaaacauguacguggccuaaaucucauacacuguggucaaauggaguacuagaaucggauaugauuauaccaaaaucacuagcagguccgauaucccagcauaaucauaggccaggauaccauacgcaaacugccggaccuuggcauuuagguaaacucgaguuagacuuuaauuacugugaagggaccaccguaguuaucacagaaaauugugguacacgugguccaucccugcguacaacuacaguaagugguaaauugauucaugaguggugcugccgaucguguacauuaccuccauuaagguacaugggugaggauggaugcugguacgguauggagauaagaccuauaagugaaaaagaagaaaauaugguuaagagucucgucagcgcagguucugggaaaguagauaauuguacuaugggaguacucugucuugcaauacucuuugaggacgugaugagaggaaaauuuggcaagaaacauaugauugcuggaguguucuucacuuuuguuuuacuauuaucagggcaaauuacguggagagacauggcacacacccuaauaaugauaggcaguaaugcaucggauagaaugggaaugggaguuacguacuuggcuuuaauagcaacuuuuaaaauacaaccguuucuugcccugggcuuuuucuugaggaaacugacuucucgagaaaaccuuuuacuagggguaggucuugcuauggcuacaacgcuacaacuaccugaagauauagagcaaauggcgaacggaauagcauuaggacuaauggccuuaaaauuaauaacccaauucgaaacuuaccaacuuuggacugcgcuaaucucguuaacauguuccaacacaauguuuacacuuacaguagcuuggagaacugcuacucuaauacuggcaggcguaucacuauugccuguuugucagaguaguucgaugcgaaaaacugauuggcuuccgauggcgguagcggcuaugggcguuccaccacucccguuauuuauauuuucauuaaaggauacauuaaaaagacgaucguggccguugaacgagggugugauggcaguaggcuuaguaaguaucuuagcaagcagccuauuaagaaacgaugugccuauggcaggcccguuaguugcaggcgguuuguugauugcauguuauguaaucacuggaacgagugcagaccuuaccguggaaaaagcagcagauauaacaugggaagaagaagcugagcagacgggagucagucauaauuuaaugacuaccgucgaugaugacggaacgaugcggauaaaagaugacgagacagaaaacaucuugaccguuuuauuaaagacggccuuaacaaucguuucgggaguauuuccauacucgaucccggcuacccuauuaguauggcacacuuggcaaaaacaaacacagagaagugggguacuaugggauguacccucgcccccagaaacacaaaaggcagaacaagaagaaggagucuaccgcauaaaacaacaaggcauauuuggaaagacccagguaggcguaggagugcaaaaagaggguguuuuucauaccauguggcacguuaccaggggagcaguacuuacauacaauggaaaacgauuagaaccuaauugggcaagcguuaaaaaggaucuaauaucauauggggguggguggcgcuuaagugcccaauggcaaaaaggagaagagguccaaguaaucgcaguagaaccaggcaaaaacccuaaaaacuuucagaccaugccuggaaccuuucaaacuaccacaggugaaaucggcgcgauagcacuagauuucaaaccagggacaaguggaagcccaauuaucaacagagaagguaaaguagugggauuauacgguaauggcgucguaaccaaaaacggaggguacguaagcggaauagcacaaacaaaugcggagccagacggaccgacaccugaacuugaagaagaaauguuuaaaaagagaaaucugacaaucauggauuugcacccagggagcgguaaaacaaggaaauauuuaccugccauaguucgugaagcaauaaaacgacguuuaagaacacucaucuuagccccaacacgaguuguugccgcagaaauggaagaggcacucaaaggauuaccuauucgauaccaaacaacugcaacgaaaagcgaacauacagggagagaaauuguugaccuuaugugccaugcgacauucacaaugagguuguuaagcccaguacgaguuccaacauacaaccuaauuauaauggacgaagcucacuuuacggacccagcaagcauagcggcaaggggcuauauuucuacaagaguuggcaugggggaagcggccgcaauauuuaugacugccacacccccugguacugcugaugcuuuuccucaaucaaacgcgcccauacaagacgaagagagggauauaccagagagaagcuggaacagcggcaaugaauggauaacggauuuugcaggaaagacagugugguuuguaccaucaauaaaggcaggaaacgauaucgccaacugucuuagaaagaauggcaagaaagucauacaauuauccagaaaaacauucgauacugaauaccagaaaacgaaauuaaacgauugggacuuuguugucaccacagauauaucagagaugggugcgaacuucaaagcagaccguguaaucgaccccagaagauguuuaaaaccaguaauccuaacugauggucccgaacgcguaauucucgcaggaccgaugccgguuaccgcugccucugcggcacaacgaagaggccguguaggaagaaacccgcaaaaagaaaaugaucaguauaucuuuacaggccagccguugaacaaugaugaagaucaugcccauuggacggaagcaaaaauguugcuagacaauauaaauacaccagaagguaucauuccugcucuauuugaaccggaaagagagaaaagugcugcuauagauggugaauaucgguuaaaaggggaaucuagaaaaacuuuuguagaacucaugagacguggagaucugccaguuugguuggcacauaagguagcuagugaagggauuaaguauacagaccgaaaauggugcuuugauggacaacggaauaaucaaauucuagaggaaaauauggacguagaaaucuggacaaaagaaggagagaagaagaaacuccgucccagauggcuagaugcucgaacuuauagugaucccuuggcacuaaaagaguucaaagauuuugcagcuggucgcaagucgaucgcuuuggaccugguaacugaaauuggacgugucccuucucaccuagcucaucgaacaagaaaugcauuggacaaccuuguuauguuacauacaagugaacacggagggagagcauauagacaugcaguagaagaacuaccugaaacaauggaaacacuacuauuauuaggacuuaugauauuguuaacuggaggggcaaugcucuuucugaucagcggaaaagggauaggaaaaacauccauaggacuaauauguguaaucgcgaguagugggaugcuuuggauggcugaaauaccuuuacaguggauagcuucggcaaucgucuuagaauuuuucaugauggugcuccuuauuccugaaccagaaaagcagagaacaccacaagacaaccaguuagcauacgucguaauaggaauacuaacuuuagcugcgaucaucgcagcaaaugaaaugggacuauuggaaacaacuaagagggaccuugggaugagcaaagaaccaggaguuguuucacccacuucguaucuggacguugaccuccauccagccuccgccuggacguuauaugcaguugcuacuacgguaaucacacccaugcuucggcacaccauugaaaauaguaccgcuaacguaucucuugcagcaaucgcuaaucaagccguaguacucaugggguuggacaaaggauggcccauaaguaaaauggauuuaggcgugccacuacuagcacuggguuguuacagucaggugaauccacuuacacucaccgcagcuguucuauugcuuauaacacauuaugccauaauaggcccuggccuacaagccaaagcgacucgcgaggcccaaaaacgaacagcugccgggauaaugaaaaauccaacggucgaugggauaaugacuauugacuuagaucccgugauuuaugauaguaaauucgaaaaacaacuaggacaaguaaugcuacuggugcugugcgcagugcaacuucuauuaaugcguaccaguugggcuuugugcgaagcucucaccuuagcuacugguccaauaaccacgcuaugggaagggagucccgggaaguucuggaacacuacuaucgcagugaguauggccaauauauucagggggaguuaucucgccggugcuggacucgcauuuagcauaaugaagucaguuggaacuggaaaaagaggcacugguucacaaggagaaacguuaggcgaaaaguggaaaaagaaauugaaccaacuaucucggaaggaguucgauuuauauaagaagaguggaauuacagaaguugacagaacagaggccaaagagggacucaaaagaggugagauaacacaccacgcagugagcagggguagugcuaaguugcaaugguucgucgaacgaaauauggucaucccugaagggcgagucauagauuuaggguguggacgcggggguuggaguuauuacugcgcugggcugaagaaaguaacagaaguaaggggcuauacaaaaggcggaccaggacacgaagaaccggucccgaugucgacguauggcuggaacauugucaaauuaaugagcgggaaagacguguuuuaucugccucccgaaaagugcgauacgcuacuuugugauauaggggaaucuucuccaucgccaaccgucgaagaaucccgaacaaucagaguacuaaaaaugguugagccauggcucaaaaauaaccaauucugcauuaaaguuuuaaacccguacaugccaacagucauagaacacuuagagagacuccaacgaaaacacggaggcaugcuaguaaggaauccauugucgcguaauuccacacacgaaauguauuggauaucuaacggcacagguaacauaguggcuucgguuaauaugguuucucguuuauuauuaaaucguuuuaccaugacacauaggagaccgaccaucgaaaaagauguagaccucggagcgggaaccagacauguuaaugcugaaccugaaacacccaacauggacgucauaggagaaagaauuaagagaaccaaagaggaacauaauagcacuuggcauuaugaugaugaaaacccauacaaaacgugggcauaucaugguaguuaugagguaaaagcaacaggaagcgcuaguucaaugaucaauggaguugugaaacuucugacaaaaccaugggauguagugccuaugguaacucaaauggcuaugacagacaccacaccuuuugggcaacaacgcguguucaaggaaaaaguagauacaaggacgccuaggucaaugccuggaacccgcagaguuaugggaauuacugcagaaugguuauggcgaacacucggcaggaauaagaaaccacggcuuuguacacgagaggaauuuaccaagaaaguaaggacuaaugcggcgaugggagcuguuuuuacugaagaaaaucaaugggauuccgcaaaagcagcagucgaggaugaagauuuuuggaaacugguggaucgagagagagaacuacauaaacuggguaaaugcggauccuguguguacaacaugauggggaaaagagagaagaaacucggagaguucggaaaagcaaaaggaagcagagccauuugguauauguggcucggagcacgauaccuagaguuugaggcacuuggauuuuuaaaugaggaucauugguuuagcagagaaaauagcuauucuggaguugagggcgaagggcuccacaaacuuggauauauacuacgugauauaucgaaaaucccugggggcgcuauguacgcagacgauacagcaggaugggacacaaggauuacugaagaugaucuucauaacgaagagaagauaacucaacaaauggacccagaacaccgacaacuagcaaaugccaucuucaagcuaacguaccaaaauaaagugguaaagguacaaagaccaacccccacuggaacgguaauggauauaaucucucggaaagaucagcgagguucuggccagguaggaacguauggacuaaauacuuucacgaacauggaagcucaauuaauaagacaaauggagggagaagguguauuaagcaaagcagauuuggaaaauccacauuugccggagaagaaaauuacacaaugguuggaaacuaaagguguagagagacucaagagaauggcuauaagcggugaugacugcguagugaaaccgauagaugaucguuuugcaaaugcgcugcuugcacuaaaugauaugggaaaggugagaaaggacaucccacaauggcaaccaucaaaagguuggcacgauuggcaacaagugccuuucugcagccaucauuuucaugaguuaauuaugaaagacgggagaaaacuuguaguaccgugucgaccacaagaugagcuuauaggacgugcuagaauaagucaaggggcuggcuggagucucagagaaacggcaugucuugggaaggcuuaugcccaaauguggucauugauguacuuucaccgucgcgaucuaagacuagccucuaaugcuauauguucggcaguaccaguccauugggucccuacgucacgaacuacauggucaauacaugcacaccaccaguggaugaccacagaagacauguuaacuguuuggaaucgagucuggauugaagauaacccuuggauggaggauaaaacuccagugaccacgugggaaaacgugccauauuuggguaagagggaagaccaauggugcgguagucuuauaggacuaacaaguagagcaacaugggcccaaaauauacccacugcgauucaacaaguccggucacucauagguaacgaggaguuucuugauuauaugccauccaugaagcgauuuagaaaggaagaagaauccgaaggagcuauaugguaa

SEQ ID NO: 23039 - RNA, 9873 nt, Artificial Sequence
  derived and/or modified CDS sequence (opt6) from DENV-3__JF808123__SS-prME
acuucacuuugccuaaugaugauauugccugccgcgcuggcauuucacuugaccucgcgcgauggggaaccuaggaugauuguagguaaaaaugaaagagggaaaucacuauuauucaaaacggcaucagguauaaauauguguacucuaauugcaauggaucuuggggaaaugugcgaugacacugugacguauaaauguccucacauaacggaaguagaacccgaagauauagauuguugguguaaccuaacgucgacauggguuacauacggaacuugcaaccaagcaggagaacggagacgggacaaacgauccguagcacuugcaccacauguggguaugggacuggauacuagaacacaaacauggaugagcgccgaaggagcauggagacaaguagaaaaaguagaaacaugggcauuaagacacccaggauucacaauacuagcauuauuuuuagcucacuauauuggaacuucacuuacucaaaaaguugucauauuuauucuucugaugcuagugacacccucuaugacgaugcgaugcguaggaguuggaaauagggauuucguagaaggucuauccggagcgacguggguagauguaguacuugaacauggggguuguguaacaacaauggcuaaaaauaaaccuacacuugauauagaauuacagaaaacugaagcaacacaccuugcaacucuaagaaaauuaugcauagaaggaaaaauuacaaauaucacaacagacucacgauguccaacacaaggugaagcagugcuuccagaagaacaagaccaaaacuacguuuguaaacauacguauguggaccgcgguugggguaauggcuguggucuuuuuggaaaggggucucuaguuacuugcgcaaaauuccaaugcuugggaccaauugagggaaaaguuguacaauaugagaacuuaaaguacacgguuaucauuacagugcacacgggagaccaacaccaaguaggaaaugagacacaaggaguuacagcagaaauuacuccucaagcaucuacaacagaggccaucuuaccugaauacgggaccuuaggacuagaauguucaccaagaacaggauuggacuuuaaugaaaugauacuuuuaacaaugaagaacaaagcguggaugguccacaggcaaugguucuucgaucugccuuugccauggacaaguggagcuacaaccgagaccccgacauggaaucgaaaagaacuucuugugacauuuaaaaaugcacaugcgaagaaacaagaaguuguaguacugggcagucaagagggagcuaugcauacagcucuaacuggugcuacagagauucaaaauucgggaggaacaaguauauucgccgggcaccuaaaaugccgauugaagauggacaaacucgaacuuaaaggcaugucauaugcuauguguaccaauacuuuuguguuaaagaaggaagucagcgaaacccaacauggcaccauacuuauaaaaguagaguauaaaggagaagaugcucccuguaaaauuccguuuaguacagaagauggacaaggaaaagcacauaacggaagacuaauaacggcaaacccugucgucacaaagaaagaagaaccuguaaauauugaggcggaaccaccuuuuggugaaaguaacauagugauuggaacaggagacaacgcauuaaaaauaaauugguauaagaaagguucaucuauugggaagauguuugaggcuacagcccguggcgcacgacguauggcuauuuuaggugauaccgcuugggacuucgggucggugggagguguacuuaauuccuuggggaaaaugguccaucaaauuuucggaagcgcguacacagcauuauucaguggcgugucauggguaaugaagauaggcauaggaguuuuacuaacuuggauaggccugaacucaaagaacacaucaaugaguuuuagcugcauugcaaucggcauaauaacucuauaucuuggagcaguagugcaagcggauaugggaugugucauuaacuggaaaggaaaggaacuuaaaugcgggucuggaauuuuuguaacuaacgaaguacauacauggaccgaacaauauaaauuccaagcggauucacccaaaagauuagcaacggcuaucgcgggugccugggaaaacggaguaugcggcauuaggucaacaacaagaauggaaaaucuuuuauggaaacaaauagcaaaugaauugaacuacauccucugggaaaacaacauuaaauuaacuguagugguaggugauauaaucgggguucuagagcaaggaaagagaacuuuaacuccacaaccaauggaacucaaauacucuuggaaaacuuggggaaaagcuaaaauaguuaccgcugagacacaaaacagcucauuuauaauagacgggccuaacacgccugaauguccaucagcaagccgggcauggaauguaugggagguagaagacuacggauuugguguauuuaccaccaacauuugguuaaaacuccgggaaguauauacccaacuuugugaucauagacuuaugagugcagcugucaaagaugagagagcuguccaugcggacaugggauauuggauagaaucacagaaaaaugguagcuggaaacuugaaaaagcaucgcuaauagaaguaaaaacauguacauggcccaaaucacauaccuuauggucaaauggcguucuggaaucagacaugauaauuccaaaguccuuagcaggcccaauaucccaacacaaccauagaccaggcuaccacacacaaacagcuggaccuuggcaccugggaaagcuagaauuagauuuuaacuauugugaagggacuacugucguuauuacugaaaauuguggcacacgggggcccagccuaagaacaacgacuguaucgggcaaguugauucacgaaugguguugccggucguguacacuuccaccacugagauauaugggcgaagacgguuguugguacgguauggagauaagacccauaagcgagaaggaagagaacaugguuaagucccuuguaucugccggaucaggcaagguagauaacuucacgaugggaguauuauguuuagcaauacuuuuugaagaaguaaugagaggaaaguucgguaagaaacauaugauugccggcguauuuuucacuuucguguuguuauuaaguggacaaaucacauggcgagauauggcgcacacguuaauaaugaucggaucuaaugcaagugacaggauggguaugggaguuacuuaccuggcauugauagcuacuuucaaaauucaacccuuccuugcccuuggauucuuuuugaggaaacuaacaucucgagaaaaccuucugcuugguguagguuuggcaauggccacuacccuacaauuaccugaagacauagaacagauggcaaacgguaucgcauuaggcuuaauggcacuaaaguuaauaacucaauucgaaacauaccaacuuuggaccgcuuuaaucucacuuacguguaguaauaccauguucaccuuaaccguagcuuggcggacugcgacauugauauuagcaggagugucucuauuaccggucugucaaucaaguucaaugaggaaaacagauuggcuaccuauggcagucgcugcgaugggaguacccccgcuuccucuauuuauauuuagucuuaaagauacacuaaaaagacgaucuuggccuuugaaugaaggaguaauggcggucggccuagugucaauucuagcaaguucgcuauuaagaaaugauguaccuauggcaggccccuuggucgcuggcggacuguuaaucgcguguuauguaaucacuggcacaagugcagaccuuacuguagaaaaggcggcagacauuaccugggaggaggaagcugaacaaacgggggucucucauaaccucaugauaacgguugaugacgacgguacuaugagaauaaaagaugacgaaaccgagaacauacuuacaguuuuacucaaaacugcguuacuaauuguaaguggggucuuuccauauuccauaccagcaacccuacucguguggcauacauggcaaaagcaaacgcagagaagcgguguauuaugggacgucccuucaccaccagaaacccaaaaagccgagcucgaagaaggcguguauagaauaaaacaacaggggauauuuggaaaaacucaaguuggaguuggaguucagaaggaaggaguuuuucauacuauguggcaugucacaaggggugcuguacucacguauaacgguaaacgacuugaaccaaauugggcgucagucaagaaagacuuaauaaguuacgguggcggcuggcgcuugucagcucaguggcaaaaaggugaagagguucaaguaauagcaguugaacccgguaaaaacccaaagaauuuccaaacaaugccuggcaccuuucaaacaacaaccggagaaaucggagcaauagcgcuagauuucaaaccagguacaucaggguccccgauaauuaaucgagagggcaaaguugucggucuguaugguaauggaguuguaacuaagaacgggggauacguuucgggaauugcucaaacaaaugcagaaccggaugguccaacaccugaacuagaagaagaaauguucaagaaaagaaaucugacaauuauggaucugcaucccgguucggguaaaaccagaaaauaccuaccugcaauuguacgggaagcgaucaaaagaaggcucaggacacuuaucuuggcgccaacccgggugguagcagcugaaauggaggaggcuuugaaaggacuacccauaagauaccaaacaacugccaccaagucagagcacacugggagagaaauaguagaccucaugugccaugcaacuuucacgaugagacuauuaagucccguacguguaccaaauuacaauuuaauuauaauggaugaagcgcauuuuacagauccagcaagcauugcggcucgugguuauauaucuaccagaguagggaugggggaagcagccgcuauauucaugacggcaacgccuccuggaacggcagaugcuuucccacaaucaaacgcaccuauacaggaugaagaacgagacauaccagaacgaaguuggaacucaggaaaugaguggauuacagacuucgcagguaagacagugugguuuguaccuaguaucaaggccggcaaugauauagcaaauugcuuaagaaagaacggcaagaaaguuauacaguuaaguagaaagacauuugauacggaauaucagaaaacgaaauuaaaugauugggacuucgucgucacaaccgauauaagugaaaugggugcaaauuucaaagcugacaggguuauugauccuagaaggugcuugaagccuguaauacuuacagaugguccggaaagagucauauuggcagguccaaugccaguuacagcugcaagugcugcgcaaagacguggacgagucgguagaaauccccagaaagaaaacgaccaauacauauucacaggccaaccacugaauaacgaugaggaccaugcacauuggacagaagcgaaaaugcuccuagauaacauuaauacuccagaagguaucauaccagcucucuuugaaccugagagagagaaaagcgcugccauugauggagaauacagguuaaaaggagaaagcagaaaaacguucguagagcuuaugcgacguggugaccugccaguuuggcuugcacauaagguggcaucugaagguaucaaauacacggacagaaaguggugcuuugauggucagcguaauaaucaaauacuagaggaaaacauggauguagaaauauggaccaaagaaggagaaaagaaaaagcuaagaccucguuggcuugacgcccgcacauacuccgauccucucgccuuaaaagaguucaaggauuuugccgcaggaaggaaaucaauagcacucgacuugguuacagaaauugguagagucccaucccaucuagcucacagaacuagaaaugcucuagauaaucuggugaugcuacacacuuccgaacauggagggagagcuuaccgacacgcuguagaagaauuacccgaaacgauggaaacucuacuccuauuaggacuuaugauauuacugaccgggggagcuauguuauuuuuaauaucugggaagggcauaggcaagacgucaauaggcuugauuuguguaauagcaaguuccggaaugcuauggauggcagagauuccauuacaauggauugcaucugcaauaguguuggaguucuuuaugaugguacucuuaauuccugaaccagaaaaacaacgcacaccucaagacaaccaauuagccuaugucgucauugguauccuuacccucgccgcuauaaucgcagcgaaugaaaugggucuccucgaaacaaccaagagggacuugggaaugucuaaagaaccaggaguaguuucuccuacaaguuauuuagauguugaccuucaucccgcuagugccuggacucuauaugcgguggcaaccacaguaauaacaccgauguuacgacauaccauagaaaacaguacagcuaaugucagccuagcagcuaucgcaaaucaagcuguaguuuuaaugggguuagauaaaggguggccgauaucuaagauggaccucggcgugccccuauuagccuuggguuguuauucucaagugaauccgcuuacccuaaccgcugcuguucuauuacuuauaacacauuacgcgauuauaggaccgggccuacaagcgaaagccacccgagaggcucagaaaaggacugcagccggcauaaugaaaaaucccaccguagacgggaucaugaccauagaucucgauccggugaucuaugauaguaaguuugaaaaacaacuuggacaaguuaugcuccuaguauugugcgcaguacagcuacuguugaugaggacuuccugggcacuuugugaggcucuuacauuggccacgggcccgaucacaacauuaugggaaggaaguccuggaaaauucuggaauacuacuauugcgguuaguauggcaaauauauuuagagguucuuauuuggcaggagcagguuuggcguucucaauuaugaaaaguguugguacgggaaaaaggggaaccgguagccaaggugaaacgcuaggggaaaaguggaaaaagaaauugaaccaauuaucaagaaaagaauuugauuuguauaagaaaagcggaauaacagaaguggauaggacagaagcaaaagaagggcuuaaaagaggggaaauuacgcaccacgcgguaagcagagguagugcgaaauugcaaugguuuguugaaagaaacaugguuauuccagaggguaggguaauagaccuggguugcggaagaggugguuggucuuauuacugugcuggauuaaagaaaguaaccgagguucgcggcuacacgaaaggugggccaggccaugaggaaccuguuccuauguccacauaugguuggaauauaguuaaacuuaugagcgguaaagacguauucuacuuaccaccagaaaaaugugacacauuacugugugauauuggcgaaucuucaccuucucccaccguggaagagucucgcacaauuagaguauuaaaaaugguagaaccguggcuuaaaaauaaccaguucuguauuaaaguacuuaacccauauaugccaacggucaucgaacaucuugaaagacuacaacgaaaacacggaggaauguugguaagaaauccauuaaguagaaauucaacgcaugaaauguauuggauuaguaaugguacaggaaacauugucgccagugugaacaugguaagcagauuauugcuaaaccguuuuaccaugacccauagacgucccaccauagaaaaagauguggauuuaggagcgggaacucgccaugucaaugcggaaccugagacuccgaauauggauguuauaggagaacgcauaaaacgaauaaaagaagaacauaacaguaccuggcauuacgacgaugaaaaucccuacaaaacaugggcguaccauggaagcuacgagguuaaagcuacagggucggcauccucaaugauuaauggaguggugaaguuauuaaccaaaccuugggacgucgucccaauggugacccaaauggcuaugaccgacacgacuccauucggccaacaacgagucuuuaaagaaaaagucgauacuagaacuccacguucaaugccaggaacuagaaggguuaugggaauuacugccgaguggcuuuggaggacucuaggacguaacaagaaaccgcgucuuuguacuagagaagaguucacgaagaaaguacgaacaaaugcugcaaugggugcggucuuuacagaagaaaaucaaugggauucagcuaaagcggccguugaggacgaagauuuuuggaagcucguagauagagaacgugaacuucacaaguuaggcaagugcggaucaugcguuuacaauaugaugggaaaaagagagaagaaacugggugaauuuggcaaagcaaaaggaaguagagccauaugguauaugugguuaggugcucgcuacuuagaguucgaagcacugggauuuuugaaugaagaccauugguuuucgagggaaaacucauauaguggugucgaaggugagggauuacacaaauuaggauauauuuugcgugacauaagcaagauuccuggaggggccauguacgcggacgacacagcuggaugggauacgagaauaaccgaagaugaccuccauaaugaagagaagaucacacaacaaauggacccggaacaucgacaguuagcgaaugcuauauuuaaauuaacguaccaaaauaaaguuguuaagguacaacgaccuacuccaacuggaacgguaauggacauaauuucaagaaaggaccaaagagguucgggacaaguuggaacguauggccuaaauaccuuuacaaauauggaagcucaacuaauacggcaaauggagggggaggggguauugucuaaggcagacuuagaaaauccacauuuacccgagaagaaaauuacccaaugguuggaaacuaagggaguagagagacuaaaaaggauggcaaucaguggagaugauuguguaguuaaacccauagacgaucgauuugcuaacgcucuauuagcacucaacgauaugggcaaaguuagaaaagauauaccccaguggcagccaaguaaaggauggcaugacuggcaacaagucccuuucugcagccaucacuuucaugaguuaauaaugaaggauggcaggaaauuaguuguaccaugcagaccccaagacgaauugaucggcagagcccguauuucccaaggagcuggauggucauuacgggaaacagcaugcuuaggaaaggcauacgcgcaaauguggagcuuaauguacuuccauagaagagauuuaagauuagccagcaaugcaaucugcucggcgguaccaguccacuggguaccgacaucucguacgaccuggagcauacaugcccaccaccaauggaugacaacagaagacauguugaccguauggaauagaguguggaucgaagauaacccguggauggaagacaaaacuccagucaccacaugggaaaacguaccuuaccuugguaagagagaggaucagugguguggcuccuugauagguuugacgucccgagcuacgugggcacaaaacauuccuacugcaauucaacaagugcgcucguuaauugguaaugaagaguuucuugacuacaugccaaguaugaagagauuuagaaaggaagaagaaagcgaaggagcaauaugguga

SEQ ID NO: 23040 - RNA, 9873 nt, Artificial Sequence
  derived and/or modified CDS sequence (opt6) from DENV-3__JF808128__SS-prME
acgucccucugucuuaugaugauacuuccagcagcucucgcauuucaucucacuagcagagacggggaaccgcgaaugauagugggcaaaaacgaacguggaaaaucuuuacuguucaaaacugcaucugggauuaauauguguaccuuaaucgcaauggaccuuggagaaaugugcgaugacacuguuaccuauaaauguccacacauaaccgaaguagaaccggaggauaucgacuguugguguaaccuuacaagcacuuggguaacguacggaacuugcaaccaagcaggggaacacagaagagacaaacgcaguguagcauuagcgccgcacguagggauggguuuggacacacgaacgcaaacuuggaugucugcggagggagcuuggagacaagucgagaaagucgaaaccugggcgcuccgucacccaggauucacgauccuagcauuauuuuuagcgcacuacauagguacuuccuuaacucaaaaaguaguaauauuuauucuacuaauguuagucacaccaucaaugaccaugcguugcguaggugucggcaauagagauuuuguagaaggccuaucgggugcuacuuggguugauguggugcuggaacauggagggugcgucacaaccauggcuaaaaacaaaccaacuuuggauauugaauugcagaggacugaagcgacacaacuugcgacgcucaggaaauugugcaucgagggaaaaauaacuaauauaacgacugauagcagaugcccgacucaaggagaagcgguuuugccagaagaacaagaccaaaauuauguuuguaaacacaccuauguugauagaggaugggguaauggauguggauuauuuggcaaaggaagucuuguaacaugugcaaaauuucaauguuuagaacccauagagggaaaaguagugcaguaugaaaaccucaaauauaccguaauaaucacagugcauacaggagaucaacaccagguagggaacgaaacacaagggguaacagccgaaauaacgccgcaagcaucuacgacugaagcaaucuugccggaguacggcacucuaggucucgaaugcagcccacggacaggacuagauuucaaugaaaugauacuccuuacuaugaaaaacaaagcauggaugguacauaggcaaugguuccuugacuugcccuuaccauggacaucgggugccacuacugaaacuccaacuuggaacagaaaagaguuacuuguaacguuuaaaaacgcccacgccaagaaacaggaaguugugguacugggaucacaagaaggcgcaaugcauaccgcgcuuacgggugccacugaaauacaaaauucugggggaacuagcaucuucgcgggccacuugaaaugucgacuaaaaauggacaaacuagaacucaaaggaaugaguuaugcaauguguacaaacacauuuguuuugaagaaagaaguaucagaaacucagcacgggaccauccucauaaaaguagaauauaaaggagaagacgcaccaugcaaaauaccuuuuagcacggaggauggccaaggaaaagcacacaauggacgauuaauuacagccaauccgguaguuaccaagaaagaagaaccaguaaauauagaggcugaaccuccguucggggaaucuaauauagucauuggaauaggagauaacgcacuuaaaauuaauugguauaagaaaggaucuuccauuggcaaaauguuugaagcuacagcaaggggagcaaggagaauggcgauauugggugacacugcuugggauuucgggagcgugggaggcguacucaacucuuuaggaaaaauggugcaucaaauauucggcucugccuauaccgcacucuuuaguggcguaucaugggucaugaaaauagguauaggaguuuuguuaacuuggaucggacuaaauagcaaaaauacaaguaugagcuuuagcuguauugcgauaggaauaauaacucuauacuuaggcgccguuguucaagcggauaugggcugcguaauaaacuggaaagguaaagaacucaaauguggauccgguauauuuguuacaaaugaaguacacacuuggacggaacaauacaaauuccaagcugauagcccuaaaagguuggcaaccgccauagccggggcaugggaaaauggcgugugcggaauccgaucaaccacccggauggaaaauuuacuauggaagcaaauugcaaacgaacuaaauuacauuuugugggaaaauaauauaaaauuaacagucguugucggcgauauuauaggagucuuagaacaaggcaaaagaaccuuaacuccgcaaccuauggaacugaaauauucauggaagacuugggguaaauccaaaauagucacugccgaaacacaaaacucuagcuuuauaauagauggacccaauacaccagaauguccaucagcaagccgagcauggaauguaugggagguugaagacuacggauucgggguuuucacaacaaauauuuggcugaaauuaagggaaguauauacgcaauuaugugaccaucgacuaaugucagccgcuguuaaagaugaaagggcaguacaugcugauaugggcuauuggaucgagucucaaaagaauggaucauggaaguuggaaaaggccucacucauagaagugaaaacauguacauggccgaaaucacauacuuuaugguccaacggaguacuugagucagauaugauaaucccaaaaagccuugcgggaccgauaagccaacauaaucauagaccaggguaucacacacaaaccgcaggaccauggcauuuaggaaaguuagaacuagauuuuaacuacugcgaagggacuacuguggugauaacagaaaauugcgguacucgugggccggccuuaagaacaacaacagucucuggaaaguuaauacaugaauggugcugucgcagcuguacauuaccuccucugagauacaugggagaagaugguuguugguaugggauggagauacgaccaauaucugaaaaagaagagaacaugguaaaaucuuuaguauccgcaggcucgggaaaaguggacaacuucacaaugggcguacuuugccucgcaauccuguuugaggaaguaaugcgagguaaauucgguaagaaacauaugauugcuggaguauuuuucacauucguuuuauugcuaagcgggcagauuacguggcgugacauggcacauacauugauuaugauaggaucgaaugcuagugacagaaugggaaugggagucaccuaucuggcauugauugcuaccuucaaaauacaaccauuuuuggcucuuggauucuuucuaagaaaauuaacuuccagagaaaauuuauuauuaggaguaggucuagccauggcuacuacuuuacaacuaccugaagacaucgagcaaauggcaaaugguaucgcauuggguuuaauggccuuaaaguuaaucacacaauuugaaacguaucagcuguggacagcacuaauaagucugacaugcucaaauacgauguucacccuuacugucgcguggagaacagcgacacuaauucuagcaggagugagccuucugccugucugucaaucaucgucaaugagaaaaacagacuggcucccaauggccguugccgcaaugggcguuccgccauugccgcuauuuauauucucacuaaaagauacauuaaaacggcgcucguggccucugaaugaggguguaauggcagugggauuaguaagcauucucgcuaguucacuauuacggaaugaugugccaauggcuggcccuuuaguugcugguggucuuuuaauugcuuguuaugucauuacugguacuucagcugaucuaacggucgaaaaagcagcagacauuaccugggaagaagaagcagaacaaacagggguaagucacaaucucaugauuacgguagaugaugacgguaccaugcgcauaaaagaugacgaaaccgaaaacauuuuaacagugcuuuugaaaacagcucuuuuaaucguuucggggguguuuccauauagcauaccagcuacuuuauuaguguggcauaccuggcagaaacaaacucaacgaagugguguucuuugggaugugccgaguccgccagaaacacaaaaggcggaauuagaagaaggugucuacagaaucaagcaacagggcauauuuggaaaaacucaagucgggguagggguacaaaaagaaggagucuuccacaccauguggcaugugacgcggggagccguacuaacauauaacgguaagagacuugaacccaauugggcgagugucaagaaagacuuaguaucuuacggugguggguggcgacuaucugcccaguggcaaaagggugaggaaguucagguuauagccguagaacccggcaaaaaucccaaaaauuuccaaacaaugccagguaccuuucagacaacaaccggcgaaauuggagccauagcgcuggacuucaaacccggaacuucugggucaccaauuauuaaucgugaagggaaaguuguuggacuguacggcaauggaguuguuacuaaaaacggaggauauguaagcgguauagcacagaccaaugcugaaccagauggaccgacgccagagcuagaggaagagauguuuaagaaacgcaauuuaacuauaauggaucuacauccagguucgggcaaaacacguaaauaccuuccagccauaguucgggaagcaauaaaaagaaggcugagaacccuuauauuagcaccaacaaggguaguagcagcugaaauggaagaggcuuuaaagggacucccaaucagauaccagacaacagcaacaaagucagaacacaccggacgagagaucguggaucuaaugugccacgccacguucacaaugcgguuacuuucaccugucagaguaccaaacuacaaucucauaauuauggacgaagcucacuuuacagauccggccaguauugcagcaagaggcuacauuucuacacggguugguaugggagaagcggcagcuaucuuuaugacugcaacaccgccaggaacagccgaugcauuuccacaaaguaaugccccuauucaagacgaggagagagauaucccagaacgaagcuggaauagugggaacgaauggauaacagacuucgcgggaaaaaccguaugguucgugccgucaauuaaggcagguaaugacauugcuaauugucuuaggaaaaacggcaaaaaggucauucaacuuuccagaaaaacauuugauaccgaauaucaaaagacaaaauuaaaugauugggauuucgucgugacuacagauauauccgagaugggcgcuaauuuuaaagccgacagaguaauagauccacgcagaugccuaaaaccagucauauugacugauggacccgagcggguaauauuagcggguccaaugccaguuacugcggcaagugcagcccaaagaagagguagagugggcagaaauccacagaaagagaacgaccaauacauuuuuacaggucagccucucaauaacgacgaagaccacgcgcauuggacagaagcaaaaauguuguuggacaacauaaauacgccagaagguauaauaccagcacuuuuugaaccugaacgggaaaagagcgccgcgaucgauggggaauauagacuaaaaggcgaaucaagaaaaacauuuguagaguuaaugagacgaggugaucuuccggucugguuagcacacaaagucgcuuccgaaggaauuaaauauacagacagacgaugguguuuugacggucagagaaauaaucaaauuuuagaagaaaacauggauguagaaauauggacaaaagaaggagagaagaagaaauuaagaccaagauggcucgaugccagaacauauucggacccucuagccuugaaagaauuuaaagacuucgccgcaggccgcaaaagcaucgcacuagaccuugugacugagaucggaagaguccccucccaucucgcacacagaacacgaaacgcauuagauaauuugguaaugcugcacacaucugagcacgguggccgggcguaccgccacgcaguugaagaacuuccagaaacuauggaaacauugcugcuucuuggccuuaugauuuuacuaacgggaggugcgauguuauuucugauuucgggcaaagguauuggaaaaacaaguauaggauugaucugcgucauugcaucuaggaguaugucuuggauggcagaaauuccacuucaauggauugccuccgcaauaguacuagaguucuucaugaugguacuauuaauaccagaaccugaaaaacaaagaacuccucaagauaaucagcuagccuauguaguaauagggaucuuaacacuagcugccaucauagcagccaacgagauggggcuacuagagacaacaaaaagagaucucggcaugucgaaagaaccugguguuguuucacccacaaguuaccuagacguagauuuacacccagccagugcguggacucucuaugcgguugcaacgacaguaauuacaccaauguuaagacacacaauugaaaauucgaccgcgaacguaucguuggccgccauagcaaaucaagcaguaguauugauggggcuagauaaggguuggcccaucuccaaaauggauuuagguguaccgcucuuggcacucggauguuauucgcaaguuaauccauugacccucacagcggcgguucugcuacucauuacacacuacgccauaauaggacccggucuacaagcgaaagcaacuagggaagcucagaaaagaacagcugcaggcauaaugaaaaacccuacgguugaugggaucaugacuauagaucuagauccaguuauauaugacucgaaauucgaaaaacaauugggucaggugaugcuacucguacuaugcgcuguucaacuauugcugaugaggaccaguugggcgcugugugaagcguuaacguuagcaacuggaccaauaacaacccucugggaaggaaguccaggaaaguucuggaauacaacuauugcagugaguauggcaaacauauuuagaggcagcuauuuggccggagcaggacucgcuuuuucaauaaugaaaaguguaggcacaggaaaacguggaacaggaucucaaggugagacauuaggggaaaaauggaagaagaaacuaaaccagcuaucgagaaaagaguucgaccuguauaagaaaucagggaucacagaaguagaucguacugaagcuaaagagggauugaagagaggagagaucacccaccacgcagugucuaggggaucugcuaaguuacaaugguucguggaaagaaauauggugauaccggaagguagagucaucgacuuagguugugggcggggcggauggucauauuacugcgccggucuaaagaaaguaacagaaguucgggguuauacaaaaggaggcccugggcaugaagaaccggugccuaugaguacguauggauggaacauaguuaaacucaugucagggaaagaugucuucuaucuuccaccagaaaaaugugauacccuucuuugcgauauaggugaaucgucacccucuccaaccguugaagaaaguaggacaauucgagucuugaaaaugguagaaccauggcugaagaauaaccaguuuugcauuaaaguauuaaaucccuacaugccaacaguuauagaacauuuagaaaggcuacaaagaaagcacggaggaauguuggugagaaauccauugagcagaaacucgacacaugaaauguacuggauaucaaaugggacagguaauauaguagcaucgguuaacaugguaucacgauuauuacuuaauagguucaccaugacacauagaagaccgacaauagaaaaagauguggaccuuggagcuggaacucgucaugucaaugcggaaccugaaacgccaaauauggauguuauaggggagagaauaaagcgcauuaaagaagaacauaacucuacauggcacuaugaugacgaaaauccuuacaagacuugggcuuaucauggcucauaugaaguuaaagcgacaggaagcgcaucauccaugauaaacggagugguaaaguuacugacuaaacccugggacguuguuccaauggucacucaaauggcaaugaccgauaccacgccauuuggacaacaacggguuuuuaaggaaaagguggacacgcguacgccaagaucaaugccagguacuagacgcguaauggguauaaccgcagaauggcucuggcgaacacuagggagaaauaagaaaccgagacuguguacaagagaagaauuuaccaagaagguacgaacaaacgcugcaaugggagcaguuuucacggaagagaaccaaugggacuccgccaaagccgcaguugaagacgaagacuucuggaaauuggucgauagggaacgugaauuacauaaauuagggaaaugugguucauguguuuauaacaugaugggaaaacgugagaagaaauuaggagaguuuggaaaagcaaaagggucaagagcaauaugguacauguggcuuggagcgagauacuuagaauuugaagcguugggcuuucuaaacgaagaucacugguuuucacgugaaaauucauauucgggaguagaaggagaaggguuacacaagcucgguuacauuuuacgugauaucaguaagauuccaggaggagcgauguaugccgacgauaccgcaggaugggauacaagaauuacagaagaugauuuacacaacgaagagaagauaacccaacaaauggauccagaacacagacaauuagcaaaugccauauucaagcuaaccuaccaaaauaagguaguuaagguacagagacccacaccuaccgguacuguuauggauauaaucaguagaaaagaucagagggguagcggacagguaggaacauauggcuuaaauacauuuacuaauauggaagcucaacuaauuagacaaauggaaggugaaggaguauuaucaaaagcggaucuagaaaacccacacuuacccgagaagaaaaucacacaguggcucgaaacgaaaggaguagaaaggcuuaaacggauggcuauaaguggcgacgauuguguagucaagccaauugacgauagguuugcaaacgccuuacuggcucugaaugacauggguaagguuagaaaagauauuccucaauggcaaccgucaaaggguuggcaugauuggcaacaaguaccauuuuguucccaccauuuucaugaacuaauaaugaaagauggucgcaaauuaguaguuccuugcagaccacaggaugaauugauuggacgagcucgaauaucacaaggcgccggauggucgcuaagagagacggcaugcuuagguaaggcuuaugcucaaauguggagccuaauguauuuucaucgccgagacuuaagauuagcaagcaacgcaaucugcucagcugucccaguacauuggguaccuacaagucgaacaacauggaguauccaugcacaucaucaguggaugacaacagaggauauguuaacuguauggaacagaguuuggauagaagauaauccauggauggaggacaaaaccccugugacaacuugggagaauguaccauaccuuggcaaacgggaggaucagugguguggaaguuuaauaggacucacgagccgugccacgugggcccaaaacauaccuacagccauccaacaaguacguucguuaaucggaaaugaagaguuccuagauuauaugccaaguaugaagcguuuuagaaaagaagaagaaucagaaggagcaauaugguga

SEQ ID NO: 23041 - RNA, 9873 nt, Artificial Sequence
  derived and/or modified CDS sequence (opt6) from DENV-3__JF808122__SS-prME
accaguuuaugucuaaugaugauacuucccgcagccuuggccuuccauuugacuucacgcgauggggaaccucggaugauaguaggcaaaaacgaacgaggaaaaaguuuauuauuuaaaacagcaagugggauuauaaaauguacacucauugcaauggaucucggcgaaaugugcgacgacacuguuaccuauaaauguccucauauaacagaaguagaaccugaagauauagauugcuggugcaacuugacuucgacuuggguaacauaugguacauguaaccaagcuggggaaaggaggcgagacaaacgaaguguagcacucgcuccgcauguggguauggguuuagacaccaggacucaaacuuggaugucagcugaaggagcauggcgacaaguggaaaaaguggagacgugggcgcugcgccacccggguuuuacuauccuagcgcuauuucuugcccauuacauugguaccagccucacccaaaaaguaguaauuuuuauauuacuaauguugguaacaccuaguaugacaaugcggugugucgggguugggaacagagauuuuguugaagggcuauccggggcaacauggguagauguggucuuggagcauggaggauguguaacaacaauggccaaaaacaaaccaacauuagacauagaacuacagaaaacugaggcuccccacuuagcaacuuugcgaaaacucugcauagaagggaaaauuacuaauauaacuaccgauagucguuguccaacacaaggggaagcuguucuaccggaggaacaagaccaaaauuauguguguaaacauacuuaugucgacagaggaugggguaaugggugcggacuauucgguaaagguagucucguaacuugcgcaaaauuucaauguuuagagccaauugagggaaaaguaguacaauacgaaaacuuaaaauacacuguaauaauaacaguacauacaggggaccaacaccaggucggaaacgaaacacaaggcguaacggcagaaauaacaccccaagcuaguaccacagaagccauauuaccagaauauggcacauuaggacuagaauguucaccaagaacuggauuggacuuuaaugaaaugauauuacugacuaugaaaaauaaagccuggaugguacauagacaaugguuuuucgaccuuccauuaccuuggacgucuggagcaacaacggaaacucccacauggaacagaaaagaacuauuagucacauucaagaacgcucacgcaaagaaacaggaagucguugugcuaggaagucaagaaggugcgaugcacaccgcgcuuacgggagcaacugaaauacaaaauucaggaggaaccuccauauuugcaggucaccuaaaauguagauuaaaaauggacaaguuggagcuaaaaggcauguccuaugcaaugugcacuaauacuuuuguacucaaaaaggaaguuucugaaacacaacacggaacaaucuugaucaaaguagaauauaaaggugaagacgcaccuugcaagaucccauuuaguacggaagauggacaagguaaagcucauaauggucgucucauaaccgccaauccuguagucacuaagaaagaagaaccagugaauauugaggcggagcccccauuuggcgaaucaaauauuguaauagguacaggcgauaaugcuuuaaaaauaaauugguacaaaaagggcucgucaauagguaagauguuugaggcaacugcucguggugcccguagaauggcaauccuaggggauaccgcuugggacuucgggucgguaggcggcguacuaaauucacuuggaaaaaugguacaccaaauuuuuggaucagccuacacggcucuuuucucagguguaagcugggucaugaaaaucggaaucgggguguuguuaaccuggauaggacuuaauagcaaaaacacaaguaugucuuuuaguugcauugcaauagguaucauaaccuuauaccuuggugcuguaguccaggcggauauggguuguguaauuaauuggaagggaaaagaacugaaaugugggagcgguauauucgucacaaaugaaguccauaccuggacggaacaauauaaguuucaagcggauaguccuaaaagguuagcgacugcaauagccggggcaugggagaauggcguaugugggauacgaucaacgacucggauggaaaaucuauuauggaaacaaauugccaaugaauugaauuauauccugugggagaauaacauaaaguugacagucguuguaggcgauauaauaggggugcuggaacaaggaaaaaggacuuugacuccacaaccuauggaacuaaaauauucuuggaagacuuggggcaaggccaagauagugacggcugagacacaaaauucauccuuuauaaucgacggacccaacacgcccgaauguccuagcgcaucuagagccuggaauguaugggaaguugaagauuacggauucggcguauucaccacaaauauuuggcuuaaauugcgagagguauacacacaauuaugcgaccacagguuaaugucugcagcugucaaagacgagagagcaguacaugcugauauggguuauuggauagaaagucagaaaaaugguagcuggaaacuugaaaaggcgagucucaucgaaguaaagacuuguacuuggccgaaaucucauacgcuuuggagcaaugguguacucgaaucugauaugauuaucccgaaaagccuagcuggcccaauuagucaacauaaccacaggccuggcuaucauacacaaacagcggguccauggcaucuagguaagcuggaguuagacuuuaauuauugcgaaggaacaacagucgugauaacagaaaauugugguaccagagguccaaguuuacgaaccaccacaguaagcgguaaguuaauacaugaaugguguugccgcaguuguacuuuaccaccauugagauacaugggggaagacggcuguugguaugggauggaaauaaggcccauaagugagaaagaggagaauaugguaaagagccugguuucagcuggauccgggaaaguugacaauuuuacgaugggaguguuguguuuggcgauacucuucgaagaaguaaugcgaggcaaauucggaaagaaacacaugauagccgguguauucuuuacguuuguucuacuuuuaagugggcaaauuacguggagagacauggcacauacucuaauaaugauaggaucuaaugcaagcgaucgcaugggcaugggagugaccuaccucgcucuaauagcaacuuucaagauucaaccauuuuuagcacugggauucuuucuaaggaaguuaacuagcagggaaaauuuacuacucggaguugguuuagcuauggcaacuacuuuacaacuaccagaagauauagaacaaauggcuaacgggaucgcuuuaggccuaauggcccugaaauuaauuacccaguuugaaacauaccagcuuuggacagcucuaauaucacuaacgugcucaaauacaauguuuacacuaacuguugcuuggcggacugcaacucucauacuugccgguguuucacuacuuccuguuugccagucaucaucuaugcgaaaaacagauugguugcccauggccgucgcagcuauggguguaccaccucugccacucuuuauauuuucgcuaaaagauacuuugaaacgaagaucauggccguugaaugaagguguaauggcaguuggcuugguaagcaucuuagcaucguccuuucuucgaaaugacguuccaauggcgggaccuuuaguagcgggaggucuacuaauagcauguuauguuauaacagguacaagcgcagacuuaacgguagagaaagccgcagacauaacaugggaagaagaggcagagcagacaggcguaucacacaauuuaaugauuacagucgacgacgacggaacuaugagaauaaaggacgaugaaaccgaaaauaucuugacuguacuuuuaaaaacagcauuacuuauaguaucuggaguauuuccguauucgauaccugcgacauuguugguauggcauacauggcaaaaacagacacaacgcagugguguuuugugggauguaccaagucccccugaaacccagaaagcugaauuagaagagggaguguauagaauaaaacaacagggaauauucggaaaaacacaaguaggaguaggggugcaaaaagagggaguauuucauacuauguggcauguaacaagaggagcaguacuuacauauaaugguaaaagacucgagccuaauugggccucugucaagaaagaucugaucaguuaugguggugguuggagauugucagcacaguggcaaaaaggcgaggagguucaaguuaucgcgguugaaccagguaaaaacccaaagaacuuucaaacgaugccaggcaccuuccagaccaccacaggugaaaucggagcaauugcacuugauuucaagccaggaaccagcgguaguccaaucauuaaccgugaagguaaaguagugggccuuuacgggaauggggucguaacaaagaaugggggauauguaucgggaaucgcacagacaaaugcggaaccugauggaccgacaccugagcuagaagaggaaauguuuaaaaagcgaaaccuuacgaucauggaucuacacccuggauccggaaaaacuaggaaauaucuaccugccauaguuagggaagcuauaaaacgacgauuacgaacucuuauauuagcaccuacacgcguuguggcagcagaaauggaggaggcuuuaaagggauuacccauuagauaucaaaccacagccacaaaaucagaacacacaggaagggaaauuguugacuugaugugccaugcgacauuuaccaugcgauuacucuccccgguaagaguuccaaacuacaaucugauuaucauggacgaagcccacuuuaccgaccccgcauccaucgcugccagagguuauauuucaacacgcguagguaugggugaggcggcggcgauuuuuaugacugccacaccaccaggaacagcagaugcuuuuccacaauccaaugcuccaauacaggacgaagaaagagauauuccagaaagaucauggaacucaggcaaugaauggauuacugauuuugccggaaaaacaguaugguuuguacccucaauaaaagcagguaaugauauagcgaacuguuuacggaaaaacgguaaaaaggucauucaauuaucgagaaaaacauuugauaccgaauaucagaaaacgaagcuaaaugauugggauuuugugguuacuaccgacauuagcgaaaugggagcaaacuucaaggcugacagaguaauagacccuagaagaugucugaaaccaguaauacuaacggacgggccagagaggguuauacuagcgggcccaaugccuguaacggcagccucagcugcacaacgucgaggccgagucgguagaaauccucaaaaagagaaugaucaguacauuuucacggggcaaccccuaaacaaugacgaagaccaugcucauuggacagaagccaaaaugcuucucgacaauauuaacaccccggagggaauuaucccugcucucuucgagccagaacgugaaaaauccgcugcgauugauggagaguaccguuugaaaggagaaagcaggaaaacuuuugucgaauugaugagacgcggagaccuucccgucuggcuagcucauaaaguugcaucggaaggaauaaaauacacagaucggaaaugguguuuugauggccagagaaacaaucagauucuagaagaaaacauggaugucgagauuuggaccaaagaaggggaaaagaagaaacugcguccaagauggcuugaugcaagaacauauagcgacccacuagcauuaaaggaauuuaaagauuucgcagcgggaaggaaaaguauugcacuagaucuaguaaccgaaaucgguagaguacccagccacuuagcacaccguacacguaacgcuuuagauaaucucgucauguuacauacaucugaacaugguggucgugcauaucgucaugcuguagaagaauugcccgaaacaauggaaacauuacuuuuauuaggauuaaugauuuuauugacugggggcgccauguuguuuuuaauaucaggaaaagguauagguaaaacaucaauaggcuuaauaugcgucauugcuaguagugguaugaguuggauggcagagaucccgcuucaguggauagccagcgcaauugucuuggaauuuuucaugaugguauuauugaucccugaaccggaaaaacaacguacaccacaagacaaucaauuggccuauguaguaauaggaauccuaacucuugcagccauuauagcagcuaaugaaaugggucuucuagaaacaacgaaaagagauuuaggcaugagcaaagaaccagguguaguaucacccacaagcuauuuggauguggacuuacaucccgcaagcgccuggacccucuaugcaguagcaacuacgguaauuacgccaaugcuaagacauacuauagaaaacucaacggcuaacgucaguuuagccgccauagcaaaucaagcgguaguuuugaugggguuagauaaaggauggccuaucucuaaaauggaccuaggcgugccauuacucgcccuuggguguuacucgcaaguaaacccacugacauugacagcagcgguucugcuacucauuacacacuaugcaauuauuggacccgguuugcaagcuaaagcaacgagagaagcucagaaaaggacagccgcaggaauaaugaaaaacccaacugucgauggcaucaugacgaucgauuuagacccaguaauuuacgacucaaaauuugaaaaacagcuaggacaaguaauguuacuuguucuuugcgccguccaauuauuguuaaugagaacaagcugggcgcuaugugaggccuuaacguuagcgacuggaccgauuacuacauuaugggaagguuccccaggaaaauuuuggaauacaacuauagcuguauccauggccaauaucuuccguggaaguuauuuggccggcgcuggauuagccuuuaguauaaugaagucuguugguacgggaaaaaggggaacaggaucacagggagagacucuuggagaaaaauggaaaaagaaauuaaaccaguuaagccgcaaggaauuugauuuauacaagaaaucaggaauaacagaaguggacagaaccgaagcaaaagagggccuuaagagaggcgaaauaacucaccaugccgucuccagaggaucugccaaacuccagugguucguagaaagaaacaugguuauuccggaaggacgaguaauagauuuggguugcgguagaggcggauggucguacuauugcgcgggccugaagaaaguaacagaaguaaggggcuacacuaaaggagguccaggccaugaggaaccuguaccuauguccacauacgguuggaacauaguuaaacuuaugucgggcaaagacguguuuuaucuacccccagaaaaaugugauacacuguugugugacauuggagaaucaaguccuagcccaaccguugaggaaagcagaacaauaagagucuugaaaaugguggagccguggcucaagaacaaucaauucuguauuaaaguauuaaacccguauaugccaacaguuaucgagcaccuagaaagacuacaaagaaagcauggugggaugcuuguccgaaauccccuaucgcgaaacucuacacacgaaauguauuggauaaguaacggcacaggaaauauagucgcaucaguaaauaugguaucucgacucuugcucaacagauucacgaugacucauaggcggccaacuauugagaaggauguagaucucggcgcuggaacaagacauguaaacgcggagccagaaacuccaaacauggacguaaucggugagaggauaaaaaggauuaaggaagaacauaacucuacguggcacuacgaugaugaaaacccuuauaaaacaugggccuaccacggaucguacgaagucaaggcaacagguagcgcaaguuccaugauuaacggaguaguaaaauugcuuacaaagccaugggauguaguuccaauggugacucaaauggcaaugaccgauacuacaccauuuggucaacaacgagucuucaaagaaaagguugauacgcgaacaccacguagcaugcccggaacacgccgcguuaugggaauaaccgcugaaugguuauggcgaacauuaggcagaaauaaaaagccccggcuauguacccgugaagaauuuacuaagaagguacguacgaacgcugcgaugggagcuguuuucaccgaggaaaaccaaugggacucggcaaaggcggcaguggaagaugaagauuuuuggaaguuaguugaucgugaacgugaacuucauaaacuggguaaauguggcucuugcguguacaacaugaugggcaagagagagaagaaacucggcgaauuuggaaaagcaaacgggucuagggccauuugguauaugugguuaggugcgcgauaccuugaauuugaagcgcuuggauuucucaaagaauaccauugguuuagcagagagaacagcuauucggggguugaaggggaaggacugcauaaacuuggcuacauuuuacgcgauauaucuaaaauuccugguggugccauguacgcugaugauacagcagguugggauacgcgaauaacugaggaugaucuccauaacgaagagaaaauuacucagcaaauggaucccgaacaucgacaacuagccaaugcaauuuucaaauuaacauaucaaaacaaagucguaaaaguacaacgaccuacucccacaggaacuguaauggacaucauauccaggaaagaucaaagggguucuggucaggucgguaccuauggauuaaauacauucaccaauauggaagcucaacuaauaaggcaaauggaaggcgaggguguacuaucaaaggcagauuuggaaaauccccauuuaccagagaaaaagauaacacaguggcuggaaacuaaaggugucgaaagauuaaaaaggauggccauaaguggagacgacugcgugguuaaacccauagaugaucgauuugcuaaugcguuauuggcauugaaugauaccggaaaaguacguaaagauauuccgcaauggcaacccaguaaaggauggcacgacuggcaacaagugccauuuuguucccaucauuuucaugaauuaauaaugaaagauggaagaaaacuugucguacccugccguccgcaggaugaauuaauaggaagggcacguauuucacaaggagcagguuggucacuuagagaaaccgcuuguuuaggcaaagcauaugcacaaauguggucgcuaauguacuuccaucggagagaucuaagacuagcaagcaacgccauauguucagcuguaccaguacauugggucccaacaagccguacaacuugguccauccacgcacaucaccaauggaugaccacggaggacaugcucacaguauggaacaggguguggaucgaagacaauccauggauggaagauaaaacgccaguaacaacuugggaaaacguucccuaucuaggcaaacgcgaggaucaauggugcgggucucuuauaggacuaacaucaagagcaacaugggcccaaaauauuccuaccgcgauucaacagguccgaucccucaucgggaaugaagaguuccuugauuauaugccgaguaugaaaagguuccgaaaagaggaagagucagaaggagcgauuugguag

SEQ ID NO: 23042 - RNA, 9873 nt, Artificial Sequence
  derived and/or modified CDS sequence (opt6) from DENV-3__GQ466079__SS-prME
acuucccuaugccuuaugaugauucugccggcagcacuagccuuucauuuaacaagcagggauggugaaccaagaaugauaguggguaaaaaugaaagagguaaaaguuuacuuuuuaaaacagcuagcgggauuaauauguguacgcuaaucgcgauggaucuuggugaaaugugugacgacacgguaacuuauaaaugcccacauaucacagaaguugaaccggaagacauugauuguugguguaaccuuacgaguacauggguaacuuaugguacgugcaaccaagcaggagaacaccgcagggauaaacgaucaguggcccuggcaccacacguaggcaugggucuagauacaagaacccaaacauggaugagugccgaaggcgcauggcggcagguagaaaaaguggaaaccugggcccuacgacacccuggauuuacaauauuggcacuauuucuggcccacuacaucggaacaucacuuacacaaaaagucgugauauuuauauuacucaugcuuguaacaccuagcaugaccaugagauguguggguguaggcaacagagacuuuguagaaggcuugucaggggcaacguggguggauguggugcuggaacacgggggauguguaacgacaauggccaaaaacaaaccuacauuagauauagaauuacagaaaacggaagcgacacagcuagcuacuuuaagaaaacucugcaucgagggcaaaauaacgaacauuacuacugauagucgaugcccuacacaaggcgaggcuguacuaccggaggagcaagaccagaauuauguuuguaaacauacguauguggacagaggauggggcaauggauguggacucuuuggaaaagguucccuaguaacaugcgcaaaauuucaaugcuuagagccaauagaaggcaaagugguacaauaugaaaauuuaaaauacacgguuaucauaacgguucacacgggggaucagcaucaaguaggaaacgaaacccaaggaguuacagcggaaauaacaccacaagcauccaccaccgaagcaauccugccugaguauggaacauuaggcuuagaauguucaccacguacuggauuagauuuuaaugaaaugauacuacuaacuaugaaaaacaaagcauggaugguucaucgccaaugguucuuugauuugccguuaccuuggacaucaggagcaacaaccgagaccccaacauggaauagaaaagaacuauuggucacauuuaaaaacgcccacgccaagaaacaagaaguagucguucugggaucacaagaaggagcaaugcauacagcauugaccggagcuacugaaauacaaaauuccgguggaacaucaauauuugcaggacaccucaaauguagauuaaaaauggacaaacuagaacuaaaagguaugucauaugcaaugugcacgaacacuuucguacucaagaaagaaguaucagaaacucaacauggaacgauuuuaauuaaaguagaguauaagggagaggacgcaccuuguaaaauuccuuuuagcaccgaggauggacaaggcaaagcgcauaauggaagacuaaucacagccaauccagucguaacuaagaaagaagaaccaguuaauauagaagcagaaccaccuuucggggaaaguaacauaguaauuggaauuggggauaaugcuuugaaaauuaacugguauaagaaaggaucauccauaggcaaaauguuugaagcaacagcucgaggugcacgacgcauggcgauucuuggcgauacagcuugggauuucggcucaguaggagguguucuaaacucacuagguaaaauggugcaccaaauauucgguucugcauacacagcacuauucucaggcguaaguuggguuaugaaaauuggcauaggagugcuacuaacguggauuggucucaauucuaaaaacacaagcaugaguuuuucauguauagcgauaggaaucauaacauuauaccugggagccguaguacaggcggacauggggugugucauaaauuggaaagggaaagaacucaaauguggcucaggaauuuucguaacaaaugaaguucauacguggacagaacaguacaaauuucaagcggauaguccaaaaagauuggcaacagcaaucgcaggggcaugggagaacgguguaugcggcauucgaagcacaaccagaauggagaaucuccuguggaagcagauagcaaacgaacugaacuauauacucugggagaauaauauaaaacuaacuguaguaguuggggauacuauagguguauuagagcaaggaaaaagaacauuaacgccacaacccauggaauugaaauacucuuggaaaacuugggguaaagccaaaauagugacagcugagacacagaauagcuucuuuauuauagaugguccaaauaccccagaaugucccucagcaaguagagcuuggaauguaugggaaguagaagacuauggauuugggguauuuacaacuaacauuuggcuuaaauuaagagaaguguauacacaauuaugugaucauaggcuaaugagugcagccgugaaagacgaaagagcuguucacgcagauaugggauacuggaucgagucgcagaaaaacggcucuuggaaauuagaaaaggcaucccuaauugaagucaaaacgugcaccuggccuaaaucucacacucuguggucuaacggaguacuugaaucagauaugauaauuccaaagucuuuagcgggacccauuagucaacacaaccaucgaccuggauaucauacccaaacugcuggaccuuggcauuuagaaaaucucgaauuggauuuuacauauugugaaggaacaacagucguaauuacagaaaauuguggaacuagaggcccaagucuaagaaccacuacugugucuggaaaacugauacaugaaugguguuguaggucauguacauuacccccauuacgguauaugggugaagauggaugcugguacggaauggaaauacgaccuauaagugaaaaggaggagaauaugguaaagucacuuguuucagcuggguccggaaaagucgauaacuuuacaaugggaauacugugccuagcgauuuuauuugaagaagucaugagaggaaaauuugguaagaagcauaugauagcgggagucuucuucacguuuguacugcucuuaagcggccaaauuacauggagggacauggcucacacucuuauuaugauaggaagcaaugcuucagacagaauggguaugggaguaacauauuuagcuuuaauugcuacauuuaaaauucaaccauuucucgcgcugggguucuuucuaagaaaacugaccucgagagaaaaucuuuuauuaggagucggccucgccauggcaacaacucuucaguuaccggaggauauugaacaaauggcaaaugguauagcucugggucuaauggcgcuaaaguuaauaacacaauucgagacguaccagcuauggacagcacuaauuaguuuaacgugcuccaauacgauuuucacauuaacuguggcuuggcgaacagcgacacuuauucuagcaggaguuucguuauuaccuguaugccaaucgucguccaugagaaaaaccgauuggcuuccaaugaccguagcagcgauggguguacccccucuacccuuguuuauuuucagccuaaaagacacgcuaaaaagaagaaguuggccauuaaaugaaggaguaauggcaguagggcuaguuucgauacuggcauccagcuugcuaagaaacgauguuccuauggcaggcccccucguugccggaggacuccuaauugcuugcuacgugaucacaggaaccucagcagacuugacaguagaaaaagcugcagaugugacuugggaggaagaggcagaacagacaggugugucgcacaaccuuaugauaacgguagaugacgacgggacaaugcgaauuaaagaugaugaaacggagaacauacugacuguccuucuuaagacugccuuacuuauaguuucaggaauuuuuccauacucgauuccugcaacucuguuaguauggcauacuuggcagaagcaaacucagagaagcgggguuuugugggauguuccuagcccuccugaaacgcagaaagccgaauuagaagagggcguguauagaauuaaacagcaaggaauauugggaaaaacgcaaguggguguggggguacaaaaagaaggaguuuuccacacuauguggcauguuacaagaggagccguauuaacgcauaauggaaaacgcuuagaaccaaauugggcaucaguaaagaaagaucuaaucucauauggaggagguuggagacuuagcgcccaauggcagaaaggugaggaagugcaaguaauagcuguggaacccggcaaaaaccccaaaaacuuccaaaccaugccugguaccuuccagacgacuacaggagaaauuggagcgauagcauuggauuucaaaccggguaccaguggaaguccaauaauaaacagagaggguaaagucguuggucuauaugguaacggaguuguaaccaaaaacgguggcuaugucucaggaaucgcccaaacgaaugcagagccugaugguccaacaccugaacuugaggaagaaauguuuaaaaagcgcaauuugacuauaauggauuuacauccaggauccggaaaaacccguaaguauuugccugcgaucguucgggaagcuauaaaacggagauuaagaacacuaauacuugcaccuacaagagucguagcugcagagauggaagaggcucuaaaaggcuuaccuauacgauaccagacuacggccacaaaaucagaacacaccggaagagaaauaguugacuuaaugugucacgcaacauucacaaugcggcuuuuaagcccgguuagagugcccaauuauaaccucauaaucauggacgaagcacacuuuacagaucccgcaagcaucgccgcacgaggguauauuucaacacgcguagguaugggcgaagccgcugcaauauucaugucagcuacaccaccaggaacagcagacgcauucccacaaaguaaugcuccgauacaggacgaagagagggacauacccgaaagaucauggaacucagggaaugaauggaucacugacuuugcaggaaagacagugugguucgucccaucuaucaaagcugguaaugauauugccaacugucuuagaaagaauggcaagaaaguaauucaacucucuagaaaaacauucgauaccgaauaccagaaaacuaaauuaaacgacugggauuucguugugacuaccgauauuucagaaaugggagcaaacuucaaggcagacagaguaauugauccccgucguuguuuaaaaccaguaauucuaacagacggaccugaacggguuauccucgcaggcccaaugcccguaacagcugcaagcgcugcccaacgucgcggacgaguuggucggaauccccagaaggaaaaugaccaauacaucuuuaccggccaacccuuaaacaaugacgaagaccacgcacauuggacagaagcgaagaugcucuuagacaauauaaauacgcccgaaggaauaauaccagcauuguucgagccagaaagggaaaaaucggcagcuauagauggagaauaccgccucaaaggagaaagucgcaagacauuuguugaauuaaugagaagaggggauuugccaguaugguuagcucauaaaguugcuucggaagggauaaaauauaccgaucguaaauggugcuucgacggucagcggaauaaucaaauacucgaagaaaauauggacguagaaauauggacaaaggagggagagaaaaagaaacuaagaccaagauggcucgacgcccguacuuauucagauccacuagcgcuuaaagaauuuaaagacuucgccgccgggagaaaaucaauagcacuagaucucguaaccgaaauaggaaggguaccgucucaucuagcccauagaacucgaaaugcauuagauaaucuugucauguugcauacaagugagcauggaggaagggcuuauaggcaugcagucgaagaauugccagaaacuauggaaacauuacuguuauuaggauuaaugauacuguuaacugguggagcuaugcuauuccugauaucgggaaagggaauagguaaaacuagcaucggacuuaucuguguaauugcaagcaguggaaugcuguggauggcagaaauuccuuugcaauggauagcaucagcaauugugcuugaguucuuuaugaugguacugcucaucccagaacccgaaaagcaacgaacgccacaagacaaccaacuugcauaugucguaaucgguauccucacacucgcagcgaucauagcugcaaacgagaugggccuucucgaaacuaccaaaagagaucuuggaaugucaaaggaacccgguguaguuagcccaacaucauauuuagauguugacuuacacccugccagcgcauggacccuauaugcaguagcuaccacuguaauuacucccaugcuuagacauacaaucgagaacaguacugcaaauguaucccuggccgcgauagcgaaucaagcgguagugcucaugggauuagacaaaggguggccuauaaguaagauggaccuagggguuccuuuacuagcauuagguuguuauucgcaagugaauccucuaacccuuacagccgcuguacuccuucuuaucacccacuaugcuauaauaggaccggguuuacaagcgaaagcaacaagagaggcccaaaaacgaacggccgcagggauuaugaaaaauccaacggucgauggaaucauaaccaucgaccuagauccaguaauauaugacagcaaauuugaaaaacaacuaggccaagucaugcuauuagugcugugcgccguacaguuauuauugaugagaacaaguugggcauuaugcgaagcguuaacccucgcgacaggcccuauaacgaccuugugggaaggaucgccaggaaaauucuggaacacaacaauagccguauccauggcaaacauuuuuagaggaucauauuuagcuggugccgguuuagcguucaguauaaugaaauccgucggaacaggaaagcguggcacaggaucucaaggugagacguugggcgagaaauggaaaaagaaacuuaaucaacuaucucguaaagaguucgaucuauauaaaaagaguggaaucacggaaguagaucgcacagaagcuaaggaaggauuaaaaagaggugaaacaacacaucaugcagugucccgagggucggcgaaauuacaaugguugguagaacggaacaugguaaucccugaaggucgaguaauugauuuagggugcggacgaggagguuggaguuauuauugcgcaggccucaagaaagucacagaagugagaggauauaccaaaggaggaccuggccaugaagaaccggucccuaugucaacuuacggauggaauauugucaaacuaaugagcgguaaggauguauuuuacuugccaccugaaaaaugugacacccuccuuugugauauaggagaaagcagcccaucaccuaccguugaagaaagucgcacuauccgaguccuaaaaaugguugaaccuuggcucaaaaacaaucaauuuuguaucaagguuuuaaacccauauaugccagccgugaucgaacaucuagaacgauuacaaaggaaacauggcgggaugcuugucaggaauccccuuagccguaacucaacucacgagauguauuggauuagcaaugguaccggcaauauugucaguucuguaaauaugguguccagacuacuuuugaaccgauucacaaugacccaccgaaggccaacaaucgaaaaagauguagaccuuggugccggaacaagacauguaaaugcugaaccggagacuccaaauauggacguaauaggagaaagaauaaaaagaaucaaggaagaacauaauucgacuuggcauuacgaugacgaaaauccuuacaagacuugggcuuaccaugguuccuaugaaguaaaagcaaccgggucagccucaucuaugaucaauggagucgugaaacuuuuaacuaagccuugggacgucguucccauggugacucaaauggcaaugaccgauacaacuccguucgggcaacaaagagucuuuaaggaaaaaguagacacucgaacgccacguccuaugccagguacccgcaaagugauggaaauuacagcagaguggcucuggaggacauuagggagaaacaaacguccgagacuuugcacacgagaagaguucaccaagaaaguuagaacuaaugcagcaaugggggccguuuuuacggaggaaaaccaaugggacuccgcuaaggcagcaguagaggacgaggaauuuuggaaguugguagauagggaaagagaguuacauaaauuaggaaagugcggcaguugcguguauaacaugaugggaaaaagagagaagaaacugggcgaguuugguaaagcaaaagguagccgugcaauaugguauauguggcucggaagcagauaucuggaauuugaggcuuugggguucuuaaacgaagaucauugguuuucuagggaaaauuccuacucugguguggaaggagaaggacuucauaaacucggcuauauauuacgggauauuucaaagauaccugguggcgcgauguaugcagaugacacagcaggaugggauacucgaauaacugaagacgauuuacauaaugaggaaaagaucacacagcagauggaucccgaacaucgguuauuagcgaacgcuaucuuuaaguuaacuuaucaaaacaagguaguaaaaguucaaagaccuaccccgacagguaccguuauggacauaauaucacgcaaagaccagagaggcucuggucaaguagggacuuauggucugaacacuuucacuaacauggaagcccaguuagugcgucaaauggaaggugaagguguccuuucuaaagcugacuuggaaaacccacaucuaccagagaagaaaauuacacagugguuagaaacuaaaggaguagaaagguuaaaaaggauggcaauuagcggugaugacuguguaguaaaaccaauagacgauagauucgcgaaugcacuuuuagcccuaaaugauaugggaaagguucggaaagacauuccacaauggcaaccaagcaagggcuggcacgauuggcaacaaguacccuucugcucccaucauuuucacgaacuuauaaugaaagauggcaggaaguuggucgucccguguaggccacaggaugaacuaaucgguagagccaggauaucucaaggggcugguuggucuuuacgagaaaccgcgugcuuaggcaaagcauaugcacagauguggagucuaauguacuuucaccggagagauuuacguuuggcaaguaaugccauaugcucggcagugcccguacacuggguuccgaccagucguacuacauggucaauacacgcccaucaucaauggaugacaaccgaagauaugcuaacugucuggaauaggguauggaucgaagacaauccguggauggaggacaagacuccuguaacuacaugggaaaacguaccguaucugggcaaaagggaggaucaauggugcggcagucuuauuggucugacaucgagggcaacaugggcucaaaauaucccgacugcuauacagcaaguuagaucuuuaauaggaaaugaagaauuucuggacuacaugccgucgaugaaaagguuucguaaagaagaagagucagaaggugcuauuugguaa

SEQ ID NO: 23043 - RNA, 9873 nt, Artificial Sequence
  derived and/or modified CDS sequence (opt6) from DENV-3__FJ898462__SS-prME
acuucacuuugucucaugaugauucuaccagcugcgcuagcauuccaucuaacuucucgcgauggagaaccaagaaugaucguaggcaaaaaugaaagaggaaaauccuuacuguucaaaacagcauccgguauuaacaugugcacauuaauugccauggacuuaggggaaaugugcgacgacaccguuaccuauaaauguccgcauaucacugaaguagaaccagaagauauugauugcugguguaaccucaccagcacaugggugacuuauggaacguguaaucaagcuggugaacacagacgugauaaacgaucaguugcgcuagcgccucauguugggaugggauuagacacucgaacgcaaacguggaugagugcggaaggagcguggagacaagucgaaaaaguugagaccugggcccuaagacaucccggauuuaccauuuuagcacucuucuuagcucauuacauuggaacuucuuuaacucaaaaagucguuauauuuauacuccuuaugcuugugacgccaucgaugacuaugagaugcguuggaguugguaaccgcgauuucguggaaggccuuaguggagcaacuuggguugacguugucuuggagcauggaggauguguaacgacaauggccaaaaauaaaccuaccuuagacauagaacugcagaaaacugaagcaacacaacuagccacucuucgaaaacucuguaucgaaggaaaaaucaccaauaucacuacagauuccagaugcccaacgcaaggugaagcaguacuuccggaagaacaagaucagaauuacguauguaaacacacauauguagaucgagguugggguaacgguugugggcuauucggcaaagguuccuuaguaacaugcgcuaaauuucaaugcuuagaaccaaucgaaggaaaagucguucaauaugaaaacuugaaauauaccguuauaauaaccguccauacgggggaucagcaucaaguagguaaugaaacacagggagugaccgcagaaauuacgccccaagcaucaacaacagaagcaauacuuccugaguacggaacauuaggauuagagugcucaccuaggacaggucucgauuucaacgaaaugauauuacuaaccaugaaaaacaaggcuuggaugguacauagacagugguucuuugaucucccauuaccguggacaaguggugcaacaacagaaacaccaacguggaaucgaaaagaacuccuaguaacuuuuaaaaaugcucacgcuaagaaacaagaagucguaguauuagggagccaagagggugcuaugcacacagcguugacaggcgcaacugaaauacagaacuccggagguacaaguauuuuugcaggacacuuaaaaugucgccuaaaaauggacaaacucgagcuaaaaggaaugucauaugcgauguguacuaacacguucguguuaaagaaagagguaucugaaacccaacauggaacaauauuaauuaaaguagaauauaaaggagaagacgcgccuugcaaaauaccuuucucaacugaagacggacaagguaaggcucauaacggccgucuuauuacggcuaacccugugguaacuaagaaggaagaacccgugaacauagaagcugaaccuccuuuuggcgaaaguaauauugugauagguauaggggauaaugcgcugaaaaucaacugguauaagaaaggaucuucaauaggcaaaauguuugaagcgaccgcaagaggcgcccgaagaauggcaauauuaggggauacggcuugggauuuugguucuguaggaggggugcuaaauagcuugggaaaaaugguacaucaaauuuuuggcucggcauauacagcauuauuuaguggaguaucauggguaaugaaaauagguauuggaguacugcuuaccuggaucggccuaaacucgaaaaauacuucuaugucauucaguuguauugccauaggaauuauaacacuauaccugggugccgugguucaagcagacaugggaugcgucauaaauuggaagggcaaagaacuaaaaugugggagcggcaucuuugucacuaaugagguacacacauggacagaacaauauaaguuucaagccgauucaccaaagagauuggcuacggcaauagcgggcgcaugggaaaauggggucugugggauacgaucaacaacgcguauggaaaauuuacuuuggaaacaaauugcaaacgaacucaauuauaucuuaugggagaauaauaucaaauuaacaguuguaguaggugacauaaucggcguuuuggaacaaggaaaaagaacguugacuccucaaccuauggaauugaaauauucauggaagacgugggguaaagccaaaauaguaaccgcagaaacccaaaacaguuccuuuauaauagauggaccaaacaccccagaaugcccaagugcgagcagagcguggaauguaugggagguugaagauuauggcuucggagucuuuacgacaaacauauggcuaaaauugcgggaggucuauacucaauugugugaucacagauuaaugucugccgcagugaaggaugaacgcgcuguacacgcagauaugggauauuggaucgagagucagaaaaauggaucuuggaaacuagaaaaagcuaguuuaauagagguaaagacuugcacauggcccaaaucucauacgcuuuggucaaaugguguauuggaaagugacaugauaauaccaaagagcuuagcgggaccgauaagccaacauaaucacagaccaggguaucauacucaaacggcgggaccguggcaucuuggcaaacucgaacucgacuucaauuacugugaagguacaacaguagugaucacagaaaacuguggaaccagagggccaucguuaagaacaacaacgguuagcggaaaauuaauacacgagugguguugccgaucgugcacauugccaccccuuagauauaugggugaagauggauguugguauggaauggaaaucagaccuauuagugaaaaggaagagaacaugguaaaaucgcuuguuagugcaggaucaggaaaaguugacaacuuuacaaugggcguuuuguguuuagcaauauuauuugaggagguuaugagggggaaauuugggaagaaacauaugauagcggguguauucuuuacguucguucuguuauuaagugggcagauaacauggagagacauggcucacacccuaauaaugauaggaagcaacgcaucggauagaaugggcauggggguaacuuaucuugcgcuuauugcaacuuucaaaauccaacccuuccuugcacuaggauucuuuuuaagaaaauugaccucaagggaaaauuuacuguuagggguuggauuggcaauggcaacuacauuacaguuaccagaagauauagaacaaauggcuaaugggauugcucuaggucuuauggcauuaaaacuuauaacccaauuugaaacauaucaauuauggaccgccuuaaucagcuuaacaugcaguaauacgauguucacauugacuguugcauggagaacugcaacucucauauuagcaggaguaucgcuccuuccaguuugucaaagcucuaguaugagaaagacagauugguugccaauggcuguagcagcuaugggcgugccaccacuuccucucuucauauuuucauuaaaagauacacuuaaacgacguucuuggccgcuaaaugaaggaguaauggccguaggucuugugucaauauuagcaucguccuuauuacgaaaugauguaccaauggccgggcccuuaguugcaggggguuuauuaauugccuguuaugugaucacagggacuagcgccgaucuaacaguagaaaaagcugcagauauuacuugggaggaagaagcggaacagacgggaguaucucacaacuugaugauuacgguagacgaugauggaacaaugagaauaaaagaugacgaaaccgaaaauauauuaaccguuuugcucaaaacugcucucuuaauaguguccggggucuuuccauauucaauacccgcuacguuacuugucuggcauacauggcaaaaacaaacucaaaggucaggagucuuaugggacgugcccagucccccagagacacaaaaggcggaauuagaagaaggaguguacaggauaaagcagcaaggaauauuuggcaaaacucaaguuggugucggagugcaaaaggaaggcguauuucacacgauguggcauguaacaagaggagccguuuuaacuuacaacgguaaacggcuagaaccaaauugggcaucuguaaagaaagaucuaauuaguuacggagggggauggcgauuaucggcucaauggcaaagaggagaagaaguucaaguaauugcaguugaacccgguaaaaauccuaaaaacuuucagacaaugccugguacauuccaaacaaccacaggagaaaucggugcuauagcccuagauuucaaaccagguacuucaggaucgccaauuauaaauagagaaggcaaagucgugggacuguaugguaaugggguaguaacuaaaaacggagguuauguauccgggauagcacaaacuaaugccgaaccugaugggcccacuccugaauuggaggaagagauguucaagaaaaggaacuuaacaauaauggaccuacacccgggcucaggaaaaaccagaaaauauuugcccgcuauuguuagggaagcaauaaaacgcaggcuaagaacacugauucuagccccaaccaggguaguagccgcagaaauggaagaagcucuaaagggacuaccaauuagauaucaaaccacggcgacgaagucugaacacacuggucgagaaauaguggaucucaugugccaugcaaccuucacaaugagacuucuauccccggugagaguaccaaauuacaaccugauaauuauggaugaagcacacuuuacugacccugcgucaauugccgcacgugguuacauauccacucgaguagguaugggagaagcugcagcuauuuuuaugacggcuacaccaccgggaacugcagacgcauucccacaaucuaaugcaccuauucaagaugaagaaagggacauucccgaacguaguuggaauagcggaaacgaauggaucacugacuucgccggaaaaacuguaugguuuguaccauccaucaaagcagggaaugacauagcaaauuguuuaaggaaaaaugguaagaaagucauacaacuauccagaaagacuuuugauacagaauaucagaaaacaaaacuaaacgauugggacuucguaguuacaacagacauaucagaaaugggggcgaauuuuaaagcagauagaguaauagacccucgucguugccuaaaaccugugauucuuacagaugguccagaaagaguaauauuggcgggcccuaugccgguuacugcugccucagcugcacagagaagagggagaguggggcguaauccgcaaaaagaaaaugaccaguauauauucacuggacagccuuugaauaaugaugaagaccaugcacauuggacagaagccaaaauguuacuugauaacauaaacacaccagaaggaauaauaccagcauuguucgagccagaaagagaaaaaucagcugcaauagacggagaguaccgucuuaagggagaaucaaggaagaccuuugucgaauuaaugcgaagaggugaucucccagucuggcuagcacauaaaguugcuucggaagguauuaaauauacggacagaaaaugguguuuugacggccagagaaauaaccaaauacuugaggaaaauauggacguggaaauuuggacaaaagaaggcgagaagaagaaacugcgaccacgaugguuagacgcaagaaccuacucggauccacuugcacugaaagaguucaaagacuuugcagcaggucggaaaucaauugcacuagauuugguuacggagaucgguaggguuccuagccaccuagcucauagaaccagaaacgcgcuggauaaccugguuaugcuacacacaagcgaacauggagggcgagcguaccgacacgcaguggaggaauuaccggagacgauggagacuuuauuacuacuagguuuaaugauacuccucaccgguggugcaaugcuauuucucauuagcggaaaggggaucggaaaaacuucaauaggauuaauuugugucaucgcaagcucaggaaugcuauggauggccgaaauuccacuccaguggauagcauccgcgauuguccucgaguucuucaugaugguucuacugauaccugaaccggaaaaacaacggaccccacaagacaaccaacuggcuuacguugucauaggaauauuaaccuuagcagcaauaauugcagccaaugaaaugggcuuauuggaaacuacaaaaagagaucugggcaugucuaaagagccuggagugguuucaccgaccucuuaucuagacguagacuuacaucccgccucagcauggacauuauaugcugucgcgaccacaguuauuacacccaugcuaaggcauacuauugaaaacuccacagcuaacguuucucuagcggcgauugcaaaucaggcaguuguccugaugggauuagacaaaggcuggccuauaucuaaaauggaucuaggugucccacuucuggcauuaggaugcuauagccaagucaauccucuaacucuuacugcugccgucuuacugcucauaacacauuacgccauaauuggaccaggauugcaagcgaaagccaccagggaggcacagaaacggacagcggccgggauaaugaaaaauccuacagucgauggaauaaugacaauagaucuagauccaguuauuuaugacuccaaauucgaaaagcaacuuggccagguuauguuauugguacugugcgcaguucaacuacuauuaaugcguacgucuugggcguugugcgaggcuuugacacucgcuacagggccaauaacuacccuaugggaaggaaguccuggaaaauucuggaauacgacuauagcugucaguauggcaaauauauuuagaggcucauauuuagcgggugcuggacuggcuuuuucaauaaugaaaucagucgggaccgguaaaagaggaacgggaagucaaggcgaaaccuuaggggaaaaauggaagaagaaacucaaucaacugucuagaaaggaauuugaccuauacaaaaagaguggaauaacagaaguagauagaacugaggcaaaagagggucuaaaaagaggagaaacuacccaccaugcaguaucgcgaggaucggcgaaacuucaaugguucguagaacgaaauaugguaauaccggaggggcggguaauugaucuaggauguggccgaggaggauggaguuauuauugcgcaggacuuaagaaaguaacagaaguaagaggguauacuaaaggcggcccggggcaugaagaaccagucccaauguccacuuacgguuggaacaucgugaagcugaugagugggaaggaugucuucuauuugccaccggaaaagugcgauacucuauuaugugauauaggagaaucuagcccaagcccgauuguggaagaaucgcggacaauuagagugcuaaaaaugguagaaccauggcucaaaaacaaucaauucuguauuaaaguucuuaacccuuauaugccuacaguuauagaacaucuggaacgauugcagcggaaacaugguggaauguuaguaagaaauccucuuaguagaaauucaacacacgaaauguauuggauuucaaacggaacugggaauauaguagcuaguguuaacaugguaucucgacugcuucuaaaccguuuuacaaugacgcauagaagaccgacaauagaaaaggauguggacuuaggcgcaggaacuagacaugucaacgcugagccagaaacaccaaauauggacguuauaggugaaagaauuaaacgcauuaaggaagaacauaauaguacauggcauuacgaugaugagaacccauauaaaacuugggcauaucacggcucauacgaagugaaagcaacaggcagugcuucaucaaugauaaauggaguagucaaauugcugacuaaacccugggacgucgucccaaugguaacacagauggcaaugacugauacaacgccguuuggccaacaaaggguguuuaaagagaaggucgauacaagaacaccucgaucaaugccagggacucggagagugauggggaucacggcugaguggcuuuggcgaacauuaggaaggaauaaaaagccgcgauuauguaccagagaagaguuuacuaagaaagucagaacgaacgcugcuaugggcgccguuuucacagaagaaaaucaaugggacucagcuaaagcugccguagaggaugaagauuucuggaaacucgucgacagagaaagagaauuacauaaacuggguaaauguggaucaugcguguauaauaugauggguaaacgggagaagaaguuaggagaauuugguaaagccaaaggaucacgagcaauaugguacauguggcuaggugcgagauaucucgaguuugaagcucuugguuuucuaaaugaagaucacugguuuagcagagaaaauagcuacagugguguggaaggugaaggcuuacauaaauuggguuauauauuacgcgacauaucaaaaauaccggguggcgccauguaugcugacgacacagcagggugggacacucggauaacugaagacgauuuacauaacgaagagaaaaucacccaacaaauggaccccgagcauaggcaacuagcuaacgcuauauuuaaacuaacuuaccaaaauaaagucgucaaggugcaacggccgacaccaacuggaacagucauggauauaauaagccgcaaggaccaacgcggcaguggucaggucgguacguacgguuuaaacaccuuuacaaacauggaagcacaauugauacggcagauggaaggagaaggaguucuaucaaaagccgauuuggagaacccacaucugcccgagaaaaagaucacacaaugguuggaaaccaaaggaguugaaaggcuaaagcguauggcgauuucuggagaugacuguguagucaagccgauagaugaccgauucgcgaaugcgcuacuggccuuaaacgacaugggcaaggugaggaaagacauaccucaauggcaaccaucgaaagguuggcaugauuggcaacaaguaccauuuuguucacaucauuuccaugagcuuauaaugaaagaugguagaaaauuggugguccccugucgaccucaagacgaauuaauaggacgagcucgcauuucccaaggggccggauggucacucagagaaaccgcuugucuaggaaaagcguaugcacaaaugugguccuugauguacuuucaccguagagaucucagauuagcuucuaacgcaauuuguagcgcaguaccuguucacuggguacccaccucuagaacaaccuggagcauccacgcacaccaccaguggaugacgacagaagacaugcuaaccguuuggaauagggucuggauugaagacaacccguggauggaagacaaaaccccugugacaacuugggagaacgugccauauuuagguaagagggaggaccaauggugcggaucuuugauuggucuuacgagccgagccacgugggcucagaauauuccaacagcaauucaacaagugcgcucacuuauagguaaugaagaauuucuugauuacaugccaucaaugaaacgauucagaaaagaggaggagagcgagggagcgauaugguaa

SEQ ID NO: 23044 - RNA, 9873 nt, Artificial Sequence
  derived and/or modified CDS sequence (opt6) from DENV-3__KF955473__SS-prME
acgagucucugcuuaaugaugauucuaccagcagcuuuggcauuucaucuaacuucucgugauggagaaccaagaaugaucguagguaaaaaugaacguggaaaaagucucuuauuuaaaacagcguccggaauaaacaugugcacgcucauugcuauggaucuaggugaaaugugcgaugauacgguuacauacaaaugcccucacauuacugaaguagaaccugaagauauugauugcuggugcaaccuaacaagcacauggguaacauaugggacaugcaaucaagcuggagaacaucgucgggauaaacgaucagucgcacuggcaccucacguagguaugggacuagacacgagaacucagacuuggaugucagcggaaggagcguggagacaaguugaaaaaguagaaacaugggcguuacgucacccuggauucacgauacuagcguuguuucuugcucacuacaucggaacuagcuuaacacaaaaaguuguaauauucauucuccuaaugcugguuacgccgucgaugacuaugagaugcguuggggucgguaaucgagauuuuguagaaggacuauccggagcaacaugggucgacgugguuuuagaacauggaggcuguguuacaacuauggccaaaaauaaaccaaccuuagacauugaauugcagaaaacagaagcaacgcagcucgcaauacuaagaaaacuauguauugaaggaaaaauaacgaauauaacuacugauagcagaugucccacacaaggagaagcuguauuacccgaagaacaagaucaaaauuauguuuguaaacacacuuacguggauagaggcugggguaacggauguggcuuauuuggaaaaggaucucuuguuacaugcgcaaaauuucaaugcuuagaaccuauagaagguaaagugguucaguacgaaaauuugaaauauacaguuauuauuacaguucacacaggggaucagcaucaaguugggaaugaaacgcaagguguaaccgcagaaauaacaccgcaagcaucgacuacagaagcaauacuuccagaauacgggacauuaggguuagaauguucgccaagaacgggucuagacuucaaugaaaugauauuacuaacaaugaaaaauaaagcauggaugguccaccgucagugguucuuugaccuaccccucccauggaccagcggugcuaccacugaaacaccgaccuggaauagaaaagaauuacugguuacuuuuaaaaaugcucacgcgaagaaacaagaaguaguuguacugggaagccaagaaggugcaaugcacaccgcguuaacaggggcaacugaaauacaaaacucuggaggaacaaguauuuuugcgggacauuugaaaugucgucucaaaauggauaaacuugaacucaaagguaugaguuacgccauguguacaaacacuuuuguucucaagaaagaggugagcgaaacacaacauggaacaaucuuaauaaaaguagaauauaaaggcgaggaugcaccauguaaaauaccauuuucgacugaagauggucaagggaaagcgcacaacggacgauugauaacggcaaacccagucguaaccaagaaagaagaaccggucaacauagaagcagaaccaccauuuggggaguccaauauagucauugggauuggggauaacgcacucaaaauuaauugguauaagaaaggaagcaguaucggaaaaauguucgaagccacggccaggggugcaagacguauggcaauucuuggugacacugcgugggauuuuggaucuguagggggaguccuaaauucauuagggaaaaugguacaucagauauucgggucugcauacacggcccuuuucucaggagugucuuggguaaugaaaauuggaauaggugucuuguugacguggauaggauuaaacucuaaaaauacuucaaugagcuucucguguauagcgauaggaauaaucacucuguauuuaggugcuguuguccaagcugauaugggauguguuauaaauuggaaaggaaaagagcuuaaauguggcuccgguauuuucguaacgaacgaaguacacaccuggacagaacaguacaaauuucaagcagacaguccuaaacgcuuagcaaccgcuauugcaggggcuugggagaauggaguuugcgggauacgaagcacuacgagaauggagaacuuauuauggaaacaaauugcaaacgaguugaauuacauucuaugggaaaauaauauaaaauuaaccgugguuguuggcgacauaauagguguccuagaacaagguaaacgaacucugacaccucaacccauggaauugaaguacaguuggaaaacauggggaaaagcuaaaauagucacggcagaaacgcaaaacucgucguucauaauugacgggccuaauacaccagagugcccaagugcaucaagagcauggaacgugugggaaguggaggacuacgguuucggugucuuuacaacaaauauauggcuaaaacuaagagaaguauacacgcaguuaugcgaccaccgacuaaugucagcagcaguaaaagaugaacgcgccguccacgcggacaugggcuauuggauagaaagccagaaaaauggaaguuggaaacuggaaaaagcaucuuugauugaaguaaaaacaugcaccuggccaaaaagccacacuuuauggucuaacggaguucuagaaagugacaugauaauaccaaaaucccuagcgggaccaauuagccaacauaaucaucgucccggguaccauacucaaacagcgggaccuuggcacuuagguaaauuagagcuugauuuuaauuacugugaagguacuacaguuguaauaacggaaaacugcgggacaagagggccgucacucagaacgacaacgguuuccggaaaacuuauccacgaaugguguugucgaagcuguacauugccacccuuacguuacaugggagaagacgguugcugguacggaauggaaauaaggccaauuuccgaaaaagaggagaacaugguaaaaucuuugguaucagcaggaaguggcaaaguggauaacuuuacuauggggguuuuaugucuugccauacucuucgaagaaguaaugcguggcaaauuugggaagaaacacaugauagcaggaguguucuuuacuuucgucuugcugcugagcggacaaaucaccuggagagauauggcacauacacugauaaugauagggucgaacgccagcgauagaauggggaugggaguaacauaccucgcacuaauagccacguucaaaauacaaccauuccuggcgcucggauucuuucuccggaaguuaaccaguagagaaaaucuauugcuggguguaggccuagccauggcgacgacacuccaauuaccagaagauauagaacaaauggcuaauggcauagcuuugggucuaauggcuuuaaaguugauuacacaauuugagacuuaucaauuauggaccgcauuaauaucuuugacauguucuaacacuauguucacauuaacuguagcuuggagaacggcgacacugauauuagccggugucuccuuacuaccgguuugucagagcucgucaaugaggaaaacagacuggcuucccauggcaguggcagcuauggggguacccccacuuccccuguucauauucagcuuaaaagauacacuaaaaaggcgcucauggccgcucaaugaaggaguuauggcagugggccuuguaucaauccuugcuucgucguuacuuagaaacgaugucccgauggcuggaccauugguggcugguggucuauugauagcaugcuauguaauuacaggaacguccgcagauuuaaccgucgagaaggcggcggacauaacaugggaagaagaagccgaacaaacaggaguuagucauaaucuuaugaucaccguagacgacgacggcacaaugagaauuaaagaugaugaaacggaaaacauauuaacgguguuacuaaaaacagcguuguuaaucgugagugguguuuuuccauacucaauaccugcuacccuauuaguguggcauaccuggcaaaaacagacacaacgcagugguguacuaugggaugucccaagcccacccgaaacacaaaaagccgaacucgaagaagguguuuaucguauaaagcaacagggcauauuugggaaaacucagguuggaguagguguacagaaagaaggagucuuucauacgauguggcacgugacaagaggagcgguauuaacuuauaacggcaaacgcuuagagccaaauugggcgagcguaaagaaagaucugaucaguuacggcggcgguuggagauuaucagcacaauggcaaaaaggggaagaaguucaagucauugcaguggaaccugggaaaaauccuaaaaauuuccaaacuaugccagguacauuucaaacuacuacgggggaaauaggagccauugcacucgauuuuaaaccaggcacuagcggcucaccaauaauaaaccgugaagguaaaguuguaggccuauauggaaauggagucguaacuaaaaacggaggguauguaucagggaucgcccagacaaaugcugaacccgacggcccuacgcccgaacucgaggaggagauguuuaagaaaaggaauuuaacgaucauggaccuacauccagguaguggaaagacacguaaauaccuuccagcaauaguccgagaagcaauaaaaagaagacuuagaacucugauuuuagcaccuacuagaguaguagccgccgaaauggaggaggcacuaaagggacugccaauacgauaucaaacuaccgcgacuaaaucagagcacacagggagagagauaguugacuuaaugugccaugccacauucacaaugcggcuauuaaguccgguaagagucccaaauuacaauuuaauuaucauggacgaagcacauuucacagacccagccaguauugcagccagaggguauauaucaacgagggugggcaugggagaagcagcagcuaucuuuaugaccgcuacacccccggguacagcugaugcuuucccacagucaaacgcccccauucaagaugaagaaagagacauaccugaacgaucuuggaacucagguaaugaauggauaaccgacuuugcagggaaaacaguaugguucguaccaagcauaaaagcuggaaaugauauagcaaacugccuaaggaagaauggcaagaaaguuauacagcuaagcagaaaaacauucgauacagaauaucagaaaacuaaauugaacgauugggauuucguagucaccaccgauaucagcgaaaugggagcgaauuuuaaagcagaucgugugauagacccaaggagaugccuuaaaccuguaauacucacugacgggccggagcgaguuauacuagcuggacccaugccagucacugcggcgagugcggcucaacgcagagguagagugggaagaaauccucaaaaagaaaacgaccaauauauuuuuacugggcaaccacugaacaaugaugaagaucaugcucauuggacugaagcuaaaaugcugcuagacaauauuaauacuccagaaggaauuauaccugcauuauucgaaccagagcgagagaaaagcgccgccauagauggagaauaucguuugaagggcgaaucuagaaagacauuuguagagcuaaugagaagaggagacuuacccgucugguuagcgcauaaaguugcuucagaggggauaaaguauacagauagaaaaugguguuuugacggucagcguaauaaccaaauucuugaggaaaacauggauguagaaaucuggacaaaagagggcgagaagaagaaauugcggccuagaugguuggacgcucgaacguauucugacccucuagcauugaaagaguucaaggauuuugcggcaggacgaaaaucaaucgcucuugauuuggugacggaaauuggaagagugccuucacacuuagcacaucgaaccagaaaugcauuagauaaucucguaaugcugcacaccagcgaacacgggggcagagcauaucgacaugcaguugaagaauuaccugagacaauggaaacccuguuguugcucggauugaugauccuguuaacagguggggcaaugcuauuucuaauaagcggaaaaggaauagggaaaacaaguauaggccuaauaugcgucauagcgagcaguggaaugcuauggauggcugagauaccucuacaauggauugcuuccgcgauuguccuagaguucuuuaugaugguuuugcugauaccugaaccggaaaagcagagaaccccgcaagauaaucaauuagcguacguugugauaggaauauugacauuagcggcuauaauugcagcgaaugaaauggguuuguuagaaacgacuaagagagaccucggaaugucaaaagaaccuggcguaguaucuccaacaagcuacuuagacguggaucugcauccggccucggcauggacacuauaugcgguagcaaccaccguaauuacacccaugcucagacauacuauagaaaacuccaccgcuaauguuucucuagcugcaauugcaaaucaagcaguaguguuaaugggucuggacaagggguggccgauuagcaaaauggacuuggguguaccuuuacuggcacuaggauguuauagucagguuaacccucuaacacucaccgcggcaguacuuuuauuaauaacccacuaugcaauaauaggacccggacuacaagccaaagcaacgagagaggcucaaaaacgaacagcagcaggcauuaugaaaaaccccacaguagaugggaucaugacaauagaccuugaucccguaauauaugacucaaaauucgaaaaacaacuaggccaaguuauguuauugguauuaugugcaguacaauuacuacucaugcgaacaucaugggcauugugcgaggcuuuaacccuagcuacaggucccauaacaacacugugggaaggcaguccgggaaaauuuuggaacacgacuauagcugugaguauggcaaacaucuuuagagggaguuaucuugcaggcgccggccucgcauucagcaucaugaagaguguggggacagggaaaagggguacaggaagucaaggagaaacuuuaggcgagaaauggaagaagaaauuaaaccaguuaagucgaaaagaauuugacuuauacaagaaaucagguauaaccgaaguugaucgaacagaagcuaaagagggucuaaagcgcggagaaaccacucaucacgcaguuagucgaggaagcgcaaaguuacaaugguuuguagaaagaaauaugguaauacccgaaggacggguuaucgaucuuggaugcggccgagguggauggucauauuacugugcugggcucaagaaaguuacagaagugagagguuauaccaaaggagguccagggcacgaagaaccaguaccaaugucgaccuaugguuggaauauugugaaacuuaugaguggaaaggacgucuuuuaccugccaccggaaaagugugauaccuuacugugugacauaggugaaucauccccaagucccacaguagaagagucacguacaauuagagugcucaaaaugguggaaccuugguugaagaacaaucaauuuuguaucaaagucuugaaccccuacaugccaaccguaauagaacaccuugagagguuacagagaaaacauggugggauguuaguuaggaacccgcuaucccgcaacaguacacaugaaauguacuggauauccaacggaacuggcaacauuguagcaucaguuaacaugguaagccgucuguuacuaaacagguuuaccaugacucacagaagacccacaaucgagaaagauguugaccuaggggcuggaacacgucauguuaaugcagaaccagaaacaccgaacauggauguaauaggggagcgaauuaaaagaauuaaagaagaacacaauucgacuuggcacuaugacgaugagaauccuuacaaaaccugggccuaucaugguucauaugaagugaaagcaacaggaagcgcuucaucaaugauaaacggagucgucaaacuucucacgaagccaugggauguugucccaaugguaacucagauggccaugacagauaccacuccauuuggacaacaacgaguuuuuaaggagaagguagauacacgaacaccgcgaucgaugccuggaaccagacguguuaugggaauaacggccgaaugguuauggcgaacucugggcaggaauaagaaaccucgacuauguacaagagaagaauuuaccaagaaaguaagaaccaaugcagcaaugggugcuguuuucaccgaagagaaccaaugggacuccgcaaaagccgccguagaagacgaagauuuuuggaagcuaguagaccgugaaagagaauuacacaaacuaggaaaaugcggaaguugcguauauaauaugauggggaaaagggagaagaaacuaggggaauuuggaaaagcaaaagguucuagggccauaugguauauguggcugggugcgagauauuuggaguuugaagcccuaggauuccuuaaugaagaucauugguucagcagggaaaauucguauucuggaguagaaggagaaggucuacacaaauugggauauauuuuacgagacauuagcaaaauaccgggaggugcaauguaugcugacgacaccgcuggaugggacacgagaauuacagaagaugacuuacacaaugaagagaaaauaacacagcagauggacccugaacaucgacaacucgcaaaugcgauauuuaaguugaccuaccaaaauaaagugguuaaaguacaaaggcccacaccuaccgguacagucauggauaucauaucaaggaaggaucaacgagguucuggacaaguaggcacauacggucuaaauacauucaccaacauggaagcccaauugauccgucaaauggaaggcgaaggaguucuuuccaaagccgaucuugaaaacccccaucuuccggaaaagaaaauuacucaauggcuagaaaccaaaggaguagagcgacuuaagagaauggcaaucucaggggacgauugcguggucaaaccaauugacgaucgauuugcaaaugccuuacuagcguuaaaugacaugggaaaggugagaaaagauauaccacaguggcaaccuagcaaaggcuggcacgauuggcaacaaguuccauuuuguagucaucauuuucaugaacuaauaaugaaagauggcagaaaacucguuguuccauguaggccgcaagacgaauuaauaggccgagcaagaauuagucaaggugcaggauggaguuuaagagaaacagcaugucuaggaaaagcauacgcacagauguggagcuuaauguauuuucauaggcgggaccugcgucuugcaagcaaugcaaucugcucugcaguuccugugcacuggguaccgacuagcaggacgacguggagcauacaugcccaccaccaguggaugacuacagaagauauguuaacuguauggaacagaguauggauugaggacaauccuuggauggaggacaagacgccaguaacuacaugggaaaacguuccauaucuggguaaacgggaggaccaauggugcgguagcuugauuggguuaacaucgcgagcaacuugggcucaaaauauaccaacugcaauucaacagguucgaucauuaauagguaacgaagaauuucuagauuacaugccgucaaugaaacgauuuagaaaagaagaagaaucagagggugcuauuugguaa

SEQ ID NO: 23045 - RNA, 9873 nt, Artificial Sequence
  derived and/or modified CDS sequence (opt6) from DENV-3__FJ850079__SS-prME
acuucucugugccuuaugaugauacuuccagcagcuuuagccuuucauuuaaccucacgugauggagaaccucggaugauugucggcaaaaaugaaaggggaaaaagucuauuauuuaaaacggcaucaggaauuaauauguguaccuuaauugcaauggaccuaggagaaaugugugaugacacuguaacguacaaauguccacauauaacagaaguagaaccggaagacauagauuguugguguaacuuaacuucaacauggguuacauauggcacuugcaaucaagcuggugaacaccgucgcgauaaaaggaguguagcauuagcgccacacguaggaaugggacuagacacacguacccaaacuuggaugagugccgaaggagcuuggcgacaaguugaaaaaguagaaacaugggcgcugaggcauccaggguuuacuauacuggcacuauuucuugcacacuauauugggacaagccuaacccaaaaaguaguaauauucauccuacuuaugcuuguaacaccuaguaugacaaugaggugcgucggcgucggcaauagggacuucguugaaggauuaucgggcgcaacuuggguugacgucguguuagagcauggcgguugcguaacuacaauggcuaaaaauaaaccaacauuagacauagaauuacagaaaaccgaagcgacucaauuagcaacgcuacgaaaacuaugcauugaagguaaaauuacuaauauaacuacagacuccagaugcccaacccaaggagaagcggugcuuccugaagaacaagaucaaaacuacguuugcaaacauacuuacguagaccggggaugggggaauggcugcggucuauuuggaaaaggguccuuaguaacuugugcgaaauuucaaugucuugagccuauagaagggaaaguaguacaauaugagaaucuuaaauacaccgugauuaucacaguucacacuggcgaucaacaccaggugggcaacgagacccagggcguuacugcagaaaucacuccucaggcuucuacuacagaagcuauuuuaccagaauacgguacuuuagguuuagaaugcuccccaagaaccggccuggauuuuaaugagaugauuuuauuaaccaugaaaaacaaagcauggaugguucauagacagugguuuuucgauuuaccacuaccguggacaaguggagcuaccacagaaacgccuacauggaacaggaaagagcuccuaguaacauuuaaaaaugcucacgcgaagaaacaggaggucguuguucuagguagccaggaaggggcuaugcauacugcgcuuacaggagcgacagagauucaaaacaguggaggaacaaguauuuucgcgggacauuugaaaugcagauuaaagauggauaaacuugaauuaaaaggaaugagcuaugcaauguguacuaacacauucguucucaagaaagaaguaucugaaacucaacaugguacgauucuaauaaaaguggaauacaaaggagaggauguuccaugcaagaucccuuucaguacagaagauggacaaggaaaagcccacaauggaaggcuuaucacugcaaaccccgucguuacuaagaaagaagaaccaguaaauguggaagcagaaccuccuuuuggagaaucgaauaucguaauagggauuggcgauaacgcacuaaaaauaaauugguauaagaaagguuccaguauaggaaaaauguuugaggcgacugcccgcggugcaagaagaauggcaauauuaggagauacugcuugggauuuuggaucuguuggagggguucuaaacagccucgguaaaaugguacaucaaauauuuggaagcgcguauacugcacucuuuucagggguauccuggguuaugaaaauagggauagggguacuauuaacguggauugguuuaaauagcaaaaacaccucaaugucauuuuccugcauugcuaucggaaucauuacucuauaccuuggagcggucguacaggcagacaugggauguguaauaaauuggaagggaaaggaauuaaaguguggaagcgguauuuucguaacuaaugaagugcauacauggacugaacaauauaaauuucaagcagacucuccaaaaagacuagcaacagcuauugcaggcgcuugggaaaacggcguauguggaauccguagcaccacuaggauggaaaaccuguuguggaaacaaauugcaaacgaguugaacuauauuuugugggagaauaacauaaaacuaacggucguagugggcgauauaaccggugugcuggaacaggguaaacgaacuuugaccccgcagccaauggaacuaaaauacucauggaagacuuggggaaaagcaaaaauaguaacugcagaaacucagaacagcucauuuauaauugauggcccaaauacgcccgaaugucccagcgccucaagggcuuggaauguaugggaaguugaggauuauggcuuuggugucuucacaacaaacaucuggcuaaaacuuagggaaguauauacccaacuuugcgaucaucgacugaugagcgcagcagugaaagacgaaagggcuguucacgccgauaugggguauuggauagaaagucagaaaaauggaucauggaaauuggagaaggcaucacuaauagaaguuaagacauguacuuggccgaagucucauaccuuauggucaaacggaguccuggaaagcgauaugaucaucccaaagagcuuagcggguccuauaagucaacauaauuaccguccaggauaccauacucagacugcuggaccauggcaccuuggaaaacuagaacuugauuucaacuauugcgaaggcacaacugugguaaucacagagaacuguggaacacgaggaccaaguuuaaggacaacuaccgucucgggaaaauuaauucaugaauggugcugccguuccuguacgcugccaccucuuagguacaugggagaagauggcuguugguacgguauggaaauaaggccgaucagcgaaaaagaagagaauaugguuaaaaguuugguuucagcaggcucgggagagguugauaauuuuacaaugggaguguuauguuuggcuauacuguuugaagaaguaaugagggguaaguuugguaagaaacauaugauagcuggaguauucuuuacguucgugcuccuauuaucaggacaaauaacguggcgagauauggcucauacguugauuaugaucgggaguaaugccuccgacaggauggggaugggaguaacauaucuugcucuuauagcuaccuuuaagauucagccauuuuuggcucuuggcuucuuucuaagaaaacucacaaguagggaaaaccugcugcucgguguaggcuuggcuauggcuaccacucuccaacuaccggaagauaucgaacaaauggcaaacgguauagcgcuuggccuaauggcguugaaauuaaucacgcaauuugaaaccuaccagcuauggacagcauugauuucgcuuacgugcaguaacaccauauuuacauuaacaguagcuuggagaacagcgacacuuauauuagccggaguaucuuuguuaccggugugccaaucaucaucuaugcguaagacagacugguuaccgaugacuguugcagcaauggguguuccaccacuucccuuauucauauucagcuugaaagacacucugaagagacgaaguuggccacuaaaugaaggcguaauggcagugggauuaguaagcauacuugcuaguaguuuauuacgaaaugauguaccaauggcagggccccuaguggcagggggacugcuuauagcuuguuaugucauaacugggacuucugcugaccuaaccguugaaaaggcagccgacgucacaugggaggaagaagcggaacaaaccggagugagucauaaccucaugauuacaguagacgaugauggaacaaugagaauaaaagacgaugagacugagaacauacuaacaguauuguuaaagacagcucuacugauaguuucugggauuuuuccauacucuauaccggcuacgcuccuuguauggcauacuuggcaaaaacagacacaaagaucaggagugcuuugggacgucccguccccgccggaaacccaaaaggcagaauuggaagagggaguguaccggauuaaacaacaagguaucuuugggaaaacacaaguaggaguuggaguacaaaaagagggaguauuucacacuauguggcauguaacaagaggagcgguauuaacuuauaacgggaaacgacucgaacccaauugggcgucgguaaagaaagaccuaaucaguuacggaggaggauggcgauuauccgcacaauggcagaaaggagaggaaguccaagucauugccguagaaccggguaaaaacccgaaaaacuuucaaacgaugccaggaaccuuccaaaccacaacgggggaaauaggggcgauagcguuagacuucaaaccaggaaccagcggaagcccuaucaucaacagggagggaaaagugguuggauuauacggcaauggaguagugaccaaaaacggaggauacguuucugguaucgcccaaacaaaugcugaaccagauggcccaacaccagaguuggaagaagagauguuuaagaaacguaaccuaacaaucauggaccuccacccaggcaguggaaaaacaagaaaauacuugcccgcuauaguacgagaagccauaaagaggagacuaaggaccuuaauauuagcgccuacaagggucguagccgcggaaauggaagaggcccuaaaaggcuuaccuauuagauaucagacaacagcaacuaaauccgaacauacagggcgagaaauaguagauuugaugugucacgcaaccuucacaaugagauuauuaucaccugugcgaguaccgaacuacaaucuaaucaucauggaugaggcccauuucaccgacccugcuucaauagccgcacgcggauauauuaguaccagggugggaaugggagaagccgcugcuaucuuuaugaccgcaacaccaccaggaacggcugaugcauucccccaaucgaacgccccaauccaagacgaagaaagggauauaccagaacgaucuuggaacucggguaaugaauggauaacugauuuugcuggaaaaaccguuugguucguuccgaguaucaaagcgggaaacgauauugcgaauugccuuaggaaaaauggcaaaaagguaauacaauuauccagaaaaacuuuugauaccgaauaucagaaaacuaaauugaaugauugggacuuuguaguaacaacagauauauccgagaugggagcgaauuuuaaggccgauagaguaauagacccaaggagaugcuuaaaaccaguaauacucacggacgggccugagcgaguaauuuuagcaggcccuaugccagucacugcagcgucagccgcacaaagacguggacgaguaggcagaaauccgcaaaaagagaaugaccaauauaucuuuacaggccaacccuuaaauaaugaugaagaucaugcccacuggacagaagccaaaaugcuacuagacaacauaaauacaccggaggguaucauaccagcgcuuuuugaaccagagagagagaaaagcgcugcgauugacggggaauacaggcuaaaaggagaaucgagaaaaacuuuuguugaacuuaugcguagaggggauuuaccugucuggcucgcacacaagguugccagugaaggcauaaaauauaccgaccgaaaaugguguuucgaugggcaacgcaacaaucaaauccuagaagaaaauauggacguagagauuuggacgaaagaaggugaaaagaagaaacuucguccaagaugguuagacgcucgaacuuacucugauccacuggcacugaaagaauuuaaagacuuugccgcuggccguaagucaauagcguuagaccuagucaccgaaauaggacgugugccgacucauuuggcgcaucggacaagaaacgcauuagauaauuuaguaaugcugcauaccucagaacauggaggaaaagcguauagacaugccguugaagaacuuccggagaccauggaaacuuuauuacuacuuggauuaaugauucuuuuaacagguggcgcaaugcuauuucuaauuagcgggaaaggcauagguaaaaccuccauagguuuaauauguguaauagcaaguucuggcaugcucuggauggcagaaauuccguuacaauggaucgcgucugccauagucuuagaguucuuuaugaugguauuguuaaucccagaacccgaaaaacaaagaacuccacaagauaaucaacuugcauacgucguaauugguauucuaaccuuggcagcgauaauugccgcuaacgaaaugggauuauuggaaaccacaaaaagagauuuaggcaugagcaaagagccagggguaguaucaccuacuucguaucucgacgucgaccugcauccggcaagcgcauggacccucuaugccguagcgacgacaguaauaacaccgauguuaagacacacuauagaaaauucuacagcaaacguuagucucgcggccauagccaaccaggcaguaguauuaaugggucuugauaaaggauggccaauaagcaaaauggaucuagguguaccauuacuugcacuaggaugcuacucucagguaaauccgcugacauuaacagcagcaguacugcuauuaauaacgcauuaugcaauaauaggcccggguuuacaggcgaaagcgaccagagaagcacaaaagaggaccgcagcggguaucaugaaaaauccaacgguagauggaaucaugacuauagaccuagacccgguuaucuaugacucaaaauuugaaaaacaguuaggacaaguaaugcuccuaguuuuaugcgcuguccagcuucugcuuaugcgaaccucaugggcacuaugcgaagcacucacacuagcaacggggcccauaacuacccucugggaagggucacccgguaaauuuuggaauacuacuauugcugucagcauggccaauauauuucgagguuccuacuuagccggagcaggacuggcauuuagcauaaugaaaagcguuggaacuggaaaacgggggaccggaucacagggagagacucucggagaaaaauggaaaaagaaauuaaaucaacucucccgaaaagaguuugaccuuuauaagaaaucggggauaacugaaguagauagaacagaggcaaaagaagguuuaaaaagaggcgaaauaacacaucacgccguaucaagaggaagcgcgaaauugcaaugguuuguugagcgcaauaugguuauaccagagggucgagugauagaccuaggauguggaagaggcggaugguccuauuauugugcgggucucaagaaaguuacggaaguaagagguuauacaaagggaggacccgggcaugaggagcccguaccaaugaguacauacggauggaacauuguuaaauuaaugucuggaaaagauguauucuaucugccucccgagaagugugauacguuacuaugcgauauuggagagucgagcccauccccgacaguagaggaaagucgaacaauaaggguccuuaaaaugguagaaccauggcucaaaaauaaucaauuuuguauuaaaguauuaaauccauacaugccuacaguuauugaacaucuagagcguuuacagcgaaaacauggcgguaugcucguacgaaacccuuuaucuagaaauucuacucaugaaauguauuggauuaguaacggaacuggaaauauuguagcuaguguaaauauggugucaagauuauuacuaaaccgauuuaccaugacucauagaagaccgacgauagagaaagauguugaccuuggcgccgguacacgucacguuaacgcagaaccugagacacccaauauggauguaauaggagaaagaauaaaaagaauuaaagaggagcaugacucaacuuggcauuaugaugacgagaacccuuauaagacuugggcauaccauggauccuacgaagugaaagcuaccgguuccgcaucaucaaugaucaauggaguuguuaaacugcucaccaaaccaugggaugugguuccuaugguuacacagauggcuaugacugacaccacuccguuuggacaacaaagaguauucaaggaaaaggucgauaccagaacaccgagguccaugccagguacucgccguguuaugggaaucacagccgaguggcuauggcgaacucuugggaggaauaagaaaccgcggcuuuguacaagagaagaauuuacuaaaaagguucgaacuaaugcugcaaugggagcaguuuucacagaagaaaaucagugggauagugcaaaagcagcugucgaagaugaagauuucuggaagcuaguagauagagagagagaacuacacaagcugggcaaauguggaucauguguauacaacaugauggguaaaagagagaagaaacuaggugaauuugggaaagcuaaagguucgagagcaauaugguauaugugguuaggcgcacguuauuuagaauuugaagcauuagguuuccuuaaugaggaucacugguuuaguagagaaaauucauacucaggaguugaaggugagggguuacacaagcucggauauauucuucgagacauuagcaaaauccccggaggagcaauguaugccgaugauaccgcuggaugggacacaagaauaacagaagacgaccuacauaaugaagagaaaauuacacagcaaauggacccugaacauaggcaauuagcaaacgcgaucuuuaaauugacauaccaaaacaaggucgugaagguacaaagaccaacgcccacaggcacuguaauggauauaaucagccgaaaggaucaaagagggagcggacaaguuggaacuuauggacuaaacacauucaccaacauggaagcacaacucauacgacaaauggaaggggaaggaguauuaucgaaagcggauuuagaaaauccacaucuaccagagaagaaaaucacgcaauggcuagagacaaaagggguagagaggcucaaaaggauggcaauaucgggugaugauugcguaguaaagccaauagaugaccgguucgcaaaugcguuacuggcccugaaugauaugggcaaaguacguaaagauauuccccaauggcaacccuccaaaggauggcaugauuggcagcaaguacccuuuugcucacaucacuuccaugaauuaauuaugaaagacggacgaaaauuaguagucccaugucguccccaagaugaacuaauaggacgagcacgaauaucccaaggugccggauggagucuccgagaaacggccuguuuagggaaggcauaugcccagauguggucacuaauguacuuucauagaagggacuuaagacuugcauccaaugccauaugcuccgcaguaccaguucauuggguucccacgaguagaacaacguggaguauacacgcacaucaucaguggaugacgacagaagauaugcuaacagucuggaacaggguuuggauagaagauaauccuuggauggaagauaagacuccuguaaccacaugggaaaacguaccguacuuaggcaagcgagaagaucaaugguguggaagucuaauaggauuaacaucccgugcuaccugggcacaaaacaucccuacugccauucagcagguuagaagccuaauuggaaaugaagaauuuuuagacuauaugccuaguaugaaacgcuuucgaaaggaggaagagagugaaggagcgauuugguaa

SEQ ID NO: 23046 - RNA, 9873 nt, Artificial Sequence
  derived and/or modified CDS sequence (opt6) from DENV-3__FJ850080__SS-prME
acaucuuuaugccugaugaugaucuuaccagcagcgcuggcguuucaucuaacgaguagggauggagagccacgcaugauugucgguaaaaacgaaagagggaaaucccuuuuguuuaaaacagcaagugggauaaacauguguacuuugauagcaauggaucuuggagagaugugcgacgauacagugacauacaaaugcccacacaucacagagguagagccugaggauauugacuguuggugcaaccuaacauccacuuggguaacuuaugguacaugcaaccaagcuggagaacaucguagggauaaaaggagcguugcuuuagcuccccacgucgguaugggacuagauacuagaacucaaacuuggaugucagcagaaggagcauggaggcaaguugaaaaaguggaaacaugggcacuaagacacccgggauucacaauccuagcacucuuucuggcacauuacauaggaacuucccugacacaaaaaguuguaauauuuauauuacugaugcuuguaacgccuaguaugacaaugcgcugugucgguguagguaacagggacuuuguagagggacuuucuggggcaacgugggucgacgucgucuuagaacauggaggauguguuacuaccauggccaaaaauaaaccgacacucgauauagaauuacagaaaacugaggcaacacaauuagcaacucuuaggaaacucugcauugaaggaaaaauuacaaauauuacaacugauucgagauguccuacacaaggcgaggcaguucugccagaagaacaagaucaaaauuacguauguaaacacacuuacgucgacagaggcugggguaaugguugcggacuguucggaaaagguuccuugguuacuugcgcaaaauuucaauguuuagaaccaauagagggaaaaguaguucaauaugaaaacuuaaaauacaccguaauaauaaccgugcauaccggugaucaacaucagguaggaaacgaaacacaagguguuacggcagaaauuaccccacaagcuagcacaacugaagccauuuuaccggaauauggaacacuaggacuagaauguuccccucgaacuggucuugauuuuaacgaaaugauacuucugacuaugaaaaauaaggcuuggaugguccacagacaaugguucuuugacuuaccguuaccguggaccucaggagcuacuaccgaaacaccgacauggaacagaaaagaacuguuagucacguuuaaaaacgcccaugccaagaaacaagagguaguaguauuagguucccaagagggugcaaugcacacggccuugaccggcgccaccgaaauacaaaauucgggaggaacaagcauuuucgcagggcacuugaaaugucgucuaaagauggacaaacuugaacuaaagggaaugucauacgcaauguguacuaacaccuucguccuaaagaaagaaguguccgagacgcaacaugguacaauuuuaauuaaaguggaauauaaaggagaagaugcaccgugcaaaauuccauuuucaacugaagacgggcaagggaaggcgcauaauggaagacuaauuacugcuaauccaguaguaaccaagaaagacgaaccaguaaauauugaagcagaaccgcccuuuggcgaaaguaauauaguuaucgggauaggcgauaacgcacuaaaaauuaauugguauaagaaaggcucaaguauaggcaagauguucgaagcuacggcuagaggcgccaggcggauggcaauacuaggugacacagcaugggacuucggaagcgucggaggugugcuaaauucuuuaggcaaaaugguacaucaaauauucggaagcgcauacacggcauuguucaguggcgucaguuggguuaugaagaucgggauaggaguccuucuuacauggaucggcuuaaacuccaaaaauacgaguaugagcuuuaguuguauagcaauaggaauuauaacucuuuacuugggcgcuguaguacaagcggauaugggcuguguaaucaacuggaaagguaaagaacuaaaaugugguaguggcaucuucguuacgaacgaaguacauacuuggacagaacaguacaaguuucaagcagauucacccaagcguuuagcaaccgccauagccggugcaugggaaaacggaguauguggaaucagaaguacaacacgcauggaaaaccuacuguggaaacaaguagcaaacgaacuaaacuauaucuuaugggagaacaauaucaaacucacaguuguaguaggugauauaaucggagucuuggagcaaggaaaaagaacacuuacgccacaaccaauggaacuuaaauacuccuggaagaccuggggcaaagcuaagauaguuacggccgaaacucaaaauucaucauucaucaucgauggacccaauacgccagaauguccuucagcaagucgagccuggaauguaugggaaguugaagauuacgguuuuggaguuuuuacgacaaacauaugguugaaauuaagagaaguauacacacaacuaugcgaccaccgacuaaugucugcagcaguaaaagacgaacgugcaguacaugcggauaugggguacuggauagagucccagaaaaaugguucauggaaacuugaaaaggcaagccugaucgaaguuaagacguguaccuggcccaagagccauacucucuggucgaauggugucuuggaaagugauaugauaauuccaaaaagccucgccgguccuauaucucaacacaaccauagaccaggauaccacacacagacagcgggcccuuggcauuuaggaaaauuagaauuagacuucaauuauugugaaggcacaacuguuguaauaacggaaaauuguggaacuaggggcccuucguuacguacuacaacagugagcgguaagcucauacaugaaugguguugucggaguuguacacuuccuccauugagguacaugggagaggaugguuguugguacggcauggaaauaagaccaauauccgaaaaggaagagaauauggugaagucccugguaucugccggaagugggaaaguagacaacuucacaaugggcgugcuguguuuagcaauacuuuuugaggaagugaugcguggaaaauuuggcaagaaacauaugauugccggaguauucuucauguuuguacuuuuacuaucuggucaaauaacauggagagacauggcccacacauugauuaugauaggcuccaaugcuucggauaggauggguaugggcguaacauaucuagcacuaauagcgacauuuaaaauacagcccuuccuagcucuaggauucuuucuucguaaacucacuagccgugaaaaccuuuuacuaggugucggucuugcaauggccacaacgcuccaacuacccgaagauaucgaacaaauggcgaauggaaucgcguugggucucauggcacuaaagcuaauuacucaauucgaaacauaucaacucuggaccgcacucauaagucucaccuguucaaauacaauguucacccuaaccgucgcauggagaacagcgaccuuaauacucgccgguguaucacuacucccgguuugucagaguucaucaaugagaaaaaccgacugguuaccaauggcaguugcugcuauggggguaccuccucugccuuuauucauuuuuagccuaaaagacacauuaaaaagaagaucguggccacuaaaugaaggugugauggcuguuggucuagucaguauacuagcgagcuccuuacuacguaacgacgucccaauggccggucccuugguagcuggaggcuugcuaauagccuguuacgugauuacgggcaccuccgcagauuugacuguagaaaaggcagcagauaucacaugggaagaagaagccgaacagacgggggugagccauaaccuuaugauuacaguugacgaugauggaacuaugcgaauuaaggaugaugaaacugaaaauauuuugacggucuuacuuaaaacugcacucuugauuguauccgggguguuuccguauaguauaccagcgacauugcugguuuggcauacguggcaaaaacaaacucagcggagcggcguccuaugggacgugccuagucccccggagacacaaaaggccgaacucgaagaagggguauauagaauaaaacaacaaggaauuuuugguaaaacccaaguaggcguugguguacagaaggaaggaguauuccauaccauguggcacgugacuagaggugcaguccugacauauaauggaaagagguuagaaccaaacugggcgagcguaaagaaagaccucauaucuuaugguggcgguuggaggcucagugcucaauggcaaaaaggggaagaaguacaaguaauagccguugaaccaggcaaaaacccuaaaaacuuucaaacaaugcccgggacauuucaaacaacgacaggugaaaucggagcgauugcucuagacuucaaaccugggacaucagguaguccuauaauaaacagggagggcaaaguugucggauuauacggcaauggaguuguaaccaaaaacggaggcuacgucagcgggaucgcccaaaccaacgcagaaccggauggaccuacgccagaauuggaggaagaaauguuuaagaaacggaacuuaacuauuauggacuuacacccaggaucagguaagacccgcaaauacuuaccagcgauaguccgugaggcgauuaaaagacgauuaagaacacuuauacuagcaccuacuagaguaguggcagcugaaauggaagaagcgcugaaaggcuugccaauaagauaccaaaccacugcuaccaaaucagaacacacagggagagaaauuguggauuuaaugugccaugcaacuuucacuaugcgguuacugucaccaguccguguaccaaauuacaacuuaauaauaauggaugaagcucacuuuacggauccagcuagcauagcagcaagagguuauaucucuacucgaguaggaaugggugaagcggcggcuauauucaugacagcuacaccuccuggaacagcagacgcuuuuccucagaguaacgcuccaauucaggaugaagaaagggacauaccugaaagaagcuggaacucaggaaaugaauggauaacugauuucgcaggaaaaacagucugguucguuccuaguauaaaggcuggcaaugacauagcuaacugccuacgcaaaaaugggaagaaagugauucaguuaucacgcaaaacguucgacacggaguaccagaaaacaaaacuaaacgacugggauuuuguaguaacaacugauauaagcgaaaugggagcaaauuuuaaagcggaucgaguaauagauccucguagaugcuuaaagccaguaauucuuaccgaugguccagaacgagugauacuagcggggccuaugcccgugacagcugcuucagcagcccaacguagggguagaguaggccguaacccacaaaaagaaaaugaucaauacauauuuacaggacaaccgcuaaauaacgaugaagaucacgcucacuggacggaggcuaagaugcuguuagauaauauuaauacuccagaagguaucauaccugcacuauucgaaccagaacgagagaaaagcgcagcuaucgauggggaauaccgucuaaaaggcgaaucaagaaagacuuuugucgagcugaugcguagaggagaucucccgguaugguuagcgcauaagguagcaagcgaagggauuaaguacaccgaccguaaauggugcuuugacggacaaagaaacaaucagauacuugaagagaacauggacguggaaauuuggacaaaagaaggagagaagaagaaacuacguccucgauggcuagaugcccggacauauagugacccuuuagcauuaaaagaguuuaaagauuuugcggcuggccgcaaaucuaucgcccuggaucucgucacugaaaucggucgcguaccaucccaccuagcgcauagaaccagaaacgcacuggauaaccuuguaaugcuucauacuucagagcacggugguagggcguaucgucaugccguagaagaauuaccagaaacaauggagaccuuauuauuacuggguuuaaugaucuuacucacuggcggggcuauguuguuucuaauaucaggcaaaggaauagguaaaacgucaaucggacugauuugugucauugcgucaucugguaugcuuuggauggcagaaauuccacuucaguggauugcuucugcgauuguauuggaguucuucaugaugguacuucuaauuccugagccagaaaaacagcggacaccacaggacaaccagcuagccuacgucgucauaggcauacucacauuagcugcuauaaucgcggcaaacgagaugggauuacucgagaccacaaaaagggaccuaggcaugucaaaagaacccgguguagucucgccuacaucuuaucuggacguggaccuucauccggcuuccgcuuggacauuauacgcgguagcgacaacaguuauuaccccuauguuaagacauacaauagaaaacaguacugcaaacguaagucucgcagcuauagcuaaucaagcaguuguacuaauggguuuagauaaaggauggccuaucaguaaaauggaccuaggaguuccgcuacuagccuuaggauguuauucacaaguaaauccucuuacacuaacugcagcaguauuacuauuaauuacgcacuaugcaauaaucgggccaggacugcaggccaaagcaaccagagaagcucaaaaacgaaccgcugcagguauaaugaaaaauccaacaguugaugggauaaugaccauagaucucgauccggugauauacgauucaaaguucgagaagcaguugggacaagucaugcucuuaguauugugugcaguacaacuuuuacuaaugcgaacauccugggcauuaugugaggcucuuacacuagcgacuggcccuauaacaacacucugggaaggcuccccagguaaauucuggaauacaacgauagcaguuaguauggcgaauauauucagagggaguuauuuagcuggugcaggacuagcauucucaauaaugaaauccguuggaacaggaaaaaggggcacuggaagucagggugaaacccucggcgaaaaauggaagaagaaguugaaucaacuaagcagaaaagaauuugaccuauauaagaaaucuggaauaacugagguugaccggacagaagccaaggagggauugaaacgaggugaaaccacccaucaugccguguccaggggaucugcuaaacuacaaugguucguagaacgaaauaugguaauaccugaagggcguguaauugaucuaggcugcggaagaggcggguggucauauuauugugcuggacuaaagaaaguaacugaaguccgggguuauacaaaagguggaccagggcaugaagaacccguaccuaugucuacuuauggauggaauaucauaaaauuaauguccgggaaagacguguuuuaucuaccuccugagaaaugcgacacgcucuugugugacaucggcgaaaguucacccaguccaacgguagaagaaucaaggacaauucgaguauugaaaaugguugaaccauggcucaaaaacaaucaguuuuguauaaaaauucuaaauccuuacaugccaacuguaauugaacacuuagaaagguugcagagaaaacauggcgguauguuagugagaaauccacuaucacguaacucaacccaugagauguacuggauuucaaaugggaccggcaacauuguugcaucugugaacauggugagucguuugcuucugaauagauuuacaaugacgcacagaagaccgacaaucgagaaggauguagaccuuggggcuggaacucgacauguaaaugcggaacccgaaacaccuaauauggauguaauaggagaaaggauuaaacgaauaaaagaagaacauaauagcacguggcauuaugacgaugagaaucccuacaaaacaugggcguaccacgguagcuacgaagugaaggcgacugguagugcaagcucgaugauaaaugguguugugaaauugcucacaaaaccaugggaugucgugccaaugguuacgcaaauggcuaugacagauaccacaccauucggacaacagcgcguauucaaagagaaaguagacacuagaaccccucgcucaaugcccggaacacggaggguaaugggcauaacugcagaaugguuauggcgaacccuugguaggaauaagaaaccaagacuguguacccgugaagaauuuaccaagaaaguaaggacaaacgcagcaaugggggcaguguuuacugaggaaaaccaaugggauucagcgaaagcagcuguggaagacgaagauuuuuggaaauugguagacagagagagagaacuacacaaacucgguaaaugcggauccugcgucuauaacaugauggguaagagagagaagaagcucggggaguuuggaaaggcuaaggguagucgugccauaugguauauguggcuaggggcaagguaccuagaauuugaagcucuaggauuucucaaugaagaucauugguuuaguagagaaaauuccuauucgggaguagagggcgaaggucuccauaaacuaggguacauauuaagggacauaucgaaaauuccagguggugccauguacgccgacgauacugcaggcugggauacacgaaucacggaagaugaucuacacaaugaagagaaaauaacacaacaaauggaccccgaacacagacaauuggcuaacgcuauuuucaagcuaaccuaccaaaacaaaguaguaaaaguucaaaggccaacaccgaccgggacgguuauggauaucauaaguagaaaagaucagagaggaucuggacaaguggggacguacggauugaauacuuuuacaaacauggaagcgcaguugauacggcaaauggaaggcgaaggggugcuaagcaaagccgauuuagagaacccucauuuaccggagaagaaaauaacacagugguuagaaacgaaaggugucgaaagauuaaaaagaauggcaauaaguggagacgauugcguuguaaaaccaauagacgaccguuucgcgaacgcauuacuugcccucaacgacaugggaaagguaaggaaggauauaccucaguggcaaccgagcaaaggauggcaugacuggcaacagguccccuuuugcucucaucacuuccaugaguuaauuaugaaggauggaaggaagcucguagucccauguaggccucaagacgaauuaauagguagagcaaggauaucgcaaggggccggauggucguuaagagaaacagccugccuaggcaaagccuaugcucagauguggaguuuaauguacuuccauagaagggaccugagacuggccucaaaugcaauuugcagugcuguaccaguccacuggguaccgaccagccgaacgaccugguccauccaugcgcaccaucaauggaugaccaccgaagauaugcuaacagucuggaacaggguuuggauagaagauaauccuuggauggaagacaaaacaccugugacuaccugggaagacguaccuuaucucggaaaacgcgaagaucaauggugcgguuccuuaauuggauuaacgucacgugccaccugggcacaaaauauuccuacagcgauccagcaaguaaggagccuaaucgggaacgaagaauuucuagacuauaugccaaguaugaaaagauuucggaaagaagaagaaagugaaggagcuauuugguaa

SEQ ID NO: 23047 - RNA, 9873 nt, Artificial Sequence
  derived and/or modified CDS sequence (opt6) from DENV-3__FJ850083__SS-prME
accaguuuaugccucaugaugauauuaccagccgcacuugcguuucauuuaacuucaagagauggagagccuagaaugauaguggguaaaaaugaaagaggaaaaucacuccuuuucaaaacugccucgggaauaaauauguguacacuaauagcuauggaccuaggagaaaugugcgacgauacaguuacauacaaaugcccgcacauuacggaaguagaaccagaggauaucgacuguugguguaaucugacaaguacaugggugacuuaugggacauguaaccaagcgggagaacauagaagagacaaacgaucuguagcacuggcaccgcaugugggcaugggguuagacacacgaacucaaacauggaugagcgcggaaggggcguggagacaaguugaaaaaguagagacaugggcacuccgacacccaggauucacuaucuuagcacuauuccucgcacauuacauugggacaagucuaacgcaaaaaguagugauuuucauacugcuuaugcuagugaccccaucaaugacaaugaggugugugggugucggaaaccgagauuucguugaaggguugucgggugcaacauggguagacguuguacuagagcaugguggauguguuaccacgauggcgaaaaacaaaccaacuuuagauauagagcuccagaaaacggaagcaacccaacucgcuaccuuacgaaaauuaugcauagagggcaaaauaaccaauauuacgacagauaguagguguccaacacaaggagaagcagucuuaccagaggaacaagaucaaaacuacguauguaaacauacauauguagauaggggcuggggaaauggguguggcuuauucgguaaaggaagccuaguaacaugcgcaaaguuucagugcuuagaaccgaucgaagguaaggucgugcaacaugagaaccugaaauauacaguaauuauaacaguccauacaggcgaucaacaccaagugggaaaugaaacacagggcguuacagcugagaucacuccgcaagcaagcaccacggaagcgauccuaccugaguaugggacauuaggacucgaguguaguccucguacugggcuggauuuuaaugaaaugauucuacucacuaugaaaaauaaggcuuggaugguacacagacaaugguuuuucgaccugccuuuaccauggacaaguggggccacaaccgaaacuccuacuuggaacagaaaggagcuauuagugacauuuaagaaugcccaugccaagaaacaagaaguagucguauuaggaucacaagaaggcgcaaugcauacagcguugacaggagcaacagaaauacaaaauucugggggaacaagcauuuucgcuggacaccuaaaauguagacuaaagauggacaaacuagaacugaaggggaugaguuaugcaaugugcacaaacacguucguucugaagagagaaguaucagaaacucaacauggaaccauauuaauaaaaguugaauauaaaggagaagaugcaccaugcaaaauaccauucucuacugaagauggacaaggaaaagcgcauaacggucgguuaauaacugccaaccccguuguaacuaagaaagacgaacccguaaacauagaagcggagccgccauuuggugaguccaauaucgugauagguauaggggauaaugcacuaaagauaaacugguacaagaaaggaucgaguauaggaaaaauguucgaagcgacugcaaggggagcaagacggauggcuauacuuggcgacaccgcaugggauuucggaucaguggguggaguacuaaacaguuuagggaaaaugguacaucagauauucggcagcgcauacacagccuuauucagcgggguaaguuggguuaugaaaauaggaauugggguauugcugacguggauaggguuaaauaguaaaaauaccagcaugucuuucaguugcauagcgauugggacuauaacgcuauauuuaggggcaguagugcaagcagauaugggauguguaaucaacuggaaaggaaaagaauuaaaauguggaucgggaauauucguaacaaaugaaguacauacauggacggaacaauacaaauuccaagcagauucaccaaaacgauuagccacugcaauagcaggagcuugggagaauggagucugcgggauucgaagcacuacacguauggagaaccugcuguggaaacaaauugcaaacgaauuaaacuacauucucugggaaaauaacauaaaacuaacgguuguaguuggcgauauuauaggaguacuagaacaggguaaaagaacacugacuccacagcccauggagcuuaaauauucauggaaaacauggggaaaagcaaaaauaguaacugcugaaacacaaaacaguucauuuauuaucgauggccccaauacaccugaaugcccuucugccucacgcgccuggaaugucugggaaguugaggauuacgguuuuggaguguucaccacaaacaucugguugaaacuacgggaaguauacacgcaacuaugcgaccaccguuuaaugucagcggcagucaaggaugaacgagcuguucacgcugacaugggauauuggauugagucacagaaaaacggaagcuggaaauuagaaaaagccuccuugauagaagugaaaacauguacuuggcccaaaucacacacacuauggagcaaugguguacuagaauccgauaugaucauacccaaaucuuuggcagguccuauaagucaacauaaccaucggccaggauaucauacucaaacggccgguccuuggcauuugggaaaacuugaauuggauuuuaacuacugugaaggcacaacgguuguaauaacugaaaauugcggaacaagaggccccucacucagaacaaccaccguaagcggaaaacuaauucaugaaugguguugcagaucuuguacucuaccaccauugcguuacaugggagaggauggauguugguauggaauggaaauuagacccauaucagaaaaagaagaaaauauggugaagagucuaguaagugcaggaagcggaaaaguagauaacuucaccaugggaguguuaugcuuagcaauccuauuugaagaagugaugcgaggcaaauuugguaaaaagcauaugauagcaggggucuucuuuacguuuguacuauugcuaucaggucaaaucacguggcgcgauauggcucauacuuuaauaaugauagggaguaaugcuucugacagaaugggaaugggaguaacuuacuuagcucuaauugcaacauucaaaauacaaccauuucuagcacuagguuucuuccuuagaaaacuaaccuccagagaaaaucuucugcuggggguuggacuagccauggcaaccacacuccaacuuccagaagauauagaacaaauggcaaauggaauagcucuggggcuuauggcauugaaacuuauaacacaguuugaaaccuaucaauuauggaccgcucucaucucacuaacauguucuaacacaauguuuacgcuaacaguugcauggagaacggcaacccucauuuuagccggcguuucacuuuugccaguuugccaaaguaguaguaugcgaaagaccgauuggcuuccaauggcaguggcugcaaugggcguaccuccucugccauuguucauauuuucuuuaaaagauacauuaaaacgaagauccuggccucuuaacgagggugucauggccgucggcuugguaucuauacucgcaucuuccuuacuacguaacgacguucccauggcggggccucucguagccggaggcuuguugaucgcuuguuauguuauaacaggaacaucggcggacuuaacagucgaaaaagcagcugauaucacuugggaggaagaagcagaacagacuggcgugagucauaaccucaugauuacuguagacgaugauggaacaaugagaauaaaagaugaugaaacagaaaacauacuaacaguucuguugaaaacugcucugcuaauaguauccggaguguuuccauauagcauaccugccacucucuuaguguggcauacuuggcagaagcaaacacaacgaucagggguccuaugggacgucccaagcccucccgagacccagaaggccgaacuagaagaagguguuuaccgaauaaaacaacaaggaauauucggaaaaacucaagugggugucgguguacaaaaagaaggcguauuucacaccauguggcacguaacucgaggcgcaguguugacauauaacgguaagagauuagaacccaauugggcuagugucaagaaagacuugaucucguacggaggggguuggagauuaagugcacaguggcaaaagggugaggagguucagguaauagcaguggaaccgggaaagaaucccaaaaauuuucaaaccaugccuggcacauuucaaacaacgacuggagaaauaggugcaauagcgcuagauuucaagccuggcaccaguggaucuccaauuauuaauagagagggaaaagucgucgggcuauauggcaauggaguggucacuaagaaugggggauacguuucagguauugcacaaacuaaugcagagccagacgguccaacaccagaauuggaagaggaaauguuuaagaaaaggaauuugacaauuauggaucuucauccaggaucagguaaaacaagaaaauauuuaccagcgauuguaagagaggcuauaaagagaagacuacgcacgcuaauccuagcaccaacacgaguaguugcggcugaaauggaagaagcacuaaaaggacuaccuauucgauaucaaacaacggcaacaaaaucugagcacacagggcgugagauuguagacuuaaugugccacgcaacguuuacuaugagacuacuaagucccguucgagucccaaacuauaaccugauaauaauggacgaagcacauuucacugauccagcaucuaucgcugcaaggggcuauauaaguacccgugucggcaugggagaagcggcagccauuuucaugacagcuacgccaccaggcacagcugacgcguucccucagagcaaugcuccaauccaagacgaagaaagagauauuccagaacgcagcuggaauagcgguaaugaauggauaacugacuuugcagguaagacgguaugguuuguuccuucaauaaaagccggaaaugacauugcaaacugccuacguaaaaacggcaagaaagucauucaacuaaguagaaaaacauuugacacugaguaccagaaaacuaaacugaaugacugggacuucguagucacaaccgacauaagcgaaaugggagcuaacuuuaaagcugauagaguaauagauccacgaagaugcuuaaaaccagugauccucacagauggacccgagcgaguaauuuuggccgguccgaugcccguaacugccgccucugcagcccaaagaagaggaagaguaggaagaaauccgcaaaaagagaaugaucaauauauauuuacaggucagcccuuaaauaaugaugaagaucacgcgcacuggacagaagcgaaaaugcuacuagacaacaucaauacuccugaagguauaaucccugcccuuuuugaaccugaacgagaaaagucagcugcuaucgacggagaauacagacugaaaggagaaucccguaaaaccuucguggagcuaaugagacgaggggauuuaccgguguggcuagcacauaaaguugcaucagaagggauaaaguauacagaccgaaaauggugcuucgacggacagcgaaacaaucaaauccuagaggagaacauggaugucgagauuuggacaaaggaaggcgagaagaagaaacuacgaccucggugguuggaugcacggaccuauagugacccauuggcgcuaaaggaguuuaaagacuuugcagccggccggaaaucuauagcucuugaccuuguaaccgaaauaggacgaguaccaucacauuuagcgcaucgaaccagaaaugcauuagacaacuugguuaugcuacacacaagcgaacauggcggacgagcauauagacaugcgguggaagaacuacccgaaaccauggagacauuacuacuuuuaggcuuaaugauauuacuuaccgguggggcuauguuguucuuaauaucggggaaaggaauagggaaaacauccauuggauuaauuugcgucauugcuaguagugguauguuauggauggcugaaauucccuugcaauggauagccucagccauaguucucgaauuuuucaugaugguucucuuaauccccgaaccggaaaaacaacgaacaccacaagauaaucaacuagcuuacguugucauagguauauuaacuuuggcagcgauaauagcggcaaacgaaaugggacuuuuagagacuacaaaaagagaucuagggaugucaaaagaaccagggguaguaucaccaacaucauaucuugacguggaccuacacccagcuuccgcuuggacacuauaugcuguugcaaccacagucauaacacccauguuacgacauacaauagaaaacucuacugcaaauguaaguuuagcagcgauagcaaaucaagccguaguauugaugggucuagacaaaggauggccaauaucaaagauggacuuaggcguaccacucuuagcauuagguuguuacucucaaguaaacccucucacucuaacggcagccgugcuucuucuuauaacacacuaugcaauaauugggccaggacugcaggcaaaagcaacccgggaagcgcagaaaaggacagcggcgggaauaaugaaaaacccuacgguagacggcauaaugaccauugaccuugaccccguaauauaugacucaaaauuugagaagcaauugggacaaguuaugcuauugguguuaugugccguacagcuacuacuuaugaggacaagcugggcucuuugugaagcucuuacacuagcaaccggacccauuacaacacuaugggaggguaguccugguaaauuuuggaacacaacgaucgcggucagcauggcgaauauauuuaggggaucguauuuagcaggagcuggucuggcauuuucuauuaugaaauccguagggacuggcaaaagggggacaggaucccaaggcgaaaccuuaggcgaaaaauggaagaagaaauuaaaucaacuaagccgaaaagaauuugauuuauauaagaaaucagggauaacagaaguugacagaaccgaagcaaaagaagguuuaaaacgaggagaaaccacucaucaugcaguuucgagaggaagugccaaguuacagugguuuguugaacguaacaugguuauuccugaaggccgaguaauagaccugggauguggacgaggggguuggucauacuauugcgcaggauuaaagaaggugacugaaguacgaggguacacaaaaggagggccaggacacgaggaaccgguuccaaugaguacauauggcuggaauauuguaaaacuuaugucaggcaaagauguauuuuacuuaccaccagaaaaaugcgacacacuacugugcgauauaggugaaucuagcccgucgccuacaguagaggaauccagaacaauaagaguguuaaaaauggucgaaccguggcucaagaauaaucaauucugcauaaaaauacugaacccguacaugccaacaguaauagaacauuuagaaagacuucaacggaaacacggcggcaugcuaguaagaaacccuuuaucgagaaauucgacgcacgaaauguauuggaucucaaacgguaccggcaauaucguagcaucagucaauaugguuagcaggcuucuucugaaucguuucacuaugacgcacagacggccaacuaucgaaaaagacgucgauuuaggagccggaacacgucauguaaacgcagagcccgaaacuccuaauauggacguaauaggcgaaagaauuaaaagaauaaaggaggagcacaauucaacauggcauuaugacgaugagaauccguauaaaacaugggcauaucaugguagcuaugagguaaaggcaacgggcucagcgucguccaugauaaacgggguaguaaaacucuuaacaaagccuugggacgugguccccauggucacacaaauggcgaugacugauacaacacccuucggacagcaacgaguauucaaagaaaaaguggauacgcgcacgccuagaaguaugccagguacucggcgaguuaugggaauuacagcugagugguuguggagaacgcugggaagaaacaaaaagccaagacuguguacaagagaggaguucacuaagaaagugagaacuaacgcggcaaugggugcaguauuuacagaagaaaaccaaugggacucagcuaaggccgcggucgaagacgaagacuucuggaaauuaguugacagagaaagagagcuacauaaauuagggaaaugcggcaguugcguguacaacaugaugggaaagagggaaaagaaacucggagaauuuggcaaagcaaaaggaucuagggccauuugguauaugugguugggagcaagauaccuagaauuugaagcucugggauuccuaaaugaagaccacugguucucaagagaaaauagcuauucaggugucgaaggagaagggcuacacaaauuaggauauauucuacgugacaucagcaaaauuccaggaggcgcaauguacgcagacgauacagcaggaugggacacaaggauuacugaagacgacuuacauaaugaggagaaaauuacacaacaaauggauccugaacacagacaguuagcaaaugcaauauucaaauuaacguaccaaaauaagguagucaaaguccagcgaccaacgccaaccggaacggugauggacauuauuucaagaaaagaccaacgaggcucuggccaaguugguaccuauggcuuaaauaccuucacaaacauggaggcucaauugauacgacaaauggaaggagaagggguacuuucgaaagcagaucuagaaaauccgcacuuaccggaaaagaaaauaacgcaguggcuugaaacuaaaggcguagaacgacuaaaacggauggcgauuucgggagaugauugugugguaaaaccuaucgaugaucguuuugccaaugcacuucuggcauugaacgacaugggcaaaguccgcaaggauauaccccaauggcaaccaucgaaaggauggcaugauuggcaacagguacccuuuugcagucaccacuuucaugagcugauaaugaaagaugguagaaaguuggucguacccuguagaccacaagaugagcuuauugggagagcacgcauaucccagggugcaggguggaguuugcgugagacagcauguuuaggaaaggccuacgcacaaauguggucucuaauguauuuccauagaagagaccuaagguuggcgucgaacgcuauaugcuccgcaguaccuguacauugggucccgacaucaagaacaacguggucuauucacgcucaccaccaauggaugacaaccgaagacaugcucacagucuggaaucgcguguggauagaagacaacccauggauggaagacaaaacaccagucacaacuugggaggacguuccuuauuuaggaaaaagagaggaucaaugguguggcucgcucaucggacuaacaagucgcgcgacuugggcacagaauauacccacggcuauucaacaagugcgcucacuaauuggcaacgaagaauuuuuagacuacaugccaucuaugaagcguuuccgaaaagaagaagaaagugaaggggcaauuugguaa

SEQ ID NO: 23048 - RNA, 9873 nt, Artificial Sequence
  derived and/or modified CDS sequence (opt6) from DENV-3__FJ850086__SS-prME
acaucauuaugucuuaugaugauauuaccggcagcauuagcuuuccauuuaacaucccgugacggugaaccgaggaugauaguggggaaaaacgaacgagguaaaucuuuauuauuuaaaacugcaagcgggauuaacaugugcacauuaaucgcaauggaucuuggagaaaugugugaugauacagugacauauaaauguccccauaucacagaaguagaacccgaagacauagauuguuggugcaaccucacaucgacuugggugacauacggaacaugcaaucaagcuggagaacacaggcgagauaaacggagcguugcucuugcaccacacguagguaugggcuuagauacucgaacccaaacguggaugucagcggaaggagcauggagacaaguggaaaaaguagaaacgugggcacuccgacacccagguuuuaccauacuagcuuuauuuuuggcgcacuauauuggaacgucauugacgcaaaaagucgucauauuuauacuacuuaugcucguaacuccgaguaugaccaugcgcugcguugggguagggaaucgugacuuuguugaaggucuuucaggcgcuacauggguugauguaguccucgaacauggaggauguguuacgacaauggccaaaaauaaaccaacucuagauauagaacuccagaaaacugaagcaacacaacuagcaacguuacgcaaacucugcaucgaaggaaaaauuaccaauauaacuacugauagcagauguccgacacaaggagaggcgguucugcccgaagaacaagaccaaaauuacguaugcaaacauacauauguagauagaggauggggaaacgguuguggcuuauucgguaaaggaaguuuggucacgugugcuaaauuccaaugucuugaaccuauugaaggaaaaguaguacaguaugaaaaucuuaaauacacuguaauuaucacaguucacacuggagaucaacaccaagucgguaacgaaacgcaaggaguaacugcagagauaacgccucaagcaucuacaacggaagcaauauuaccagaauauggcacgcugggguuggaaugcucgccuagagcuggauuggacuuuaacgaaaugauuuugcuaacaaugaaaaacaaagcauggaugguacaccgccaaugguuuuucgauuuaccauuacccuggaccucaggggcaacgacggaaacuccuacguggaaucgaaaagaacuacuuguaacuuucaaaaaugcacaugccaagaaacaggaagugguaguauuaggaucacaggaaggugcgaugcauaccgcuuuaacuggggccacagaaauacaaaauucuggugggacuucaauauucgcaggucauuuaaaaugucgguugaaaauggacaaauuagagcucaaagguaugucguaugcaaugugcaccaauacauuuguacuuaagaaagaaguaucagagacacagcauggaacaaucuugauaaaagucgaauauaaaggugaagaugcaccaugcaaaauacccuucucgacagaagacggacaagggaaagcacauaacggacgauuaauuacagcaaacccgguggugaccaagaaagaugaaccgguaaacauugaagcggaaccaccuuucggcgagaguaauauuguaauaggaaucggggauaaugcucuaaaaaucaauugguacaagaaaggaucaucaauaggaaaaauguuugaagcaacggcaagaggcgcucgcagaauggcuauacucggagauacggcaugggauuuuggcaguguaggugguguacuuaauaguuuagguaaaacaguucaucaaaucuuuggauccgcauacacagcuuuauuuucaggcguuagcugggugaugaaaauaggcauuggagucuuauuaacuuggauaggauuaaauuccaaaaauacaaguaugucguuuucuugcauugcgauuggaauuauaacuuuauaccuaggcgcgguuguacaagcggacaugggauguguuaucaacuggaaaggaaaggagcucaaaugugggagcggaauuuuuguuacuaacgaaguucacacauggacagagcaauacaaauuucaagccgauagucccaaaagacuggcgacugccauagcuggugcgugggaaaaugguguuugcggaauaagaaguacaacaagaauggagaaucuucucuggaaacagguagcaaaugaacuuaauuacauucugugggaaaauaacauaaaacuaaccguaguagugggagacauaauaggaguacuggaacagggaaaaagaacacuaaccccucagccuauggaacuaaaguauaguuggaaaaccuggggaaaggcaaaaaucgugacggcagaaacacaaaauaguaguuucauuaucgacggcccaaacaccccugaguguccuucagcaagucgagcuuggaacgucugggaaguagaagauuaugguuuuggaguauuuacaacaaacauaugguuaaaacuaagagagguuuacacucaacugugugaucaucgacuuaugagugccgcagugaaagacgagagagccgugcaugcagauauggguuacuggaucgaaucucagaaaaaugguaguuggaaguuggagaaggcaucauuaauagagguaaaaacuugcaccuggccuaagucacauacuuuauggucuaauggugugcuugaaagcgacaugaucauaccgaagucccucgcggguccgauuucccaacacaaccaucgacccggguaucacacacaaacggcuggaccuuggcauuuggggaaacuggaauuagauuucaacuauugugagggaacuacaguggucauuacugaaaacugugguacucgaggacccagcuugcgaacgacaacagugagcggaaaauuaauucaugaaugguguugcagaucguguacccuaccaccacuacgauacaugggagaagacggcuguugguaugguauggaaauccgccccauaucagaaaaagaggaaaauauggucaaaucuuugguaagcgcggguaguggcaagguugauaacuucaccaugggaguacuaugccuugcuauauuauuugaggaggucaugcgaggcaaauucgggaagaaacacaugauugcuggaguuuucuucauguucguauuauuacuaaguggucaaauaacauggagagacauggcacauacccuuaucaugauugguucaaacgccagugaucguaugggcaugggagucaccuacuuggcuuuaaucgcaacauuuaaaauucaaccauuucuagcuuuaggauucuuccuaagaaagcuaacgucuagagaaaaccuuuugcuaggcguuggauuagcgauggcuacaacacuucaguugccagaagacaucgaacaaauggcuaacgguauugcauuaggucuaauggcccuuaaacuaauuacucaguuugaaacauaccagcuauggaccgcuuuaaucucacuaacaugcucaaauacgauguuuacacugacggucgcauggagaacagcaacgcuaauuuuggccgguguuucauuacucccagucugccaaucuaguaguaugaggaaaacggacugguugccuauggcggucgccgcaauggggguaccaccucuaccauuauuuauauuuucacugaaagacacccuuaaacgcagauccuggccauuaaacgaaggaguaauggcgguagggcucguaucaauuuuagcuucuucgcugcuaaggaacgacguaccaauggcugguccccuugucgcuggaggucucuugauugcauguuauguuaucacuggaacaagcgccgaucuaacaguugagaaggccgcagacauaacaugggaggaagaagcagaacagacuggaguaucacacaacuuaaugaucaccguugacgacgauggaacuaugagaauuaaggacgaugaaaccgaaaacauacuuacaguucuacucaagacugcguuauuaaucgucagcgggguauucccuuauuccauucccgcaacacuccuuguguggcacacauggcagaagcagacacaaagaucaggaguucuaugggacguaccgaguccgccagagacucaaaaagcagaacucgaagaagguguuuauagaauuaaacagcaaggaaucuuugguaaaacccaaguaggagugggcguacaaaaagagggcguauuccacacgauguggcacgugacaagaggugcagucuugacauauaauggaaaacgauuggaaccgaacugggcaagcgucaagaaagauuuaauuaguuauggagggggcuggagauuauccgcgcaauggcaaaaaggugaagagguccaggugauagccguagagccagguaagaauccuaaaaauuuucaaacuaugccaggaacauuccagacuacaacaggggagaucggugccaucgcgcuggauuucaaaccaggcacgagugguucgccuauaaucaacagagaagguaaagugguaggacucuauggaaacggaguuguaaccaaaaacgggggcuaugucucaggaauagcacaaacgaacgcagaaccggauggaccaaccccugaacuagaggaagaaauguuuaagaaaagaaaucuuacuauaauggaccuacacccuggaagugguaaaacuaggaaguauuuaccagcaauugucagggaggcgauuaaaaggcgauuacguaccuuaaucuuggcaccaacaagggucguugcagcagagauggaagaagccuuaaaaggacuaccaaucagauaucaaaccacugcuacuaaaagugaacacacaggaagagaaauaguugauuugaugugucaugcaacguucacaaugcgucuuuuaucgcccguaagaguaccgaauuauaacuugauaauaauggaugaagcgcauuuuacggauccugccaguauagcugcgagaggauacauuagcacacguguugggaugggcgaggcggccgcaauauucaugacggcaacuccaccugguaccgcugacgcguuuccacaaagcaaugcucccauacaagacgaagaaagagacauaccugagagaucauggaacuccggaaaugaauggauuacagauuuugcugggaaaacuguaugguucguaccuucuauaaaggcagggaaugauauagcaaauuguuuacgcaaaaacggcaagaaaguuauacaacuaucuaggaagacguuugauacggaauaucagaaaacuaaacugaacgacugggacuuugucguaaccacugauauuucagaaaugggugcaaacuuuaaagcagaucggguuauugacccuagaagaugucuaaaaccaguaauucuuacagacggaccggaacgaguaauacuagcagguccgaugccuguaaccgcagcaagugcagcacaaagacgcggcagggugggaagaaauccucaaaaggaaaaugaucaguacauauuuacaggucaaccgcugaacaaugacgaggaccacgcacauuggacugaagccaagaugcuacuggacaacauaaauacuccagaagggauaaucccugcucuuuuugaaccagagagggaaaaaucggcagcgauugauggcgaauaucgcuuaaaaggcgagaguagaaagacauuuguugaacuaaugagacgaggcgauuuaccaguuuggcucgcacauaaggucgcaucugaggggauaaaauauacagauaggaaguggugcuucgauggacaaagaaacaaucaaauucuagaagaaaauauggauguugaaauauggaccaaggaaggcgagaagaagaaauuacgcccaagaugguuggaugcaagaaccuacuccgauccuuuagcgcucaaagaguuuaaagacuucgcggcgggaaggaagucaaucgcgcuggaucuggucacugagauagggagaguaccaagccaucuugcacaucggacucgcaaugcccuagauaaccuaguaauguuacauacgucugaacacgggggcagagcauacagacaugccguagaagaacuaccugaaacaauggaaacuuuauuauuguuaggucugaugauuuugcuuacggguggggcaauguuauuuuuaauaagugguaagggaaucggaaagacaucaauagguuuaauuuguguuauugccagcucugggauguuguggauggcagagauuccuuuacaguggauagcaucagcgauagucuuagaguucuuuaugauggugcuucuaaucccagagcccgaaaaacaaagaaccccacaagauaaucaacuugcauacguaguuauaggcauccuuacucucgcagcgauaauugcagccaaugagaugggacucuuagaaacaacaaaaagagaccuagguaugucuaaagaaccuggaguaguuuccccgacauccuaucuggauguggaucuucaucccgcaucagcuuggacauuguaugcaguggcgacuacaguaauaacuccaauguuacgccauacaauagaaaauaguacugcuaauguuagucucgcagcaauagcaaaucaagcuguaguuuugaugggguuagacaaaggauggccaauaucgaaaauggauuuaggcguaccacuauuagccuuaggauguuauucucagguuaacccacuaacccuuaccgcggccguuuuacuacuaaucacacacuaugcuauuauugguccgggguuacaagcaaaagcgacuagagaagcgcaaaaacguacugcagcaggaauuaugaaaaauccgacgguagacggcauaaugacaauagaucuagacccuguaaucuaugauagcaaauuugaaaagcaacuaggucaaguuauguuacuuguguuaugcgcggugcaguuguuauugaugagaacaagcugggcuuuaugcgaagcgcuaacguuagcaacgggccccaucacgacguuaugggaaggaucaccugguaaauucuggaauacaacuauagcuguuaguauggcuaauaucuuuagagguagcuaccuagccggugcaggccuagcuuucucuauuaugaaaaguguagggacaggaaaaagaggaaccgguucccaaggcgaaacguugggagaaaaauggaagaagaaauugaaucaauuaucacguaaagaauuugauuuauacaaaaagucaggcauuacagaagucgaucgaaccgaagcgaaagaaggacuuaagagaggagaaaccacacaccaugcagugucacgagguucugcaaaauuacaaugguuuguagagcguaauaugguuauuccggagggaagagucaucgacuuagguuguggcagaggagguuggucguacuauugcgccggccuaaagaaagugaccgagguaagggguuauaccaaaggaggaccuggacaugaagaaccuguuccuauguccacauauggguggaacauaauuaaacucauguccgggaaggauguauuuuacuuaccaccugaaaaaugugacacucuucuuugugauauaggagagagcucaccuaguccuaccgucgaagaaucacgcacaauacgcguucuaaagaugguagaacccuggcuuaaaaacaaccaauucugcauuaaaauacuaaauccuuauaugccgacaguaauugaacacuuagaacgauuacaacgaaaacaugguggaauguuagucagaaacccacuuucgcggaacucgacucaugaaauguacuggauuucaaauggaacuggaaauauuguugccucuguaaauaugguuucacggcuguuguugaauagauuuacgaugacacacagaagaccuacgauugaaaaggauguagacuuaggagcgggcacccgucacgugaaugcagagccagaaacuccaaauauggacguaaucggagaaagaauuaaaagaauaaaagaggaacacaauuccacauggcacuacgaugacgagaacccuuacaaaaccugggcuuaucauggcucauaugaaguaaaggcgacaggauccgcaucauccaugauuaacggcguuguaaaguuguuaacuaaaccuugggauguuguuccaaugguaacacaaauggcaaugacugauacuacuccauucggccaacaaagagucuuuaaagaaaagguagacacacguacaccaagaucaaugccgggaacaagacgaguaauggggauaaccgccgaaugguuauggcggacacuugguagaaauaaaaagccacgguugugcacgcgagaagaauuuacuaagaaagucaggaccaaugcugcuaugggugcugucuuuacugaagagaaccaaugggauucagcaaaagccgcaguagaagacgaggauuuuuggaaauuaguugaccgggagcgagaacuccacaaacuugggaaaugcggcucuuguguauacaacaugaugggcaaaagagagaagaaacucggagaauuugggaaggcaaagggaucuagagccauuugguauaugugguuaggagcgcgguauuuagaauuugaggcuuuaggcuuuuuaaaugaagaccacugguucucucgagaaaacaguuacagugggguggaaggugaaggccuacauaaacucggauacaucuuaagagauauaucuaaaauacccggcggugcaauguacgcugaugacacagcgggcugggacacccggauuacagaggaugaucuucauaaugaagagaaaauaacucaacagauggauccagaacauagacaguuagcaaaugcuauauuuaaauuaacauaccaaaauaaagugguuaaaguacaacguccaaccccaaccggcacaguuauggacaucaucucaagaaaggaucaacguggcucaggacaagugggcacguauggcuuaaauaccuucacgaacauggaggcacaauuaauccggcaaauggaaggugaagguguucuaucgaaagcagacuuagaaaacccacaucuaccagagaagaaaauaacgcaauggcuggagacaaagggcguagaaaggcuaaagcggauggccauaucuggcgacgacugcgugguuaaaccaauugacgauagguuugcgaaugcguuauuagcauuaaacgauauggguaaaguacgcaaagauauuccccaauggcaaccuagcaaggguuggcaugacuggcaacaagugccuuucuguagucaccacuuucacgaacuaauaaugaaagauggacguaaguuggugguuccaugucgcccucaagacgagcucauugggagggcaagaauaucacaaggugcaggauggucauuaagggaaaccgcuugcuuagggaaggcuuaugcucaaauguggucucucauguacuuccaucgccgagauuuacgccuagcuuccaaugcuauuuguagcgcuguacccguacacuggguaccaacgagucguacgacauggaguauacacgcacaucaccaauggaugacuacagaagauaugcuaacaguauggaacagaguguggauagaggauaauccguggauggaggauaagacgccaguuacaacgugggaagauguaccauacuuagggaaaagagaagaucaguggugcggcaguuuaauagguuugacaucaagagcaacaugggcacaaaauauaccaacggcgauucaacagguacgauccuuaauuggaaacgaagaguuccuugauuauaugccaagcaugaaaagauuccgaaaagaagaggagucagaaggcgccauaugguga

SEQ ID NO: 23049 - RNA, 9873 nt, Artificial Sequence
  derived and/or modified CDS sequence (opt6) from DENV-3__FJ850089__SS-prME
acuucuuuaugucuaaugaugauccuccccgcggcauuggcguuccacuuaacuucgagagauggugaaccacgcaugaucguaggcaaaaaugaacgugguaaaucucuguuauuuaaaaccgcaucugguaucaauauguguacucuuauagccauggauuuaggggaaaugugugacgauacaguaacauacaaauguccucauauaacugaaguugaaccagaagauauagacuguuggugcaauuuaacgagcacaugggucacguauggaacaugcaaucaagcgggagaacacaggagagacaaacgaaguguagccuuagcuccucauguuggaaugggauuggauacucgaacacaaacguggaugucugcagaaggagccuggcgacaaguggaaaaaguagaaacaugggcacuucgccacccaggcuuuacuauacuugcguuauuucuggcacacuacaucggaacaagccugacacaaaaaguugugaucuuuauacuauuaaugcucguaaccccaucuaugacuaugagaugcgucggggugggaaauagagauuucguugaaggucuaucuggcgcuacuuggguggauguaguguuggaacauggagguuguguaacaaccauggcuaaaaauaaaccgacuuuggauauagaauuacagaaaacggaagcaacacaauuggcgacuuuaagaaaacuuugcauagaagguaaaauuaccaauauaacgacugacucucgcuguccaacacaaggagaagcgguguuaccggaagaacaagaucaaaauuauguaugcaaacauacauauguagaccgagguuggggcaacggcuguggacuauuugggaaaggaucgcuggucacgugugcaaaauuucaaugucuggaaccuauagaaggaaaaguaguucaacaugaaaauuuaaaauauacuguuauaauaacaguccauacuggugaucaacaccaaguaggaaaugaaacucaagggguuacugcagaaauaacaccacaagccucgacaacugaagucauauuacccgaauauggaaccuuaggacuagaaugcucaccacgaacaggacuagacuuuaaugaaaugauacuucuaacaaugaaaaauaaagcauggaugguccaucgucaaugguuuuucgaccugccuuugccauggaccaguggggcuacaacagaaacgccaacauggaaucgaaaagaauugcuuguaacuuuuaaaaacgcucaugcaaagaaacaagaagugguaguucucgguagucaagaaggagcaaugcauaccgccuugaccggagccacggaaauucaaaauaguggagguaccaguauauuugcgggacauuuaaaaugucgauuaaaaauggacaaacuggaacucaaagggaugucauacgcaauguguacuaauaccuucguacucaagaaagaagugucugaaacucaacacggaaccauacuaauuaaaguagaauauaaaggagaagacgcaccaugcaaaaucccuuucucaacggaagacggucaggguaaagcgcauaauggaagauuaauuacugcgaaccccgucgugacaaagaaggaugaaccuguaaauauagaagcagaaccacccuucggagaaucuaauauaguaauaggaauaggugacaacgcacucaagaucaacugguauaagaaagguuccaguauaggcaagauguuugaagcgacagcucgaggggcaaggagaauggcaauccucggugauacagcaugggacuucgggagcgucggaggggugcugaauaguuuaggcaagaugguacaucaaauauucggaucagccuauacagcccuguuuucaggugucucauggguaaugaaagugggcauuggaguccuauuaacauggaucgguuuaaacaguaaaaauacgaguaugucguucaguuguaucgcaauagguauaaucacacuauauuuaggagcgguaguacaagcagacaugggcuguguaaucaacuggaagggaaaagaacuaaaaugcgguucagggauauuuguuacaaacgaaguucacacauggacugaacaauauaaauuucaagcggauagcccuaaaaggcuugcgacagcaauugcaggagcuugggaaaacggcgucugugguaucaggagcacaacgagaauggaaaaccuacuguggaaacaaauagcaaacgaauugaacuauauauuaugggaaaacaauauaaaguuaaccguagugguuggggauauaauugggguucucgaacagggaaagcgaacucuaacaccacaaccaauggaacuaaaauauagcuggaaaacauggggaaaggccaaaauaguaacagcggaaacucaaaauucuaguuucaucaucgacgggccuaauacaccagaauguccuucggcaagcagagccuggaaugucugggaaguggaggacuacggguucgggguauucaccacaaacauauggcugaaacuccgugaaguuuauacgcaauuaugcgaucaucgucugaugucagcugcuguuaaagaugagagagcuguacaugcagacaugggauauuggauagaaagucagaaaaauggauccuggaaacuugaaaaagcaucacuaauugagguaaagacaugcacuuggccuaaaagucauacgcuguggaguaauggcguacuugagagcgauaugauaauaccuaaaagucucgcggguccuaucucacaacauaaccaucgaccugguuaccacacucaaacagccggacccuggcauuuaggaaaguuggaacuugauuuuaauuacugcgaagguacgacugucgucauaacagaaaauugcgggacaagaggaccaucacuaagaaccacuaccguuucgggcaaacuuauucacgaauggugcugcagauccugcacacugccaccuuugagauacaugggagaagauggaugcugguacggcauggaaauacgaccaauuagugagaaagaagaaaauaugguaaaaagucuaguaucugcuggaucagguaaaguggauaauuuuacaaugggaguucuuuguuuagcaauauuguuugaggaaguaaugagaggaaaauuuggcaagaaacauaugauagcuggaguauucuuuacguuuguucugcuucucucaggccaaauaacauggagggauauggcccacacucucauaaugauaggauccaacgccagugacaggaugggaaugggaguuacuuaucuagcacuaauagcaacuuuuaaaauucaaccauuucuagcgcuaggauucuuucuaagaaaguugacgucaagagaaaaucuccuauuaggggugggucuggcaauggccacgacacuacaacugcccgaagacauagaacaaauggcuaacggaauagcgcuaggacuaauggcucuuaaacuaauaacacaauucgagacguaccaauuauggacagcacuaauuucacuuaccuguuccaauacaauguucacacuaacgguagcguggagaaccgcuacucuaauacuugcuggugucucucuucuuccugucugucaaucuucuuccaugcgaaaaaccgauuggcuaccaauggccguugcagcaaugggagugccaccucucccauuauuuauauucagucuaaaagacacucucaaaaggagaucuuggccacugaaugaagguguuauggcuguaggauuagugagcauauuagcaaguuccuuauugcguaaugaugucccuauggcuggaccccuaguagcaggaggguuguuaauagcauguuacgugauaacuggaacaucagcugaccugaccguagaaaaagcagcugacauaaccugggaagaagaagcggagcaaacagguguuucgcacaauuuaaugauaaccguagaugacgauggaaccaugcggaucaaagaugaugaaacagagaacauacugacagucuuacuaaaaacagcacuucuuaucgucuccgguguauuuccauacucgaucccagcgacccuccuaguguggcauacuuggcaaaaacagacacaacgauccggagucuuaugggacguaccaagucccccagagacucagaaggcggaacuagaagagggcguguaucgaauuaaacaacaagggaucuuuggaaagacucagguagguguugggguucaaaaggaaggaguuuuccauacgauguggcacgucacgagaggagccguacucacuuacaacggaaaaagauuagaacccaauugggccagcgugaagaaagacuuaauaucauacgguggaggcuggagauugucagcgcaauggcagaagggugaagaaguacaaauaauugcaguagagcccgguaaaaacccgaaaaauuuccaaacaaugccaggaacauuucaaacaacgacgggagaaaucggugccauagcauuagacuucaaaccaggcacaucuggaucaccaauaaucaaccgugaaggaaagguaguaggucuguacggaaauggcguugugacuaaaaauggaggguauguaagcggaauugcucaaaccaacgcugagccagacggaccaacacccgaauuagaagaggagauguucaaaaagcggaacuuaacuauaauggaucuacauccaggcucuggaaaaacacgaaaauacuugccagccauuguccgcgaagcuauuaaaagacggcuccgaacucuaauacuagcgccgacaaggguagucgcugcagagauggaggaagccuugaaaggguugcccauacgcuaccagacgacagcaacuaagagcgagcacacagggagggaaaucguagacuuaaugugucaugcgacguucacgaugaggcuucuaucacccguaagaguuccaaauuauaauuuaauaaucauggacgaggcgcacuuuacagaccccgcaagcauugccgcaagagguuacauuuccacgagaguagggaugggggaagcggcagcuauauucaugacggccacgccaccuggaacugcagaugcauuuccacagucaaacgcaccaauacaagaugaagaaagggacauucccgaacgaucguggaacucgggcaaugaauggauaacugacuucgcgggcaaaacagucugguucguaccaagcauaaaggcuggaaaugauauagcuaacugccuuagaaagaacggcaagaaaguaauucaauuaucgagaaagaccuuugacacugaauaccagaaaacuaaauuaaacgacugggauuuugucgucacgacagacauuucagaaaugggcgcaaauuucaaagcugacagaguuauugacccccgaaggugccugaagcccguuauuuugacagaugguccagaaagaguuauucuggcaggaccaaugccagucacggcagcgagcgcugcgcagcggcgcgguagggucgguagaaauccucaaaaagagaacgaucaauauauuuuuacagggcagccacuaaauaacgacgaggaucacgcgcacuggacugaggcaaaaauguuauuagacaacauaaacaccccagaaggaauaauuccagcucuauucgaaccagagcgugagaaaagcgcggcgauagauggagaauacagacucaaaggugaaagccguaagacuuucgucgaacuaaugcgacgaggcgaucuacccguauggcucgcgcacaaggucgcaucggaagguaucaaauacaccgacagaaaauggugcuucgacggccaacgcaacaaccaaauccuggaagaaaacauggauguagaaauauggacaaaagaaggcgagaagaagaaauuaagaccacgcuggcucgaugcuaggacauauucggacccacuggcauuaaaagaauuuaaagauuuugcagccggacguaagagcauagcauuagaccuugucacagaaauuggcaggguaccaucucaccuagcccaucgaacaagaaaugcucucgauaaccuaguaauguuacauacaagugaacacggggguagggccuauagacacgcaguugaagaauuaccugaaaccauggagaccuugcuacuacuagggcugaugauacuuuuaacaggaggagcaaugcuguuccucaucucaggcaaggggauaggaaaaacaaguaucgggcuuaucuguguuaucgcuucaucugguaugcuuuggauggcagaaauaccauuacaauggaucgcaagcgcgauuguacuagaguucuuuaugaugguuuuacucauaccagaaccagaaaagcaacgaaccccgcaagacaaucaacuagcauaugucgucauagguauacuaacgcucgcagcaauaaucgcagcaaacgagaugggacuccuugaaacuacuaaaagagacuuagguauguccaaagagccaggaguuguuuccccuacguccuauuuagauguagaccuacauccagccucugcauggacauuauacgcgguggcgacaacggucauaacaccuaugcuccgacauaccauagaaaauaguacugcaaacguuagccuugcagccauagcaaaccaggcaguaguccuuaugggauuagacaaggguuggccaauaaguaaaauggaucugggcguaccuuuacuugcguuagguuguuauucgcaaguuaauccuuuaacgcuaacugcugcagucuuacugcucauaacucauuaugcuauaauaggccccgguuuacaagcaaaagccacgagagaagcgcaaaagagaacagcagcagggauaaugaaaaauccaacggucgauggaaucaugacaauagaccuugauccagucaucuacgauuccaaauucgagaaacaacuaggacagguaaugcuucuuguccugugcgcagugcaguuacucuuaaugcgcacaucuugggcuuuaugugaagcacuaacccuagcaaccggaccgauuaccacacugugggaagguagcccgggaaaauuuuggaauacaacaauagccguaucgauggccaauauauuccgggguaguuauuuagcgggggcaggcuuagcauuuucgauuaugaaaaguguaggcacagguaaaagaggcacuggaagucaaggcgaaacacuaggugaaaaauggaagaagaaauugaaccaacucuccagaaaagaguucgacuuauauaagaaaagcggcauaacggagguagauagaaccgaagcuaaagaaggucuaaaacgaggugagacuacucaucaugcuguaaguagagguagcgcaaaauugcaaugguucgucgaaaggaauaugguuauuccagagggaagaguaauugacuuaggaugugggagaggaggcuggucauauuacugcgccggcuugaagaaaguuacagaaguuagaggguacacuaagggcgguccaggccaugaagaaccugucccuaugagcacguacggauggaauauuguaaaauuaaugucgggcaaggacguauucuauuuacccccugaaaaaugcgacacauuauuaugugauauaggcgaaucaucaccauccccuaccgucgaggaaagccggacaauucgagucuuaaaaauggucgaacccuggcucaaaaauaaucaauucuguauuaagauacuaaaucccuauaugcccacagucauagaacauuuagaacguuuacagagaaaacacggugguauguuaguaagaaauccccuuagucgcaauucaacccacgaaauguauuggaucucaaaugguacugguaacauaguagcguccgugaacauggucucccgauuacucuugaacagauuuacuaugacacauagacgcccgacgauugaaaaagacguagaucuaggugccggcacgcgccacguuaaugcugaaccugaaacacccaauauggacguuaucggagagcggauaaaaagaaucaaggaagaacacaacaguacauggcauuacgaugaugagaauccauacaagacgugggccuaucacggaaguuaugaaguuaaagccacagggagugcgaguucaaugauaaauggcgucgucaaauuacuuacaaaaccaugggauguuguacccaugguuacacagauggcgaugaccgacacaacccccuuuggacaacaaagagucuucaaggaaaaagucgacacucgaacgccaagaucgaugccagguacgcgccgcgugauggguaucaccgcugaauggcuguggcggacucucgggcguaacaagaaaccaagacucuguaccagagaagaauuuacuaagaaaguaaggacaaaugcugcaaugggagcaguauucacugaagaaaaucaaugggauucugcaaaagccgcagucgaagacgaggauuuuuggaaacuugucgauagagaacgugagcuucacaaauuaggaaaaugugguagcuguguuuauaauaugaugggaaagcgggagaagaaauuaggcgaguucggaaaagcaaaagguucaagagccauuugguacauguggcuaggugcaagauaucuagaauuugaggcuuuaggauucuuaaacgaagaucacugguuuagucgggaaaacucuuauucuggggucgagggugagggacuucacaaguuagguuauauacuacgugauauaucaaaaauaccaggcggagcgauguaugcggaugauacagcagggugggacacaagaauaaccgaagaugaccuacacaaugaagagaaaauaacacaacagauggaccccgaacauagacaacuugccaaugccauauuuaaauugacguaucaaaauaagguaguaaaaguacaaagaccaacuccuacugggacgguaauggacauaauuucuagaaaggaucaaagaggaaguggacagguuggaacuuacggguuaaauacuuucacaaacauggaagcucaauuaauaagacagauggaaggggaaggaguucucaguaaagcugaucuagaaaauccucaucugccggaaaagaaaaucacacaauggcuggaaaccaaaggaguggaaaggcuaaagaggauggccauuucgggagaugacugugucguuaaaccuauagacgaucgauucgcuaaugcguuauuagcccuaaaugauaugggaaaagucagaaaagacaucccacaguggcagccuucuaagggauggcacgauuggcaacaggugccuuuuuguucgcaccauuuucaugaauuaauaaugaaagacggacgcaagcucguaguuccguguaggccacaagacgaacucauuggacgagcucgaauaucacaaggagcuggauggagccuuagagaaacggcuugccuaggaaaggcuuaugcgcaaauguggagucuuauguauuuccauagacgagacuuaaggcuagcuucuaacgcaaucugcagugccguuccaguccauuggguaccgacuucccgcacaacauggucuauucacgcacaucaucaauggaugaccacagaggauaugcuaacagucuggaacagagucuggaucgaagacaauccauggauggaagacaaaacaccaguaacaacuugggaggauguaccguaucuuggaaaacgcgaagaccaguggugcggaucuuuaauagggcuaaccagccgagcuacaugggcucagaauauaccaacugcuauacaacaaguucguucauuaaucggcaaugaagaauuuuuagacuauaugccgagcaugaaacgauuucggaaagaagaggaaucugaaggagcgaucugguaa

SEQ ID NO: 23050 - RNA, 9873 nt, Artificial Sequence
  derived and/or modified CDS sequence (opt6) from DENV-3__FJ850092__SS-prME
acaucgcuaugcuugaugaugauucuuccugcagcauuagcauuucauuuaacuucuagggacggugaaccacgcaugauaguagguaaaaaugaacgaggaaaaucccuauuauuuaaaacugcguccgggauaaacaugugcacucucauagcaauggaucuaggggaaaugugugaugauacgguuacguauaaaugcccgcacauuacagaaguugaaccugaagauauagacugcugguguaaucuuacaucaacuuggguaacauacggaacauguaaccaagcgggugaacacagacgugauaaaaggaguguugcuuuagcuccucaugucgguaugggacuagacacacgaacacaaacuuggaugucugcugaaggcgcauggagacaaguggaaaaaguagaaaccugggcauuacgccauccaggauucacaauauuggcacuuuuucuugcgcacuauauaggaaccagcuuaacgcaaaaaguagugauuuuuauauuauuaauguuagucacuccaaguaugacaaugagaugugucgguguagguaaucgugacuucguugaaggauuaucgggcgcaacaugggucgauguaguguuagaacauggggguugcgucacgacaauggccaaaaauaaaccaacauuggacauagaauugcagaaaacagaggcaacucaauuagcuacacuccgcaaacuguguaucgaagguaaaauuacuaauauaacuacggauagccgaugucccacccaaggagaagcaguucucccggaggaacaggaucaaaacuacguguguaaacauacauacguagauagagguugggguaacggauguggacucuucggaaaagggucuuuaguuacaugugcaaaauuucagugucucgaaccuauagaaggaaaaguaguacaacaugagaacuuaaaauauacgguaauaauaacagugcauacuggagaucaacaucaggucggaaacgaaacacaaggugugacggcagaaauuacaccgcaggcuucgaccacugaaguaauccuaccugaauacggcacacugggucuugaauguagcccgcggaccggacuagacuuuaacgaaaugauauuauuaaccaugaaaaauaaagcguggauggugcaucgacagugguucuuugauuuacccuuaccauggacaaguggcguaacaacggaaacuccaacauggaauagaaaagaacuacuugugaccuucaaaaacgcccacgccaagaaacaagagguugucguacuagguagucaagagggugcuaugcauacagcguuaacuggagcgacagaaauccagaauaguggcgggacgucgauauucgcgggucauuuaaaaugcagauuaaaaauggauaaauuagaacuaaaagguaugagcuacgcaauguguacuaauacauucguuuugaagaaagagguaagugagacucaacauggaacaaucuuaauaaaaguagaauacaaaggagaagacgccccuugcaaaauuccauuuagcacggaggauggacagggaaaagcucauaauggaaggcuaauuaccgcuaacccaguaguaaccaagaaagaugagcccguuaauauagaggccgaaccgccguuuggagaaucgaacauuguaauuggaauaggagacaaugcgcuuaaaauaaacugguacaagaaagguaguagcauuggcaaaauguuugaagcaaccgcaagaggugcgcgcaggauggcaauccuaggagauaccgccugggauuuuggaagcguaggcgguguccuaaacagcuuaggaaaaaugguacaucagauuuucggaucagccuauacggcucuauuuucaggcguaucauggguaaugaagguuggaaucgguguccuacuaacauggauaggacuaaauaguaaaaauacaucaaugucauuuucauguauugcaauuggaaucauaacucuuuaccuaggagccguuguacaggcagacauggggugugucauuaacuggaaggggaaagaacuuaaaugugguucaggaauauucguaacaaaugagguucauacguggacggaacaauacaaauuucaagcagauagccccaaaagauuagcaacagcuauagcuggggcuugggaaaacggggucugugguauuaggaguacgacgagaauggaaaacuuauuauggaaacagauagcuaacgagcugaauuauauuuugugggagaacaauauaaaacuaacaguuguggugggugauauuaucggggugcuagaacaaggaaaaaggacucucacgccgcaacccauggagcuaaaguacaguuggaagaccuggggaaaagcaaaaauaguaacagcagagacacagaacaguucauucauaauagauggcccaaauacuccggaauguccgagugcaagucgugcauggaauguaugggaaguggaagacuacgguuucggcguuuuuaccacaaacaucugguuaaaacuaagagaaguguauacgcaacuaugcgaccaucgccuuaugagcgcagcuguuaaagacgaaagagcaguacacgcagauaugggauauuggaucgaaucacagaaaaauggaaguuggaaacucgaaaaagcaucuuuaauagaggucaaaaccugcacauggcccaaaagucacacauuguggucuaauggaguacuagaaucggacaugauuauuccaaaaagccuagcaggccccauaagccaacauaaucaccgccccggauaucauacgcagacugcuggcccauggcacuuaggaaaacuugaacuugacuuuaauuacugcgaaggaacuacagugguuaucacugaaaacugcgguacaagaggucccucucuuagaacgacaacggugucaggcaaauuaauccaugaaugguguugcagaaguuguaccuugccacccuuacgguauaugggagaggauggaugcugguauggaauggaaauaagacccauaagcgaaaaggaagaaaacaugguaaaaucucuugugagugcaggaagcggaaaaguugacaauuucacaaugggaguguuaugccuugcaauauuauuugaagaaguaaugcgugguaaauucgggaagaaacacaugauagcagggguauucuuuacuuucguacuuuuauuaucgggacaaauuacauggcgagauauggcgcauacgcuaauuaugaucgguucgaacgcaucagauagaauggggauggguguuacauaccuugcccuaauagcaacguucaaaauacaacccuuucucgcauuaggguucuuuuuaaggaagcucacgucucgugagaauuuacuauuaggaguaggccuagcaauggcaaccacucuucaguugccagaagacauagaacaaauggccaacgggauagcuuuagggcuaauggcacugaaauuaaucacgcaauuugaaacuuaucaacuauggacugcacuaaucagucugaccuguuccaauacaauguucacacuaaccguggcauggcgaacagcaacucuaauauuagcaggcgucucgcuucugccugugugucaauccaguaguaugagaaaaacggacugguuaccgauggccguagcagccaugggaguucccccauuaccguuauucauuuuuagccuuaaagauacauugaagagaagauccuggccuuuaaacgagggagucauggcuguaggccuaguuucuauacuggccaguucacucuuacgcaacgauguccccauggcaggacccuuaguugcuggagggcuccugauugcaugcuacgugauaacaggaacaagugcggaucugauaguagaaaaagcagcggacauuacuugggaagaggaggcugagcagacaggggucucccauaaucucaugauaacgguugacgaugauggcacaaugcguauaaaagacgaugaaaccgaaaauaucuuaacugucuuacuuaaaacagcauuacugauaguuaguggaguauucccguauagcaucccugccacacuauuaguuuggcauacauggcaaaaacaaacacaaagaagcgguguucuaugggacgugccuucaccaccagaaacacaaaaggcggaacuugaagaagguguauacagaauuaaacagcaaggaauauuuggaaaaacacaaguuggggucgguguccaaaaagaggguguuuuucacacaauguggcacguaacgcgaggagcuguuuuaacuuacaauggcaaaagacuugaaccaaauugggcauccgucaagaaagauuugaucucauacggaggaggauggagauuaucggcccaguggcaaaagggugaagaaguacaggugauagcaguggaaccugguaaaaaucccaaaaacuuccaaacaaugccaggaacuuuccaaacuacaacuggagagauaggagcaauagcacucgacuucaagcccggaaccucagguaguccaauaauuaauagagaaggaaaaguaguugguuuauauggaaacggcgucguuaccaaaaacgggggauauguaucaggaaucgcccaaacgaaugcagaacccgacggucccacgcccgaacuagaagaagaaauguuuaagaagagaaaccuuaccaucauggacuuacaccccggcucaggcaagacaaggaaguacuuacccgcaauuguuagggaagcaaucaagagaagauugagaacacuuauucuagcaccgacucggguaguggcugcggaaauggaagaagcguuaaaagguuuaccuauaagauaccagaccacagcaacuaagucagaacacaccggaagagaaauaguggaccucaugugucaugcaacguuuacaaugcgucuucuuaguccggucagaguacccaauuauaauuuaaucauuauggaugaagcacacuucaccgauccugcuucaaucgcagccagagguuauaucagcacccgagugggcaugggagaggcggcagccauauuuaugaccgcaaccccaccuggcacagcggaugcauuuccgcaaucuaaugcuccgauucaagaugaagaaagagauauacccgagcggagcuggaacucaggaaaugaguggauaacggauuucgcgggaaaaacuguaugguucguuccuuccauaaaggcagguaaugacauagcgaacuguuuaaggaaaaacggaaagaagguaauacaguuaucaaggaaaaccuucgauacagaguaucagaagacaaaacuuaacgacugggauuucguagugacuaccgacaucucagaaaugggugcaaauuuuaaagcagaccgcgugauugauccgagaagaugucucaaaccuguaauccugacagacggcccugaaagagugauauuagcaggaccaaugccgguaacagcagcuagugcagcgcaacguaggggcagaguggggcggaauccucagaaagaaaacgaccaauacauauuuacgggacaaccauuaaacaaugaugaggaccacgcacauuggacagaagcaaaaaugcuguuagacaauaucaauacaccugaggguauaauaccugcgcucuuugaaccagagagagaaaaaucugcagcuauagauggggaauauaggcuuaaaggagaaucccgaaagacauucguagaacugaugcgaagaggagaccucccaguuugguuagcgcacaaaguugcgagugaagguauaaaauacacagaucgaaaaugguguuucgauggacagcguaauaaccaaauacuagaggaaaauauggauguagaaauauggacgaaagaaggagagaagaagaaacuuagaccaagauggcuugaugcucgaacauauucggacccgcuggcguuaaaagaguuuaaagauuuugcagcugggagaaaaagcaucgcauuagauuuagucacagaaauagguagagugccaagucauuuagcacaucguaccagaaacgcucuagacaaucuagugauguugcauaccucagaacauggugguagggcauaccggcaugcaguagaggaguuaccagaaacaauggagacguuacuauuauuagguuuaaugauauuacucacaggaggugcaauguuguuccugauaucggggaaaggaauaggaaaaacaucuaucggguugauaugugucauagcaucaagugggaugcuauggauggcugagaucccguuacaguggauagcgucagcgaucgucuuggaauuuuucaugauggucuuacuuauaccagaaccggaaaaacaacggacaccgcaagacaaucaauuggcguauguuguaauaggaauauugacauuagcagcaauaauugcugcuaacgaaaugggauuauuggagacgacaaaacgagaccuaggaaugaguaaggaaccuggcgucguaucuccaaccagcuaccuugauguagaccuucaccccgccucugcuuggacacuguaugcaguagcgacuacaguuaucacuccuaugcuaagacauacgauagagaauagcacugcuaacguaaguuuagcggcuauugcaaaucaggcaguaguauuaaugggacuagacaaaggcuggccaauaucaaaaauggaccuugguguaccauuacuagcguugggcuguuauagucaagugaacccacuuacacugaccgcagcuguucuacuuuuaauaacucauuaugcaauaauaggcccaggccuacaggcaaaagcuacacgagaggcacaaaagaggaccgcggcaggaauaaugaaaaauccgacaguagacggcauuaugacaauagaucuagacccggucauauacgacucaaaauuugaaaaacagcuaggccaaguuauguugcuaguacuuugugccguacaacuauugcugaugcgaacaagcugggcacugugugaagcucucacuuuggcuacgggcccaauaacaacauuaugggaaggaucaccagguaaauucuggaauacuacuaucgcuguaucuauggccaauauuuuccgcgggaguuaccuagccggugcugggcuagcguucucaauaaugaaauccgugggaacaggaaaacgugguaccggaagccaaggugaaacuuugggagaaaaauggaagaagaaacuaaaccaauugagucguaaggaguuugauuuguacaagaaaagcggaauaacggaaguugaucguacagaggcuaaagaaggauuaaaaagaggggaaacuacucaucaugcggucucgcgcgggagugcuaaacuccaaugguuugucgaacguaauauggugauuccagagggccgaguuauagaccuggguugcgggagggguggcuggucguauuacugugcaggccucaagaaagucacggagguucgagguuacacaaaaggcgguccaggucaugaagaaccuguacccaugaguacauauggauggaauaucguaaagcucaugucgggaaaagauguauuuuaucucccaccagagaagugugauacauuacuuugugauaucggcgaaucguccccaagcccuaccguagaagagagcagaacgauaagagugcucaaaaugguagagccauggcuuaagaacaaucaauuuuguauaaagauccuuaauccauauaugccgacaguaauugaacacuuagaaagacugcagagaaaacacggagguauguuggugcgaaacccucuuucuagaaauucaacucaugaaauguacuggauuucuaacggaacagguaauaucguagcuucagugaacauggucagucgacuccucuuaaaucgauucaccaugacucaccgacggccuacuauagaaaaagauguagauuuaggcgcugguacucgacauguuaaugcagaacccgagacaccuaauauggauguuauaggagaacguauaaaaagaauaaaagaagaacauaauaguaccuggcacuaugaugaugaaaacccguacaaaacgugggcguaccauggaucguaugaaguaaaggcuacaggaucagcaucaaguaugaucaaugguguaguuaaacuucugacaaaaccaugggacgugguaccaaugguaacccaaauggcgaugacggacacuacaccguucggacagcagcgagucuucaaagagaaaguugacacucgcacucccagguccaugccagguacaaggcgggucauggguauaacugcugagugguuauggagaacauuagguagaaacaagaaacccagauuauguacacgugaagaauuuacaaagaaagugagaacaaaugcggcaaugggugcaguguuuacagaggaaaaucaaugggauucagcuaaagcugcagucgaagacgaggauuucuggaaguuaguagauagagagagagaacugcauaagcuagguaagugugguucauguguauauaacaugaugggaaagagagagaagaaacucggugaguuuggcaaagcuaaaggaaguagggccauuugguauaugugguuaggggcuagauaccucgaauuugaggcuuugggcuuccuuaacgaggaucauugguucaguagggaaaacucuuauucaggcgucgaaggagaaggacuucacaaacuuggguauauuuugagagacauaucgaaaaucccgggaggagccauguaugcagaugacaccgcaggaugggauacgagaaucacagaagaugaccuucauaacgaagagaaaaucacgcagcaaauggauccugaacaucgacaacuggcaaaugcgauuuuuaaacuuacuuaccaaaauaaggugguaaagguucagcggccuacgccuacuggcaccguuauggauauaaucucgcgaaaggaccaaagaggaucuggccagguagggacuuacggauuaaacacauucacgaauauggaggcacaacuaauacggcagauggaaggagaaggcguccuaucaaaagcagaucuugaaaacccucauuuaccagagaagaaaauuacccaguggcuagagacuaaaggugucgaaaggcuaaaacggauggccauaucaggcgaugauuguguugucaaaccuauugaugacagauuugcaaacgcauuguuggcauuaaaugauaugggaaaaguucggaaagauauuccacaauggcaaccuucaaaagguuggcaugauuggcaacaagugccauucugcagucaucauuuucaugaacuaauuaugaaagauggcaggaagcuaguuguaccgugccgcccacaagacgaacuaauuggucgugcaaggauuucucagggcgcaggauggagucuaagagaaacagcuuguuuagguaaagcauaugcgcaaauguggagucuaauguacuuucaccgucgugacuugagguuagcaucuaacgccauuuguagcgcaguaccuguacacuggguuccaacaucucgaaccacguggucuauacaugcacaccaccaauggaugacgacugaagauauguuaacaguauggaaccggguauggaucgaagacaacccauggauggaagacaaaaccccggucacaaccugggaagacguuccguaccuugguaaacgcgaagaccaauggugcgguagcuuaauagggcugacaagcagggcuacuugggcacaaaacauucccacggcaauacaacagguucgaucucuaaucgguaaugaagaguuccuagauuacaugcccuccaugaaaagauuuagaaaagaagaagaaucagaaggagcaauaugguag

SEQ ID NO: 23051 - RNA, 9873 nt, Artificial Sequence
  derived and/or modified CDS sequence (opt6) from DENV-3__FJ850094__SS-prME
accucauugugccugaugaugaucuugccagcagcuuuagcuuuucacuuaaccucaagagauggggaaccucgaaugauugucggcaaaaacgaaagaggaaaaucauuauuauuuaaaaccgcuucuggaauuaacauguguacucuuauagcaauggauuuaggggaaaugugugaugacacuguuacauauaaaugcccgcauaucacagaaguggaaccagaagauauagacuguugguguaaucuaacuucaacuuggguaacuuacggaacuuguaaucaagcaggagaacacagaagggauaaacggucagucgcacuugcuccacacguuggaaugggauuagacacaagaacucaaaccuggaugucggcagaaggggcuuggaggcaaguugaaaaaguagaaacaugggcguuaagacacccugguuucacaauccuggcauuauuccuggcacacuauauagguacuagcuugacccaaaaaguaguaauauucauauuacuuauguuagugacaccuagcaugacaaugagguguguaggaguuggaaaccgagauuucgucgaaggacuuagcggugcaacauggguagauguaguacuagagcacggagggugugugacaacuauggccaaaaacaaaccuacuuuggacauagaacuacagaaaacugaagcuacacaauuggccacccugaggaaauuauguauagaagguaaaaucacgaauauuacaacagacagucguuguccaacccaaggggaggcagucuuaccggaggaacaagaucaaaauuauguguguaagcauacauaugucgauagagguuggggaaacgguuguggauuguucggaaaagggucccuaguaacaugcgcuaaauuucaaugucuggaaccaauagaggggaaagugguacaauaugaaaaccuaaaauauaccguaauuauaacaguccacacuggagaucaacaucaagugggaaacgaaacucaagguguuacggcugagauuacgccacaagcgucaacaacagaagcaaucuuaccggaauacggaacauuggggcucgaguguaguccaaggaccggauuagauuuuaacgaaaugauccuacuuaccaugaaaaauaaggcauggaugguucauagacaaugguucuuugauuugccauuaccguggacuucaggcgcgaccacgggaacucccacauggaaucgaaaagagcuauuagucacauuuaaaaaugcacaugcuaagaaacaagaaguugugguauugggaagucaagaaggcgcgaugcacacagcacuaacuggcgcuacugagauccaaaauucaggugguacaaguauauuugcagggcaucugaagugucgacuaaaaauggauaaauuggaauuaaagggaaugucuuacgcgaugugcacaaacaccuuugugcuaaagaaagagguuucagaaacucaacaugggacaauucuaauaaaggucgaauacaagggagaagacgcaccuugcaagaucccguucaguacggaagauggccaagggaaggcacauaacgguagauuaauuacagcaaauccaguuguuacuaagaaagaugaaccuguuaacauagaagcagaaccgccuuuuggugaaucaaauauaguuaucgggauaggugauaaugcacuuaaaauaaacugguauaagaaaggcuccucaauaggaaagauguucgaagcaacggccagaggagcacggagaauggcuauauuaggcgauaccgccugggauuucgguagugugggaggaguccucaauucuuuaggcaaaaugguucaucagauauucggaucagcuuacaccgcucucuuuagcggggugaguuggguuaugaaaaucggcaucggcguacuauuaacauggauuggauuaaacucgaaaaauacaaguaugaguuucucguguauugcuauagggauaaucacacuauacuuaggagcuguuguacaggccgacaugggaugcgugguaaacuggaaagggaaagaauuaaagugcgggucaggaauuuucguuacaaacgagguacacaccuggacagagcaauauaaguuucaagcggauaguccuaagagguuagcuacagcaauagcaggagcaugggagaacggggucugcgggauuagaucaaccaccagaauggagaacuuauuauggaaacaaaucgcaaaugaauuaaacuauauuuuaugggaaaacaauaucaaauuaacaguggugguaggagauacaauuggaguuuuggagcaaggaaaaagaacacugacuccacaaccgauggaacuaaaauauucauggaaaacauggggcaaagcuaaaauaguaaccgccgaaacacagaauaguucauuuauuauagauggaccaaacacaccagaauguccgagcgcaagucgcgcguggaaugucugggaaguugaagauuacggcuuuggggucuucaccacaaauauaugguugaaacuaagggaaguauauacucaauugugugaucacagacuaaugagugcugcaguaaaagacgaacgggcaguucaugcagauaugggauauuggauagagucgcagaaaaacggaagcuggaaacuagaaaaagcaucgcucauagaagucaaaacauguaccuggccaaaaucccauacuuuauggucuaauggggugcuagaauccgauaugaucaucccaaaaaguuuagcgggcccuauuucccaacauaauuauaggccugguuaucauacgcaaacggcaggaccauggcauuuaggcaaacuggaauuagacuuuaauuacugugaaggcaccacgguugucaucacagaaaauuguggaacaagaggacccagcuugcgaacaacaaccguaucugguaaauuaauacacgaaugguguugucggucauguacauuacccccacuaagauauaugggagaggacggaugcugguaugggauggaaauaaggccgaucucugagaaagaagaaaacaugguaaaaucacugguuucagcgggaucuggaaagguugacaauuuuacuaugggaguucuguguuuagccauacuauuugaagagguaaugagaggcaaauuuggcaagaaacauaugauagccggcguguucuuuacuuucguacuauuacuaaguggccaaauaacuuggagggacauggcacacacucugauaaugauagguaguaaugcgucugacagaaugggaaugggaguaacguacuuagcguugauugcaacauucaaaauucagccauuccuagcccuaggguucuuuuuacguaaauugacaucucgugaaaaucuauuguuagguguaggucuagcuauggcaacaacucuacaacugccagaagauauugaacaaauggcuaacggaauugcauugggucuuauggcacuuaaacuaaucacacaauucgaaacguaccaacuauggaccgcacuuaucagcuugacuuguagcaacacuauguuuacuuuaacaguagccuggcgaaccgcaacacucauuuuagcuggagugucccuacuaccgguuugccagaguagcagcaugcggaagacggauugguuaccaauggcaguagcagccaugggugucccuccacugccacuauuuauauuuucacuuaaagauaccuucaaacggagauccuggccacuaaacgaaggaguaauggcaguuggucugguuagcauucucgcaucaucucuucuacguaaugaugugccaauggcugguccauuaguggcuggaggguuacuuauagcuugcuauguuauaacuggaacuucugcagaucuaaccguagagaaagcagcggauauuacgugggaggaggaagcugaacaaaccgguguaucgcauaaccucaugaucacaguggaugacgauggaacuaugcgaauuaaagaugaugaaacagaaaacauucuuacuguccugcugaagacugcacuucuaauugugucgggugucuucccauacaguauaccugcuacucuucuaguguggcacacauggcaaaaacagacacaacgguccgguguacugugggacgugcccucaccaccugaaacgcaaaaagcagaacuugaagaagguguauacagaauuaaacaacaaggaauauuuggaaaaacucaaguaggaguuggcguucaaaaggaaggugucuuccauacaauguggcaugucacacgaggagcagucuuaaccuauaauggcaaacguuuagagccaaauugggcuucuguuaaaaaggaccuuauaaguuacggaggaggauggagacuuuccgcgcaauggcagaagggggaagaaguccaaguaaucgccguagaaccaggaaagaaucccaaaaacuuccagacuaugccaggcacauuccagacgaccacgggagagauuggggcaauagcccuagauuuuaaaccugguacgaguggauccccuauaauaaaccgugaaggaaaagucguuggacucuacgguaacggagucguaacgaaaaaugguggcuacguuagcggaauagcucagacuaaugcagaaccagacgguccaacgccagaauuggaagaggaaauguuuaagaaaagaaauuugacaauaauggauuugcauccaggcucuggaaagacuagaaaauaucuaccugcaauagugagagaggccauuaaacgacggcugcgcacucuuauauuagcccccaccagaguuguagcggcugaaauggaagaagcccugaagggacugccaaucagauaucagaccacagcaacaaaaagugaacauaccggacgugaaauuguggaucucaugugucaugcuaccuuuaccaugagauugcucagcccaguaagaguaccgaacuacaauuuaauuaucauggaugaagcacauuucacagacccggcaucaauugcagcacguggguacaucaguacacgcgucgguaugggcgaagcagcagcaaucuuuaugacagcaacaccaccuggaacagcugacgcauucccccaaucuaacgcacccauucaggaugaggaacgugauauaccagagcgcucauggaacagcggcaacgaguggauuacggauuuugccggaaaaaccguuugguuugucccgucuauaaaagcaggcaaugggauagcuaauugcuuaaggaagaauggaaagaaaguaauucaauuaagucgaaaaacauuugauacagaguaccagaaaacaaaacuuaacgauugggauuuuguaguaaccacugauaucagcgagaugggcgcaaacuuuaaggcagauagagugauugauccaagaagaugccugaagccaguaauucuaacagauggaccagagagagugaucuuggcuggacccaugccugugaccgccgcaucagcagcccaaaggagaggaagaguuggcagaaacccucagaaggagaacgaccaguauauuuucacuggccagccguuaaacaacgaugaagaucacgcacauuggacagaagccaaaaugcucuuagacaauauaaacacgccagaggguauaauaccagcacucuuugagccagaacgggaaaaaucggcugcgauugacggugaauacagacuaaagggggagucuaggaagacauuuguagaguuaaugcgacggggcgaccuuccaguauggcuagcucauaaaguggcuagugaaggaaucaaguacacagacaggaaaugguguuucgauggucaaagaaacaaucaaauuuuagaagaaaauauggauguugaaauuuggacuaaagaaggagagaaaaagaaauuaaggccuagaugguuagacgccagaacguauagugauccacucgcacuaaaagaauuuaaagacuucgcugcaggacggaaaagcauagcacuagaccuaguaaccgaaauugggaggguuccgucucacuuagcacaccgaacaaggaaugcguuagauaaccuaguuauguuacauacaucagaacauggcggccgugcuuauagacacgcagucgaggaguuaccugaaacaauggagacuuuacuuuuguuagguuuaaugauauuguuaaccgggggugcaauguuauuccucauaagcggaaaaggcauagguaaaacuucuauaggacuaauuuguguaaucgcuucaagcggcauguuauggauggccgaaauaccacuccaguggauagcgagcgcgauuguuuuagaguucuuuaugaugguucugcuaauaccggaaccagaaaaacaaagaaccccacaagauaaucaacucgcauaugucguaauuggaauccuuacuuuagcggcaaucauugcggcgaacgaaaugggauuauuagaaacuaccaaaagagaccuugguauguccaaagaaccaggugucgugagccccacaaguuacuuagauguagacuugcacccggcaagcgcauggacacuuuaugcaguugcaacuaccguuauaacgccaaugcuucgacacacaauugaaaauucaacagcgaacguaucucuugcagccaucgcuaaccaagccguaguucucaugggcuuagauaaaggguggccuauuaguaaaauggaucuggggguaccacuguuggcacuaggcuguuauucacaggugaauccgcugacauugacggcagccguccuauugcugauaacacauuaugcaauuauaggcccugggcuacaagcuaaagcaacaagagaagcgcagaaaaggaccgcggccggcaucaugaaaaaccccacagucgaugguaucaugacuauagaucuagacccgguuauuuaugauucaaaauuugaaaaacaauuaggacagguaaugcuauugguccuaugugcaguucagcuucuccuuaugcgaacaucgugggcacuaugcgaagcacuaacucuugcaacagggccuaucacgacccucugggaggguucuccugggaaauuuuggaauacgacaauugcggucucaauggcgaauaucuuucguggcucauaccuagcaggcgcuggauuagcuuucucuauuaugaagaguguuggcacaggaaaacgagggacaggaucccagggagaaacacucggagagaaauggaaaaagaaacuaaaccaguuaaguagaaaagaauuugacuuguacaagaaaucuggaauuacagagguugaucgaacugaggcaaaagaaggucuaaaaagaggcgaaacaacacaccaugcaguaucacgggggucagcaaaacuccagugguuugucgaacguaauauggucaucccagagggaagagucauagaucuaggguguggaagaggagguuggucauauuauugcgccggacuaaagaaaguaacagagguacggggauacacaaaaggcgguccaggucacgaggaaccaguaccaaugucaaccuaugguuggaacauaguaaaauuaaugucuggaaaagacguguucuauuugccuccagagaaaugcgauacacuucugugugacauuggcgagaguagcccaucaccaacuguugaggaaucuaggacgauccgugugcugaagaugguagaaccaugguugaaaaauaaucaauuuugcauaaaaauacuuaacccauauaugccaacgguaauagaacacuuagaacguuuacaacgaaaacacggaggcaugcuaguaagaaacccuuuaagucguaauaguacgcaugaaauguacuggauaagcaacggcacuggaaauauaguggcguccgucaacaugguuucaaggcuacuucuuaacagauuuaccaugacucauaggcgaccuacaauagaaaaggauguugauuugggugccgggacaaggcacguaaacgcagaaccugaaacuccgaacauggauguuaucggugaacguauuaaacggaucaaagaagaacauaauagcacauggcacuacgaugaugagaacccuuauaaaacuugggcauaucauggauccuaugaaguaaaggcgacaggaucggcaucaaguaugauaaacgguguaguaaaacuccucacaaaaccgugggacgucguaccaaugguuacucagauggccaugacggacaccacuccauuuggacaacaaagaguauuuaaagaaaaaguagacacccgaacuccucgauccaugccagguacuagaagaguuaugggaauuacugcugaguggcuauggcgaacucuaggccguaauaagaaaccaagguugugcacgagagaggaguuuacuaagaaaguaagaaccaaugcggcuaugggggcaguauuuacagaagaaaaccagugggacucagcuaaagcugcgguugaagacgaagauuuuuggaaacuuguagauagggaaagagaauuacauaaacuugguaaauguggaagcuguguuuacaacaugaugggaaaacgcgagaagaaacuaggcgaauuuggcaaagcaaaaggaucccgugccauuugguauaugugguuaggggcgagauaccucgaguuugaggcacuugguuuccuaaacgaggaccauugguuuagccgagaaaacucuuacaguggaguggaaggggaaggauuacauaaacuuggguauaucuuacgagauauaucaaaaauuccuggaggcgcaauguacgcagaugauaccgcagguugggauacccggaucacagaagacgauuuacacaacgaagagaaaauuacucagcagauggacccggagcaccgacaauuagcuaaugccauuuucaagcucacauaucaaaauaagguuguuaagguucaaagaccuacacccaccgggacugugauggacauuauaucucguaaagaccagcguggaagugggcaaguaggaacauauggacugaauacguucacgaauauggaagcacaguugaucaggcaaauggaaggggaaggagugcuuagcaaggcugaucuagaaaauccucaucuuccagagaagaaaauuacccaauggcucgagaccaaggggguggagcgacuuaaaaggauggcaaucaguggugaugauugcguaguaaaaccaauagacgauagauuugcuaacgcuuuacuggcucuaaaugauaugggaaaaguacgcaaagauauuccgcaauggcaaccuagcaaaggauggcaugauuggcaacagguuccauucugcagucaucauuuucacgaacuaauaaugaaggacggaagaaaauuagucguaccauguagaccucaggaugagcuaauagguagagcacgaauaucacaaggcgcgggguggucgcuucgagagaccgcauguuuaggaaaggcuuacgcccagauguggucauuaauguauuuccaucgaagagacuuaaggcuugcaaguaacgcuauaugcagcgcaguaccgguccauuggguaccaacaucacgaacaaccuggagcauacaugcgcaccaucaauggaugacgaccgaagauaugcuaacaguauggaacagaguauggauagaggacaauccuuggauggaggacaagacuccgguaacuaccugggaagacguaccuuaucuugguaagcgugaggaucaauggugcgggagcuuaauuggauugacuucgcgagcgacgugggcacaaaauauaccgaccgcaauucaacagguucguagccuaaucgguaaugaggaauuucuagauuacaugccuucaaugaaaagguuuagaaaagaagaagaaagcgaaggcgcgauaugguaa

SEQ ID NO: 23052 - RNA, 9873 nt, Artificial Sequence
  derived and/or modified CDS sequence (opt6) from DENV-3__FJ898446__SS-prME
acgucauuauguuuaaugaugauucuuccagcagcgcucgccuuucaccucacaagucgggacggcgaaccacgaaugauaguaggcaaaaaugaacgaggaaaaucacucuuauuuaaaacggcuaguggaaucaauauguguacacuuauagcgauggaccucggugaaaugugcgacgacacgguaacuuauaaaugcccucacaucacagaaguugaacccgaagacauagacuguugguguaauuuaacuucaacaugggugacguauggaacauguaaucaagcuggggaacgacgaagagacaaacguaguguagcguuagcuccacacguagguaugggcuuagacacccguacacagacguggaugagugcagagggggcguggagacaaguagagaaaguugaaacaugggcuuuaagacacccaggauuuacaauuuuagcauuauuucucgcacacuauauagguacaucuuuaacgcaaaaagugguaaucuuuauauuauuaaugcucguaacaccuucuaugacaaugagauguguggguguagguaaccgagauuuugucgagggucuuucaggagcuacauggguagauguuguuuuagaacauggaggcuguguaacaacuauggcgaaaaauaaacccaccuuagacauagaauuacagaaaacugaggcuacacaauuagcuacucugagaaaacuuuguauagaaggaaaaauuaccaauauuaccacggacagucguuguccaacucaaggagaggcaguuuuaccagaggaacaagaccaaaacuauguauguaaacacacauauguugaucgggguuggggaaauggcugcggguuguuuggcaaaggaagucuugugaccugcgcuaaauuccaaugccuugagcccaucgaaggaaaaguaguacaauaugaaaauuuaaaauauacagugauaauaacgguacauacuggugaccaacaucaaguuggaaaugagacgcaaggaguuaccgcugaaauaacuccacaagcaucaacaacggaagcaauuuuacccgaguauggcacacuaggauuagaauguucgcccagaacaggacuugauuuuaaugaaaugauauuauugacaaugaaaaauaaagccuggaugguacauagacaaugguucuuugaccugccgcugcccuggacuucaggagcuacaacagaaacgcccacauggaauaggaaagagcuauuagucaccuuuaaaaaugcucacgcuaagaaacaagaagucgugguauugggcagucaggaaggcgcgaugcacacagcgcucacaggagcgacagaaauacagaacucgggcggaacaucaauauucgcaggucaccuaaaaugcaggcugaaaauggauaagcuagaacuaaaaggaaugaguuacgccauguguacaaacacguuugugcuaaagaaagaaguaagcgagacucaacacggaacuauucucauaaaaguagaauauaaaggagaagacgcgccuuguaaaauaccuuuuucgacggaggacgggcagggaaaagcccacaaugguagauugauaacggcaaauccaguaguuacuaagaaagaggagccgguaaauaucgaagcagaaccaccauuuggcgagaguaacauagucauugguaccggugauaacgcacuuaaaauuaauugguauaaaaagggaaguagcauaggaaaaauguuugaaacgacggcuagaggugcaagaagaauggcaauacuaggagauacagcuugggacuuugguucaguggguggaguacuaaauagccuagggaaaaugguucaccagaucuucgggucugcauauaccgcacuauuuucaggcgugagcugggucaugaaaauaggcauagguguccuauuaaccuggauugggcuaaacucuaaaaacacauccaugucguuuaguuguaucgccaucggaauuauuacuuuauauuuaggagccguaguacaagcagacaugggcugugucauaaauuggaaagguaaggaauuaaaaugugguagcggcaucuuuguaacaaaugaagugcauacguggacggagcaauauaaauuccaagcggauuccccuaagcgauuagcaacagcgauugccggagcaugggagaaugguguaugcgggauaagaaguacuacgcguauggaaaaccuauuauggaagcaaauagcaaaugaauuaaacuauauucuuugggaaaacaacauaaaacuaaccguuguaguaggcgauauaaucggaguauuagaacaaggaaaacgcacucuaacaccacaaccaauggaauuaaaauacucguggaaaacuuggggaaaagcaaaaauugucacagcagagacacaaaauucaucguuuauaaucgaugguccaaacacuccagaauguccuagcgcaagccgugcauggaauguaugggaagucgaagacuauggguucggugucuucacgacaaauauauggcugaaacuacgugaaguauauacacaacuuugcgaucaucgacuaaugucagccgcaguaaaagaugaacgagcuguucacgcggauauggguuacuggauagaaucccagaagaacggcucauggaaguuagaaaaagcaucauuaauugagguaaagacuuguacauggccaaaaucacauacucuauggucuaacggcguauuggaaagugacaugauaaucccaaaaagccuugcgggccccauaucacaacacaaccaucgcccagguuaucacacccaaacagcaggacccuggcaucugggaaagcuggaauuggacuuuaacuacugcgagggaacuacggugguuaucacugaaaacuguggaacacggggcccgagcuuaagaacuaccacagucucuggcaaacuuauucacgaauggugcuguagaucuugcacgcuucccccauuaagauauaugggagaggacgguugcugguaugguauggaaaucaggccaauauccgagaaagaagaaaauaugguaaagagcuuggugagugcagggagugggaaaguagauaacuuuaccauggggguacuuugcuuagcuauuuuguuugaggaaguaaugcguggaaaauucggaaagaaacauaugauagcuggcguguucuuuacauucguucuacuuuugagugggcaaauuacguggcgggauauggcucacacacugauaaugaucggaagcaaugcaagugaucguauggguauggguguaaccuauuuagcacuaauagcuacguucaaaauccaaccguucuuggcucugggguuuuucuugagaaaacuuacaucgcgagaaaaucugcucuuaggugugggcuuggccauggcuacaacacuccaacuucccgaagacaucgagcagauggcaaauggcauagcacuuggguuaauggcacucaaacuuauuacacaguuugagaccuaucaacuauggacugcacuuaucucguuaacuugcaguaauacaauguuuacauuaacaguggcuuggcggacggcaacucuaauuuuagcagggguuucauuauuaccaguaugccaaaguucuagcaugaggaaaacagauuggcuuccaauggcaguugccgcaaugggcguaccuccauugccuuuauuuauauucucacuaaaagacacgcuuaaaagaagaagcuggccuuugaacgagggggucauggccguaggguuggugucaauacuagccucuucauugcuuagaaacgauguaccuauggcugguccguuaguagcaggcggccuacuaaucgcuuguuaugugauaacaggcacuucagcagauuugacugucgaaaaagcagcugauauaacgugggaagaagaagcagaacaaacugguguaucccauaaucuaaugaucacaguggaugaugaugggacaaugagaaucaaagacgaugagacagaaaauauacuaacuguguuacuuaaaacagcauuacuaaucguaucuggaguauucccauauucuauuccagcgacuuugcugguuuggcacacauggcaaaaacaaacucaacggucaggcguacucugggacguaccuucgccuccggaaacccaaaaagccgagcuagaagaaggagucuauaggauuaaacaacaagguauauucggaaagacacaaguaggcguggguguccagaaagaaggaguuuuucauaccauguggcauguaaccagaggagcggugcucacuuacaaugguaaaagguuagaaccaaauugggcgucuguuaagaaagacuugauuaguuacggggguggauggcgccugagcgcucaauggcaaaagggugaagaaguccaggucauugcuguagagccggggaaaaauccaaagaauuuccagacuaugccaggcacauuucagacgaccacaggugaaauaggugccauagcuuuagauuucaaaccagggaccucuggcucuccaauaaucaaucgagaaggaaaaguagucggguuguaugguaacggugugguaaccaagaauggcggguacguuagcgguauagcgcaaacaaaugcugagccggacggaccuacccccgaacuggaagaggaaauguucaagaaacgaaaucucacaauaauggaccuucauccaggauccgguaaaacccguaaauaucuacccgcaauaguaagagaagcaaucaagcgaagauuaagaaccuuaauauuagcccccacccgaguaguggccgcagaaauggaagaggcgcugaaaggccuccccauccgcuaucaaacaacggcgacaaaaucggaacacaccggccgggagaucguugauuugaugugccaugcuacguucacaaugcgauuauuaucuccagugagagugcccaacuauaauuuaauuauaauggaugaggcacauuucacagauccggccaguauagcggcgagaggcuauauaagcacucgaguagggaugggagaggcggcagcaaucuuuaugacggcgacaccgccugguacagcggaugcauuuccccagucaaaugcaccgauacaagaugaagaaagggacauaccagaaaggagcuggaacagugguaaugaauggauaacggauuuugcaggaaagacuguaugguucgucccaaguauaaaggccgggaaugacauagcaaauuguuugcguaaaaacgguaaaaagguaauccaacuuuccagaaaaacguuugauaccgaguaucagaaaacgaaauuaaaugauugggacuuugugguaacaacagauauuucagaaaugggcgccaacuuuaaggcugauagaguuauagauccgagaagaugccuaaagccaguaauacuaacggauggaccugaacggguaauucuggcagggccgaugcccguaacagcagcuucugcugcccagagacgugggagagugggccguaacccucaaaaagaaaaugaucaguacauuuuuacgggacagccauuaaauaacgacgaagaccacgcccacuggacagaagccaagaugcugcucgauaauauaaacacacccgaagggauaauuccagcccuguuugaacccgaaagagaaaaaucggcugcaauugauggugaauacagacuuaaaggggagagucgaaagaccuuugucgaauuaaugaggcgaggagaccugcccguguggcuggcacacaaaguagcaucagaagggauaaaauacacagauaggaagugguguuuugauggacaaagaaauaaccaaauccuugaagaaaacauggacguugaaauuuggacaaaagaaggcgagaagaagaaacuucggccgcgauggcuugaugcaaggacauacucagacccgcuugcacuaaaagaguuuaaagauuucgcagcagguagaaaaagcauugcacuggauuuaguaaccgaaaucgggcgaguacccucucacuuagcccacagaacgagaaaugccuuagauaaucuaguuauguuacauaccucugaacacggcggcagagcauaccgacaugcaguugaagaacucccggaaaccauggaaacacugcuccucuuaggucuaaugauucuucugacuggaggggcuaugcuuuuucuaauuaguggaaaagguauuggcaaaaccaguauaggacucauaugugugauagcuagcucaggaauguuauggauggcugaaauuccuuugcaauggauagcaucagcuauaguacuagaauuuuucaugaugguuuuauuaauucccgagcccgagaaacaaagaacuccucaggauaaccaauuggcauacgucgucauaggaauuuugacccuggcagcaaucauugcagcgaaugaaaugggguugcucgaaacuacuaaaagggaucuuggcaugucgaaagagcccggggugguaucucccacaaguuacuuagauguggaccuccauccggcaucagcauggacuuuauaugcuguugccaccacagucauaacuccgaugcuaagacauaccaucgaaaauuccacagcaaacgugucacuagcugcaaucgccaaccaagcuguuguacuaaugggucuagacaaagguuggccaauuucaaagauggaucugggcguuccuuuacuagcccugggaugcuacagccaagugaauccauuaacacuaacagccgcgguacuuuuauugauuacccauuacgcaauuauuggaccgggccuacaagcgaaagcuacaagagaagcgcagaaacguacagccgccggaauuaugaaaaauccaacuguagacggaauaaugacuauugauuuggauccagugauauaugauaguaaauuugaaaaacaacuaggacaaguuaugcuauuaguacuaugcgccgugcaauuacuacuaaugcgaaccaguugggcguuaugcgaggcuuuaaccuuagcaaccgggccuauuacuaccuuaugggaaggaucuccaggcaaauuuuggaauacaacuaucgcagugucaauggcuaauaucuuccgagguucauaucuggcaggggccggauuagcguucucuauaaugaaaucaguagguacaggcaagagagggacuggaagucaaggugagacauugggagaaaaauggaagaagaaacuaaaccaacucucacgcaaagaguucgaccuuuacaaaaagagugggauaacagaagucgaucgcacagaagcuaaggagggacugaaacgaggagaaauuacacaccaugcaguuuccagagguuccgcgaaauuacagugguuuguugaacgcaacaugguuauucccgagggucguguaaucgaccuuggguguggacgugggggcuggaguuauuauugcgcaggacuaaagaaagucaccgaagugcgcgguuauacaaaaggagguccuggacaugaagaaccaguuccaaugucaacguauggauggaauaucguuaaauugaugucugggaaggacguauuuuaucugccaccugaaaaaugugacacucuauugugugauauuggggaaagcaguccaaguccaacgguugaagaauccagaacgauaaggguucugaagaugguagaaccuuggcugaagaauaaccaguucuguauaaagguauuaaacccguacaugcccacgguuauagaacauuuagaaaggcuacagcgaaagcacgggggaaugcuggugagaaacccauuaucaagaaauuccacucaugaaauguauuggauuucuaacggcacaggaaacaucgucgccagcgugaauaugguaucuagauugcuauugaacagguuuacaaugacucauaggagacccacgauagaaaaagacguagaucugggugcagguacaaggcacguuaacgcagaaccagaaacucccaauauggacguuaucggugaaaggauuaagagaauaaaggaagaacauaacaguacguggcauuaugacgacgaaaauccuuauaagacuugggccuaccauggaucuuacgaagucaaagcaacgggauccgcgucaucgaugauaaauggugucgugaaacuccucacaaaaccuugggauguuguuccaauggucacgcaaauggcaaugacagauacgacgccauucggacagcaaaggguguuuaaagagaaaguagauacgcgcacaccgaggagcaugccgggcacuagacgaguaaugggaauaaccgcagaguggcuuuggagaacucucggcagaaacaaaaagccgagguuguguaccagagaagaauuuacuaaaaagguacgcacuaacgcagcuaugggagcgguuuucacagaagaaaaucaaugggauagugcaaaagcugccguggaagaugaggacuuuuggaaauuaguagaccgagagagagaacugcauaaguuaggaaaaugcggaucuugugucuauaauaugaugggaaaaagagagaagaaacuaggagaauuugggaaagccaagggaagcagagcuaucugguauaugugguuaggcgcccgauaccuagaauuugaagcacuaggauuuuuaaaugaagaucauugguucagcagggaaaacucuuacucaggaguugaaggagagggacuucacaaacuaggauacauuuuaagagacauuuccaaaauuccugggggcgcaauguaugcagacgacaccgcagguugggauacaagaauaacagaggaugacuuacauaaugaagaaaagauuacucagcaaauggauccagaacauagacaauuggcaaacgcgauuuucaaguuaacauaucaaaauaagguagugaaaguacagcggcccaccccuacaggcacaguaauggacaucauaucucgaaaagaucagagaggcaguggucagguaggaacauauggcuuaaauaccuuuacuaauauggaagcacaguugauaagacaaauggagggcgaaggaguauuauccaaagcagaccuagagaauccucaucuacccgagaagaaaauaacucaaugguuagaaacaaaaggaguggaacgguuaaaacgcauggcaauaagcggggaugauuguguuguuaaaccgaucgaugacagauucgcuaaugcauuguuggcacuaaaugacaugggcaaaguccgaaaagacauaccacaguggcaaccaaguaaaggauggcacgauuggcagcaggucccuuuuugcucucaucacuuucacgagcuaaucaugaaagauggucgaaaguuaguaguaccgugccgaccacaagacgaauuaauugggagagcaagaaucucacaaggugcaggguggucucugcgagagacagcauguuuaggcaaggcauaugcacaaauguggucacucauguauuuucaccgccgugacuuacgacucgcaaguaaugcuauauguucugcagucccaguacauuggguuccgacaaguagaacuaccuggucuauccaugcccaucaccaauggaugacaaccgaagacauguuaacgguauggaacagaguguggauugaagacaauccauggauggaagauaaaacuccaguaacgacaugggagaacguccccuauuugggaaaaagagaagaucaguggugcggcucccuaaucgguuugacaaguagagcaaccugggcccaaaacauuccaacugcaauucaacaaguucgaucacuaaucggaaacgaagaauuuuuagauuauaugccuucgaugaagcguuuuaggaaagaggaagagucagaaggagcuauaugguaa

SEQ ID NO: 23053 - RNA, 9873 nt, Artificial Sequence
  derived and/or modified CDS sequence (opt6) from DENV-3__GU131844__SS-prME
acgaguuugugucuuaugaugauauuaccggcugcguuggcguuucauuuaacaucaagagauggugaaccuaggaugauaguuggcaaaaaugaacgcgggaaaucccuacuguuuaaaacagcgucagguauuaauaugugcacucuaauagcuauggaccuaggagaaaugugugacgauacagugacauauaaauguccacacauaacagaaguggaaccagaagacauagacuguuggugcaaucuaacuagcacauggguaacauaugguaccugcaaucaagccggagaaaggcggcgggauaaaagauccguugcauuagcuccacacguggggauggguuuagacacuagaacucaaacguggaugucugccgaaggagcauggcgccaaguagaaaaagucgaaacaugggcacugcggcauccggguuuuacaauucuagcuuuguuuuuagcacacuauaucggaacaucauugacacaaaaaguuguuauuuucauauuacuuauguuagucacuccaucgaugacaaugagauguguugggguugggaauagagauuuuguugaggguuuaucaggggcgacauggguggacguuguucucgaacacggagggugcguaacaacuauggcuaaaaauaaaccgacacuagacauagaauuacagaaaacagaggcuacacaacuagcuacccuucgaaaacuuugcauugaggggaaaauaacgaauaucacuacagauaguagauguccgacacaaggugaggcgguuuugccggaagaacaagaccaaaauuacguauguaaacacacguacgucgauagaggguggggaaaugggugcggucuguuuggaaaaggcagccucguaacgugcgccaaauuccaaugucuggaauuaauugagggcaaagucguacaauaugagaacuugaaauauacaguuauuauaaccguacauacgggcgaccaacaccaaguuggaaaugaaacucaaggagugacagcggagaucacaccucaagcgaguaccacggaagcaauacuccccgaguauggaacgcucggucucgaguguucaccacgaacugggcuagauuuuaaugaaaugauacuguuaaccaugaaaaauaaagccuggaugguucacagacaaugguucuuugauuuaccgcuaccguggacgucgggcgcaacaacagaaacaccaacguggaacaggaaagaauuacugguaaccuucaaaaaugcacaugccaagaaacaagagguagucguauuaggcucacaagagggggcuaugcacacggcucucacuggagcgacugaaauacaaaacaguggugguacauccauauuugcaggacaccucaaauguaggcugaaaauggacaaauuagaguuaaaaggcaugucauaugcuauguguacaaauacuuuuguguugaagaaagaaguauccgagacacaacacggaacaauauugaucaaaguugaguauaaaggggaagacgcuccuugcaaaauucccuuuaguaccgaggauggucaaggaaaagcacauaauggcagacucauuacagcuaaucccguggucaccaagaaagaagaaccugucaauauugaggcagagccuccauucggugaaaguaauauaguaauaggcacgggcgacaaugcacucaaaauaaacugguacaagaaaggaucaucuauagggaaaauguucgaggcaacagcgagaggagcaagaaggauggcgaucuuaggcgauacagcuugggacuuuggaucugugggugguguguuaaauagccugggaaaaaugguacaucagauauuuggaucagcuuacacagcauuauuuaguggagugaguugggugaugaaaauagggauaggagucuuguuaacauggauagggcuuaauagcaaaaacacaucaaugaguuuuagcuguauugcgauuggaauaaucacacuguaucugggagcaguuguccaagcagauaugggcuguguuauaaauuggaaaggaaaagaacuuaaaugugguucgggcauauuuguaacaaacgaagugcauaccuggacagagcaauauaaauuucaagcggauucgcccaaaagacuagccaccgcaauagcgggugcaugggagaauggaguuugcggaauaagauccacaacgagaauggagaacuuguuauggaaacagauugcaaacgaacuaaauuauauacuaugggaaaacaauguaaaauuaaccguugucgucggcgauauaauuggcguucuagaacaagggaaaagaacauuaacaccacaacccauggaguuaaaauauucauggaaaaccuggggcaaggcaaaaaucgucaccgcggaaacgcagaauaguaguuuuauaauugaugggccaaauaccccugaauguccaucagcaagucgugcauggaacguaugggaaguagaagauuauggauuuggagucuuuacgacaaacauauggcuuaaauugagggaagucuauacccaacuaugugaucacagacucaugucagccgcuguaaaagaugaaagggcuguacacgcagacaugggauauuggauagaaucgcaaaagaauggaucauggaaauuggaaaaagcaagucucauugaaguaaagacaugcaccuggccaaaaucucacacuuugugguccaacggaguucuagagucugacaugaucauaccuaaaagccucgcggguccuauuucacaacacaaucauagacccggcuaucacacgcaaacagcgggaccauggcauuuaggaaaguuagaacuagauuuuaauuacugcgaaggaacaaccguaguaauaacagaaaauugugguacuagggggccaucacugaggacaacuacaguuucaggaaagcuaauacacgaauggugcugcagguccuguaccuuaccgccacuccgauacaugggcgaggacggaugcugguaugggauggaaauuaggccaauaagugaaaaagaagagaauaugguaaagagucuaguaucggcuggaaguggaaaaguagauaacuuuaccaugggaguucuauguuuagcaauucuauuugaagagguaaugaggggaaaauucgguaagaaacauaugauagcaggaguauuuuucacauuuguuuuauuguuaucaggacagauuacauggagggauauggcacauacauuaauuaugauugguaguaaugcaagugaccgcauggguaugggcguaacauauuuagcuuugauagcuacuuuuaaaauucaaccauuucuugcuuuaggcuucuuucuuaggaaauuaacaagccgugaaaacuuacuuuuaggcguaggucuggcaauggcaacgacucuucaguugccagaagacaucgaacaaauggcaaacggaauagcacuuggacucauggcauuaaaauuaaucacccaguucgagacguaccaacuuuggacugcguuaaucucauugacguguucaaacacgauguucacguuaacaguagcauggcggaccgcuacguuaauuuuggcaggagugagucuacugccaguuugccaaagcaguucaaugagaaaaacugacugguuaccaauggcuguggcagcaauggggguacccccacucccccuauuuauuuuuagucuuaaggauacacuaaaaagaagaucuuggccccugaacgagggggugauggccgucggauuggucucaauauuggccucuucucuauuaagaaaugacgugccgauggcaggaccuuugguagcuggagguuugcucauagcgugcuaugucauaacaggcacgucugcggaucuuacaguugaaaaggccgcagauauuacaugggaagaagaagcagaacaaacaggaguuucgcauaacuugaugaucacaguagaugaugacggcacaaugagaauaaaagacgaugagacagagaacauucuaacaguucugcuuaaaaccgcacugcuuauaguguccggaguuuucccauacuccaucccagcuacacuacugguauggcacacauggcaaaaacagacucaaagaucagggguacugugggacgugccgaguccgccugaaacucaaaaggcagaacuagaagagggaguauauagaauuaaacaacaagggauauuugguaaaacacaaguagguguaggcguccagaaggaaggaguauuucauaccauguggcacguaacuagaggagcaguauuaacguauaacgguaaaagauuagagccaaauugggcuagcguaaagaaagauuugauuaguuacggaggaggauggagauuaagcgcccaguggcagaagggugaagagguucaaguuauagcaguggaaccugggaaaaaucccaaaaacuuucaaacuaugccggguacguuccaaacaacaacaggugaaauaggugcaauugcacucgacuuuaaaccuggaacgaguggcucuccaauaaucaaccgagaagguaagguaguaggacucuauggcaaugguguaguuaccaaaaauggaggguauguaucgggcaucgcucaaacgaacgcagaacccgaugguccaacuccagaauuagaggaggagauguuuaagaaaaggaaucucacuauaauggauuuacauccuggcucaggaaaaacucgaaaguaucugccagcuauaguccgagaggcuaucaagcgacgucuccgaacucuaauacuagcaccgacgagaguagucgcagcagagauggaggaagcguuaaaggggcuuccuauacguuaucaaacgacagcaacgaaaucugaacauacaggacgggaaauaguggaucuaaugugucaugccacuuucacuaugcgauuauuaucgccuguaaggguaccuaacuacaauuuaauaauuauggaugaagcacacuuuaccgauccugcaaguauugcagcaaggggauacauuaguacacgggugggaaugggagaagcggcggcgauuuuuaugacugcaacaccuccaggaacagcggacgcauucccccagucgaacgcaccaauacaagaugaggaaagagauauaccagaaagaaguuggaacucaggaaaugaauggauaacagauuuugcagggaagacaguaugguucgugccaagcauuaaagccggaaaugacauagcaaauugccuaaggaaaaauggaaagaaagucauccaauuaaguagaaaaacauuugacacugaauaccagaaaacuaaacuaaaugauugggauuuuguggugacgacggauauuucggaaaugggagcuaacuucaaagcugaucgaguaauagacccuagaagaugucugaagcccguaauacucacagauggacccgaacgaguaauccuggcuggaccaaugccuguaacagcggcuagcgcugcacaacgacgaggaagaguagguagaaacccucaaaaagaaaaugaucaauauauuuucacagggcaaccuuuaaauaaugaugaagaucaugcucacuggaccgaagcaaagaugcuacuggacaauauuaacacacccgaggguauuauacccgcacuauucgaaccugaacgagaaaaaucggcugcaauagauggagaauauagacuaaaaggcgagaguaggaaaacauucguagaauugaugcgucgcggcgaucugccuguuugguuagcucauaaaguagccucagagggcaucaaauauacugaccgaaaauggugcuuugauggucaacggaauaaucaaauccuagaggagaauauggacgucgaaauuuggacaaaagagggagagaagaagaaacucagaccaagguggcuagacgcaaggacauauucagauccauuagcauugaaggaauuuaaagauuuugccgccgggagaaagaguauagcucucgaucuuguaaccgaaaucggaaggguaccaucacaucucgcacacaggacaagaaaugcgcuagacaaccucguaaugcuccauacgagugaacauggcgguagagccuaucgacacgcaguagaagaacuaccagaaacuauggaaacauuacuguugcugggacuaaugaucuuacuuacagguggggcaauguuguuucucauaucagguaaagguauagggaaaacuucuaucggacucauuugcguuaucgcuagcaguggaaugcuuuggauggcagaaaucccuuuacaauggauagcaagcgcaauaguacuggaguucuuuaugaugguauuguugaucccugaaccggaaaaacaacgaacuccacaagacaaccagcucgcuuacgucgugauaggaauauuaacccuagccgcaauuauagccgccaaugaaaugggucucuuagagacuacuaaacgugacuuagguaugucaaaagaaccaggggugguuucuccaacaucauauuuggacguagacuugcauccagcgagugcguggacguuauaugcaguggcgacgacaguuaucacuccuaugcugaggcauacuauagaaaacaguaccgcgaacguuucauuggcagcgauagcuaaccaggcuguuguacuuaugggacuugacaaaggauggccuauaucaaaaauggauuuaggaguaccguuacuagcacuuggauguuacucccagguaaaccccuuaacuuugacagccgcuguacuuuuacuaauaacacauuaugcaauaauugguccuggucuccaagcuaaagcaacaagagaagcacaaaaacggacggcagccgggauuaugaaaaacccuacaguagacggaauaaugacaauugauuuggaucccguuauuuaugauagcaaauucgaaaaacaacuaggucaaguaaugcuacucgugcuaugugcagcgcaacuuuuacugaugcggacaucaugggcucucugugaggcauuaacacuggcaacagguccuauaacaacuuuaugggaagggucgcccggaaaguucuggaauacuacuauagcuguuucaauggcaaacauauuuagaggaucguauuuagcaggggcuggacuggcauucuccauaaugaagucgguaggaacagggaaaagagguacgggaucucaaggagaaacgcuaggagagaaauggaagaagaaacuaaaccaauuaucuagaaaagaguucgauuuguauaagaaaaguggaauaacagaaguggacagaacagaagcaaaggaaggacuaaaaagaggggaaauaacacaccaugccguaucacgaggaagugcuaaacuacagugguuuguagagcguaauauggugaucccggagggaagagucauagaucugggguguggucgcgguggauggucauauuacugugcuggacuaaagaaagucacagaggucaggggcuauacaaaaggagguccuggacacgaggaaccgguaccaaugaguaccuauggauggaauauaguuaaacuaauguccggaaaggauguauucuaucuuccaccugaaaaaugcgacacuuuacuaugugauauaggagagucaucaccuaguccaacuguugaggaaagcagaacgauacguguacuaaaaauggucgaacccuggcucaaaaauaaccaguuuuguauaaaagucuuaaaucccuacaugcccaccguuauugaacauuuagaaagauuacaaagaaaacauggcggcauguuaguaagaaauccguuaaguagaaacucaacacacgaaauguauuggauaucgaacggaacagggaauaucguugccuccgugaauaugguuucucgacuuuuauuaaaucgguucacgaugacgcacagacggccuacaaucgaaaaggacguggaucuaggugcaggaacucggcacguaaacgcggaacccgaaacuccgaacauggaugugauaggagaaagaauaaaaagaauaaaagaggaacacaauucaacauggcacuacgacgacgaaaaucccuacaagacaugggcauaccacgguaguuacgaggucaaggcaaccgggucagccagcucaaugaucaauggugucguaaaauuacuuacuaagcccugggauguaguuccaauggucacacaaauggcuaugacugauacaacaccguucggacagcaaagaguguuuaaagagaaaguagacacaagaacaccgcgaaguaugccagggacucgacgcgucauggggaucacagccgaauggcuuuggcguacucucggacgaaauaagaaaccaagauuauguaccagagaagaguuuaccaagaaaguuagaacaaaugcugcaaugggugcuguauuuacggaagaaaaccaaugggauucggccaaagcagcuguagaagaugaggauuucuggaaauugguagauagggaaagagaauugcauaaacuaggaaagugcggcucauguguauauaacaugauggguaaacgagagaagaaacuuggugaauuugguaaagcaaagggcagcagagcaaucugguauauguggcugggagcaagguacuuggaauuugaagcauuaggauuuuuaaaugaagaucacugguuuuccagagaaaauucauacuccggaguagaaggagaaggucuucacaaauuaggauauauucuacgggacauuucaaaaauucccgggggagcaauguacgcggacgacacugcagguugggauacgcgcauuacugaagaugaccuucauaaugaggagaaaauaacucaacaaauggaucccgaacaccgacaauuggcuaacgcuauuuuuaaguugaccuaccagaacaagguagucaaaguccaaaggccaacucccacagggacggugauggacauaauauccaggaaggaucaacgagggagcggacaaguaggaacguauggcuugaacacauuuaccaauauggaagcacaauuaauaagacaaauggagggggaaggaguauuauccaaggccgauuuagaaaauccccaccuuccugagaagaaaauagcgcagugguuagaaacaaaagggguggaaaggcuaaaacgaauggcaauaaguggggacgacuguguaguaaaaccaauugaugaccgguucgcgaaugcgcugcuagcgcucaaugacaugggaaaaguuagaaaagacaucccgcaauggcaaccaaguaaaggguggcaugauuggcaacaaguaccguucuguucccaucauuuucaugaauugauuaugaaagauggacgaaagcugguagugccaugcagaccacaagaugaauuaaucggucgcgcacggauaucgcaaggcagcggcuggucacuaagagagacugcauguuuaggaaaggcuuacgcccagauguggagucuuauguauuuccacagacgcgaucuaagauuggcgucuaaugcaaucugcucagccguaccuguacacugggugccuacuucacgcaccacuugguccauucacgcccaccaucaauggaugacuacagaggauaugcuggcgguauggaauagggucuggauagaagacaacccauggauggaagauaagacgccaguaacaacuugggaaaauguuccuuauuuaggcaaaagggaggaucaauggugugguucacuuaucggacuaacgucgcgugccacgugggcccagaauauccccacggcaauacaacaggucagaucuuuaauuggcaaugaagaauuucuagacuacaugccuucaaugaaaagguuucgcaaagaggaggaguccgaaggagcuauaugguaa

SEQ ID NO: 23054 - RNA, 9873 nt, Artificial Sequence
  derived and/or modified CDS sequence (opt6) from DENV-3__GU131849__SS-prME
accucucuguguuuagugaugauauuacccgcagcacucgcuuuucauuugacauccagagauggugaaccgagaaugauaguugggaaaaaugaaaggggaaaaucacuacuauucaaaacagcaaguggaauuaauauguguacucucauagcaauggaucucggggaaaugugcgaugacacaguuacuuacaaaugcccccacauaacagaaguagaaccugaagacauagauuguuggugcaauuuaacaucaaccuggguaacauaugguacauguaaccaagcaggagaaagacggcgggauaaacgcucgguagcccuggccccucauguagguaugggacuagacacaagaacccaaacuuggaugucugcugaaggagccuggagacagguggaaaaaguugaaacuugggcacuaagacauccagguuucacaauacuagcacuauuucuugcccacuacaucggaacaucucuaacacagaaaguuguaauuuuuauccuccuaaugcuuguaacaccuucgaugacaaugcguuguguaggaguagggaaucgagacuuuguagaaggauuaucaggagcaacuuggguugaugugguguuagaacauggaggauguguuacaaccauggcuaaaaacaaaccgacacuugacaucgaacuucagaaaaccgaagcaacacaacuagccacccugaggaaacugugcauagaagguaaaaucacuaauauuacaacagacaguagaugcccaacccaaggcgaagcugugcuuccagaggaacaagaccaaaauuacguauguaaacauaccuaugucgacagaggauggggaaaugggugugguuuguuugguaaaggauccuuaguaacuugugcaaaauuccaguguuuggaaccaauagaaggcaaaguuguucaguacgaaaaccuuaaauauacaguaauaauaacuguacauaccggcgaucaacaucaaguagggaaugaaacucaaggaguaaccgcagaaauuacaccgcaagcaaguaccauagaggcaauauuaccugaauauggcaccuugggacucgagugcucuccaaggacuggucuagacuuuaacgaaaugauacucuuaacaaugaaaaauaaagcguggaugguacaucgacagugguucuuugaucuaccacuucccuggacaaguggagccacuacugaaacaccaacguggaacagaaaagaauuauugguuacauucaaaaacgcccacgccaagaaacaagaaguaguaguauugggaucgcaggagggagcaaugcauacagcacugacuggugccacugagauacaaaauuccggcggaacuucuauauucgcagggcacuuaaaaugcagauuaaaaauggacaaacuugaauuaaaaggaaugucuuaugccaugugcacaaauacguucguacuaaagaaagagguaagcgaaacacaacacgguacaaucuugauuaaaguagaauauagaggcgaagaugccccuuguaaaauaccguuuaguacagaagacggccagggaaaagcacauaacggccgacucaucacugcgaauccuguaguuacgaagaaagaagaaccaguaaauaucgaagcugaaccuccauuuggcgaaucuaacauaguaauuggaauaggagauaacgcuuugaaaauaaauugguauaagaaagggagcucaauagguaagauguuugaggcaacagcuagaggagcuagaagaauggcaauacuuggcgacacagcaugggauuucggaagcguagggggagucuuaaacucuuuaggaaaaaugguccaucagauuuucggaagcgcuuacacagcacucuucagugguguuucaugggucaugaaaauaggaauaggcauucuucuaacauggauuggacuuaauaguaaaaauaccagcaugaguuuuaguugcauagcuauuggaauaaucacgcuguaucucggagccguuguucaggccgauauggguuguguaauuaauuggaaaggaaaagaauuaaagugcggaucugguauuuuuguaacgaaugaaguacauaccuggacugaacaauauaaauuucaagcagauagucccaaaagacuagcaaccgccauagccggagcuugggaaaacgggguauguggcaucaggucaacaaccagaauggagaaccuacuguggaaacaaauugcaaacgaauuaaauuacauccuaugggaaaauaauauaaaauuaacgguaguggugggagacauaauaggcguacuugagcaaggaaagcgaacacuuacuccgcaaccuauggaacuaaaauauucuuggaaaacaugggguaaagcaaaaauagucaccgcggagacacaaaauuccagcuuuaucauugauggaccaaacacgccggaguguccaagugcaucuagagcauggaaugugugggaaguagaagauuacggauucggaguguuuacaacgaauauuuggcuaaagcucagagaaguuuauacacaacuaugcgaccaucgguuaaugucugcagcuguaaaagacgaaagggcuguacaugcugacaugggcuauuggauagagagucagaaaaauggcaguuggaagcuagaaaaagcaaguuuaauagaaguaaaaacguguacauggccaaaaucacacacauuauggucaaacggaguacuugaaagugacaugaucauacccaaauccuuagcagggccgaucucgcaacauaaccauagacccggauaucauacucaaacggccggcccuuggcacuuagggaaacuagagcuggauuucaacuacugcgaaggcaccaccgucguaaucacagagaauuguggcacaaggggaccuucuuugcgaacaaccacgguaucggguaagcuaauacaugaauggugcugcagaucguguacauuaccuccacuaagauauaugggagaagacggaugcugguacgguauggagauucgccccauuagcgaaaaagaggaaaauaugguuaaaagucugguuagugcuggaucgggaaaaguggauaacuucacuaugggaguacucugcuuagcuauacuauucgaagaagucaugaggggcaaauucggcaagaaacauaugauagcgggaguauucuuuacauuuguauuacugcuaaguggacaaaucacuuggagagauaugacgcauacgcuuauaaugauuggcucuaaugcaucagaucgcauggguauggguguuaccuaccuagcacuaaucgcgacuuuuaaaauacaaccauuucuagcacucggguuuuuccuuagaaaacugacgucaagggagaacuuauuacuugguguaggauuagcuauggcuacgaugcuacagcugccugaagauauagaacagauggcgaauggaauagcacugggauuaauggcacuaaaguuaauaacucaauuugaaacguaucaacuguggaccgcgcuuauuagccuuacauguucuaauacaauguucacauugacuguagcauggaggacggcaacuuuaauccucgcaggagucaguuuauugccagucugucaaaguaguaguaugagaaagaccgauuggcucccuauggcgguagcggcaaugggaguuccaccgcugccauuauucaucuuuucccuaaaggacacgcugaaacgaagaaguuggccacugaaugaaggcguuauggccgugggacugguauccauacuagcuaguagucuacuacgcaaugauguuccuauggcuggaccuuuaguugcaggagguuugcuuauugcaugcuacgucauuacgggcacgagugcggacuugaccguagagaaggccgccgacauaacgugggaagaagaggccgagcaaaccggcgugucgcauaacuugaugauaacaguagaugaugauggcacgaugagaauaaaagaugaugaaacugaaaacauucugacaguccugcucaaaacagcguuauuaaucguuuccggugucuuuccguacuccauaccggcuacacuucugguuuggcacacauggcagaaacaaacucaaagaaguggugugcuaugggacguaccuucaccacccgaaacucaaaaggcagaguuagaggaagguguauauagaauuaagcaacaagguauuuucggaaagacacaaguaggugugggaguacagaaggaaggaguauuucauacaauguggcacguaacaagaggagcagugcuaacuuacaauggaaagcgcuuagaacccaacugggcuaguguaaagaaagaccuaauuaguuauggagguggguggcgauuaucggcacaauggcaaaaaggagaagaaguccagguaauagcugucgaaccugguaaaaaucccaaaaacuuccagaccacgccaggaacuuuccaaacuaccacgggagagauuggggccauagcucuugacuuuaagccggggacgagcgggucgccaauuauaaacagggaagggaaaguugucggacuguauggcaauggcguagucacaaagaacggcgguuaugugucaggaaucgcucaaacaaaugccgaaccugauggcccgacaccagaacuugaagaggaaauguucaagaaacgaaaucuuacuaucauggaccuccacccaggauccggaaaaacucgaaaauaucuaccagcaauuauacgggaggcgauaaagcggagauuaagaacacuaauacuagcgccgaccagaguaguagcggcugaaauggaagaagcacuuaaaggacuaccaauuagguaucaaacgacagcgacuaaaucggaacacaccggaagagaaaucguggaucuuaugugccacgcaacuuucaccaugagacucuuaucaccugugagaguuccuaauuauaaccuuauuauaauggacgaagcucacuucacggacccagcaucaauagcugccaggggcuacauaagcacaagaguaggaaugggagaagccgcggcaaucuucaugaccgcaacuccuccagggacugcagaugccuuuccucagucuaacgcaccuauacaggaugaggaacgggacaucccggaaagaaguuggaacucuggcaaugaauggauaacugauuucgccggaaaaaccguuugguucgucccaucaaucaaagcaggaaacgauauagcaaauuguuuaaggaaaaauggaaagaaagucauacaacuaucaaggaaaacauuugauacugaauaucagaaaaccaaguuaaaugauugggauuuuguuguaaccacggauauaucagaaaugggggcaaauuucaaagcagaucgaguuauagacccgaggagguguuuaaagccaguuauacuuacagauggcccugaacggguuauauuagccgggccuaugccaguaaccgcagccagugccgcacaacggaggggaagaguuggaaggaacccacaaaaagagaacgaccaguauaucuuuaccggacaaccuuugaauaaugacgaggaccaugcccauuggaccgaagcgaaaaugcuucuagacaacauuaacaccccggaaggaaucauaccggcccuauucgagccagaaagagagaaaagcgcagcaauagacggugaauaccgacugaaaggugaaagcagaaagacuuuuguugaauuaaugagaaggggcgacuuaccagugugguuggcucauaaaguagcaucggaagggauaaaauacacugacaggaaaugguguuuugaugggcaaagaaauaaucaaaucuuggaagaaaauauggauguugaaauuuggacuaaagaaggagaaaagaagaaauuacgacccagauggcuagaugcuagaacauacagcgacccacucgccuugaaagaauuuaaggacuuugcagcaggccguaagucaaucgcacuugacuuaguaaccgaaauaggaagggugccgucccaucuagcacauagaaccagaaacgcguuagauaacuuagugaugcuccacacauccgaacauggcggcagagcauaucgccacgcaguagaagaguuaccggagacaauggaaacguugcucuuacucgggcuaaugauucuucuaacaggaggugcuaugcuuuuccuuaucucagggaaaggaauagggaagacaaguauaggccucauaugcgucauagccucgagugguaugcucuggauggcagaaauuccauuacaauggauagccagugcaauuguccuggaguucuuuaugaugguauuauuaauucccgaaccagaaaaacaacggacaccccaagauaaccaauuagcauauguuguaaucggcauccuaacacucgcugcaauaauugcggccaaugagaugggauuacuugaaacaacgaaacgagacuugggaauguccaaagagccaggugucguuagucccacgagcuaucuggacgucgaccuacauccagcaucagcauggaccuuauacgcgguggcgacuacagugaucacacccauguugaggcauacgauugaaaauucuacagccaacguaucucuagcagcuauagcgaaccaagcaguuguccugaugggucucgauaaaggauggccgauaucaaagauggaccuggguguuccuuuguuagcguuagguuguuacucacaaguaaauccgcuaacacuaacugccgcggucuugcuucuaauaacucacuaugcgaucauuggaccuggauuacaagccaaggcaacucgagaagcucaaaagaggaccgccgcgggaauaaugaaaaacccgacgguagaugguauaaugacaauagaucuagauccaguaaucuacgacucuaaguuugagaaacagcugggacaaguaaugcuguuaguucucugcgcuguacaauugcuacuaaugagaacauccugggcauuaugcgaagccuuaacuuuggcaacaggaccgauaacuacucuaugggaaggaagcccuggcaaauuuuggaauaccacuauugcgguuagcauggccaacauuuuucguggaucguaucuagccggugcaggauuagcauuuucaaucaugaaaagcguggguaccggaaagcggggaacagggucacaaggggagacucuuggggaaaaauggaaaaagaaacuaaaucaauuaagcagaaaagaauuugauuuauacaagaaauccggaauaacagagguugaccguacggaggcaaaagaaggucuaaaaaggggcgaaaucacucaucaugcgguaucgcgcgguucagcaaaauuacaaugguucguugaaaggaauaugguuauaccagaagguaggguaauagacuuagguugcggacgaggggguuggaguuauuauugcgccggccucaagaaagucacagagguucguggguauacuaaaggaggacccggacaugaggaacccgucccuaugucaacguauggauggaauauaguuaaacuaaugagcggaaaggaugucuuuuacuuaccaccagaaaaaugcgauacgcugcuuugugacauuggagaauccucuccuagucccacggucgaagagucacgaacgauacggguguuaaaaaugguugagccaugguuaaagaauaaccaauuuugcauaaagguccuaaauccuuacaugccgacagugauugaacauuuagagcgguuacaacguaaacauggagggauguuaguucguaacccacuuucacguaauuccacccaugaaauguacuggauuagcaauggaacaggcaacauaguagcgaguguuaauauggucaguagguuauuauuaaauagguuuaccaugacacacagaagaccuacaauugaaaaagacguugacuuaggggcagguacgcgucaugugaaugcggaaccagaaacaccuaacauggaugugauuggugaacgaauuaagcgcaucaaagaagaacauaauucuacguggcacuaugacgaugagaaccccuacaaaacgugggcauaccaugguagcuaugaaguaaaagcaacggguagugcaucaagcaugauaaaugguguagucaaauuacucacaaaaccuugggacguagugccaaugguaacucaaauggcuaugacggacacuacuccguuugggcaacagcguguuuuuaaagaaaaaguagacacacgcacacccagauccaugccagguacgagacgaguuauggaaauaacagccgaauggcuuuggcgaacauuaggaagaaacaagaaaccacggcuauguaccagagaggaguucacgaagaaaguucgcacaaacgcagcaaugggagccguauucacagaggaaaaccaaugggacucagcuaaagccgccguugaagacgaagauuuuuggaaauuaguagauagagaacgugaauuacacaaauuaggaaaaugugggucauguguauauaacaugaugggaaaacgugagaagaaauuaggagaguucggcaaagcgaaaggaagcagagccauuugguacauguggcuuggcgcgcgauaucuagaguucgaagcauuaggauuccuuaaugaagaucauugguucucaagagaaaacucguacagcggaguugagggugaaggucuacauaaauuaggauacauucuaagggauauaucgaaaauaccugggggcgccauguaugcggacgauacugcgggcugggauacaaggauuacugaagaugacuuacacaacgaggagaaaauaacacaacaaauggauccugaacaccgacaauuggcaaaugcgauauuuaaacuaacauaucaaaauaaaguggugaaaguacaacgaccuacaccaacaggaacugucauggacauuauaucuagaaaagaccaaagaggcaguggacaagucggaaccuacggacuaaacacauuuacuaacauggaagcccaacucauuagacagauggaaggagaaggcguauugagcaaggcggaucuggaaaauucacacuugccugagaagaaaaucacgcaguggcuagaaacaaagggugucgagaggcucaaaaggauggcaauaaguggggaugacuguguuguuaagccuauugacgaucgauuugcgaaugcacucuuagcauuaaacgauauggguaaaguuaggaaagauaucccgcaguggcagccaucuaagggcuggcaugacuggcagcagguccccuucugcucucaucacuuucacgaacuaauaaugaaagauggcaggaaacuuguaguuccaugccguccacaggacgaacuuauaggcagagcacgaauaucgcaaggagcuggauggucguuaagagaaaccgccugccugggaaaggcuuacgcucaaauguggucguugauguacuuccaucggagagacuuacgauuagccucaaaugcaauuuguucggccguaccaguacauugggugcccaccagucguacaacguggucuauacaugcacaccaccaauggaugaccaccgaggacauguuaacgguauggaaucguguauggauagaagauaaucccuggauggaagauaaaacaccaguuacgaccugggaaaacguacccuaucucggaaaacgggaagaccaaugguguggaucuuuaaucggucuaaccucucgcgcgacaugggcccaaaacauaccaacagccauucaacagguacguucguuaauaggaaaugaagaguucuuggauuacaugccuagcaugaagcgauuucguaaagaagaggagucagaaggugcaauaugguaa

SEQ ID NO: 23055 - RNA, 9873 nt, Artificial Sequence
  derived and/or modified CDS sequence (opt6) from DENV-3__GQ868546__SS-prME
acaucauuguguuuaguaaugauucuaccagcagcgcucgcuuuucacuuaacuucacgagauggugaaccgagaaugauuguggggaaaaaugaacgagguaaaucauuguuauuuaaaacugcaaguggaauuaacaugugcacguuaauugcaauggaucuaggcgaaaugugcgacgauacaguaacguauaaaugcccucauauuacugaaguugagccagaagacauagacugcuggugcaaccuaacuagcacauggguaacauaugguaccugcaaucaagcaggagaacggaggcgagauaaacgaucuguugcauuagccccucacguuggaaugggccuagauacacgcacgcagaccuggaugucugccgaaggcgcauggagacaaguagaaaaaguagaaacaugggcacuuaggcacccagguuucacuauuuuagcacuguuuuuagcacauuacauaggaacuagcuugacccaaaaaguuguaauauucauacuguuaaugcuaguaaccccaaguaugacaaugcgauguguaggaguagguaacagagauuucguagaaggucuuaguggcgcuacauggguagauguaguucuagaacaugguggguguguaacuacuauggcuaaaaacaaaccaacuuuagacaucgaauuacagaaaacagaagcaacacaacuugcuacgcuaagaaaacuuugcauagagggcaaaaucacaaauauuaccacagauucccgcuguccuacacaaggugaggccguguuaccagaagaacaagaucaaaacuauguauguaaacauacguacguagaucggggauggggaaacgguuguggauuauuugggaaagguagcuugguaaccugugcaaaauuucaauguuuagaaccuauagaaggcaaagugguacaauaugagaaccucaaguauaccguuauaauaacaguacauacuggagaccaacaucaaguaggaaaugaaacucaagguguuacugcagaaauaaccccacaagccucgaccacggaggcuauauuaccagaauacggaacacuaggacuggaaugcucaccccguacuggacuugauuucaacgaaaugauucuauugacaaugaaaaacaaggcuuggaugguacacaggcaaugguuuuucgaccuaccacuaccauggaccucuggugcgacgacugaaacaccaacguggaacagaaaggaauugcuugucacuuucaagaaugcgcacgccaagaaacaggaagucgugguuuuagguagccaagaaggugcuaugcacaccgcucucacuggggccacugaaauucaaaauucugguggaacaucaauauuugcaggccaucugaaaugucggcuaaaaauggauaaacuggaauuaaagggaaugagcuaugcuauguguaccaauacguucguacuaaagaaagagguaagcgaaacccaacacggaaccauacuuauaaaaguagaauaucgaggagaggaugcacccuguaaaauccccuuuaguacggaagauggucagggaaaagcccauaauggucgccuaauuacugcaaaucccguagucaccaagaaagaagaaccgguaaauaucgaggccgaaccuccauuuggggaaucuaauauagucauaggaauaggagauaacgcacuaaaaauaaauugguacaaaaagggaucuucgauugggaaaauguuugaagccacagcgcgcggugccaggagaauggcuauuuuaggugacacggcaugggauuuuggaucgguagguggcguguuaaauuccuuaggcaaaaugguucaucaaaucuuuggaucagcguacacagcguuauuuucuggaguaucguggguaaugaaaauaggaauagguaucuuauuaaccuggaucggauuaaauaguaaaaauacauccaugagcuucaguuguauagccauuggcaucauuacauuauaccucggcgcaguuguccaagcggacaugggcuguguaaucaauuggaaagggaaagaauugaaaugugguaguggcauauucguuacaaacgaaguacacacauggacugaacaguauaaauuccaggcugauagcccuaagagacuggcaacagcgauagcuggugcaugggagaauggcguaugcgggauacguaguacuacaaggauggaaaaccugcuuuggaagcagaucgcuaacgaacugaauuauauucugugggaaaacaauauaaaauuaacgguaguggugggcgacauaauuggcguauuggaacaagggaagaggaccuuaacaccucaaccuauggaauuaaaauacucauggaaaacauggggaaaagccaagauuguuacagcugaaacucaaaauucuucuuucauuauagacgguccgaauaccccagaguguccaucagcuucaagagcauggaacgucugggaagucgaagauuaugguuucggaguauuuacaaccaacauuugguuaaaauuacgugagguguauacacaacucugugaccauagauuaaugagugccgcgguaaaagaugagcgcgcuguccaugcggauaugggauacuggauugaaucucagaaaaaugggucuuggaaacuugaaaaggcgaguuugauagaaguuaaaacaugcacuuggccaaaaucgcauacacuuuggagcaaugggguacuugaaagcgauaugaucauaccuaaaagucucgcgggacccauuagucaacauaaccauagaccagguuaucauacacaaacagcgggaccuuggcaucuuggcaaacuagaauuagacuuuaacuauugcgagggaacaaccgugguuauaacugagaacugcggaacgagggguccgaguuugagaacaacaacuguuagcggaaagcuaauacacgaaugguguugucgcuccugcacauugccaccacuacguuauaugggggaagauggauguugguaugggauggaaauucgcccaauaagcgagaaagaagaaaacaugguaaaaagccucguuucugccgguuccggaaaaguagauaacuuuacaaugggugugcuuugcuuagcaauucucuuugaagaaguaaugagaggcaaauuugguaaaaagcauaugaucgcugggguauucuuuacuuuuguccuacuacuaagcggacagauaacauggagagacaugacccauacauuaauaaugauaggaucuaaugccagcgaccgcaugggcaugggagugacauauuuagcucuaauagcgacauucaaaauucagccuuuccuagcucuaggcuucuucuuaagaaaauugacgucacgggaaaacuuacugcuugguguaggucuagccauggcgacuacuuuacaauugccggaagacauugaacaaauggcaaaugggauugcacuugggcuaauggcauuaaaacuuaucacccaguucgaaacguaccagcuauggacugccuuaauaucacucacauguucaaauacaauguuuacauuaacuguagcuuggagaacagcaacacuaaucuuggcagggguuucuuuauuaccagucugucaguccucuucuaugcgcaaaacugacuggcuaccaauggcaguagcagcaaugggcguaccgccacugccucuuuuuauauucaguuugaaagauacauuaaaaaggaggucguggccuuugaacgagggaguaauggcaguggggcuagugucuauauuggcaaguagucuccuccgaaaugacguacccauggcggggccacuuguugccggugguuuauuaauugcaugcuacguuauuacaggaaccagugccgacuugacugucgaaaaagcugcugauauuacaugggaagaagaggccgagcaaacuggugucagucacaaucugaugauaacagucgaugaugacgggacuaugaggaucaaagaugacgaaacugagaauaucuuaacuguucuacugaaaacagcucuauuaauaguuucaggaguauuccccuauucaauuccagcaacauuauuaguauggcauacguggcaaaagcagacucaaagaucugggguacuaugggacguaccuucaccuccugagacgcaaaaggcugaauuagaggaagguguauaucgcauuaagcagcaggggauuuuuggaaaaacacaaguugggguaggagugcagaaggagggaguauuccacacaauguggcauguaacgaggggagccguguuaacuuauaaugguaaaagacucgagccuaauugggccaguguuaagaaagaccuaauuucguauggaggaggauggcgauuaagcgcacaauggcaaaaaggagaagaagugcaaguaauugcuguagaacccgggaaaaaccccaaaaauuuccagacaacuccaggcacauuucaaacaaccaccggggaaaucggcgcuauagcucuugacuuuaaacccgggacgucugguucaccaauaauuaaucgagaaggcaaaguaguuggacucuaugguaauggugucguaaccaaaaauggagguuacguuucugguauugcacaaaccaaugcugaacccgacgggccuacuccagaacuagaagaagagauguuuaaaaagagaaaccuuaccauuauggaucuacauccaggcagcggaaaaaccagaaaauaucugccagcuaucauacgagaagcgauuaaaaggagacugaggacuuuaauacuggccccaaccagggugguugcugcagaaauggaggaggcauuaaaaggacuaccuauuagauaucaaacgacugccacaaaaagcgaacacacaggacgggaaauaguagaucuaaugugucaugcuaccuucaccaugagacugcugagcccuguccgcguaccuaacuauaauuuaauuauuauggacgaagcacacuucacggauccagcaagcauagcggcaagagguuauaucagcacgagaguuggaaugggagaggcagcagccauuuuuaugacugcgacaccuccagggacugcggacgccuucccacaaaguaacgcaccaauacaagacgaagagagggacauuccagagaggaguuggaauaguggaaaugaauggauaacagauuuugccgguaaaacuguuugguuuguuccaucaauuaaagcugguaaugauauagcaaauuguuuaagaaagaaugguaagaaagucauacaacugaguaggaaaacauuugacacugaauaucagaaaacgaaacuaaaugacugggauuuugucguaacuacggauauuucagaaaugggugcgaauuuuaaagcagauaggguaaucgacccgcgcagauguuuaaaaccuguaauauugaccgauggaccugaacgcguaauacucgcagggccuaugccaguaacugccgcgucagcggcacagcgacgaggucggguugggagaaauccgcaaaaagagaaugaucaauauaucuuuacgggccaacccuuaaacaacgacgaagaccacgcacauuggacugaggcgaaaaugcuauuggacaauauaaauacaccggagggcaucauaccugcauuauuugaacccgaacgagaaaaaucagcagcuauagauggggaauauagacugaaaggagagucacguaaaacauucguugaauuaaugcgccguggugaucuaccagucugguuagcccauaaagucgcaucagagggcauuaaauauacagauagaaaguggugcuuugauggccaacgcaauaaucagauucuggaagaaaacauggaugucgagaucuggacuaaagaaggagagaagaagaaacuuagaccuagguggcuggacgcucgcacauauagugauccccuagcauugaaagaguuuaaagacuucgcggccgggcguaaaaguauugcacuagacuuagucacagaaauuggaagaguacccucacaccuugcacaccgaacucgcaaugcuuuggacaauuuagugauguugcacaccucugaacauggaggacgcgcauaucggcacgcggucgaagaacugccagagacgauggaaacccuucuucuuuuaggacuaaugaucuuacuaacaggcggcgccauguuauuuuuaauuucagggaaagggauagguaaaacaaguauuggguuaauuugcguuauugcaucgucuggaauguuauggauggcugaaauaccauuacaguggauagcaagugcaauaguacucgaauuuuucaugaugguacuccucauuccagaaccagaaaaacaaaggacaccccaagauaaccaacuugccuacguaguaauagggaucuuaaccuuagcggcuauuauagcagccaaugaaaugggacugcuagaaacaacaaaacgggaucuagguaugagcaaagaaccuggaguugugucgccgaccucguacuuagaugucgaccuacacccggcgagugcuuggacauuauaugcuguugcgaccacuguuauaacaccgaugcugcggcauacuauagaaaauaguaccgccaauguaagucuugcugcuauugcaaaucaggccguaguauuaaugggucuugauaaaggguggccaaucaguaaaauggauuuaggaguaccucuucucgccuugggaugcuauucucaaguaaauccccuuacucuaacugccgcaguacucuuguuaauaacccacuaugcaauaauaggaccaggacuacaagcaaaggcaacgagagaagcacaaaagcgaaccgcagcaggcauaaugaagaauccgacaguagaugguauaaugacgaucgacuuggacccugugauuuaugauucuaaauucgagaagcaauuaggacaggucaugcugcuaguauuaugugcgguacagcucuuacuuaugagaacgucuugggcauuaugugaagcauuaacccuggcaacuggcccaauaacgacucugugggaagggaguccgggaaaauucuggaacacaacuaucgcgguaucuauggcaaacaucuuucgugguucguaucuagccggugcuggguuagccuuuuccauaaugaaaaguguuggaaccggaaaacgcggcacggggucgcaaggcgaaacccuuggugaaaaauggaagaagaaauuaaaucaacuaucucguaaagaguuugacuuauauaagaaaucuggaauaacggagguagauagaacagaagcaaaggaaggauugaagaggggagaaaucacccaccacgcuguaucaagaggcucugcuaaacugcaaugguucgucgaaagaaauaugguaauuccagaaggacgugugauugauuugggguguggccgagguggauggucuuauuacugcgcaggcuuaaagaaaguaacagaaguacgaggguauacuaaagggggcccuggucacgaagaaccuguaccuaugaguacguacgguuggaacauaguaaaauuaaugucagggaaagauguauuuuaucuacccccggagaaaugcgauacauuacuuugcgacaucggagaguccucaccaucacccacuguagaggaaaguagaacuauaaggguauuaaaaaugguggagccuuggcucaaaaauaaccaauuuugcaucaaagugcuuaacccauauaugcccacaguaauagaacaccucgaacggcuacaaagaaaacauggcgguaugcugguuagaaauccgcucucucgaaacagcacccacgaaauguauuggauuaguaauggaacgggaaauauaguugcaagcgucaauauggucucacgacucuuacuaaauagauuuacuaugacacauagaagaccgaccauagagaaagacguugaucucggugcuggcacuagacaugugaaugccgaaccagaaacgccaaacauggacgugauuggcgagcgcauaaaaagaauuaaagaagaacacaacaguacauggcauuacgaugaugaaaauccguauaaaacaugggcauaucauggcucauacgaggugaaagcaacaggaagugcaucauccaugaucaauggcguuguaaaacuuuuaaccaaaccaugggauguagucccuaugguaacacaaauggcaaugacagacacaaccccauucggucaacaaagaguauucaaggaaaaaguggacacgagaacgccccgaaguaugccuggaacccggaggguaauggagaucacagccgaauggcucuggagaacauuaggaaggaauaagaaaccaagauuauguacaagagaagaauuuaccaagaaaguacgaacaaaugcugcaaugggggcuguuuucacugaagaaaaucaaugggacucugcaaaagcagccguagaggacgaagauuuuuggaaacugguagauagagaaagggaguugcauaaguuagguaaguguggaaguuguguuuauaauaugaugggaaaacgagaaaagaaauugggcgaguucggcaaagcuaagggcaguagagccauuugguauauguggcuuggggcaagguauuuagaauuugaggcccugggauuuuugaacgaagaucauugguucucucgagaaaauucauacucuggcguagagggagagggauuacacaaacuaggauacauuuugcgugacauuuccaaaauuccugguggugcaauguaugcagacgauacugcaggaugggauaccagaaucacggaagaugauuugcauaacgaggagaaaauaacccaacaaauggaucccgaacaccgacagcuggccaaugcuauauucaaguuaacauaucaaaacaaggucguaaaaguccaacgaccaaccccuacugguaccguaauggacauaauaucacgaaaggaucagcgcggaaguggacaaguagguaccuauggacuaaauacuuucacaaacauggaagcacaacugauaagacagauggaaggagaggguguacugaguaaagcugaucuggaaaacccccaucugccggagaagaaaauuacgcaauggcucgaaacuaaagguguugaacggcuuaaacgaauggcgauauccggagacgauuguguuguaaagcccauagaugaccgauucgcaaaugcucuauuagcacuaaacgacaugggcaagguaaggaaggauauuccccaguggcagccuucgaaaggauggcacgacuggcaacaaguaccauucuguagucaccauuuucaugaacucaucaugaaagacgguagaaaguuagucguuccgugccggccgcaagacgagcuuaucgggagagcgcgaauaucgcagggugcaggcuggaguuugcgagagacagcgugucuagggaaagcauaugcucaaauguggucacuaauguacuuccacagacgagaucuaagacuggcaucgaaugcaauaugcucggcuguacccgugcauuggguaccaaccucacguacgacauggucaauacacgcacaucaucaauggaugacuacagaagauauguuaacuguauggaaccgcguauggauugaagauaauccauggauggaagacaagaccccagucacaacuugggagaaugucccguaucucgguaagagagaagaucaaugguguggaagucucaucggacuaaccucacgugcgacuugggcucaaaauauaccaacugcaauacaacaaguacguucauuaauagguaaugaagaauuuuuagacuacaugccgucgaugaaacgguuuagaaaagaagaagaaagugagggagcaaucugguaa

SEQ ID NO: 23056 - RNA, 9873 nt, Artificial Sequence
  derived and/or modified CDS sequence (opt6) from DENV-3__GU131850__SS-prME
acgucacuauguuuggucaugauacuaccugcagcuuuggcauuucaucugacgucccgcgacggugaaccgagaaugauaguugggaaaaaugaaagagguaaaucccuauuauuuaaaaccgcuucuggaauuaauauguguacucuaauagcuauggaucuaggagaaaugugugacgacaccgucacauauaaauguccccacauuaccgaagucgaaccagaagacauagacuguugguguaaccucacaucaacguggguaacuuacggaacaugcaaccaagcuggagaaagacgcagggauaaacgaucaguagcauuagcgccacacguaggcauggggcuagacacgagaacgcaaaccuggaugucagcugagggagccuggcgacaagucgagaaaguagaaacaugggccuugcgucacccuggcuuuacaauccuugccuuauucuuggcacauuauauugggacaucucucacacagaaagucgugaucuucauccuuuugaugcuagugacaccgucaaugacaaugcgauguguggguguugguaauagggauuuuguagaaggcuuaucuggugcaaccuggguagacgucguauuggaacauggagguuguguaacaacaauggccaaaaauaaacccacccuagauauagaauuacagaaaacugaggcaacccaacuagccaccuuaagaaaacuuuguauagaaggaaaaaucaccaauaucacaacagauucccguuguccaacccaaggagaagcugucuuaccggaggaacaagaccagaauuacguauguaaacauacauauguagacagaggguggggaaauggcuguggccuauuuggcaaaggcucgcuaguaaccugcgcgaaauuccaaugcuuagaaccaauagaaggcaaagucguacaauaugaaaaucuaaaauauacuguaauuauaaccguacauacaggggaucaacaccaagucggaaaugaaacccagggaguaacggccgaaauaacaccacaagcaucaacuaccgaagcaauauuaccggaauauggaacccugggucucgaauguagccccaggacagggcuugauuuuaaugagaugauacuuuuaacaaugaaaaacaaagcguggauggugcaccgacaaugguuuuucgaucucccuuuacccuggaccuccggggcaacgacggaaacaccaacuuggaaccguaaagaacuguuagucaccuucaaaaacgcgcacgcuaagaaacaggaaguuguagugcuuggaagccaggaaggugcaaugcacacugcacugacuggcgccacagaaauacagaauaguggaggcacaagcaucuucgcuggucaccuaaaaugucgauuaaaaauggauaaauuggaacucaagggaaugucuuaugccaugugcaccaauacauuuguuuugaagaaagaggucagugagacacaacaugguacaauccuaauaaagguggaauauagaggagaagacgcuccuuguaaaauacccuuuucaaccgaggauggacaaggaaaggcucacaauggacgauugauaacugcgaaucccguuguuauaaagaaagaagaaccugugaauauugaagcagaaccaccguuuggagagucaaacauugugauaggaauuggugauaaugcauuaaaaauaaauugguauaagaaagguucuagcauaggaaagauguuugaagcaacagccaggggcgcucgccgaauggcgauuuuaggagacacagcuugggacuuuggcucuguugguggaguauuaaacagccuaggaaaaauggugcaccaaauauucgguucugcuuauacugcucuauuuuccggaguaaguugggucaugaaaaucggaauaggaauacuacugacauggauaggauuaaauagcaaaaauacaaguaugucuuucucguguaucgcaauaggaauaauuacuuuguaucuaggggcgguagugcaggccgauauaggaugcgucauaaacuggaagggaaaggaauuaaaauguggcucaggcaucuuuguaacaaaugaaguccauacuuggacggaacaauauaaauuccaagcugauuccccuaaacggcuagcaacagccauagcaggagccugggagaaugguguauguggaaucagaucgacaacccggauggaaaaccuucuguggaaacaaauagcgaaugagcucaacuauaucuuaugggaaaauaacauuaaauuaaccgucguuguuggggauauuauaggaguucuugaacagggaaaaagaacauugacuccucaaccuauggagcuaaaauauucauggaaaaccuggggcaaagccaaaauuguaaccgccgaaacacaaaacucaucauuuauuauagauggaccuaauacucccgaaugcccgucagcgagcagagcauggaaugucugggagguagaggauuacgguuuuggugucuuuacaacgaauauauggcuaaaauuacgagaaguuuacacccaacuuugugaccaccgcuuaaugagcgcagccguuaaagacgaacgagcaguacacgcagacaugggauauuggauagaaagucagaaaaacgguagcuggaaacuugaaaaagcgucucuuaucgagguuaaaacguguacauggccaaaaucacauacgcucuggaguaauggaguccuggagucugauaugauuauccccaaaucucucgcagguccaauaucccaacauaaucauaggcccggcuaucauacacaaacagcugguccguggcaccuaggcaaacuagaacuagauuucaacuacugcgaaggcaccacaguaguaauaacugaaaauuguggaacucgagguccgucccugcgaacaacgaccguauccggaaaauuaauacaugaauggugcugccguucaugcaccuugccucccuuacgguauaugggugaagauggaugcugguaugguauggaaauuaggccgauaagugaaaaggaggaaaacauggucaaaagccugguuuccgccggcucaggaaaaguugacaacuucacaaugggaguguuaugccuagcaauacuuuucgaggaaguuaugcgaggaaaauuugguaagaaacauaugauugcagggguauuuuucaccuucguucucuuacuaucuggacaaauaaccuggcgagauaugacucacacacuuauaaugauagguaguaacgccucagauagaauggggaugggaguuacguaucuagcgcuaauagcaaccuucaagauacaaccauucuuagcauugggauucuuuuugagaaagcuaacgagcagggaaaaccuuuuguuaggcguagguuuagcaauggcaacuaccuuacaacuaccugaagauauagagcaaauggcuaacggaauagcauuaggguuaauggcccuaaaacuaaucacacaauuugaaacauaucaguuauggaccgcgcucaucucuuuaacguguucaaauacuauguuuacuuuaacugucgcauggcggacagcuacccugauacuagcagggguaagccuacuaccugucugucaauccuccuccaugcgaaaaacugacugguuaccuauggcaguagcagcuaugggcgugcccccucugccauuauucaucuucucacuuaaagauaccuuaaaaagacgaucguggccucucaaugaaggagucauggcaguaggauuaguguccauacuugcgucgucacuauuaagaaacgauguacccauggcgggaccauuaguugcagggggauuguuaaucgcguguuacguaauaaccggcaccagugcagauuugacaguagaaaaagcagcugauauaacuugggaagaagaagccgaacagacuggaguaagucauaaccuaaugauaacuguagaugaugauggaaccaugagaauaaaggacgacgaaacggaaaauauacugacgguauuauugaaaacugcccuuuuaauagucucaggcguguuuccuuacucuauaccagcaaccuuacuuguuuggcacaccuggcaaaaacaaacacaaagaucgggugugcuaugggacguaccauccccuccagaaacacaaaaagcugaauuagaagaaggcguguaucgaauuaaacaacaagguauauucgggaaaacucaaguuggagucgggguccagaaggagggagucuuucauacaauguggcauguaacacgaggugcuguuuuaacauauaacggcaaacggcuagaaccgaacugggcuucaguuaagaaagaucugauaucguauggagguggcuggcgauugagcgcucaguggcaaaagggagaggagguacaagucauugccguagagccugggaaaaauccgaagaauuuucaaacuaugccugguacuuuccaaacaacaacaggggaaaucggugcuaucgcgcuagauuuuaagccugguacauccggaucgcccauaauuaaucgggaagggaaaguagucggacucuauggaaauggagucguuacaaagaauggagguuacguaucagguauugcgcaaaccaaugcggagccugauggcccaacacccgaacuagaagaggaaauguucaagaaacgcaacuuaacuauuauggaucuucauccaggaagcggcaaaacaaggaaauaccuccccgccauaauucgcgaagccauaaaaagacgacuucgaacccuuauuuuggcucccacuagaguuguggccgcugaaauggaagaagccuugaaggggcuacccauuagauaccaaacuacagcaaccaaaagugaacauacaggcagggaaauuguggauuuaaugugucaugcaacuuucacuaugagguuacuaagcccuguacgaguacccaauuacaacuuaauaaucauggaugaggcacacuuuacugacccagcuagcaucgcagcuagaggauauauuucuacacgaguugguaugggugaagcagcugccaucuucaugacggcaacaccucccgguaccgcagaugcuuucccccaauccaaugcaccaauucaagaugaggaaagagauauacccgaacggucguggaacaguggaaaugaguggauaacggauuucgucggaaaaacggugugguucgucccaaguauaaaagcuggaaacgacaucgcaaacugucuaaggaaaaaugguaagaaaguuauucaacuaucccggaaaaccuuugacaccgaguaucagaagacgaaauuaaaugauugggauuuuguuguaaccacagauauuucagaaaugggagcaaauuuuaaagcggauagaguaaucgauccaaggaggugcuuaaaaccaguaauccuaacagacggcccagaacgcguuauccuagcaggaccuaugccagugacugcugcaucagcagcgcagcgacgcggaagggucgguagaaauccccaaaaagaaaacgaucaauauauuuucacuggccagccuuugaauaacgaugaagaucaugcccauuggacggaagccaaaauguuacucgauaauauaaacacacccgaagguauuaucccugccuuauucgaaccggaacgagagaaauccgccgcaaucgauggagaguacagacucaaaggggagucuagaaaaaccuuuguggaacuaaugcgucgcggugaucuaccgguauggcucgcacauaaagucgcaucagaggguaucaaauauacagaucgaaaaugguguuucgauggacaaaggaauaaucagaucuuagaagaaaacauggaugucgaaauuuggaccaaggaaggggagaagaagaaacuaagaccaagaugguuagacgccagaacuuauucggacccacuagcacuaaaagaguucaaagauuuugcagcaggaaggaaaaguaucgcacucgaucuaguaaccgagauugggagaguuccaucgcauuuagcacaucgaacacgaaacgcacucgacaauuugguuaugcuucacacgucggaacauggagggagagcuuauagacacgcuguagaagaacuaccugaaacaauggaaacuuuguuauugcuuggacucaugauacuauugaccggaggggcuauguuauuuuugauaagcggaaaggggaucggaaagacgucaauaggacuuaucuguguaauagcuucauccgggaugcucuggauggccgaaauaccacuacaauggauagcgagugcuauaguccuagaauuuuucaugaugguacuucuaauaccugagccagagaaacaaagaacuccacaagacaaccaguuggcuuacguaguaauaggcauauuaacuuuggccgcuauaaucgcugcaaacgagaugggacuacuugaaaccacaaaaagagauuuaggaauguccaaagagccaggaguugucagcccaaacuccuacuuagaugucgaucuucauccagccucagccuggacccuuuacgccguagcuaccaccgugauaaccccuauguuaagacacaccauagaaaauaguacagcuaaugugucucuugcagccauagcaaaucaagccguaguucuaaugggauuagauaaaggguggccaauuaguaaaauggaucuuggugucccucuccuugcucucggcuguuacucccaagugaauccauuaacacuuaccgcagcgguuuuauugcuaauaacacacuaugcaauuauuggccccggacuacaagcaaaagcaacgagggaagcacagaaaagaacagccgccgguauaaugaaaaauccaacaguagauggcauuaugacaauagaccucgauccagucaucuaugacagcaaauucgagaagcaauuaggccagguaauguuacucguauuaugugccguucaacugcuacuaaugcgaacguccugggcccucugugaagcguugacccuugcuacaggaccaaucacuacauuaugggaaggaagucccgggaaauuuuggaauacaacaauagccgugaguauggcaaacaucuuccguggaucauaccuggcaggggcaggucuagcguuuucaaucaugaaguccguuggaacuggaaaaagagguacuggcucccaaggggagacauuaggggaaaaguggaagaagaaacuaaaccaacucaguaggaaagaguucgacuuauacaagaagaguggaauaacagaaguagauaggacagaagcgaaagaaggacugaagaaaggugaaauuacacaucacgcaguuucacgaggaucagcaaaacuccaaugguuuguagaacgaaacaugguuauaccugaaggaagggucaucgaucucggauguggaagaggaggauggaguuauuauugugcaggucucaagaaggugacagaagugaggggauauacuaaaggagggccuggucacgaggagccaguaccgaugagcacguauggguggaauauagugaaacuuaugucugguaaagacguauuuuaccuaccgccagaaaaaugcgauacccuucugugugacauaggugaaagcaguccuuccccaacaguagaagagucgcguacaauaaggguccuaaaaaugguugaaccuuggcuaaagaauaaccaauuuuguaucaaaguauuaaauccguauaugccuacggucauagaacaucuggaaaggcuacagcguaaacacggcggaaugcucguaagaaacccacucucaagaaauucaacacaugaaauguauuggauaagcaauggaacaggcaauauuguagcuucugugaacaugguaagucggcuucugcuaaacagauucacuaugacucauagacgaccgacaauugaaaaagauguggaucugggugcgggcacuagacacgugaaugcagagccugaaacgccgaacauggacguuauaggggaaagaaucaaaaggauaaaagaggaacauaacucaacuuggcauuacgaugaugagaacccuuauaagaccugggcauaccauggcucuuacgaagucaaagcgacuggaucagcauccucgaugauaaauggcgugguaaaauuacuuaccaaaccuugggaugugguacccauggucacacagauggccaugacggacacaacaccauucggccaacagagggucuucaaagagaagguagacacccggacaccucgaaguaugcccggaacacguagaguaauggguaucacggcagaauggcuauggcggacacucgggcguaacaagaaaccaagacucuguacaagggaagaguuuacgaaaaagguccguacaaaugccgccaugggggcaguuuucacugaagaaaaccaaugggacucugcuaaagcugccguagaggaugaagauuuuuggaaauuaguugaucgagaaagagaacuccauaaguugggcaaaugcgguaguugcguauauaacaugaugggcaaacgcgagaagaaauuaggagaauuugguaaagccaaagggucucgagcuauaugguacaugugguuaggcgcucguuaucuugaguuugaagccuuaggguuucucaaugaggaccacugguuuucaagggaaaacuccuacagcggagucgaaggagagggccuacacaaauuaggauacaucuuacgugacaucaguaaaauaccaggcggggcaauguaugcggaugauacagcgggaugggacacgagaauaacagaagacgacuuacauaaugaagagaaaauaacgcaacagauggauccugaacaccgccaacuagcaaaugcaauuuuuaaauuaacauaccagaauaaaguagugaaaguacaacgaccaaccccaacugggaccgucauggacauuauaaguaggaaagaccaaagagguaguggacaaguaggaacguauggacuuaacacauuuacgaauauggaggcucaauuaauaagacagauggaaggagagggaguacuaucaaaagcagaucuagaaaauccacaucuuccggagaagaaaauaacacaaugguuagagacaaaaggaguagaacgucuaaagcgaauggcgauuaguggagaugacuguguaguuaaaccuauugacgacagauuugcuaacgcauuacuggcucuaaaugauauggguaaaguuagaaaagauaucccacaauggcagccgagcaaaggguggcaugauuggcaacaagugcccuucuguucacaucacuuucacgaacuaaucaugaaggacgguaggaagcucguaguaccaugcagaccucaagacgaguugauaggucgagcacggaucagucagggggcuggguggaguuuaagagaaacugcgugucuagguaaagcauacgcucaaauguggucccucauguauuuucauagacgggaucuaagacuagcgucuaacgcgaucugcagcgcaguaccuguacauugggugccaaccucucguaccacauggucaauucaugcucaccaucaguggaugacaacggaagauauguuaacuguauggaaccgaguauggauagaagauaacccauggauggaagacaaaacaccggugaccacuugggaaaacguacccuaucuaggaaaaagagaagaucaauggugcggaucccuaauaggacuaacaagucgugcaaccugggcccagaauauaccaacggcgauacaacaaguaagaucgcucaucggcaaugaggaauuucuggauuauaugccaaguaugaaacgauuucgcaaagaagaggaaucugagggagcaauaugguaa

SEQ ID NO: 23057 - RNA, 9873 nt, Artificial Sequence
  derived and/or modified CDS sequence (opt6) from DENV-3__GU131851__SS-prME
acuucuuuaugcuuaguuaugauauuaccugcagcuuuggcguuccaucugacgaguagagacggggaaccucauaugauaguugguaaaaacgaacggggaaaaagccuauuauucaaaacugccucagguauaaauauguguacucuuauugcgauggauuuaggugaaaugugcgaugauacuguaacuuauaaauguccucacauaacugaaguugaaccagaagacauagauuguuggugcaacuuaacgucuacgugggugaccuaugguacuugcaaucaagcgggcgaaagacgucgagauaaacgcaguguggcuuuagcuccacacguagggaugggacuagacacccguacucaaacuuggaugagugcggaaggggcauggcgacaaguagaaaaaguugaaacgugggcacuacgucauccuggguucaccauuuuggcucuauuccuugcucauuacaucgguaccagucuaacacaaaaaguaguaauauuuauacuucuaaugcuuguaaccccaaguaugacuaugagguguguaggcgucggaaacagagacuucguggaaggauuaucgggagccaccuggguagacguugucuuagaacacggugguuguguuacaacaauggcuaaaaauaaaccgacacuugacauugaacuucagaaaacugaagccacacaacuagcaaccuuacgaaaacugugcaucgagggaaaaauaacgaauaucacgacagauagucgcugccccacacaaggggaagcggucuugccugaagaacaagaccaaaacuauguuugcaaacauacguacguugauagaggcuggggaaacggguguggguuguuugggaaaggcucauuagugacgugugcaaaauuucagugccuugaaccuauugaagguaaagucguucaauacgagaauuuaaaauauacaguaauaauaacagugcauacgggggaccagcaucaaguagggaacgagacccaggguguaacugcugaaauaacaccacaggcuucaacgacagaagcaauauugccagaauauggaacucuuggauuagaguguucuccaagaacgggacuugacuuuaacgaaaugauauuauugacgaugaaaaacaaagcauggauggugcaccggcaaugguuauucgacuuaccucucccuuggacaaguggagccacgacagagacaccuacguggaauaggaaagaacuccuaguuacuuuuaaaaacgcccaugcuaagaaacaagaaguaguaguucuggguagccaggaaggagcgaugcacacagccuuaacgggggccacagaaauacaaaacagugguggaacaaguauuuuugcaggacaccuaaaauguagacugaaaauggacaaacucgaguuaaaaggcaugucauaugcgauguguacaaauacauucguacuaaagaaagaaguuagugaaacacagcacggcacaaucuuaauuaaaguugaauacagaggggaagacgcuccuuguaaaauuccguuuaguacagaggauggucaagggaaagcccauaacgggagauuaauuacagcuaauccaguagucacgaaaaaggaagaacccguuaacauugaagcugagccgccauuuggcgaaucaaauauaguaauuggaaucggugacaacgcauuaaaaaucaacugguauaagaaaggaucaucaauaggaaaaauguucgaagcaaccgccaggggagcaagaaggauggcgauacuaggagauacagccugggauuuuggaagugugggaggcguacuaaauucauuagggaaaaugguacaccaaauauuuggaagugcuuauacagcauuguuuucaggcguaucauggguaaugaaaauaggaauaggaauauuauugacauggaucggacuaaauuccaaaaacacgaguaugucauuuagcuguauugcgaucggaaucauuacguuauaucuaggagcaguaguacaagcagacaugggaugcgugauaaacuggaaagguaaagaauuaaaauguggaaguggcaucuuuguaaccaaugaaguucacacguggacggaacaauauaaauuccaagcagauagcccgaagcgauuagcaacugcgaucgcgggugcuugggaaaauggaguaugugggauucgaagcaccaccagaauggaaaaucugcucuggaagcaaauugcgaaugaacuuaacuacauacuaugggaaaacaauauaaaacuaacaguaguaguaggagauauaauagguguucuugaacaaggaaagcgcacauuaacuccccaaccaauggaguuaaaauacaguuggaagacauggggcaaagcuaaaauuguaacagcggagacucaaaacucuagcuuuauaaucgauggaccaaacacaccugagugucccucagcuucccgagccuggaauguuugggaaguagaagacuacggauucggggucuuuacaacuaauauuugguuaaaauuaagggagguauauacucaauuaugugaucacagauuaauguccgcggcgguaaaagaugaaagggcaguucaugccgauaugggauacuggauagagagccaaaagaacggaucuuggaaacuagaaaaggcaucucuaauagaaguuaaaacgugcacuuggccaaaaagucauaccuuauggagcaauggggugcucgaaagcgauaugauaauucccaaaucauuagcgggaccaauaucgcaacauaaucaccgcccagguuaccauacacaaacugccggaccuuggcacuugggaaaacuugaacuagacuucaauuacugugaggguacuacaguuguaaucacggaaaauugugguacgagagggccgucgcuacgaacaacgacaguaucggggaaacuuauacacgaaugguguuguaggaguuguaccuugccaccacugcgauauaugggugaagaugguuguugguacggcauggaaauacgaccuaucagugaaaaagaagaaaacaugguuaaaaguuuaguuagugcuggcucugguaaaguugauaacuuuacuauggggguucuaugucuagcgauuuuguuugaagaaguaaugaggggaaaguuugggaagaaacacaugaucgcaggcgucuuuuucaccuucguucucuugcugucaggccagauuacuuggagggauaugacacauacauuaauaaugauugggaguaaugcaagugaccguauggggaugggaguuacauacuuagccuuaauagcgacguucaaaauacagccauucuuggcuuuaggguucuuucuuagaaaauuaaccucgagagaaaacuuacucuuagguguggggcuugcaauggcaacaacgcuucaauugccagaagacauugaacaaauggccaaugguauugcucuugggcuaauggcauuaaagcuaauuacacaauucgaaacauaccaacuauggacagccuuaauaaguuuaacaugcagcaauaccauguucacauugaccgucgcguggagaacggcuacauuaauuuuagcaggaguaucccuauuaccgguaugucaaaguagcucaaugcgaaaaacagauuggcucccaauggccgucgcugcuaugggaguuccaccguugccauuguuuauuuuuagcuuaaaagacacucucaagagaagaaguuggccguuaaaugagggugugauggcaguaggccuagucucgauacuggcgagcagcuuauuaagaaaugauguuccaauggcgggaccacugguagcugguggacugcuaauagcauguuauguuaucacaggaacaucugcagacuuaacuguugaaaaagccgcagauauuacaugggaagaagaagcagaacaaacgggaguaucccauaaucucaugauaacagucgaugaugauggaacuaugagaaucaaagaugacgaaacggaaaauauccuuacaguacuauuaaaaacagcauuacucauuguaucaggaguauucccauacuccauuccagcaacacuauugguauggcauacuuggcaaaaacaaacccaaagauccgguguguugugggaugucccaaguccacccgaaacucaaaaagcagaauuagaagaggggguguauaggauaaaacaacaagggauuuuuggaaaaacucagguuggugucggaguacaaaaggaaggugucuuucauaccauguggcacgugaccagaggcgcuguguuaacauauaaugggaaacgucuagagccgaauugggcaucugucaagaaagaucuaaucucauacggaggaggauggaggcuaagugcgcaauggcagaagggugaggaaguacaaguuauagcgguagaaccagguaagaaucccaaaaauuuccaaacuacccccggaacuuuucagacaacaacgggcgaaaucggagcgaucgcauuggacuuuaaaccagguacgagcggaagcccaauaauuaacagagaagguaaaguaguaggauuauauggcaauggcgugguaacuaagaaugguggauaugugagcggaauagcccagacuaaugcggaaccagacggcccuacaccagagcuagaagaagagauguuuaagaaacgaaaucuaacaauuauggauuugcaccccggaucgggaaaaacaaggaaguaucuuccagcuauuauucgcgaagcgauaaaacgaagauuaaggacccuaauacucgcucccacuagagugguugccgccgaaauggaagaggcgcugaaaggacuccccauuagauaccaaacgacagcaaccaagucggaacauaccggcagagaaauaguagaccugaugugucacgcaacauucacuaugaggcuucuauccccaguccgaguuccaaauuacaaucuuaucaucauggaugaggcacacuucacugauccggcuuccauagcugcuagaggauauaucagcacacguguaggaaugggagaagcagccgccauuuuuaugacagcuacaccaccggggaccgcugaugcauucccgcaaucaaaugcgccgauccaagacgaggaacgggauauuccugaacgaucauggaacucugggaaugaguggauuacggauuuugccggaaaaaccguaugguuugugccaucgauaaaagcaggaaacgauauagcuaauugccuuaggaagaaugggaagaaaguuauucaacucaguagaaaaaccuuugacacugaauaucagaaaaccaaacuaaacgauugggacuucguuguaacaaccgauauuucagaaaugggagccaacuucaaggcagaccgcguaauagacccaagaaggugucugaagccgguaaucuugacugacggaccggaacgaguaauccucgcgggcccuaugccaguaacugcggcaucagcugcacaaaggagagguaggguaggaaggaauccacaaaaagagaaugaccaauauauauucacaggccaaccacuuaauaacgaugaggaucacgcccacuggacggaggcgaaaauguuauuagauaacauaaauacuccagaaggaauaauaccagcauuguuugaaccagaaagggaaaaaucagcagcaauagacggggaauauagacucaaaggagaaucaagaaagacauuuguagaauuaaugcgucgcggugaucuccccgucuggcuagcgcauaagguggcaucugaggguaucaaauacacagauagaaaaugguguuucgacggucaacgcaacaaucaaauauuagaggaaaacauggacguugaaauauggacuaaggaaggugagaagaagaaacuucgaccuagguggcuugaugcuaggacauacagcgauccccuugcauugaaagaauuuaaagauuucgcagcugggagaaaaucaauagcucucgaccuuguaacggaaauaggucgugugccaagccaccuagcccauagaacacgaaacgcguuagacaacuuagucauguuacacacaucagaacacggaggacgagcauaccgacaugcaguagaggaacuuccugaaacuauggaaacuuuauuauuacuaggccuaaugauuuugcuaacugggggagcaaugcucuuucuaauuucagguaaaggaauagguaagacaaguauuggacucauauguguaaucgcaaguagcggaauguuguggauggcagagaucccccuacaauggauagcauccgcaaucguauuggaguucuuuaugaugguccuauugauuccggaaccagaaaaacaacguacaccgcaagauaaucagcuagccuacgucgucauaggcauccucacacuugcggcaauaauagcagcaaacgaaaugggccuucuggaaacaaccaagagggauuuaggcaugucaaaagaaccagguguaguaaguccuacaaguuacuuagauguagaucuacacccugcuucugcguggacacuauaugcugucgcgacaaccguaauuaccccaaugcuuaggcacacgauugaaaauucaacagcaaacguuagcuuagccgcgauugccaaucaagcuguuguauuaauggggcuugauaaaggcuggcccauaucgaagauggaucuagguguuccuuuacuagcauuaggauguuacagccaaguuaacccauuaacauuaaccgccgccguauuacuacugauaacacauuaugccaucauuggcccagguuugcaggcaaaggcaacacgcgaggcucagaaaaggaccgcagcugggauaaugaaaaauccuacaguggaugguauuaugacaauugacuuagacccaguuauuuaugacuccaaauuugaaaaacaacucggacagguaaugcuccuaguauuaugugcagugcaauugcuacuuaugcguacuucaugggcuuuaugugaggcuuuaacauuggcgacugggccgaucacaaccuuaugggaaggaucaccagguaaauuuuggaauacuacuauugcaguaucuauggcuaacaucuuucgagggucguauuuggcaggagccggcuuagcguucucaauaaugaaaucaguagggaccggaaaacgaggcacgggaucacaaggugaaacauuaggagaaaaauggaagaagaaacugaaucagcuaaguagaaaagaauuugacuuguacaaaaagucaggaauaacagagguugacagaacagaggcaaaagaaggucugaaaagaggcgaaaucacacaucaugcaguaucacguggaagcgcaaaacuacaaugguuuguagagcgaaauaugguaauaccugaggguagaguuauugaucuagguugcgggagagggggaugguccuauuauugugcaggucuaaagaaaguaacagaaguacguggauacacuaaaggagggccaggccaugaagaaccgguacccaugagcacuuauggauggaacauugugaaacucaugagugggaaagacgucuucuacuuaccuccggagaagugcgauaccuuacuuugugacauaggugaaucaucaccaaguccuacaguagaggaaaguagaaccauccgaguccuaaaaaugguugagccauggcucaaaaauaaccaguuuuguauuaaaguguuaaacccauacaugccaacaguuauagagcaucuugaacgauuacagcgaaagcacggaggaauguuaguaagaaauccauuaucucggaacucaacccaugagauguacuggauuagcaacggaacaggaaauauugucgcgucaguaaauaugguuuccaggcuucuguuaaaucgguuuaccaugacucauagaagaccaacuauagaaaaagauguagacuugggugcuggcacaagacauguuaaugcggaaccagaaacaccaaacauggaugucauaggagaaaggauuaaacgaauaaaagaagaacacaacaguacuuggcacuacgaugaugagaauccauauaagacuugggccuaccacgggucauaugaaguaaaagcgaccgggagcgcuuccaguaugaucaacggcguuguaaaacuacuaacaaaaccaugggacguuguccccaugguaacucaaauggcuaugacagauacaacgccauuuggccagcaacguguauuuaaagagaaagucgacacuagaacaccacgaucaaugccagguacacgaagaguuauggagauaacggcggaauggcuuuggcggaccuugggaagaaauaaaaagccaagacuauguaccagagaggaguuuacuaagaaaguacggaccaacgcugccaugggugcaguauuuacugaagaaaaucagugggacagcgcaaaagcugcgguugaagacgaggauuuuuggaaguuagucgauagagaacgggaauuacauaaacuuggaaaaugcgguucauguguauacaacaugauggguaaacgugagaagaaauuaggugaauuugggaaggccaaagggagucgagcgauuugguauaugugguugggagcuagauauuuagaguucgaggcacuaggguuucugaaugaggaccacugguucagccgggaaaauagcuacagugguguggaaggugagggacugcacaaauuaggauauaucuuacgcgacauauccaagauccccggcggugccauguacgccgacgacaccgcagguugggauacgcgcauaaccgaagacgaccuacacaacgaagagaaaauaacccaacagauggaucccgaacaucgacaacuagcaaacgcaauauucaaauuaacguaucaaaacaagguagucaaaguucaaaggccgaccccuaccggaacgguuauggauauuauuucucgaaaagaccaaagagggaguggacaagucgguacauacggacuaaauacuuuuacuaauauggaggcgcaacuaaucaggcaaauggaaggggagggaguccucucaaaagcggaucuagaaaauccacaucugcccgagaagaaaauaacgcaauggcuugaaacgaaggguguggaacgauugaaaagaauggcaaucucaggggacgauuguguggucaaaccaauagacgauagauucgccaacgcacugcuagcacuuaacgauaugggaaaagugaggaaggauauuccgcaauggcaaccaaguaaaggcuggcacgauuggcagcaaguaccauuuuguagucaccacuuccaugaguuaauuaugaaagacgggcgaaagcuaguaguaccaugcagaccucaagacgagcuuaucgggagagcaagaauaucacagggagcugguuggucccucagggaaacugcuugucuagggaaagcauacgcgcaaauguggagucuaauguauuuccauagaagagaucugcguuuagccucuaacgcaauuuguucugcugugccuguccacuggguuccaacgagucgaaccaccuggagcauacacgcacaucaucaguggaugacgacagaagacaugcuaacaguauggaacaggguguggauagaggacaauccguggauggaggauaaaacaccgguaaccaccugggagaauguuccguauuugggcaaacgagaggaucaauggugcggaucauugaucggccugacuucaagagcuacaugggcacaaaauauacccaccgcuauucaacagguuagaaguuuaauaggcaaugaagaauuuuuggauuauaugccuucgaugaaaagauucagaaaagaagaagaaucagaaggagccauaugguaa

SEQ ID NO: 23058 - RNA, 9873 nt, Artificial Sequence
  derived and/or modified CDS sequence (opt6) from DENV-3__GQ868547__SS-prME
acgaguuugugcuuggucaugauauugccugcggcccuggcauuccacuugaccucuagagauggggaaccuaggaugauugucggcaaaaaugaacgagguaaaucacuacuguuuaaaacagcaagugggaucaacauguguacauuaaucgcaauggaccugggagaaaugugcgaugacacaguaacauauaaauguccacauauaacagaaguugaaccagaagacauugacugcugguguaaucuaacaucaacuuggguaacauacggaacauguaaccaagcuggagaacggagaagggacaaaaggucuguagcuuuagcgccacauguagggaugggacuagacacaaggacacaaacauggaugagcgcggaaggagcguggaggcaaguagaaaaaguagaaacaugggcucuaaggcauccagguuucacgauacuugcauuguuucuggcgcacuacauaggaacaagccuaacucaaaaaguuguaaucuucauacuauuaaugcuagugacuccuaguaugacaaugcggugcguagguguaggaaaucgugauuuugucgaagggcuaagcggagcgacuuggguagauguaguccuugagcaugguggaugcgugacgacaauggcuaaaaacaaaccaacccuagauaucgaauugcagaaaaccgaagcuacgcaacuagccacgcuccgcaaacuuugcauugagggcaaaaucacuaacauuacuaccgacucgcgauguccuacccaaggcgaagccguauuaccggaagaacaagaucaaaacuauguaugcaaacauaccuacguagaucguggcugggguaauggcuguggguuauucgguaaagguagccucguuaccugugcaaaauuucaaugcuuagaaccaaucgaggggaaaguuguucaauaugagaaucuaaaauauacgguuauuaucacagugcacacaggagaucaacaucaaguaggaaaugaaacgcaaggaguuacagcagagauaacuccacaagcgucaacgacagaggccauccuacccgaauauggaacguuaggccuugagugcagcccaagaacagguuuagauuucaaugaaaugauucuauuaacuaugaaaaauaaggcuuggauggugcauaggcaaugguucuuugauuuaccguuaccauggacaucaggagcgacuacugagacuccgacauggaauagaaaagaacuucuaguaacauucaaaaaugcacaugcgaagaaacaagaaguagucgucuuaggaucgcaagagggugcaaugcauacugcuuuaacuggagccacggaaauacaaaauagcggaggcaccucaauauucgccggccaucugaaaugucgacuaaaaauggauaaauuagaguuaaaaggcaugaguuaugcuaugugcacuaauacuuucguccucaagaaagaggugucagaaacgcagcacgguacgauacuaauaaaaguggaauauagaggugaagaugcuccuuguaaaauucccuucucuacagaagauggacaggggaaagcacauaacggcaggcuaauaacagcaaacccaguggugaccaagaaagaagaaccaguuaacauugaagccgaaccaccauuuggagaaagcaacauugucaucgggauaggugauaaugcuuuaaagauuaauugguauaagaaagguuccucuauuggaaaaauguuugaagcgacggcgcgaggagccagacgaauggcgauccuaggagauaccgcuugggauuucggaucaguuggugggguacucaauagcuuagguaaaaugguccaucaaauuuuuggaucagcauacacugccuuguuuucaggugugagcugggucaugaaaaucgggauaggaauacuuuuaacauggauaggucugaacucgaaaaauacauccaugucauuuaguuguauugcuauaggaaucauaacacuauaccugggagccgucguccaagcggauauggguugugugauaaacuggaaaggcaaagaauugaaaugcggguccggaauuuuuguuacaaaugagguacacacuuggacggaacaauacaaauuucaggcagauucuccaaaaagguuggcaacagcuaucgcuggagcuugggagaauggcguaugcgggaucagauccaccacaaggauggaaaaucuccuauggaaacaaauagccaaugaauuaaauuauaucuugugggaaaauaauauaaaauuaacaguaguaguuggcgauauaauuggcguauuagaacaagggaaaagaacacuuacuccccaaccuauggaacugaaguauuccuggaaaacuuggggcaaagcaaaaaugguaacugcagagacacaaaacagcaguuucauuaucgacgggccaaauacgcccgaaugcccaucagcaaguagggccuggaaugucugggaaguagaagauuacggauuugguguguucacaacaaauauaugguugaaacucagagaaguucacacccaauuaugcgaccaucgacuuaugucagcggcuguuaaagaugaacgggccguucaugcggauaugggguauuggauagaaagucagaaaaaugguaguuggaaacuugaaaaagcaagucugaucgaaguaaaaacuuguacauggccaaaaucgcauacucuaugguccaacgguguucuagaaucugacaugauuauaccgaagagucuggcaggacccauaagccaacauaaucaucgaccagguuaucacacacaaacagccggacccuggcaccugggaaaauuagaacuggacuucaauuacugugaaggaaccacagugguaauaacugaaaacugugguacgagaggaccaucucucaggacaacaacggugucagggaaacuuauacaugaaugguguugccgcagcuguaccuuaccucccuugcguuauaugggugaggacggcugcugguacggaauggaaauucguccgauaucagaaaaagaagagaauauggugaaaucucuugugagcgcagguagcgggaaaguagauaacuuuacuauggggguauuaugccuagcaauuuuguucgaagaagugaugcgagguaaauucgguaaaaagcacaugauugccgguguauuuuucacauuuguauuauuacugaguggccagauaacauggagggauaugacacauacacugauaaugaucggaucaaaugcuuccgaucggaugggaaugggaguuacguaucuagcucucaucgcaacauucaaaauucaaccauuuuuggcuuugggauucuuuuuaagaaaguugacuagccgcgaaaauuuacuucugggagucgguuuggccauggcgacaacucuacaauuaccggaggacauagaacaaauggcuaacgggauugcgcuuggacuuauggcucuuaaauuaauaacacaauuugaaaccuaccaauuauggacugcgcugauuucucuuaccugcagcaacacaauguuuacgcucacuguagcauggaggacggcaacauuaauuuuagcuggaguuagcuuauuaccgguaugucaaaguucuucaaugagaaaaacagacugguuaccgauggcagucgcagcuaugggaguaccaccccuaccuuuauuuauauucucauuaaaagauacucuuaagagacggaguuggccuuuaaaugaaggaguaauggcuguggguuuaguaaguauuuuggcgaguagccuucuaagaaacgacgugccaauggcggggccguuaguugcuggaggauuacuuauagcaugcuauguaauuaccgggacaucagcggaccugaccguugaaaaagcagcagacauaacaugggaagaagaagccgagcaaacaggaguaagucacaacuuaaugauaacggucgacgaugauggcacgaugagaauaaaagaugaugagaccgagaacauacuuacaguuuuacuaaagacagcgcugcuaauaguuagcggaguguucccauauaguauaccugcgacauuacugguauggcauacuuggcaaaagcaaacucaaagaaguggaguuuuaugggauguuccaucgccgcccgagacacagaaggcagaguuggaggaagguguuuacagaauaaaacaacaaggaauauucgggaaaacacagguagguguugggguacagaaggaggggguguuucauaccauguggcauguaacucgcggagcuguucuuacauauaacggaaaacgacucgaaccgaacugggcgagcguuaagaaagauuuaauaucauaugguggcggguggagguuaucagcacaauggcaaaagggggaagaaguucaaguuauagcgguagaaccaggcaaaaaccccaaaaacuuccaaaccaccccgggaaccuuucagacuacaacuggagaaauuggugcaauagccuuggacuucaaaccagggacgagcggcagcccuauaauuaauagggaaggaaaagucgugggauuauacgguaauggaguagugacgaagaauggaggauauguaagugggauagcacaaacaaaugcagaaccagauggaccaacuccagaacuagaagaagaaauguuuaagaaaagaaauuuaacuauaauggaccuucacccagggaguggaaaaacacgaaaauauuuaccugcuauaaucagagaagcaaucaagcggaggcugcgcacacugauccucgcgccaacuagagugguagccgcggagauggaagaggcucuaaagggauugccuauaagauaccagacaacugccacuaagucagagcacaccggucgcgaaaucguagaucuuaugugucaugcaacauucaccaugagacuauugagccccguaagagucccgaacuacaaucuaauaauuauggaugaagcacauuuuacggacccagcaagcaucgcagccagaggauauauuaguacuaggguugggaugggagaagcugcugcgauauucaugacggcgacaccacccggcacagcugaugcauucccccagucaaaugcuccaauccaagacgaagaaagggauaucccagaacggagcuggaauaguggaaaugaguggaucacagauuuugcaggaaaaacgguaugguucgucccaucuauuaaagcuggaaacgauauagcaaauugcuuaagaaagaacggcaagaaaguaauccagcuaucgagaaaaacauuugacacagaguaucagaaaacaaaauuaaaugacugggacuucguaguuacuacagauauauccgaaaugggugcaaacuucaaagcggauaggguaauugauccaaggaggugucucaaaccugucaucuugaccgauggccccgaaagaguaaucuuagcaggccccaugccagucacagcugcauccgccgcacaacggagaggaaggguaggaagaaacccccagaaagagaaugaucaauauauauuuacaggucaaccauuaaacaacgacgaggaccacgcccauuggaccgaagcgaagaugcuucuagauaauauaaacaccccagaggguauaauuccugcgcuguuugaaccugaacgagaaaaaucugcagcaauagacggagaauaucgauuaaaaggggaaucaaggaaaacguuuguugaauuaaugaggcgcggggaucucccuguuuggcuagcacacaaaguagcuagcgaagguauaaaauauacagacagaaaaugguguuucgacggucaaagaaauaaucaaauacucgaagaaaauauggacguagagaucuggacuaaggaaggagagaaaaagaaacugaggccaaggugguuagaugcaaggacauacucugacccccuggcucuaaaggaguucaaagauuuugcggccggacgaaaaagcauugcacuggaccucguuacagaaauuggccgcguaccgagucacuuagcacaucgcacuagaaacgcucucgacaaucucguaauguugcacacgucagaacacggagggagggcauaucgccacgcuguagaagaguugccugagaccauggaaacacuacuccuacugggguuaaugauccuauuaaccgguggugccaugcuguuucucauauccggaaaaggaauugggaaaacaucuauaggauugaucugcguaauugcaucaaguggaaugcuguggauggcugaaauuccauuacaauggauugcauccgcgauuguccuagaauuuuucaugauggucuuauuaauaccagaaccugaaaagcaaagaacaccucaggauaaccaauuagcauauguagugauuggaauauuaacccucgcagcaauaaucgcugcgaaugaaaugggcuuacuugaaacuacaaagagagaucucgguaugucaaaggaaccaggagucguaucucccacaucauaucuugauguugaucuacauccugcaucugcauggacucucuaugccguggcuacuaccguaauaaccccgaugcuaagacauacaaucgaaaacucuacagcaaacguaagucucgcggcgauagcaaaucaggcggucguacuaaugggccuagacaaaggcuggccaauuaguaagauggaccuugggguuccauuacucgcuuuagguugcuauagucaaguaaauccguuaacucuaaccgcugccguccucuuguuaauaacucacuacgcgauuauuggcccaggauuacaagcgaaggcuacgagagaagcacagaaaagaaccgcagcugggauuaugaaaaauccaacaguugacggaauuaugacuauugaucuagauccgguaauauaugauucaaaauuugaaaaacaacucggacaagugauguuguuaguuuuaugugcugugcaacuucuauuaaugcgcaccucaugggcccuaugugaagcgcuaacucucgcgacugguccgauaacuacacugugggaagguaguccuggaaaauuuuggaacaccacaauagccguaucaauggccaauauauuccgggggucauaucuagccggugcaggauuagcuuucucgauaaugaaaagcguagguacagggaaacgcgggacgggaucacaaggagagacacuaggcgaaaaguggaagaagaaauugaaucaauuaaguaggaaggaguucgaucuuuacaagaaaagugggauuacggagguagauagaacugaagcaaaagaagggcugaaaagaggggaaaucacucaucacgccguuucaagagggagcgcaaagcuacagugguuugucgaaaggaauaugguaaucccggaaggacguguuauagaucuuggauguggcagagguggaugguccuauuauugugcuggcuugaaaaagguaacagaaguuaggggauacacaaaaggggguccuggucaugaagaaccugucccgauguccacauauggauggaauauuguuaaauuaaugucgggcaaagacguauuuuacuuaccacccgagaaaugugauacucuucucugugacauuggcgagucaagcccuagucccacaguugaggaaucacgaacgauucgaguauuaaaaauggucgaaccauggcugaaaaacaaccaauuuuguauaaaaguccuaaacccuuacaugcccacuguaauugagcaccuagaaagguugcagagaaaacacgguggaaugcuaguaaggaacccucuuucaagaaacucuacgcaugaaauguacuggaucucaaaugguacaggaaacauaguggcgaguguaaacauggugucacgucuguuauugaauagauuuacaaugacccaccguagacccacaauugaaaaagacguggacuuaggagccgguaccaggcauguaaacgccgagccugaaacgccaaauauggacguuauuggcgaaagaaucaaaagaauaaaagaggaacauaauaguaccuggcauuaugaugacgaaaacccauacaagacuugggcauaucacggaagcuaugaaguuaaggccacaggauccgcauccucaaugauaaauggugugguaaaacuacuuacaaagcccugggacguugugccaauggugacucaaauggcuaugaccgacacgacccccuuuggccagcaacgcgucuuuaaagaaaaggucgacacgagaacaccaagaucaaugccaggaacacgacgagugauggaaauaaccgcagaaugguuauggaggacauuggggcgaaauaagaaaccaagacuaugcacaagggaggaguucacaaagaaaguaagaacaaaugcagcuaugggagcgguauuuacagaggaaaaucaaugggacucagcaaaagccgcaguagaagacgaagauuuuuggaaacuuguugaucgagaaagagaacuucauaaacuagggaaaugcggaagcuguguauauaauaugauggguaagcgagaaaagaagcucggcgaauuuggcaaagccaaagggucuagggcaauaugguacaugugguuaggugcaagauauuuggaguucgaagcgcuugguuuucuaaaugaagaucacugguucucaagagaaaauucuuauagcgguguggaaggcgaagggcuucauaaacuugguuacaucuugcgcgauauuucgaaaauccccgggggugcaauguacgcagacgacacggcaggaugggauacaaggauuacugaggaugauuuacauaaugaggagaaaauaacacaacagauggaccccgaacacagacaacuugcaaaugcuauauuuaagcuaacauaccaaaauaagguggucaaaguucaacggcccacaccgacggguacagucauggauauaaucucaaggaaggaccagagaggaucgggccaagucggaaccuauggucucaacacuuucacgaauauggaagcacaauuaauaaggcagauggagggggaggguguucucucaaaagcggauuuagaaaauccccauuuacccgagaagaaaauaacacaauggcuggaaacaaaaggcgucgaacgauuaaagcggauggccauaucaggugacgacugcguuguuaaacccaucgacgauagguuugcaaaugcauuauuagccuuaaaugauauggguaagguacgaaaagacauaccucaguggcaaccaaguaaagguuggcacgauuggcagcaaguaccguuuugcagucaccauuuccaugaauuaauaaugaaagacggaagaaaacuuguugucccaugucguccucaagacgaauuaauuggacgcgcaagaauaagucaaggcgcaggcuggaguuuaagggaaacagcuugccuaggaaaggcguaugcacagauguggagucuaauguauuuucaccgaagagauuuacggcuugcuaguaaugcuauuuguagugccguaccuguacauugggugccaaccagucggaccacauggucaauacacgcucaucaccaauggaugacaacugaagauaugcugacgguuuggaauagaguauggauagaagauaacccguggauggaagacaagacaccuguuaccaccugggagaauguaccauacuuaggaaagcgggaagaccaauggugugggagucucaucgggcuaacuagcagagcaaccugggcacaaaacauaccuaccgcaauucaacaagucagaagccuuaucggaaacgaggaauuuuuagauuauaugccaagcaugaagcgauuuaggaaggaagaagagagcgaaggugcaauaugguga

SEQ ID NO: 23059 - RNA, 9873 nt, Artificial Sequence
  derived and/or modified CDS sequence (opt6) from DENV-3__GU131857__SS-prME
acaucgcuauguuugguaaugauacuacccgcagcuuuagcauuccacuuaacaaguagagauggagaaccacguaugauuguaggcaaaaacgaaagaggaaaauccuuacuuuucaaaacagcaucgggaauaaauaugugcacucuuaucgcgauggaccuuggagagaugugcgaugauacaguuacuuauaaauguccucacauaacagagguugagccggaagacauugauuguuggugcaaccuaacgaguacuuggguaacuuaugggacauguaaucaagcaggggaacgcagacgugauaaacggucgguugcccuagcuccccauguuggaaugggucuugacacuagaacgcagacauggaugucagccgaaggugccuggcggcaaguggaaaaaguagaaacgugggcccuacgucacccaggauuuacaauacuagcucuuuucuuggcucacuacauaggaaccagucuaacacagaaaguuguaauauuuauacuuuugauguuggucacaccgucuaugacgaugagaugcguggggguuggaaauagagauuucguagaaggacuaaguggagcuacguggguagauguuguccuagaacacggcggguguguuacaacaauggccaaaaacaaaccaacgcuugauauagaauuacagaaaacugaagcuacacagcuugccacgcuacguaaacuaugcauagaaggaaaaaucacuaacauaacaacagauagccguugcccuacucaaggagaggccguauuaccugaagaacaagaucaaaacuacguauguaaacauacuuacgucgaucguggcuggggaaauggcugcggacuguuuggcaaaggcagucugguaacaugcgcaaaauuccaaugucuugagcccauagaagggaaagucguucaguaugagaauuuaaaauauacagucauaauuacgguacauacuggagaccagcaucaagugggaaacgaaacgcagggagucacggcagagauuacaccccaagcuaguacuacagaagcaauucuuccagaauacggaacucuaggucuagaauguucaccuagaacgggauuggauuucaacgagaugauauuacuuacaaugaaaaacaaagcauggaugguccaucggcaaugguucuuugaccuaccgcugccguggaccagcggagcaacaacggaaacucccacauggaaccgaaaagagcuauuaguuacuuuuaaaaacgcacaugcgaagaaacaggaaguuguagucuuaggaucacaggagggcgcuaugcauacggcacugacgggcgcaacugagauacaaaauucaggcgggaccucaaucuuugccggacauuuaaaaugccgacuaaaaauggacaaacuagaacuaaaagguaugucguacgcaaugugcaccaacacguuuguauuaaagaaagaggucagcgaaacacaacacggcaccauacuaauaaaaguagaauauagaggagaagaugccccuugcaaaauucccuuuagcaccgaagaugggcaaggaaaagcgcauaacgggagguuaauaacggcuaacccggucguaaccaagaaagaggaaccaguuaacauagaggcagaaccgccauucggagagaguaauauuguuaucggaauaggugauaaugcacucaaaaucaacugguauaagaaagggucgagcaucggaaagauguucgaagcuacagcuagaggagcacgccgaauggcgauacuaggcgacacugcuugggauuucggguccgucggugggguauuaaauucauugggaaaaaugguacaucaaauuuucggaucagcuuauacugccuuauucucgggcguaucaugggugaugaagauagguaucggaauuuuauuaacauggauuggauuaaauucuaaaaacaccucaaugucuuuuagcuguaucgcuaucgguauuaucacuuuguaccuaggugcagucgugcaggcugacaugggguguguaaucaacuggaagggcaaggaauugaaaugugggucagggauauucguuacuaacgaaguccauacuuggacugaacaguauaaguuucaggccgacucaccaaaaagauuagcgacggccaucgcaggcgcaugggagaacggugucuguggaauaagaucuaccacuagaauggaaaauuuguuauggaaacaaauagcuaaugaacuaaauuacauucucugggaaaacaauauaaaauuaacuguuguagugggugacaucauagggguguuggagcaaggaaaaagaacauugacgccucaacccauggaacugaaauauucauggaaaacuugggguaaggcaaagauugugacggcagagacccagaacaguucguuuauuauagaugguccuaauacacccgaaugucccucugcgagucgagcuuggaaugucugggaaguugaagauuaugguuucggagucuuuaccacaaauauuuggcuaaaacuuagagaaguauauacacaacuuugugaucacaggcuuaugagugcagccguuaaagaugaacgagcaguacaugcagacauggguuacuggauagaaagccaaaagaacggaucauggaaguuagaaaaggcuaguuugaucgaaguaaaaacaugcacuuggccaaagagccauacacuguggagcaacgguguauuggaaagcgauaugauuauccccaaaagucuagcagguccaauuagucagcauaaucauaggcccggauaccacacacaaacggcuggcccauggcauuuagggaaacuugaacuagacuuuaacuacugcgaaggaacaacaguugucauaacugaaaacugugguacucgaggucccagcuuacgcacuacaacuguaucgggaaaacuuauacacgaauggugcugucgaucguguacccugccucccuuaagauauaugggugaggauggauguugguauggcauggaaaucagaccuauuucagaaaaagaagaaaauauggucaagucucucguaagcgccgguuccgguaaaguagacaauuucaccaugggaguacuuugucuagcaauauuguuugaggaaguaaugcgcggaaaguuugguaagaaacacaugauagcgggaguauucuuuaccuucgugcuguuacuaucagggcagauaacauggcgcgacaugacgcacacacugauaaugauagggagcaacgcuucagaucgcaugggaauggggguaacguauuuagcuuugauagcaacauucaaaauccagccguuucuagcuuuaggauucuuucuaagaaaguuaacuagcagagagaaucuucugcucggggugggacuggccauggcuacaacuuugcaacugccagaggauaucgaacaaauggccaacggcaucgcauuagggcuaauggcauugaagcugauuacccaauucgaaacguaucaauuauggacagcuuuaauaucacucacguguucaaacacuauguuuacauuaacaguugcguggcggacagcaaccuuaauccuugcaggaguaucgcuacugccaguuugucagucaucaagcaugagaaaaacugacuggcucccaauggcuguugcggcaauggggguuccaccauuaccccuguuuauauuuagucucaaagacaccuugaaaagaagguccuggccauugaaugaaggugucauggcaguuggacucguauccauacuagcauccagucucuuaagaaacgacguaccaauggcggguccauuaguugcugggggucuauuaauugcaugcuauguuaucacaggaacaagugccgacuuaacaguagaaaaagcggcugauauaacgugggaagaagaagccgagcaaacagggguaucucauaauuuaaugauaacagucgacgaugacggaacaaugagaaucaaagacgaugaaacagagaauauacugacuguauuacuaaaaaccgcguuacuaauaguaagugguguuuuucccuauaguauuccggcaacccuucucgucuggcauacauggcagaaacagacucagagaaguggaguguuaugggaugugccuucaccacccgaaacacaaaaagcagaguuggaagaagggguauaucggauuaaacagcaaggaauauuuggaaaaacacagguaggugucggagugcaaaaagaaggaguauuucauacuauguggcacguaacuaggggagccguacuuacauauaaugguaaaagauuagaaccgaacugggcaucagucaagaaagacuuaauaucuuauggggguggauggaggcuuagcgcacaauggcaaaaaggagaagaaguccagguaaucgcaguugaaccaggcaaaaacccgaagaauuuucagacuacaccugggaccuuucagacaacaacuggugaaaucggagcuauugcacuugauuuuaaaccaggaacauccgggagcccaauuauaaaucgugaagguaaaguuguaggcuuguauggcaauggugucguuacuaaaaauggaggauauguaaguggcaucgcacaaacgaaugcggaacccgauggaccaacaccggaacuagaagaagagauguuuaaaaagagaaaccuaacaauaauggauuugcauccaggaagcgguaaaacucgaaaauaucugccggcuauaauacgggaagcaauaaaacggcgauuaaggacuuuaauacuagcuccuacucgugucguagccgcggagauggaagaagcguuaaaaggucuaccaaucagauaccagacuacagcaacaaaguccgagcauacaggacgagagauaguagaccuaaugugucaugcaacuuucacaaugcgccuacugucacccgugaggguacccaauuacaaccugauaaucauggaugaggcucacuuuacagauccagccagcauugcugcacguggguacauaucaacgagagucggaaugggugaggcggcggcaauauuuaugacggcaacaccuccaggaacugcggaugcguuuccucaaucaaacgcaccaauucaagaugaagaacgugauaucccagaaaggucuuggaauaguggaaaugaauggaucacugauuuuguuggaaagacaguaugguucguuccuucaauaaaagccgguaacgacauagcaaauugucucaggaaaaaugggaagaaaguaauucagcuauccagaaaaaccuucgacacugaauaccaaaagacuaaauugaaugauugggacuuuguuguaaccaccgacauuagugaaaugggugccaacuucaaagcagauagaguaauagauccgaggagauguuuaaaaccaguaauacuaacagacggaccggaaagagugauauuggcuggaccuaugcccguaacagcagcaagugcagcucagcguagggguagagugggaaggaauccucaaaaagaaaacgaccaauauauuuuuacaggccaaccuuuaaauaacgacgaggaucaugcccauuggacagaagcaaaaauguuauuagacaauauuaauaccccugaaggcaucauaccugcacucuucgaaccagaaagagagaagagugcagcgauugauggcgaauauagauugaaaggcgagucacgaaaaacauucguugaacuuaugcggcgaggggaucugccaguuuggcuggcucacaaaguagcuagugagggaauaaaguacacggaucgcaaaugguguuucgaugggcaacguaacaaccagauucuagaagaaaauauggacguagaaauauggacaaaagaaggagagaaaaagaaacucagaccgcgguggcuagacgcgcgaaccuacagcgacccucuugcacuaaaagaauuuaaagauuuugcugcaggucgcaagucgauugcucuggaccuuguaacugaaauagguagaguaccuucacaccuugcccacaggaccagaaaugcuuuagacaacuuggugaugcuacacacaagugaacauggcggcagagccuauagacaugcagucgaagaauugccagaaacuauggaaacacuuuuacuucuaggguugaugauauuguuaacugguggagcuauguuauuucucauuucagguaagggaauaggaaaaacaagcauaggccucauaugugucauagcgucaaguggaaugcuauggauggcggaaauuccauuacaguggauagcuagugcaauaguacuugaguucuucaugauggucuuauugauaccagaaccugagaagcaacgaacaccccaagacaaccaacuugcuuauguaguaauuggcauacucacccuggcagccaucauugcggcaaacgaaaugggccucuuagaaacgacaaaaagagaucugggaaugaguaaagagccugggguagucucaccaacgucguacuuagacgucgauuuacaucccgcaucugccuggaccuuauaugccguagcaacaacaguaauuacaccaauguugcgacauacaauagaaaauucuacugcuaaugucucgcuggccgcgauagcaaaccaagcuguaguacuaaugggguuagauaaagguuggccaauauccaagauggaccugggaguuccacuacuagcacuugguuguuauucacaaguaaauccuuuaacacuaacugcugcgguuuuacuucuaauuacacauuaugccaucauugguccuggacugcaagcgaaggcaacccgggaagcucaaaagcguaccgcagcuggaauaaugaaaaacccaacaguagacgggaucaugacaauagaucuagacccaguaauauacgauucuaaauuugaaaaacaacuaggucagguuauguuauuaguauugugcgccguucaacuacuuuugaugagaaccagcugggcucuuugcgaagcacuaacguuggcgacugguccuauuacaacacuaugggagggaucuccaggcaaguucuggaauacaacuauugcagucucaauggcuaauauuuuucgugguaguuaccucgccggagcgggauuagcauuuucaauuaugaaaucaguuggaaccgggaaacguggaacaggcucacaaggcgaaacccuaggggaaaaguggaagaagaaacugaaccaacuaucgagaaaagaauuugauuuauauaagaaauccgguauaacagaaguugacagaacagaagcuaaagagggacuaaaaaggggugaaauaacacaucaugccguuucccgugguucagcuaaacuacaaugguuuguggaaaggaauaugguaauaccagaggggagaguaauagaccuuggauguggacgaggaggauggucuuauuacugugcgggguuaaagaaaguaaccgaaguuagagguuauacaaaaggcggcccuggucaugaagaaccuguuccgaugaguacuuacggauggaauauagucaaauuaaugucgggaaaagacguguucuaccucccuccagagaaaugcgauacuuuauugugugacauaggggaaucaucgcccaguccaacuguugaagaaucccgaacuauccguguccuaaaaaugguagagccuugguugaaaaacaaucaauucugcaucaagguacuaaacccauauaugccaaccgucauugaacaucuagaacgguuacagagaaagcauggagggaugcuaguuagaaacccccucagcagaaauucuacucacgaaauguacuggauaucgaauggaaccggaaacaucgucgcaagugucaauaugguuucaagauuacucuuaaaucgauuuaccaugacacacagacguccaacaaucgagaaagacguagacuuaggcgcaggaacccgacauguuaaugcagaaccagaaacaccgaauauggacguaauuggggaaaggauuaagcgaauuaaggaagaacauaauagcacauggcacuaugaugacgaaaauccauauaaaaccugggcauaucacggcagcuacgagguaaaggcaacagguagugcaaguucgaugauaaaugguguuguaaaacuauugacgaaaccaugggauguaguuccaauggucacgcagauggcuaugacugacacaacuccuuuuggccaacagagaguuuuuaaagaaaagguugacaccaggacgccaaggucaaugccaggaaccagaagaguaauggaaauuacggcugaauggcuauggcguacacuuggacggaacaagaaaccaagacuuuguacaagagaagaauuuacaaagaaaguacgcaccaacgcagcgaugggcgcaguauucacugaggaaaaucaaugggauagcgccaaagcagcgguugaggacgaggauuuuuggaagcuaguagauagggaaagagaauugcacaaacucggaaaaugcggaucaugugucuacaauaugaugggaaaaagagagaagaaauugggugaauuugggaaagcgaaagguagucgcgccauuugguacauguggcucggcgcaagguaucuggaauuugaggcauugggguuuuugaaugaagaccauugguucucacgugaaaauucuuauucaggaguugagggagaaggccuucauaaguuaggauacauucucagggauauuucaaaaauaccuggaggagcgauguacgcagacgacaccgcaggaugggauaccagaauaacugaagacgaucugcauaacgaggagaaaaucacacaacagauggaucccgagcaucgacaauuagcgaaugcgaucuucaaacuaacguaccagaauaagguaguaaaggugcaaaggccuacgccaacuggaacaguaauggacauaauaucgcguaaggaccagagggguucaggacaaguagggaccuauggacuuaacacuuucacaaacauggaggcacaauuaauacggcaaauggaaggugagggcguucugucaaaagcugacuuggaaaauccccaccuucccgaaaagaaaauaacgcaauggcuagaaacgaaggggguugaacggcucaaacgaauggcuaucaguggugaugacugcgucgucaaaccuaucgacgauagauucgcgaaugcauugcuugcauuaaaugauauggguaaaguaaggaaagauaucccucaauggcaaccuuccaagggauggcacgauuggcaacagguuccauuuugcagccaccauuuucacgagcucaucaugaaagacggcagaaaacuuguugucccgugccguccacaagaugaauugauaggcagagcucguauuagucagggagcagguuggucgcucagagagacugcauguuuagguaaagccuacgcucaaauguggucgcuaauguauuuucaccgaagagauuugcgcuuagcuagcaaugcaauaugcagcgcuguacccguucacuggguaccuacguccaggacgacauggucaauacaugcacaccaccaauggaugacuacugaagauaugcuaacggucuggaauaggguuuggauagaagacaacccguggauggaagacaaaacaccagugacuacgugggaaaauguaccauacuuaggaaaaagagaagaucaauggugcgguaguuuaauuggacuuaccucgcgugccacaugggcgcagaauauaccuacugcaauacagcaaguaagaucacucaucggaaaugaagaauuuuuagauuacaugccaagcaugaaaagauuuagaaaagaggaagaaucagaaggagcuauaugguaa

SEQ ID NO: 23060 - RNA, 9873 nt, Artificial Sequence
  derived and/or modified CDS sequence (opt6) from DENV-3__GU131858__SS-prME
acaaguuuaugucuaguaaugauauuaccagcugcacuggcguuucaucugacaagucgagacggagaaccaagaaugaucgucgggaaaaaugaaagaggaaaaucgcuauuauucaaaacagcaucaggaauaaacaugugcacccuaauugcgauggaucuuggagaaaugugcgaugacacuguaacauauaaauguccgcauaucacugaaguugaaccagaagacauagauuguuggugcaauuuaaccagcacuugggugaccuacggaacauguaaucaagcaggagaacgacgacgcgauaaaagaaguguugcauuagcgccacaugucggcaugggacuagauacaagaacccaaacauggaugucugcagaaggagcuuggaggcaaguggaaaaaguagaaacaugggccuugcggcauccagguuucacaauacucgcguuauuucucgcgcacuauaucggcacuucauuaacucaaaaaguagugauauucauuuuacucaugcuugucacgccauccaugacuaugcgcuguguaggagucgguaaucgagauuucgucgaaggccugucgggugcaacaugggucgauguaguacuugaacauggaggaugcguaacaaccauggccaaaaauaaaccuacacuugacauugaacuucagaaaacagaagcgacucaacucgcuacccuucgaaaauuauguauagaaggaaaaaucacaaacauuacuacggacucccgaugccccacucaaggugaagcuguguuaccugaggaacaagaccaaaauuacguaugcaaacacacauacgucgaccgaggcugggguaacggauguggauuauucggaaaaggaucucugguuaccugcgccaaauuccaaugucuugaacccauagaagguaaaguagugcaauaugaaaaccucaaauauaccgucaucaucacaguucauacuggagaucaacaccaggugggaaaugaaacacaagguguuacagcagaaauuacaccccaagcaucaacuacggaagcaaucuugcccgaguacggaacgcuggguuuagaaugcagucccagaacaggucuugauuucaaugaaaugauucuuuugaccaugaaaaauaaagcguggaugguacauagacaaugguuuuucgaucucccccucccguggacaagcggagcaacgaccgagacacccacuuggaaucgaaaagaacuauuaguaacauuuaaaaaugcccaugcaaagaaacaagaaguagucguucuaggaagucaagaaggagcuaugcauacagcacugacaggugcgacagaaauacaaaauagugggggaacaagcauuuuugccggucaccugaaauguagacugaaaauggauaaauuagaguuaaaagguaugaguuacgcuaugugcacgaauacguucguuuugaagaaagagguaagugaaacccaacaugguacuauacuuauaaaaguagaauaccgaggggaagaugccccuuguaagauucccuuuucaacagaagauggucaaggaaaggcgcacaacggcaggcuaauuacugcaaauccuguuguaauuaagaaagaagaaccaguuaacauugaggcagaaccaccguuuggugaauccaauauuguaaucggcaucggggauaacgcacugaaaauaaacugguauaagaaaggaaguagcauaggaaaaauguuugaggcgacagcacggggcgcaaggagaauggcgauacuaggagacacagcgugggacuuuggcucuguagguggaguauuaaacucacuugguaaaaugguacaucaaauauuugggucagcauauacugcgcucuuuuccggaguaucguggguuaugaaaaucgggauaggaauauugcugacguggauaggauuaaacaguaaaaauacuucgaugagcuuuucuugcaucgcaauugggauuauaacauuauauuuaggggcuguaguucaagcagacauagguuguguaauuaauuggaagggcaaagaacuuaaauguggaucgggaauauucguuacuaacgagguacauacauggacugaacaguauaaauuucaagcggacaguccaaaaagacuagcaacggcaaucgcaggagccugggaaaauggcguaugcgggauuagaagcacaacucgcauggaaaacuuauuauggaaacaaauagcuaaugaauugaauuacauucuaugggaaaacaauaucaaacugacgguggugguuggggauauaauaggagugcuagaacaagguaagaggacauuaaccccgcaaccuauggagcuuaaauauucguggaaaacuugggguaaagccaaaauaguaacagcugagacucaaaauucaaguuucauaaucgauggaccuaauacaccagaaugcccaucagcaucgagagcguggaacgucugggaaguagaagauuaugguuucggugucuuuacgacaaacauauggcuuaaauugcgcgaaguguauacucaguugugugaccaccgauuaaugucagcggcuguuaaagaugaacgagcuguucacgcagacaugggauauuggaucgaaucacagaaaaauggcucuuggaaacuagagaaagcuagucuaauagaggucaaaacgugcaccuggcccaaaagccacacuuuauggagcaauggaguuuuagagucggacaugauaauacccaaaagucuugccggcccaauuucccagcauaaccaucgaccuggcuaucacacgcaaacugcaggaccuuggcaccucggcaaacuagaguuggauuuuaacuacugugaggguacaacaguaguuauaacugagaacuguggaacuucaggaccaucacuaacaacaacaacaguaagcgggaagcuaauucaugaaugguguugucggucaugcaccuuaccgccucuaagauauaugggagaagacgguugcugguauggcauggaaauucguccaauuuccgagaaagaagaaaacaugguuaaaucguugguauccgcuggaucgggcaaaguagacaauuuuacaaugggcguacuauguuuagccauacuauuugaagaaguuaugagaggaaaauuuggcaagaaacacaugauagccggcguauucuuuacauuuguauuguuauuaucuggucaaauaacguggcgagacaugacacauacccuuauaaugauuggaucaaacgcaagcgaucguaugggaaugggcguuacauauuuagcauuaaucgcuacuuucaaaauucaaccauuuuuggcauuaggcuuuuuccuucgaaaacucacauccagagagaacuuacucuuggggguaggacuagcaauggcuacaacacugcaguuaccugaggauauagaacaaauggcgaacggcauagcucuggguuuaauggcccugaaacuuauuacacaauuugaaacauaccagcuauggaccgcacugauuagucuaaccuguucgaauaccauguucacuuuaacgguagcguggagaaccgcgacgcuaauacuagcgggcgugagcuuauugccaguaugucaauccucaaguaugaggaaaacugacuggcugccaauggcgguugccgcaaugggugucccaccccuccccuuguuuaucuucucucuaaaagacacgcugaaacguaggucauggccacuaaaugaggguguaauggccguaggauuaguaaguauacucgcaucaagccuacuaagaaacgacguacccauggccgguccgcuaguagcugguggcuuauugauagccuguuacguuauaacuggaacaagugcggauuugacuguagaaaaggccgcugauauaacaugggaggaagaggcagaacaaaccggagucagucacaaucucaugauuacgguagaugaugauggaacuaugcggauuaaagaugaugagacagaaaauauauuaacuguucuacuuaaaacagcauuauuaauuguaagugggguuuucccauacagcaucccugccacauuacuuguuuggcacacguggcagaagcagacacagcgcagcgguguccuaugggauguucccucgcccccagaaacucaaaaagcagaauuggaggaagggguuuauagaauaaaacaacaagguaucuucgggaaaacacaaguugggguggggguucaaaaagaaggagucuuccacacgauguggcauguaacccggggugccguguuaaccuacaaugguaaaagauuagaacccaauugggcaucuguuaagaaagaccucauuaguuauggcggaggauggagauuaagcgcgcaguggcaaaaaggcgaggaaguucaggucauagcaguagaaccuggcaaaaauccgaaaaauuuucaaaccaugccagguacguuccaaaccaccacaggagaaauuggugccauagccuuagauuucaaacccggcacuuccggaucaccuaucauuaauagggaaggaaaaguaguuggauuauacggaaacgguguagugacgaaaaacgggggcuauguaucuggaauugcacaaacaaaugcggaaccugaugguccaacaccugagcuagaagaagaaauguucaagaaacgcaaucucaccauaauggacuuacauccaggaucaggcaaaacucguaaauaucuuccugcgauuauucgagaagcuaucaaacguaggcuccguacauuaauacuugcaccuacaaggguugucgcagccgaaauggaagaggcacuuaaaggauugccuauccgguaucaaaccacggcgacgaagucagaacacacagggagagagaucgucgacuuaaugugccacgcaaccuucacaaugagguuauuaucaccgguuagaguucccaauuacaauuuaauuauaauggacgaagcgcacuucacggauccggccucaauugcggcuagagguuauauuucgacaagaguggguaugggugaggccgcagccauuuuuaugacagccacaccuccugggacugcagaugcuuucccacaauccaacgcaccgauacaggacgaggaaagagauauaccagagagauccuggaacucaggaaaugaauggauaacagauuucguuggcaagacaguuugguuuguaccuaguauaaaagccggcaacgauaucgcaaauuguuugaggaaaaauggcaagaaagucauucagcuaagcagaaaaaccuucgauacagaauaucagaaaacgaaacuuaacgacugggauuucgucgucacaacagauaucucugaaaugggagcaaauuucaaagcagauagagugauagauccacggagguguuugaagccuguuauacuuacggaugggccagaaagaguaauuuuagcaggccccaugccagucaccgccgcuuccgcagcgcagagaaggggucgcguagguagaaauccucaaaaagaaaaugaccaguacauuuucacuggucaaccauuaaacaaugaugaagaccacgcgcacuggacugaagcaaagaugcuccuagauaauauuaauacccccgaagguauaauaccagcacuauuugaaccagaacgagagaagucugccgcaaucgauggggaauacagacugaaaggggagagcagaaagacuuucguugaacuuaugaggagaggagaccuaccuguauggcuagcgcauaaagucgcauccgaagggauaaaauauacagacagaaagugguguuuugacggccaacggaauaaccaaauacuagaagaaaauauggacguugaaauauggacaaaagaaggagagaagaagaaauuacguccucgcugguuagaugcaaggacuuauuccgacccauuagcauuaaaggaauuuaaagauuuugcagcgggaagaaaaaguauagcuuuggaucuaguuaccgaaauuggaaggguaccgucccaccucgcccauaggacgcggaaugcucuggauaacuuagugauguugcacacaucugaacaugggggcagagcuuauaggcacgcaguagaggaguuaccggaaacuauggaaacccuacuuuugcuaggauuaaugauuuugcuaacagggggagcaaugcuauuucuuauaagcggaaaagguauugguaaaacaucaaucgggcuuaucuguguuauugcaucuuccggaaugcuuuggauggcagagauaccccugcaguggauagcaagcgcaauuguucuagaguucuuuaugauggugcuucuaauaccagaaccagagaagcaacguacuccacaagauaaccagcuagcuuauguaguaauaggaauccuuacucucgcagcgauuauagcagccaacgaaaugggacuacuugaaaccacaaagagagaccuagguaugaguaaagaacccggcguaguaagcccgaauagcuacuuggaugucgaccuccauccagcguccgcuuggacuuuguacgccguagcaacgacagucauuacaccgauguugcgacauacgaucgaaaauaguacagcaaauguaucuuuagccgccauagcaaaccaagcuguaguguuaaugggcuuagauaagggauggccuauaucuaagauggaccuaggaguaccuuuauuagcacuugguuguuauagucaagucaauccucuuacauugacugcagcaguuuuacuauugauuacacacuacgcaaucauaggcccagggcugcaagcaaaagcgacacgcgaggcucagaaacgaacagcagcuggcauuaugaaaaauccaacuguugauggaaucaugacuauagaccuggaccccguuauauacgacaguaaauuugagaaacaacuaggacaaguuaugcuuuuaguuuuaugugcuguacaguuacuuuugaugagaacuucaugggcuuuaugcgaagccuugacguuggcuacaggaccuauaacgacccuaugggaggguagccccgguaaauucuggaauacaacuauugcugucaguauggcgaauauauuucgaggaagcuaccuagcuggagcggguuuggccuuuucuauaaugaaaagcgugggaacuggcaagcgcggaacaggcagccagggagaaacacuuggggaaaaauggaagaagaaacucaaucaauuaucuagaaaagaauuugaucuauacaaaaagucuggaauaacagaaguagauagaacggaggccaaagaaggauuaaaaagaggggaaauuacgcaccaugcaguuagucgagguuccgcaaaauuacagugguuugucgaaaggaauauggucauaccagaaggccgaguaauagaucuaggcuguggacgaggcgguuggucauauuauugugcgggguuaaagaaaguuacagagguucgagguuacacaaaaggcgggcccggacaugaagaaccggugccuaugucuacguaugguuggaauauaguaaagcuaaugucgggcaaagauguauucuaucuaccaccugaaaagugcgacacucuacuaugugauaucggugagaguucuccuaguccaacaguagaagagucucgaacaauaagaguacucaaaaugguggagccauggcucaaaaauaaccaguuuuguauaaaaguucucaacccuuauaugccgacgguuaucgagcaucuagagagguuacagcggaagcacggugguaugcuuguuagaaacccauugucaagaaauaguacucaugaaauguauuggauuucuaacggaaccggaaauauaguggcaucuguuaauaugguaucucgguuauugcugaauagauuuacuaugacacacagacgaccgacgauagagaaagauguagaccucggugccggcacgcgacauguaaaugcugaaccugagacacccaacauggacguaauaggagaacggauuaaaagaauaaaagaagaacauaacucaacuuggcacuaugacgaugaaaauccauacaagacaugggcauaucauggcaguuaugaggucaaagcaacaggaucagcgucuucaaugauaaauggcguagugaaauugcugacgaaacccugggacguagucccaaugguaacccaaauggcgaugacagacaccacaccauucgggcaacaacguguuuuuaaggagaaaguggauacaagaacgccaagaucgaugccaggaacacgccguguuaugggaauuacagcggaaugguuauggagaacguuaggacguaauaaaaagccaagacuaugcacaagagaagaauuuacgaagaagguaaggacaaaugcugcgaugggggcaguguuuacggaagaaaaccagugggacagugcaaaggcagccguggaggaugaggauuucuggaaacuuguugauagagaaagagaacuccacaaguuagguaaaugugguagcuguguauauaauaugauggguaaacgagagaagaaacuuggagaauuuggaaaagcaaagggaagcagggccauaugguacaugugguugggagcaagauacuuagaauuugaagccuuagguuucuuaaaugaagaucacugguucaguagggaaaauuccuauucaggaguagaaggcgaaggacugcauaagcucgguuacauuuuaagggacauuagcaaaauacccggaggagccauguaugcggaugauaccgcaggcugggauacaagaauaaccgaagaugacuuacauaacgaagagaagauuacacaacagauggacccugaacaucgacaacuugcuaaugcuauauucaaauuaaccuaucagaacaaaguuguuaaagugcaaagaccaacgccuaccggaacgguaauggacauuauuucgcgaaaggaccaacggggaucagggcaagucgggaccuaugggcuaaauaccuucacaaauauggaagcccaguuaauucgucaaauggagggggaggggguccugucaaaagcugauuuggaaaacccucauuuaccagagaagaaaauaacacaguggcuugagacaaaagggguagaacguuuaaaacgaauggcgaucucaggagaugacuguguaguuaaaccaauagacgauagauucgcaaaugcauuacuggcucucaaugacauggguaaagugcgaaaagacaucccgcaauggcagccaucuaaaggguggcacgacuggcagcaaguaccauucuguagccaccauuuccaugaauuaauaaugaaagauggaagaaaacugguugucccaugucggccacaagacgaacuaauugguagagcaagaauuucacagggugcagguuggagccuaagggaaacugcaugucuuggcaaagcauaugcucaaauguggaguuuaauguauuuccaccggcgagaccuaagauuggcaucgaaugcgauuuguucagcaguaccuguccacugggucccuacuucgaggacgaccuggaguauacaugcgcaccaucaauggaugacuacggaagauauguuaacugucuggaaucgaguauggaucgaagauaauccauggauggaagacaaaacaccaguaacuacuugggaaaacguaccauacuuaggaaaacgagaagaccaauggugcggaaguuuaauaggccucaccucaagagcuacaugggcccaaaacauaccaaccgcuauacaacaaguucgaucccuuauagggaacgaagaguucuuagacuacaugccaucuaugaaacgauuucgaaaggaggaggaaagugagggugcgauuugguaa

SEQ ID NO: 23061 - RNA, 9873 nt, Artificial Sequence
  derived and/or modified CDS sequence (opt6) from DENV-3__GQ868548__SS-prME
acaucgcuauguuuagucaugauccugccagcggcauuggcauuucacuuaacuuccagagacggagaaccaagaaugauagugggcaaaaacgaacgagggaaaagucuauuguucaaaacagcgucugggauaaacauguguacucuaaucgcuauggauuugggagaaaugugcgaugauacgguuacuuauaaaugcccacauauaacugaaguagaaccagaagauauagauuguuggugcaaucugacgucgaccuggguuacauaugguaccugcaaccaagcuggggaacggagacgagauaaacgaucaguagcgcuggcuccacaugucgguaugggccuagauacucguacucaaacauggaugagugcagaaggcgcauggaggcaggucgagaaaguugagacaugggcguuaaggcacccugguuuuacaauacuagccuuauucuuagcccacuauauaggcacuucgcuaacacagaaagucgucaucuuuauacuacuaaugcuagugaccccaaguaugacuaugagauguguagggguagguaaucgcgacuuugucgaaggacuaagcggggcuacguggguagauguaguccuagaacauggugguugugugacgaccauggccaaaaauaaaccaacacuugauauugaauuacagaaaacagaagcaacccaguuagcgacuuuacgaaaacuauguauugaaggaaaaaucacgaauauuacaacagacucuagguguccaacacagggagaagcaguucuaccagaagaacaagaucaaaacuaugugugcaaacauacuuacgucgauagaggcugggguaauggauguggucuguuuggcaaagguucuuuaguuacaugcgcaaaauuccagugccuagaaccaauugaaggcaaaguuguucagcacgaaaauuuaaaauauacaguaaucaucacaguacauacaggagaucaacaucaaguugguaacgaaacccagggaguaaccgcagaaauaaccccacaagcguccacaacugaagcuauacuuccagaauaugguacuuuaggccuugaaugcucaccacguacaggucuagauuuuaacgaaaugauucuacuaacaaugaaaaacaaggcuuggaugguacaucgacagugguucuuugacuugccucugccauggacgaguggugcuacuacagagacaccaacauggaacagaaaagaauuauuaguaacuuucaaaaaugcacaugccaagaaacaagaagucgucguauuagguagucaagaaggugcaaugcauacugcgcuaacaggagcaacagagauacagaacucuggcggaacuagcauuuuugcaggacacuuaaaaugccgacuaaaaauggacaaauuagaauugaaaggcaugucauaugcgauguguacgaacacauuuguguuaaagaaagaaguaucugagacucaacaugggacaauccuaauuaaaguagaguauagaggcgaagacgcaccguguaaaauaccauucucuaccgaagacggacaagguaaagcacacaauggaagacuaauuacugccaauccaguggucacuaagaaagaagaaccaguuaauauagaagcagaacccccguuuggagaauccaauauugugauugguauaggggauaacgcuuuaaaaauaaauugguauaagaaagguucuagcauaggcaaaauguuugaagcgacggcaagaggcgcucguaggauggcaauacuaggggauacagcuugggauuuugggagcguugggggaguguuaaacucacuugguaaaaugguucaccagauuuucgggucagcuuauacagcuuuauucucaggcgucagcuggguuaugaaaauuggcauuggaauacuccuaacauggaucgggcucaauucuaaaaacaccucuaugucguuuuccuguauugcuauagggaucauuaccuuauacuuaggagcgguagugcaggcagauaugggaugcgucauaaauuggaaagguaaagaacugaaauguggaucagguaucuucgucaccaacgaaguacacacauggacggaacaauauaaauuucaagcagauaguccaaaacgccucgcaacagccauagcgggagcuugggaaaauggaguuugcggcauucgcagcacgaccaggauggaaaauuuacuauggaaacaaauagcaaaugaauuaaacuauauccucugggagaauaauauaaaacuaacaguagucguaggcgacaucauuggaguucuggagcaagggaaaagaacacuuacaccgcaaccaauggaacuaaaauacagcuggaaaacuuggggaaaagcuaaaauuguaacggcugaaacacaaaacaguucuuuuaucauagacggaccaaauacaccagaaugcccuuccgcaucuagggccuggaauguuugggagguugaagauuacggauuugguguuuuuacuacgaauauuuggcuuaaacugcgagaagucuauacacaauuaugugaucacagacuuaugagcgcugcuguaaaagaugaaagggcuguccaugcugacaugggauacuggauagagagucagaaaaaugguucguggaaauuagaaaaagcaucacuaauugaggugaaaacuugcacauggccuaaaagccacacguuguggaguaacggaguccuggaaagugauaugauaauucccaaaucacuagcaggaccaauaucgcaacacaaucacaggccgggguaucauacacaaacggcugggccguggcaucuaggaaaacuugaauuagauuuuaauuauugugaagguacuacaguagucaucaccgagaacuguggaacaagaggucccagcuuaagaacaaccacaguuagcgguaagcuaauccaugaaugguguuguagaaguugcacuuuacccccucuaagguacaugggagaagauggaugcugguauggcauggagauuagaccuauuuccgaaaaagaagaaaacaugguuaagagcuuagugucagccggaagcgguaaaguugacaauuuuacaaugggaguacuauguuuagcaauccuuuucgaggaaguaaugagaggcaaguucgggaagaaacacaugauagcaggcguauucuuuaccuuuguacuguuguuaagcggucaaauaaccuggcgagauaugacccacacucucauaaugauagguucaaacgcaucggaucguaugggcaugggaguaacauacuuggcccuaauagcaacguuuaagauacaaccuuuccucgcauuagguuucuuucuuagaaagcuaacaucaagagaaaauuuacuucuuggcguagguuuggcaauggccaccacacuacaauuaccagaagauauagaacagauggccaacggaauagcauuaggacucauggcucuaaaguuaaucacgcaauuugaaacguaccagcuuuggacagcacuaauaaguuuaaccugcuccaauaccauguuuacucugacaguagcguggcguacagccacccuuauauuagcgggagugucucuacuaccaguaugucaaagcucaucaaugagaaaaacagauugguuaccaauggcugucgcugcuaugggaguaccaccguuaccgcuauucaucuuuucacuuaaagacacauugaaaaggcgaaguuggccgcucaaugaaggcgucauggcugugggacugguaucaauacuagcuagcucacuacuaaggaacgauguuccaauggcaggaccccuaguagcggguggauuacuuaucgcauguuauguuaucaccggcacaucagcugauuugacgguagaaaaagcagcugauaucacuugggaggaggaggccgaacaaacaggaguaagucauaauuugaugauuaccguagaugacgaugguacaaugagaauuaaagacgaugaaacagaaaauauacuuacuguucuucuaaagacagcgcuuuuaauaguuucuggaguauuuccauauucuauaccggcaacacuauuagucuggcacacguggcagaaacaaacucaaagaagugggguauuaugggauguaccaagcccacccgaaacacagaaagcugaauuggaagaaggaguauacaggauuaaacagcaaggaauauuugggaagacacagguagggguugggguacagaaggaaggagucuuccauacaauguggcacgugacacgcggggcuguccuuaccuauaaugguaaaagacuggaaccuaacugggccagcgucaagaaggauuugauaagcuauggaggaggcuggagguuaagcgcgcaauggcaaaaaggggaagaagugcagguuauagcaguugaaccagguaaaaaucccaaaaauuuccaaacaacuccaggaacauuccaaacaacgacgggagaaauuggagcaauagcauuagauuucaaaccagguacgucaggaaguccaauaaucaacagagaaggcaaaguagucgggcuuuacggaaauggcguaguuacaaagaaugguggguacguuuccgguauagcucaaacuaacgccgaaccagacggaccaacaccggaacuugaagaagaaauguucaagaaaagaaaucugacuaucauggacuugcauccuggcagugguaagacaagaaaauauuuaccugcaauuauucgggaagccauuaagcguagacuacgcacacugauuuuggcacccacacgcgugguggcagcagaaauggaagaggcccucaagggauuaccaauacguuaccaaacaacggcaacaaaaucugagcacacugguagggaaauagucgaucuaaugugucaugcuacauucacaaugcgauuacugucgccuguacgaguucccaacuauaaccuaaucauaauggaugaggcacauuuuacagauccggcgucgauagcagcaagaggauauauuaguacaaggguagggaugggggaggcugcugcgauauuuaugacugcuacgccucccggaacugcggacgcauucccucaguccaacgcuccuauucaagacgaagaaagagauauacccgagaggucauggaacuccgggaaugaauggauaacugacuuuguagguaaaaccgucugguucguaccuaguauaaaggcagggaaugacauagcaaauugccugagaaagaacgguaagaaaguaauccaacuuagccgcaaaacguuugauacagaauaccagaaaacaaaguuaaacgauugggauuuuguaguuacgacagacaucucagaaaugggagcuaacuucaaggcagaucgagucaucgauccucgaagaugccuuaaaccaguaauauugacugacggaccagagaggguaaucuuagccggccccaugccaguuacagccgcguccgcagcccaaagaaggggucgaguaggaagaaacccucaaaaagaaaaugaucaguacauuuucacggggcaaccauuaaacaacgacgaagaccacgcccauuggacagaagcaaagauguuacuggauaauaucaacaccccugagggaauaauaccggcucuauucgaaccagaacgcgaaaaaucagcugccauugauggagaauaccgacuaaagggagagucgcgcaaaacuuuuguagaacugaugcgaagaggagaucuaccuguauggcucgcucauaaggucgcaagugaggggauuaaauacacugaccgaaaauggugcuuugauggccaacguaacaaucaaauucuagaggaaaacauggacguugaaauuuggacaaaagagggggagaagaagaaauugcgcccacguuggcuggaugcaagaacguauucugauccccucgcguuaaaagaguuuaaagauuuugcagcuggcagaaaaucuauagcacuagacuugguaacggaaauaggaagagugccaucgcaccuagcacaucgcacacgaaacgcauuagacaaccuuguaauguuacauacgucugagcacgguggcagagccuacagacaugcaguagaagaacuucccgaaaccauggaaacauuauuacuuuuggggcuaaugauacuacugacaggcggugcaaugcuauuucuaauuucaggaaaggguauaggcaaaacuucuaucggauuaauuuguguaauugcgucuucuggcauguuguggauggcagaaaucccuuuacaauggauagcaagcgcaauagugcucgaguucuuuaugauggucuuacuaauuccagaacccgaaaaacaaagaaccccacaagacaaccaacuagccuauguugugauuggcauuuuaacccuugcagccauaauagcagcuaaugaaaugggcuuauuagaaacaacaaagcgagacuuaggcaugaguaaagagccaggaguaguuagucccacuucauaccuagacguugaccuacauccugccagcgcguggacauuauacgcugucgccacaacgguaauaacgccuauguugcgacauacaauagaaaauucuacagcgaaugucagucuagccgcaaucgccaaccaagccguaguacugaugggauuggauaaaggauggccuauaucuaagauggacuuagggguuccccugcuggccuugggauguuacagucaaguaaauccguugacauuaacugcagcaguacuccuucuaauuacgcauuacgcuaucauagguccaggauugcaagcuaaagcuacgcgcgaagcacaaaagagaacagcagcuggaauaaugaaaaacccgacaguugauggcauuaugacuauugaccuugauccaguaauauaugacaguaaauucgaaaagcaguuaggacaagucaugcuccuaguucugugcgccguacagcuuuuacuaaugagaaccucaugggcauuaugugaggcucuuacucuugccaccggaccgauuacuacauuaugggaagguucacccggcaaguuuuggaacacaacuauagcuguuuccauggcgaauaucuuccgagguuccuauuuggccggcgcuggucucgccuucaguauaaugaaaagugucggaacggguaaacguggaaccggcucucagggcgaaacuuuaggggaaaaauggaagaagaaacucaaccagcucaguagaaaggaguucgaccuguacaagaaaucaggcauuacagaaguagauaggaccgaagcaaaagaaggacucaaacgaggagagauaacacaucaugcugugucaagagggucugcaaagcuacaaugguuugucgagagaaacaugguuaucccugaaggucgagugauagauuuaggaugcggaaggggcggauggucguauuauugcgcaggacucaagaaaguaacggaagucagaggguauacaaaaggggguccaggucacgaagaaccugugccaaugaguacauacgguuggaacauugucaagcuaaugagugggaaagauguauuuuacuugccaccagagaagugcgauacucugcuuugugacauuggcgaaucaucaccaucuccuacuguagaagagucaagaacuauaagaguucucaaaaugguagaaccauggcucaaaaauaaucaauuuugcauaaaaguguuaaaccccuauaugcccacaguuauugagcaccuagaaaggcuucagagaaaacacgguggcaugcuggugagaaacccuuuauccagaaauucgacucaugaaauguauuggaucagcaacgguacagggaacauaguagccagcgugaacaugguaagcaggcuacuuuugaaucgauuuacaaugacgcaccgacgcccaacgauagaaaaagauguagaucuaggugcugggacucggcaugugaaugcugagccagagacaccgaacauggaugucauuggugaaagaauuaagagaauaaaggaagaacacaauuccaccuggcauuaugaugacgaaaaucccuauaaaacuugggcauaccauggaucguaugaggucaaagcaacuggcucugcuagcucuaugauaaauggaguggucaaacuuuugaccaagccuugggacguaguuccuaugguuacucaaauggcgaugacagauacuacacccuuuggacaacagagaguauucaaagaaaaagucgacacuagaacuccuaggucaaugccaggcacaagaagaguaauggagauuaccgcugaauggcucuggcggacucuaggacgaaauaagaaaccgagguuauguacucgcgaagaauuuacgaagaaagugcgaacaaacgcugcaaugggagccguauuuacagaagagaaccaaugggacucugcaaaggccgccguagaggaugaagauuuuuggaagcuaguugauagagagagggaacuacauaaacucggcaaguguggauccuguguguacaauaugaugggaaaacgagagaagaaauuaggugaguuugguaaagcaaaaggaagucgggcuauaugguacaugugguuaggugcgcgcuauuuagaauuugaagcgcuaggguuucuuaaugaagaucauugguuuucuagagagaacagcuacucaggaguugagggagaaggacuucacaaacucggguauauauuacgugauauaucuaaaauaccagguggagccauguaugcggacgauacggcgggcugggacacaaggauaacugaagacgauuuacacaaugaagagaaaauaacacagcaaauggauccugagcauagacaauuagcaaaugcuauuuuuaaacucacguaucaaaauaaaguuguaaagguccagagacccacaccuaccgguacgguuauggacauaauaaguagaaaggaccaaagggguagcggccaaguaggaacuuaugggcugaacaccuuuacuaauauggaagcacaguuaauucgucaaauggagggagaaggaguucuaucgaaagcugaucuggaaaauccgcauuuaccugagaagaaaaucacacaauggcucgaaaccaaaggcguugaaagauuaaaacgaauggcaauuagcggcgaugauugcguaguaaagcccauugaugaccgauuugccaaugcuuuacuagccuuaaacgacaugggaaaaguuagaaaggauauaccgcaauggcaaccuaguaaagguuggcacgauuggcaacaggucccauucuguagucaucacuuucaugaacuuauaaugaaggacggucgcaaacucguaguuccauguaggccccaagacgaacuaaucggucgagcgaggauaucccaaggagcaggcuggucuuuacgggaaacugcauguuuaggcaaagcguacgcacaaauguggucgcuuauguauuuucauaggagggaccucagauuagccucaaaugcuauuugcucugcggugcccguucauuggguaccuacuucaagaacaacauggucuauucaugcgcaucaucaguggaugacaacagaagauauguuaacggucuggaaccguguguggaucgaagauaaucccuggauggaagauaaaaccccagugacaacuugggaaaacguuccauauuuggguaagagagaagaccaauggugugguucccugaucggauuaacuucucgggcuacaugggcucaaaacauccccacugcaauccaacagguaagaagucuuaucgggaacgaagaguuccuagacuauaugccuaguaugaagcgguuccgcaaagaagaagagucagaaggcgccauuugguaa

SEQ ID NO: 23062 - RNA, 9873 nt, Artificial Sequence
  derived and/or modified CDS sequence (opt6) from DENV-3__GU131861__SS-prME
acuucacugugucuagucaugauuuuaccugccgcauuagcauuucaccuaacaaguagagacggggagccuagaaugauagucgguaaaaacgagagaggcaagucuuuacuuuucaagacugcaucaggaauaaacauguguacucucauugcaauggauuuaggugaaaugugcgaugacaccguuacguacaaauguccucauaucacagaaguugaacccgaggauauugauugcuggugcaaccuuacgaguacaugggucacguauggaacuuguaaccaagcgggggaaaggagaagagauaaaagaagugucgcacuagccccacauguaggaaugggguuagauacaagaacacaaacauggaugucggcagaaggcgcauggagacagguagagaaggucgaaaccugggcacuuaggcauccagguuuuacaauucucgcacuuuuuuuggcucauuacauugggaccucguuaacacaaaaaguaguaauauuuauacuuuugaugcuugucacaccaagcaugacgaugagguguguaggaguuggaaacagggauuuugucgaaggauuaucaggugcaacuuggguagauguaguucuagagcaugguggaugcguaacuacaauggcaaagaacaaacccacuuuagauauagaacuccaaaagacugaagcuacacaauuagcuacuuugcguaaauuauguauagagggaaaaauuacaaacauaaccaccgacucuagauguccgacucaaggcgaagcgguucugcccgaagaacaggaucagaauuacgugugcaaacacacauacguggaccgcgguuggggaaauggauguggacuguucggaaaaggcagucuugucacaugugcuaaguuccaauguuuggaaccgauagaaggaaagguagugcaauacgagaaccugaaauauacaguuauuauuacgguacacacgggugaccaacaucaaguuggaaaugaaacccaagggguaacagcagaaaucacuccacaagcaucuacuaccgaagcaauacuaccugaguaugggacgcuuggucuagaauguaguccaagaacgggacuggacuuuaacgagaugauacuccuuacaaugaaaaacaaggcauggauggugcauagacagugguuuuucgaccuaccacuaccauggacauccggggcaacaacagaaacgccaacauggaaucgcaaagagcuccuuguaacauuuaaaaaugcucaugcaaaaaaacaggagguaguaguacucggcagccaagagggcgcaaugcauaccgcacucacgggugcaacagaaauacaaaacucaggagggacgaguauuuucgcaggccauuuaaaguguagauuaaaaauggacaaguuggagcugaaaggcaugucguaugcuaugugcacaaauacauuuguauuaaaaaaggaaguaucagaaacucaacacggaacaauucuuaucaaaguugaauauaggggugaagacgcaccuugcaaaauaccguuuucuacagaagacggacaaggaaaggcacauaauggaagacuaaucaccgcuaauccuguaguaacaaaaaaagaagaacccguuaauauagaagcugaaccaccauuuggagaaucuaauauagucauugguauuggagacaacgcccuaaaaauaaauugguauaagaaagguuccaguauaggaaaaauguuugaagccaccgcgaggggagcccggagaauggcaauccuuggggacacagcuugggauuuuggcucaguagggggaguccuaaacucgcuaggaaaaaugguccaucagauuuuuggaagugccuacacagcucuguuuaguggugugaguugggugaugaaaauaggcauugguauacuucuuaccuggauagguuuaaauucuaagaacacgucuaugaguuucucguguauugcaauagguauuauaacacuauauuuaggagcuguaguccaggcagauaugggcugugugauuaauuggaagggaaaagagcuuaagugcggaagcgguauauuuguaacaaaugagguccacacuuggacagagcaauauaaauuccaagccgacuccccaaaaagacuagcaacugccauugcuggagcaugggaaaacggcguuugcggcaucagaucuacuacgagaauggaaaauuuauuauggaaacaaauagcgaacgaacugaauuauauccuaugggaaaauaauauaaaauuaaccguaguaguaggagauaucaucgguguacuagaacaaggaaaaagaacuuugacaccacaaccaauggaauugaaguacuccuggaagaccuggggaaaagccaaaauuguaacggcugaaacacagaauucuucuuuuauuauagaugguccuaauacaccagaaugcccuucugcauccagagcuuggaauguuugggaaguugaagauuacgguuuuggaguauucacuacaaauauaugguuaaaacuccgagagguguacacacaacuaugcgaccaucgauuaauguccgcggcuguuaaagaugagcgagcgguucaugccgauaugggauacuggauugaaucacaaaaaaacgguucauggaaacuugaaaaagcuagcuugauugagguuaaaacauguacguggcccaaaucccacacauuauggucaaauggaguauuggaaucugauaugauaauaccaaaaucuuuagcgggcccaauaucucaacauaaucaccguccuggcuaccauacucaaacagcagggcccuggcauuuaggcaaacuggagcuagacuuuaacuauugugaaggaacuaccguagucauaacggagaacugcgguacacgaggacccucgcuucggacuacaacgguaucugguaaacuuauacacgagugguguugucgaucgugcacgcugccuccccuacgcuacaugggagaggaugggugcugguacggaauggaaaucagaccgauuucagagaaagaagaaaauaugguaaaaucucuugucucugccggaaguggaaaagucgauaacuuuacaauggggguccuaugccuagcaauacuuuuugaagagguaaugaggggcaaguucggaaaaaagcauaugaucgcugggguguucuuuaccuuuguccuauuacugagugggcagauuacauggagagauaugacucacacacuuauuaugauuggaaguaacgcaucagacagaaugggaaugggcguuaccuauuuagcuuuaauagcaacauuuaagauucaaccauuuuuagcauuaggauuuuucuuacgaaaauuaacaagucgggaaaaccugcuuuuagggguuggauuagcgauggcaacaacgcugcagcucccagaagauauugagcagauggcgaacggaaucgccuuagggcuaauggcccuuaaauuaauuacucaguuugagacauaucaauuauggacagcccucauaucccuaacuugcuccaauacaauguucacccugacaguugcuuggaggaccgcaacacuuauauuagcgggagugucauuguuaccagucugccaaaguucgagcaugcgaaaaacggauugguuaccuauggcgguugcagccaugggaguaccaccucuaccacucuuuauauucuccuuaaaggacacuuuaaagcguagaagcuggccccuuaaugaaggaguaauggcgguagggcuugucaguauauuagcaucgaguuuacuacguaacgauguaccaauggccggaccauuaguagcggggggcuuauuaauagcaugcuaugugaucacagggacaucagcggaucuaaccgucgaaaaggcugcugauauaaccugggaggaggaagccgaacagacagguguuucccacaaucuuaugauuacuguagacgacgacggcacaaugcggauaaaagaugacgagaccgagaauauacugaccguauugcuaaaaacagcacuacuaauuguauccggaguuuuucccuauagcauacccgcuacacuauugguauggcauacguggcaaaagcaaacacaacguucugguguucuaugggauguccccucuccacccgaaacacagaaagcugaacuagaggagggagucuaccgaauaaagcaacaaggaaucuucggaaaaacucaaguagguguaggcguucaaaaggaaggggucuuucauaccauguggcauguuaccagaggagcuguacucacuuauaauggaaagaggcucgaaccuaacugggcaagcgucaagaaggacuugauaaguuaugggggcggcuggcgucuuuccgcccaguggcaaaagggagaagaaguacaaguaauagcaguggaaccagggaaaaauccuaagaauuuccagaccacaccaggaacuuuucaaaccacaacaggugaaauuggcgcgauugcucuugauuuuaaaccugguacuucaggaucaccaauaauaaaucgagaaggcaaaguugucggcuuauaugguaauggaguuguuaccaaaaacggaggauacguaucaggcauagcucaaaccaacgcggaacccgacggaccuacacccgaauuagaagaagaaauguucaagaaaagaaaucuaacuauuauggaucuacacccggggucaggaaagacccggaaauacuuaccggcaauaauaagagaagcaaucaaaaggcgauuacguacacuuauccuagcuccaacacgaguagucgcagcggaaauggaagaagcucucaaaggcuuaccaauaagauaccaaaccacgguaacaaagucagaacauaccggucgagagaucguugaccuuaugugucaugcaacuuuuacaaugaggcugcuuucaccuguuagaguaccaaauuauaaucucauuauuauggacgaagcacauuucaccgauccagcuagcaucgccgcaaggggauauauuagcacgagaguaggaaugggugaagcagcagccauauuuaugacugcaacaccgccggggacagcggaugcauuuccacaaucuaaugcacccauucaagacgaagaacgagacauaccugagcgaucuuggaacaguggaaaugaauggauaacggauuucgcaggaaaaacagucugguuuguucccaguauuaaagcagggaacgauauagccaauugucuccgaaaaaaugguaaaaaaguaauacaauuaaguagaaaaacguuugacacagaauaucaaaaaacgaaacuaaacgauugggacuucgugguaacgacagacauuagugaaaugggugcaaauuuuaaggcagaucgaguuauugacccucguaggugucuuaaaccugucauauuaacagacgggccagaacgugucauauuagcgggaccuaugccagucacugcugccagcgcagcacaaaggagaggucgaguagguagaaauccucaaaaagaaaaugaucaauauauuuuuacaggacaaccacuaaacaacgacgaggaucaugcacacuggacggaagcaaaaaugcuguuagauaauauaaauacaccagaggggauuauaccagcauuauuugaaccagaaagggagaaaucugcggcaaucgauggagaauauagauugaagggagaaaguaggaaaacauuuguagaacucaugagaagaggggaccucccgguauggcuggcacacaaaguugcuagugaagguauaaaauacacugaccgaaagugguguuuugauggucaacgaaauaaucagauauuagaagaaaauauggaugucgaaauauggacgaaggaaggcgaaaaaaaaaaauuaagaccacgauggcuggaugcgagaacuuacucagacccucuugcacucaaagaauucaaggacuucgcugcugguaggaaaucaauugcccucgaucucguuacagaaauuggacgcguccccucccaccuagcucacaggacgagaaacgcacuagacaauuuaguuaugcuucauaccucagaacauggagggcgugccuaucgacaugcugucgaagaauuaccugaaacuauggaaacuuuauuauuauuaggccuaaugauccuucuuacgggcggugcaaugcuguuucuuauaucugguaagggaaucggcaagaccucuauuggucuaauuugcguaauugcuucgagcggcauguuauggauggcugaaaucccauugcaauggauugcgucggccgucguauuagaguucuuuaugaugguguuauuaauacccgaaccagaaaagcaaaggacuccacaagauaaccaauuagccuacguaguuauugggauuuuaacauuagcugcaauaauugcagcuaaugaaaugggacuacuagaaacuaccaaacgagaucuaggcaugaguaaagagcccggcguuguuagcccaacuucauauuuagacguagacuugcauccagcaucagccuggacacuguacgcgguugcaaccacagucaucacaccuaugcuacgacacaccauagaaaacucuacagccaacgucucccuggcagcaauugcuaaccaagcuguuguacuuaugggacucgauaaaggauggcccauuucaaaaauggauuuaggcgugccacuucuagcauugggcuguuacagucaaguaaacccacucacuuugacugcagcugucuuauuacuaauuacgcauuaugcuauaauaggaccaggucuucaagcgaaagcaacacgcgaggcacaaaagcguacugcggcuggaaucaugaaaaauccaaccguggauggaauuaugacaauagaucuugacccuguaauuuaugauucgaaauuugaaaagcaacugggucagguuaugcuuuuaguguuaugugcaguucaacuccuauuaaugcgaaccucuugggcgcuaugugaagcuuuaacauuggccacgggucccauuacuacucuaugggaagguagccccggaaaguuuuggaacacgaccauagccguuucaauggcaaauauuuucaggggaaguuaccucgccggagcaggcuuggcguucucaauaaugaaaagcguugguaccggcaaacgagguacgggaucgcagggugagacauugggggagaaauggaagaggaagcuaaaucagcuaucaagaaaagaauucgaucuauauaaaaaauccggaauaaccgaaguagauaggacagaagcgaaagaaggacuaaagcgaggugaaauaacacaucaugcuguaucgcgaggaucagcgaaguuacaaugguuuguugagcgaaauauggucauaccagaaggacgugucaucgacuuagguuguggccgaggaggauggagcuauuacugugcgggguuaaagaaagugacugaggucagagguuacacgaaaggaggcccgggacaugaagaacccguacccaugagcaccuauggcuggaauauuguuaaacuaaugucagguaaggaugucuucuaccuuccaccugaaaaaugcgacaccuuacucugugacauuggagagucuaguccuucgccaaccguugaagaaagucgaacaauacgaguauuaaaaaugguagaaccaugguuaaaaaacaaucaauucuguauaaaagucuugaacccauauaugcccacgguaauagagcaucucgaacgucuacaacguaagcauggaggcaugcuaguacgaaauccacuaucucguaauucaacgcacgagauguacuggauaucaaacgggacaggcaacaucguugcaucaguuaauaugguuagucgucuucuccuuaaucgauuuaccaugacgcaccgaagaccaacaauagagaaagauguagaucugggcgcaggaacaagacacguuaaugcagaaccagaaaccccaaauauggauguuaucggggaaagaauuaaaaaaauaaaagaagaacauaacucaacguggcacuaugaugaugagaacccuuacaagacaugggcuuaucacgggagcuaugaagugaaagcuacugggagcgcuagcuccaugauuaacgggguuguaaaauuguugacaaaacccugggaugucgugccuaugguuacucaaauggcaaugaccgacaccaccccguuuggacaacagaggguguucaaagaaaaaguagauacaaggacuccucguucuaugcccgguacacgucgugugauggaaauuacugcagaauggcucuggcggacgcucggucguaacaaaaaaccaagauuguguacuagagaggaauuuacgaaaaaagucagaacaaacgccgcuaugggagccgucuucacagaggagaaucagugggauucagcaaaggcggcaguugaagacgaggauuucuggaaguuaguagacagggagagagaacuacacaaauuaggaaaaugcggaaguugcgucuauaauaugaugggaaagcgagagaagaaauuaggugaguuuggaaaagcuaaggguaguagggcaauaugguacauguggcucggcgcuagauaucuugaauucgaagcucucggcuuuuuaaacgaagaccauugguuuagcagagaaaauagcuauagcgguguugaaggggaaggacuucacaaacuagguuauauacucagggauauaucgaaaauaccaggaggugcaauguacgcugacgacacagcgggaugggauacacgaaucacugaggaugaucuacacaaugaagaaaagauuacgcaacaaauggacccugagcacagacaacuggccaacgcuauauucaaacuaacuuaccaaaacaagguggugaaagugcaaagaccgacacccacuggcacuguaauggauauaauaagucggaaagaccaacgagguucuggccaagugggaaccuacgggcugaauaccuucacuaauauggaagcccaguuaauacgacagauggaaggugagggggugcuguccaaagccgaccuagaaaacccgcaucuacccgaaaaaaaaauuacacaaugguuggaaaccaaagguguggaacgucuuaaaagaauggcuauuucaggugaugacugcgugguaaaaccuaucgaugauagauuugcaaacgccuuacuagccuuaaaugauaugggcaaggucagaaaagauauuccacaauggcaaccaaguaaaggguggcaugacuggcaacaaguaccuuucugcucucaccauuuucaugaauuaaucaugaaggaugggagaaaauuaguuguuccauguaggccucaggacgaauuaaucggaagagcacgaauaagccaaggggccggguggucacugagagaaaccgcauguuugggaaaagcauacgcucaaauguggagcuuaauguacuuucauagaagggaccuaaggcuugcgucuaaugcaauuugcucugcaguacccguucauuggguaccaacaucuagaacuacuuggucaauacacgcacaccaucaauggaugacuacagaagauauguuaacgguauggaacagaguuuggauagaagauaacccuuggauggaggauaaaacaccuguaacaacaugggaaaaugugcccuaucugggaaaaagagaggaccaauggugcggaucgcuaauuggcuuaacuaguagagcaacuugggcacagaauauaccuacagcaauacaacaaguucggagucuuauuggcaaugaagaauuucuagauuauaugccuaguaugaaaagauuuagaaaagaagaagaaagcgaaggagcaauaugguag

SEQ ID NO: 23063 - RNA, 9873 nt, Artificial Sequence
  derived and/or modified CDS sequence (opt6) from DENV-3__GU131862__SS-prME
accagucugugcuugguaaugauauuaccagcagcucucgcguuccaucuaacaucccgggacggggaaccuagaaugauaguuggcaaaaaugaacgggguaaaagucuucuuuucaaaacggcaucaggaaucaacaugugcacauuaauugcaauggaucuaggagaaaugugugaugauacaguuacauauaaaugcccucacaucacagaaguugaacccgaagacauugauuguuggugcaaucuaacgagcacguggguaacauacgguacgugcaaucaggcaggagaacguaggagggauaaaagauccgucgcgcuagccccucacgucggaaugggauuagauacucgcacacaaacauggauguccgcagaaggugcguggagacaaguggaaaaaguggaaacaugggcacucaggcauccagguuuuacuauucuugcauuauuccuagcacauuauauaggaacaagucuaacccaaaaaguaguaauauuuauauuauuaaugcucgugacacccucuaugaccaugagaugcguaggugugggaaaccgugauuucguugaaggauugucaggagcuacauggguagaugucguguuagaacacggcggcugcguaacaacaauggccaaaaauaaaccgacccuagacauugaacuucagaaaacagaagcaacacaacucgccacacugagaaaauuaugcaucgaagguaaaauuaccaauauuacaacagauagucgguguccgacccaaggagaagcuguucuuccugaagaacaagaucaaaauuauguauguaaacauacguauguggaucggggauggggaaacggauguggguuguucggaaaagguucauuggucacaugcgcaaaauuccaaugccuugaaccaauagaagggaaagucgugcaauaugaaaauuuaaaauacacuguaauaaucaccguacacaccggugaccaacaccaaguaggaaaugaaacucaaggaguaacggccgaaauuacuccgcaagcauccacaaccgaagccauuuuaccugaauacgguacuuuaggacuagaauguucaccccggacagguuuagauuucaacgaaaugauauuacuuacaaugaaaaauaaagcauggaugguccauagacaaugguucuuugauuuaccacuaccauggacgucgggagcuacaacagaaacuccgacauggaauagaaaagaacuuuuaguuacuuuuaaaaacgcacacgccaagaaacaagaaguagucguccugggaucccaagaaggcgccaugcacacagcuuuaaccggcgcuacagaaauccaaaauucaggagggacaucaaucuucgcaggacacuuaaagugucggcuaaaaauggauaaauuagaauugaagggaaugucauaugcuauguguacaaauacauucguauugaagaaagaaguaucugaaacccaacaugguaccauucuuaucaaaguagaauauagaggagaggacgcaccauguaaaauaccauucuccacagaagacggucaaggaaaagcucacaacgguagauugaucacagcuaacccaguugucauuaaaaaggaagaacccguaaauauagaagcggaaccuccauucggagaaagcaauauugucauagggauaggcgacaaugcgcugaaaauaaauugguacaagaaagggucaucuaucggcaaaauguuugaagcaacugcgcguggagcgcggcguauggcaauacuuggcgacacggcuugggacuucgguuccguaggaggaguucuaaauuccuuagguaaaaugguucaccaaauauuuggaucggcuuauacagcccuauucagugguguaucuuggguuaugaaaauuggaauaggcauuuugcuuacuuggauagguuuaaauaguaaaaacaccucaaugucauuuuccugcauagccauugguauuauuaccuuguacuuaggggcgguuguucaagcagacauaggaugcgugauaaauuggaaagggaaagaauuaaaaugugguagugggaucuucguaacaaaugaaguucacacuuggacagaacaauauaaauuccaggccgacucuccuaaaagacuugccaccgccauagcaggcgcuugggaaaauggagugugcggaauaagaagcacuacacgaauggaaaaucucuuauggaaacaaaucgcgaacgaacucaacuacauauuaugggaaaauaacauaaaguugaccguaguugucggagacauaaucggagugcucgagcaaggcaagaggacguuaacaccgcagccaauggagcucaaguauucauggaaaaccuggggaaaagcaaagauaguaacagccgaaacgcagaauagcagcuuuaucauugacggucccaacacgccggaauguccuucagcaagccgggcguggaauguuugggagguggaagauuacggauuuggaguauucacaacuaauaucugguuaaaauuaagagagguuuauacucaauugugcgaccacagacucaugucggcugcaguaaaagacgagagagcaguacaugcugauaugggcuauuggauugagucgcagaaaaaugguaguuggaaacuggaaaaggcgucucugauagaaguaaaaacauguacauggcccaaaucacacaccuuguggucuaaugguguguuggaaagugauaugauuauaccgaaaagccuugcgggaccaauaucucaacacaaccaucguccuggauaucacacacagacagcagguccauggcacuuaggcaagcuggaauuagauuucaauuacugcgaggggacaaccguuguuauaacggagaacugugggacaaggggaccgucucuccgaacuacaaccguaagcgggaaauuaauacacgaaugguguugccgcaguuguacacuaccgccauuacguuacaugggugaagaugguuguugguauggaauggagauaaggcccaucucugaaaaagaagagaauauggucaagagcuuagugucagcaggcucggggaaaguagauaauuucacuaugggcguuuuaugucuagcgauucuauuugaggaaguaaugagagguaaauuugggaagaaacacaugauagcuggaguuuucuuuacuuuuguucuacucuugagcgggcaaaucacguggagagauaugacacauaccuuaaucaugauagggucaaacgcaagcgauagaaugggaaugggggugacauauuuggcguuaauagcaacuuuuaaaauucaacccuuuuuagcauuaggguucuucuuacgaaaacugaccucacgcgaaaaucuuuuacucggcguaggauuagcaauggccacaacacuacaauuaccugaagauaucgaacaaauggccaauggaaucgccuuaggacuuauggcucucaaacuaauaacccaguucgaaacuuaccaguuguggacugcuuuaauuucccuaacuugcaguaacacgauguucacauuaacagucgcuuggaggacagccacacuuauacuagcugggguaucccuacuaccagucugccaaaguucaaguaugcgaaaaacagacugguuacccauggccguagcugccaugggcguucccccauuaccuuuguuuauauuuucacuaaaagacaccuugaaaagaagaucuuggccguugaaugagggagucauggcaguaggcuugguaaguauuuuagcauccucauuacuacggaacgauguuccaauggcagguccucugguagcugguggccugcucauugcauguuacgugauaacgggaacgagcgcagauuuaacaguugaaaaagccgcagauauuaccugggaagaagaagcagaacaaacgggggugucucauaaucuuaugauuaccguggacgacgaugguacuaugcggaucaaagaugaugagacagagaauauucucacugugcuauugaagacagcgcuucuuauaguaucaggaguuuuccccuacucaauaccagcuacucucuuaguauggcauaccuggcaaaaacagacccagagaucuggcguucuaugggauguuccaaguccuccagaaacucaaaaagcagaacuagaagagggaguuuacaggauuaaacaacaagguauuuuuggaaagacccaaguuggugugggaguacaaaaagaagguguguuucauaccauguggcauguuacaaggggagcugucuuaaccuacaauggaaaacguuuagagccaaauugggcuagcguaaagaaagaucucauaucguaugggggcgguuggagacuuagugcucaauggcaaaaaggcgaagaaguacagguaauagcuguugagccuggaaagaaucccaagaauuuucagacuaugccaggcaccuuucaaacgacaaccggcgaaauaggagcaauagcucuagauuucaaacccggaacgucugguucuccuaucaucaacagagagggaaaaguggucggacucuauggcaauggcguaguuacuaaaaauggaggauacgugucaggaauagcccagacaaaugcagaaccagauggucccacaccagaacucgaagaagaaauguuuaagaaacgaaauuuaacuauaauggaucugcacccaggaucagguaagacuagaaaauauuuaccugcuauaauuagagaggccaucaagcgaagauugcgaacuuuaauacuagccccuacaagggugguagcagcggaaauggaagaagcacuaaaaggcuuaccgauacgcuaccagacuacugcuacaaaaagcgaacacacuggucgagaaauugucgaccuuaugugccaugcgacuuucacgaugcgauuauugaguccagucagaguacccaauuacaaccucaucauaauggacgaggcgcacuuuacagacccagcaaguauagcagcccgaggauauauauccacuagggucggcaugggagaagcagcugcuauuuucaugacggccacacccccagguacagcugacgccuucccgcagucaaaugccccaauacaagaugaggagagagacauaccagaacgauccuggaacucgggaaaugaguggauaaccgauuuuguggguaaaaccgugugguuuguucccagcauaaaggcaggaaacgacauugcuaacugccuucguaaaaacgggaagaaaguaauacagcuaucaagaaagacguucgauacagaauaucagaaaacuaaauuaaacgacugggacuucguagugacaacggacauaucagaaaugggggcaaauuuuaaggcugacaggguuauagacccgaggagaugucuaaaaccgguaauauuaacugauggaccggaacguguaaucuuagcaggaccaaugccaguaacugcagcuagcgcggcacaacgaagaggucgaguuggacgcaacccucaaaaggaaaaugaucaauauauuuucacaggucaaccacuaaauaaugaugaagaccacgcucauuggacagaagccaaaaugcuguuagauaacauaaacacacccgaagguauaauuccugcccuauuugagccugaacgggagaagucagccgcuaucgacggggaauauagacucaaaggagaaucaagaaaaacauuuguugaacucaugagaagaggugaucuaccggucuggcuagcucauaaaguggcuucagaaggaaucaaguacaccgacagaaaauggugcuucgacggucaaagaaauaaccaaauauuagaagaaaauauggacgucgaaauauggacaaaagagggugaaaagaagaaacucagacccagaugguuagacgcgcgaacguauucagaucccuuggcacuaaaagaguucaaagauuucgcagcagguagaaaaucaauaacucuugaucuaguaacggaaauagguaggguuccuucgcaccucgcccaucguacaagaaaugcucucgacaaccuaguuauguugcauacaucagaacauggagggagggcauaucgacaugcaguagaagaacuaccagagacuauggaaacccugcuacuucuaggacuaaugauuuuauuaaccggaggagccauguuauuuuuaauuucagguaagggaauaggaaagaccuccauuggacuaauaugugucauagcuucgucaggcaugcucuggauggcagagauuccacuacaauggauagcaucugcuauaguacucgaguucuuuaugaugguacuuuugauaccggagccagagaagcagagaacaccacaggauaaccaacuugcguauguuguuauugggauauuaacauuagcagcaauuauagcagcaaacgagaugggacuuuuagaaacaacgaaaagagaucuaggcaugaguaaggaaccaggaguaguuagucccaauucauaucuggauguagacuugcauccagcuagugcauggacacuauacgcaguugccacgacaguaauuacaccaauguuacgucauacuauagaaaacagcaccgcaaauguaucauuagcugcuaucgcaaaucaggcuguaguacucaugggacuugauaagggguggccgauaucaaaaauggacuuaggaguaccccucuuagcuuuaggguguuauucccagguaaauccgcucacauuaaccgcugccguuuuacuacuuauaacacacuacgcgauaauuggaccagguuugcaggcgaaggcaacuagagaagcgcagaagagaacugcagcaggcaucaugaaaaauccaacaguugacgguauaaugacgaucgaucuagauccgguuauuuaugauuccaaauuugaaaaacaauuggggcaaguaaugcugcuggugcuaugcgcaguucagcuucuucucaugcgaacaagcugggcacugugcgaagcacugacuuuagccacaggucccauaacaacacuaugggagggcuccccugggaaauucuggaacaccacuaucgcgguaucaauggcaaacaucuuuagaggcaguuaucuugcuggugcgggucuagcauucuccaucaugaaaucugugggaacugguaaaaggggaacugguucucaaggugaaacgcuuggagaaaaauggaagaagaaacuaaaccaauuaagucguaaagaguucgaucuuuauaagaaaagcggcauuacugaaguugaccgaacagaagcuaaggagggucuaaaaaggggcgagauaacgcaucaugcgguaucacggggcucugcaaagcuccagugguucguagaacguaacaugguaauucccgaggggcguguuaucgaucuagguugcggaagaggaggguggagcuauuacugugccggccuaaagaaaguaacugagguaagaggauauacuaaaggcggaccuggccaugaagaaccuguaccaaugucgacuuauggguggaauaucgugaaacuaaugaguggaaaagauguguucuaucuacccccagaaaaaugugauacauuacuaugugauauuggagagagcucuccaucccccacgguugaagagagccgcaccauacguguauuaaagauggucgagccauggcuuaaaaauaaccaauuuuguauaaaaguucucaaccccuauaugccaacagucauagaacaccuggagagguuacaaagaaaacauggcgguaugcugguaagaaauccucuuaguagaaacucuacacaugagauguacuggauaucgaaugguaccgguaacauaguggccucuguuaauaugguaucccgcuuacuacuaaaucguuuuacaaugacccaucgaaggccuaccauagaaaaagaugucgaucuaggagcuggcacuagacacguaaacgccgagccagaaacgccgaacauggaugugauaggagagagaauaaaacgaauaaaagaagaacacaauaguacauggcauuacgaugaugaaaauccauauaaaacaugggcguaccacggcuccuaugaaguaaaggccacugguuccgccucuuccaugaucaauggcguaguaaaguuguugaccaaaccuugggacguuguuccuaugguuacccagauggcuaugaccgauacaacaccauuuggacaacaaagaguguuuaaagaaaagguggauacaagaacaccacgguccaugccgggaacacguagaguaaugggcauaacugcagagugguuauggaaaacuuuaggacgaaacaagaaaccacgucuuuguaccagagaagaauuuaccaagaaagugaggacaaacgccgcuaugggugccguauuuacagaagaaaaucaaugggacucugcuaaggcagcuguggaagacgaagacuuuuggaaauuaguagaucgagaacgugaacuacauaaauuagggaagugcggaucaugcguuuauaacaugauggggaaaagggagaagaaacuaggagaguucggcaaggcuaaggguucacgcgccauaugguauauguggcuaggugcuagauaccucgaguucgaggcguugggguuucuuaacgaagaccauugguuuagcagggaaaauucauauaguggaguagagggagaaggcuugcauaaacuagguuauauacuacgagacauuagcaaaauaccuggaggagcuauguaugcugacgacacggcaggaugggauacuagaauaacagaagacgaucuucauaaugaagagaaaauaacgcaacaaauggauccagaacauaggcaauuagccaaugcgauuuucaaauuaacauaccaaaauaaaguggucaagguacaacgcccuacucccaccgguacaguaauggacauuauaucgagaaaagaccaacgagggagcggacaaguagguacuuacggacuaaauacuuuuacaaauauggaagcucaacugaucagacaaauggaaggugaaggaguauuaucuaaagcugaucuagagaauccgcauuugcccgagaagaaaauaacgcaguggcuggaaacuaaggguguagagcgguuaaaaagaauggcaauauccggggacgauugugucguaaaaccaauagacgacagauuugcgaacgcauuguuggcccugaacgauaugggaaaagucagaaaggauauaccgcaguggcaaccuaguaaaggauggcaugauuggcagcaaguuccauuuuguagucaccauuuccaugaauuaauuaugaaagauggaagaaagcuaguuguuccaugcagaccccaagacgaauuaaucggacgugcaagaauuagucaaggggcgggcuggucauuaagggaaacagcaugccuagguaaagccuacgcacaaauguggagccuaauguauuuccauaggagagauuugaggcuagcaaguaaugccauaugcucagcugugccaguacacuggguaccuaccaguagaaccacauggucaauccaugcacaucaucaauggaugacuacugaagacaugcucaccguauggaacagaguuuggauagaagauaauccauggauggaagauaagacuccuguuacgaccugggagaaugucccauaucuugggaaacgagaggaccaaugguguggcuccuuaauagguuuaacuuccagagcgacuugggcacaaaauauaccuacugcaauucaacaagugcguucacuuauaggaaaugaggaguucuuagauuauaugccuagcaugaaacguuuuagaaaagaagaagaaucagaaggcgcaauaugguga

SEQ ID NO: 23064 - RNA, 9873 nt, Artificial Sequence
  derived and/or modified CDS sequence (opt6) from DENV-3__GU131865__SS-prME
acgucccuuugucugguuaugauccugccagcugcauuagcguuccaucucacaagucgugauggagaaccucgcaugauagugggcaaaaacgaaagaggaaaaucauuauuauuuaaaacugcaucaggaaucaauauguguacgcuuauagcgauggaccugggugaaaugugcgaugauacagucacuuacaaauguccacauauaacggaaguugaacccgaagacaucgauuguuggugcaaccugacaaguacgugggugaccuacgguacaugcaaucaagcaggagaaagaagaagagauaaacguucaguagcuuuagccccacaugucggcauggggcuugauacaagaacccaaaccuggaugagugcagaaggagcuuggaggcaaguagaaaaaguagaaacaugggcucuaaggcauccaggcuucacaauacuugcauuauuccuugcccacuauauagggacaaguuuaacacaaaaaguuguuauauuuauacuacuaaugcuaguuacaccaucgaugaccaugcggugugugggaguuggaaaucgugacuuuguagaaggacuuaguggagcaacuugggucgacguuguuuuggaacacgguggauguguaacaaccauggccaaaaacaaaccaaccuuggauauagaacugcagaaaacugaagcaacgcaacuagcaacacuaagaaaacucuguauagaagguaaaaucaccaacauaacuacugacucacguugcccaacgcaaggagaagcgguucuaccagaagaacaagaucaaaacuaugucuguaaacauacauauguagauagggguuggggaaaugguuguggauuauuuggcaaagggucuuuaguaacuugcgcgaaauuccaaugccuugagccaauagaaggaaaagugguccaauacgaaaacuuaaaauacaccgucauaauaacuguacauacgggcgaccaacaccaagucgguaacgaaacacaaggggucacggcugagaucacgccacaagcaagcacaacagaagcaauccugcccgaguacgggacuuuagggcuggaaugcucaccccgaacugguuuagauuuuaacgaaaugauacuauuaacgaugaaaaauaaagcauggaugguucaccgucaaugguucuuugacuugccucuccccuggacgucgggcgcgacgacagaaacaccaacuuggaauagaaaagaacuauuaguuacauuuaaaaaugcccaugcuaagaaacaagaagugguuguucuuggaagucaagaaggagcaaugcauacugcgcuuacaggggcaacggaaauacaaaauucuggagguacaucaauauucgcgggacaucuuaaaugcaggcucaaaauggauaaacuagaacuaaaagggaugucauacgcaauguguaccaacaccuucguguuaaagaaagaggucuccgaaacucaacacgguaccauauuaaucaaaguugaguacaggggugaagaugcaccauguaaaaucccguuuucuacagaagauggucaagggaaagcgcacaacggaagacugauaacugcgaacccaguuguuacaaagaaagaagaaccuguaaauauagaggcagagccacccuuuggugaaucaaauauuguaauaggaauaggagauaaugcucuaaaaauaaacugguacaagaaaggaaguaguaucgguaaaauguuugaggcuacagccagaggagcucgacgaauggcuauauuaggagauacugcuugggauuuuggguccguaggcggcguacucaauagucuagggaaaauggugcaucaaauuuucgguagcgcauacacagcauuauucuccggaguaucaugggucaugaaaauuggaaucggcauauuacuuacguggauaggccuuaacaguaaaaacacaaguaugagcuucucguguaucgcuauagggaucauuacuuuauaccuaggugcaguugugcaagcagauauggguuguguaauuaauuggaaaggaaaggagcucaaaugugggaguggcauuuuuguaaccaaugaaguccauacuuggacugagcaauacaaguuccaagcagauucaccaaaaagguuagcaaccgcuauagccggugcaugggaaaacggaguaugugguauaaggucuacaacuagaauggaaaaccuucuuuggaagcaaauagcaaacgaauuaaauuacauacugugggaaaacaauauaaaguugacagucguuguuggugauauaauugguguauuagagcaggguaaaaggacccuaacaccccagccaauggaacuaaaauacaguuggaaaacguggggaaaagcuaagauaguuacagcagaaacacaaaauaguagcuucauuauugacggcccaaacacaccugagugcccuagugcaucaagagcuuggaauguaugggaaguugaagauuacgguuuuggugucuucaccaccaauauaugguugaaguuacgagaaguauacacucaacucugcgaccauagguuaaugucagcggccguuaaggaugagagggcaguacaugcagacauggguuacuggauugagucucagaaaaauggcucauggaaacuagagaaggccagucuuauugaaguaaaaacauguacauggccaaaaucucauacccuaugguccaacggcguauuggaauccgauaugauuauacccaagaguuuagcaggcccaauaucccagcacaaucauagaccgggcuaucauacucaaacugcagggccauggcauuuaggaaaguuagaacuagauuuuaacuauugugaaggaacuacagucguuauaacagaaaauuguggaacaagaggaccuucguuaaggaccacaacugucagcgguaaacuuauccacgaaugguguugccgauccuguacgcuacccccguuacgauauaugggugaagacggaugcugguauggcauggaaauccgccccauaucggagaaagaagagaauaugguaaaaaguuuaguaucugccggaucagguaaaguugauaacuucaccaugggagucuuauguuuggcaauucucuuugaggaggucaugcgcggaaaguuugguaagaaacauaugauagccggcguuuucuucacauuugucuuauuguugaguggucagauuacauggcgagacaugacucacacccucauaaugaucggaucaaacgcaagcgauagaaugggaaugggaguaacauauuuagcacuaauagccacauuuaaaauccaaccauuuuuagcacuuggauucuuucuaaggaaauuaaccucgagggaaaauuuauuauuaggcguaggauuagcgauggccacgacacuacagcuuccugaagauauagaacagauggcuaacgguauugcucucgguuuaauggcuuugaaacuaauuacucaauucgaaacauaccaauuguggaccgcacuaauuucucucacaugcucuaacacgauguucacacuaacugucgcauggcgaacagcuacucuaauccuagcaggaguuagccuguuaccuguuugucagucuagcagcaugcgaaaaacagauugguuaccuauggcaguugcagcuauggggguaccgccguuaccuuuguucauauuuaguuuaaaggauaccuuaaagcgacguucauggccacucaacgaaggagugauggcagucggguuaguaucgauauuagcuagcucccuuuuaaggaacgaugugccuauggcaggcccguuaguggcaggaggauuacuuauagcauguuauguaauuacgggcacaagugcagauuuaacaguagaaaaagcagccgacauaaccugggaggaagaggcagaacaaacagguguaucccacaaccuuaugauaaccguugacgaugacggaaccaugcgaauuaaagaugaugagaccgagaauauacuuacaguauugcuuaagacugcccucuuaauaguaucgggagucuucccuuacagcauaccugcuacacuauuaguauggcauacguggcaaaaacagacacaacgaaguggaguguugugggacguucccaguccaccugaaacacaaaaagcagaacuggaagaagguguuuaccgaauuaagcagcagggaauauuuggcaaaacucaagugggugugggcguucaaaaagaagggguguuucauacuauguggcauguaacucggggcgcaguuuuaacauauaaugguaaaagacuagaaccuaauugggcaaguguuaagaaagaccuaauaucuuacggagguggauggagacucucggcgcaauggcaaaaaggugaagaaguacaaguaauagcagucgaacccgguaaaaaucccaaaaauuuucaaacaacuccaggcaccuuccagaccacgaccggagaaauaggggcuauagcccuugacuucaaaccagguacaaguggaucccccauaauuaaccgugaaggcaagguaguggguuuauacggaaauggaguagucacaaagaaugggggcuauguaagcggaauagcacaaacaaaugccgaaccggaugguccaacgccagagcuggaagaagaaauguucaagaaaaggaacuuaacaauaauggaucugcacccuggaagcggcaaaacaagaaaauacuugccagcaauaauaagggaggcgauuaaacgccgauugcguacauugauauuggccccgacacgaguuguggcagcagagauggaggaggcuuuaaaaggacuaccaaucagauaucagacuacugugacgaaaucagaacauacuggaagagaaauuguagaucucaugugucacgcaaccuuuacgaugagguugcuaucccccgucagagucccaaacuauaaucucauaauuauggaugaagcacauuuuacagauccugcuucuauugcagcgaggggauauauaucuacucgcguagggaugggggaagcugcagcuauauucaugacugcuacacccccaggcacagcagaugccuuuccccaaucuaacgcaccaauacaggaugaagagagagauaucccagagcgguccuggaacuccgguaaugaauggauuacagauuuugcuggaaaaacaguaugguucguuccuucuauaaaagccgggaaugauauagcuaacugccuucguaaaaaugguaagaaagucauacaacucaguagaaagacauuugacacagaguaccagaaaacuaaauugaaugauugggauuuuguagucaccacugauauaucugaaaugggcgcuaauuuuaaagccgacagaguaauagauccacgacgcugccuuaaaccagugauacuuaccgacggccccgaaagagucauucuugcaggaccgaugccuguuacagcggccagcgcggcacaaagacgugggcgaguaggaagaaauccacagaaagaaaacgaucaauauauuuuuacuggucagccguuaaacaacgacgaagaccaugcucacuggaccgaggcaaaaaugcuucuugauaacauaaacaccccagaaggcauuauuccggcguuauucgaaccggagcgagaaaaaucagccgcuaucgauggcgaguaucgauugaaaggugagaguagaaaaacuuuuguugaacugaugagaagaggugacuuaccaguauggcuggcgcacaaaguagcuucagagggaauaaaguacacagacaggaaauggugcuuugacggacaacgcaauaaccaaauccuugaggagaauauggauguagaaauauggacaaaagaaggggagaagaagaaacuaaggccaagauggcuagacgccaggacguauuccgacccguuagcucugaaagaauuuaaagauuucgcagccggcagaaaaaguauagcucuagaccuuguuacugagauagggcguguacccucacaucuagcacauagaacacguaaugcuuuagauaauuuagugauguuacacacaagugaacacggcggucgagcuuauagacaugcaguugaagaauuaccggagacaauggagacguugcucuuacugggucuaaugauuuugcuuacugguggggcgauguuauuucugauuagcggaaaagguauagguaaaacaucuauuggguuaauuugcguuauugccaguucaggaauguuguggauggcagaaauuccauuacaauggaucgcaucagcuguaguguuggaauuuuucaugaugguacuucuaauucccgaaccugagaagcaaaggacuccacaggauaaucaacuagccuauguaguaauuggcauccuaaccuuagcugcuauaauagccgcaaaugaaaugggcuuauuagaaacaacaaaacgagacuuagguaugagcaaggaaccuggcguuguaaguccaacaagcuaccucgauguggacuuacacccggcaagcgcauggacacuauaugcaguagcaacaaccguuauaacaccuauguugagacacaccauugaaaacaguacggcaaacgucagucuugcagcaauugcaaaccaggcagucguuuuaaugggacuggauaaaggcuggcccauaucaaagauggauuuagguguaccauuacuagcauuaggaugcuauagucaaguuaacccauugacacucacggcagcugucuuauugcuaauaacacauuaugcuaucauuggcccuggccuacaagcuaaggccacaagagaagcgcaaaaacgaacggcagcaggcauuaugaagaacccuacaguugacggcaucaugacaauugauuuagacccagucauauacgauucuaaauuugagaaacaacuuggacagguuaugcuuuugguccuaugugccguccaacuacuauuaaugcggacaucaugggcucuuugugaagcacucacacuagcaacggggccuauuaccacuuugugggaaggcucuccuggcaaauuuuggaauaccacgauagccguaucaauggcuaacaucuuucgugguagcuacuuggcaggagcaggucuugcauuuucaauaaugaaaaguguagggacggguaaaagggggacgggaagccaaggggagacuuuaggagaaaaguggaaacgaaaauugaaucaauuaucccguaaagaguucgaccuauauaagaaaucugguauaacagagguggaucggacggaggcgaaagagggccucaaaagaggcgagauaacccaccacgcuguaagccgaggaucugcaaaauuacagugguuuguggagaggaauauggugauaccagagggucgagugauugaucuagguuguggacggggaggcuggagcuauuacugugcuggucuaaagaaaguaacagaaguccgcggauacaccaagggcgguccuggacaugaagaaccugucccgaugucaacauacggguggaacauagugaaacuaaugaccggaaaagauguauuuuauuuaccaccggaaaaaugugacacuuuacuuugcgauauuggagaaaguucuccaagcccaacgguagaagaaucgcgaacuauacgaguacuuaagaugguugaaccuugguugaaaaacaaccaauucuguauuaagguauuaaacccauauaugccuaccguaauugaacauuuagaacgacugcagcgaaagcacggcggaauguuaguccguaauccucuuucacguaacucgacacaugaaauguacuggaucaguaaugguacuggaaauauaguagccucuguaaacaugguuagucguuuacuacucaaucgcuuuaccaugacacaucgucgcccuacgauagaaaaggacguugaccuuggugcaggaacccgccaugucaaugcggaaccugaaaccccaaacauggaugucauuggagaacgaauuaaacguauaaaagaagaacacaacucaacuuggcauuacgaugacgagaauccauacaaaacgugggcguaucaugggagcuacgagguaaaggcaacgggaagcgcgucuagcaugauuaacggugucguuaaacuuuugacuaaaccgugggaugucguuccaaugguaacccaaauggcuaugacugauacgacaccuuuuggccaacaaagaguguuuaaagaaaaaguggacacgaggacccccaggagcaugccagguacaagaagaguaauggaaauuacagcugaauggcuauggcguaccuuagguaggaauaagaaaccaagacuauguacaagggaggaguucaccaagaaaguuagaacaaacgccgcaaugggagcaguauuuacagaagagaaucagugggauucagcgaaagcggcaguugaagacgaggauuuuuggaaauuaguugaccgagaacgugagcuucauaaguuaggaaaaugcgggucuuguguuuacaauaugaugggaaaaagagagaagaaacuaggagaauuugguaaggcuaaagggagcagagccaucugguauauguggcugggugcucgauacuuggaauuugaggcauuaggcuuccuaaacgaagaccauugguucaguagagaaaacucguacucugggguggagggggaaggacuucauaaauugggauauauacuaagagacauuuccaaaaucccugguggugcaauguacgcggacgacacugcaggaugggacacgcgaauuacggaagaugaucugcauaaugaagagaaaauaacucaacaaauggaucccgaacaucgucagcuagcuaaugccaucuuuaaauuaacguaccaaaauaaaguaguaaaaguacaacgaccaacaccaacaggaacugugauggauauuaucucaagaaaagaucagagagggucagggcagguugggacauauggcuuaaacaccuucacgaacauggaaguccaacuaaucagacagauggaaggagaaggcguucugucaaaagcagaucuagaaaacccucaucuuccagaaaagaaaauuacucagugguuggaaacuaaagguguagagcgacuuaagagaauggcaauaucaggugaugauuguguaguaaaacccaucgaugacagguucgcaaaugcauuacuagcacuaaaugauauggguaaaguccguaaagauauaccacaguggcaacccucuaaagguuggcaugacuggcaacaaguaccuuuuugcagucaucauuuccaugaauugaucaugaaagacgguaggaaacuuguaguucccuguagaccgcaggacgaauuaauaggaagggcaaggauaucacaaggugcaggguggucgcuccgagaaacugcaugcuuaggaaaggcuuaugcgcagauguggucauuaauguauuuucaucggagggaucuucgccuggcaucaaaugcaauaugcagugcaguucccguacauugggugccuacaucucgcacgacauggaguauacaugcccaccaccaguggaugacaacggaggacaugcucacagucuggaaucggguuuggauagaagauaauccauggauggaggacaagaccccuguuacuaccugggaaaacguaccauaucuugggaaaagagaagaucaauggugugggucuuuaauaggucuaacaucccgagcaacaugggcacaaaauauuccaacggcuauacaacaaguacguagucugauuggcaaugaagaauuucuagacuauaugccaagcaugaaaagauucagaaaagaggaagagagcgaaggagcaauaugguaa

SEQ ID NO: 23065 - RNA, 9873 nt, Artificial Sequence
  derived and/or modified CDS sequence (opt6) from DENV-3__GU131866__SS-prME
acgucucuaugucucaugaugauauuaccugcagcacucgcguuucacuuaacuagcagagauggggaaccacguaugauaguuggcaaaaaugaacgcgggaaaucauuguuguucaaaacagcgucaggaauaaauaugugcacauugauagccauggacuuaggagaaaugugugacgacacaguaacguauaaauguccacacaucacagaaguagaaccggaggauauugacuguugguguaacuugacuuccaccuggguuacguaugguacaugcaaucaagcuggugaacgacgacgagaucgucguucuguggcccuagcaccgcacguaggaauggguuuagauaccagaacacaaacauggaugucugcagagggugcuuggaggcaaguagaaaaaguagagacaugggcccugagacauccggguuucacaauacuugcauuguucuuagcacauuacauagguacaucccucacacaaaaagugguaaucuuuauucuccuuaugcuggucacaccuucuaugacgaugcgaugugucgguguaggcaacagggauuuuguugagggacucucuggcgcuacuugggucgauguugugcuugaacaugguggcuguguuacaacaauggccaaaaauaaaccgacgcuugacauagaacugcagaaaacagaggcaacucaauuagcaacacuacggaaacuuuguauagagggaaaaauaaccaauauuaccacggacucaaggugcccaacacaaggugaagcuguucuuccagaggagcaagaucaaaacuacguuuguaaacacacuuacguugaccguggcugggguaauggaugugguuuguuugggaaagggagccucgugaccugcgcaaaauuucaaugucuagaauuaauagaaggaaaaguaguucaauaugagaacuuaaaauacacagugaucaucacaguacauacgggcgaccaacaucaagucgguaacgaaacucaaggaguuacugccgaaaucacaccccaggcuucuacgacagaagccauccuuccagaauacggaaccuuaggauuagaauguucaccccggacaggauuagacuucaacgaaaugauccuguuaacuaugaaaaauaaagcguggaugguccaccgucaaugguucuuugaucuaccacucccuuggacaaguggcgcaacaacagaaacuccgacauggaaucggaaagaauuauuaguaacauucaaaaaugcucaugcuaagaaacaggaaguaguugucuuaggaagccaagaaggagcaaugcacacggccuuaacaggcgcgaccgagauacaaaacuccggaggaacuucaauauuugcuggccaccuuaaauguagacugaaaauggacaaauuagaguugaaaggaaugagcuaugcaaugugcacuaacacauucguacuuaagaaagaggucagugaaacccaacaugguacaauacuaauaaaagucgaauacaaaggugaagacgcgccaugcaaaaucccuuuuaguaccgaagauggccaagguaaagcccacaacggaagacuaauaacagcuaacccuguaguaacaaagaaagaagaaccagugaacauugaggcagaaccaccuuuuggggaguccaauauagucauaggcauuggugacaaugcacuaaaaauaaauugguauaagaaagguaguucgauagguaagauguuugaagcaacagcaagaggcgccaggcguauggccauuuugggugacacggccugggauuuuggauccgucggaggaguauuaaacucauuaggaaaaaugguacaucaaauauucggauccgcuuacacagcccuauucuccggagucucauggguaaugaagauagguaucggaguucugcugacauggauuggauuaaauagcaaaaauacaucgaugucauucuccugcauagcaauagggauaauuacguuauaccuaggagcuguggugcaagcugauaugggaugugugauaaauuggaagggaaaagaacugaaguguggaucgggcaucuucgucacgaaugaaguucacgcuuggacugaacaauauaaguuccaagcagacucaccgaaacguuuggcuacagcaauagcgggcgcaugggaaaaugguguuuguggaauaagaagcacaacaagaauggaaaaucugcuuuggaaacagauagcgaaugaacuuaacuauauucuaugggaaaauaauauaaaacuaaccguaguaguaggagauauuauuggcguguuagaacaagguaaaagaacacuaacuccucaaccuauggaacuaaaguacaguuggaaaacaugggggaaagccaaaaucgugacagcagaaacucaaaacagcagcuuuauuauagauggacccaauacuccagaaugcccuagugcuaguagggcauggaaugucugggaaguagaagauuaugguuucggaguuuuuacuacuaacaucuggcuaaaacugagggagguauauacacaauuaugugaccacaggcuaauguccgcggccguaaaggacgaacgagcaguccacgcagacaugggcuacuggaucgaaucacagaaaaacggaucuuggaaacuugaaaaggcuucguuaauagagguaaaaacguguacguggccaaagucgcauacacuuuggucaaacgguguucucgaaagcgauaugaucauaccgaaaagccuugcggggccuauaucacaacauaaucauagaccaggguaucacacucagacagcaggaccuuggcacuuaggaaaacuugaguuggacuuuaacuacugcgaggggacaacggucguaaucacugaaaauuguggcacucgcggcccaagucuaaggacaacgacaguaagugguaaauuaauccacgaguggugcuguagaagcugcacauuaccaccccuacguuauaugggagaagacggauguugguacggaauggaaauucggccgauaucagaaaaggaagagaacauggugaaaucuuuagugucugcaggaagcggaaaggucgauaauuucaccaugggcguccuaugucucgcuauucuauuugaggagguaaugagagguaaauucgggaagaaacauaugauugcggguguauucuuuaccuucgucuuacuguuaucaggacaaauaacguggagagauauggcucacacacugauaaugauaggcaguaaugcaucagaucgcaugggaaugggagucacuuaucuugcacucauagccacguucaaaauucaaccauuucuagcacuaggcuucuuucuuagaaaacugaccucacgagaaaaucuucuacuugguguaggucucgccauggcaacaacacuacaguugccugaggacauugagcaaauggcaaacggaauugccuuaggacuaauggcucuaaaacuuauaacucaauucgaaacauaucaacuuuggaccgcuuuaauuaguuuaacaugcagcaauacaauguuuacccugacuguagcguggcgaacagccacacuaauucuagcuggggugucacuuuugcccguaugucagucuucuaguaugcggaaaacagauugguuaccuauggcaguagccgcaauggguguaccgccguuaccuuuauucaucuucaguuuaaaagauacuuugaaaaggagaaguuggccucuuaaugaagguguuauggcaguagguuuaguaaguauucuggcaucuagcuuauugcgaaacgacguaccaauggcugguccacuuguagcugguggccuccugauugcaugcuacguaaucacagguaccagugcugaccuuacuguugaaaaagcugcugauauaacaugggaagaagaagcagagcaaacaggcguuucacauaaccugaugauaacaguagacgaugauggaacuaugagaauuaaagaugaugaaacagaaaauauacucacuguacuuuugaaaaccgcacuuuugauugugaguggcguguuuccuuacucaaucccagcgacauuacucguauggcauacuuggcagaaacaaacacaacgaucaggagucuuaugggacguucccucaccgccggaaacccaaaaggcagaguuagaagaggggguauaucggauaaagcagcagggaauuuuuggaaaaacucaaguuggaguagguguccaaaaagaaggagucuuccauacgauguggcauguuacacgcggggcaguauugaccuauaacgggaaacgauuagaaccuaacugggccuccgucaagaaagaucuuauaagcuacggcgguggauggcgccuaucagcacaguggcaaaaaggagaagagguacaagugauugcagucgaaccagguaaaaaucccaaaaauuuccagacaaugcccggaaccuuccaaacaaccacaggcgaaauuggagcaauagcauuggauuuuaaaccugggacaagugggucgccgauuauaaacagagagggcaagguagucgguuuauacggaaacggagugguaacuaaaaacggggguuacguuucagggaucgcgcaaacaaacgcggaaccagauggaccuacaccagaacuggaagaagagauguucaagaaacgaaaucuaaccaucauggacuuacauccaggguccggaaaaacacgaaaauaucuuccagcgauagucagagaagccauaaaaagaagauugcgcacauuaauacuagcuccgacacggguaguggccgcagagauggaggaagcguuaaaaggacuaccaauucguuaucaaacuacggcgacuaaaucggaacauacaggcagagagauagucgaucuaaugugccaugcaacuuuuaccaugagacuacuaaguccaguucgaguucccaauuauaaccugaucauaauggacgaagcccauuuuacggaucccgccucaaucgccgcgcgaggauauauaagcacaaggguggggaugggugaagcagccgcuauuuucaugacagccacuccaccggguacagcagaugcguucccacaaucuaacgcaccaauccaagacgaggaaagagacaucccugagcgaaguuggaacucgggaaacgaguggauaacugauuucgcuggcaagacagugugguucguaccuucgauuaaagccgguaacgauauugcuaacugccugcguaaaaacggaaagaaaguaauucaacuaucgagaaaaacguuugacacagaauaucaaaagacuaaguuaaacgacugggauuucgugguaacgaccgauaucucagaaaugggugcgaacuucaaagcggaccgaguaauagacccaagacggugucuuaaaccagucauauugacagacggaccagaacgaguaauauuagcuggcccuaugccgguuacugcugcgagcgcagcgcaacguagaggacgaguaggucggaacccacagaaggaaaacgaucaguauaucuuuacuggacaaccacuaaauaaugaugaggaccacgcacauuggacagaggcaaaaaugcuacuagauaacauaaauacgccugagggaauaauacccgcccuuuuugaaccagaaagagaaaagagcgcagcaauagauggcgaguacagacuaaaaggagagucacguaagaccuucguggaacuuaugcggaggggagaccuacccguuugguuagcucauaaaguagcaucagaggggaucaaauacacggaucguaagugguguuuugauggacagagaaauaaccaaauacuugaagaaaacauggauguagagaucuggacgaaggaaggugagaagaagaaauuaagaccgagauggcucgaugccagaacguauucugauccuuuagcauuaaaggaauuuaaggacuuugcagcgggaagaaaaaguauugcauuagacuugguaacagaaaucggacguguuccuucacacuuagcacacagaacuagaaacgcucuagauaaucucgucauguuacauacuucagaacacggcgguagagcauacagacacgccguugaggaacugcccgaaacuauggagacucuguuacuuuugggucucaugauccucuuaacugguggagccaugcuguucuuaauaucagggaaaggaauaggaaaaacuuccauuggguuaauuugugucauagcaucaagcggaauguuauggauggcugaaauuccucuacaauggauagcgucagcuauuguguuagaauuuuucaugaugguuuuauuaauucccgaaccagaaaagcaaagaacaccacaggauaaccaauuagcuuauguaguaauaggaauauuaacacuagcugcuauuauagccgcaaacgagaugggacuacuagaaacaaccaaacgugaucugggaaugucaaaagaaccaggaguugucuccccaaccucuuaucuugauguagacuuacauccugcaagcgccuggacccucuaugcaguagcaacaacuguaauaacaccaaugcuucggcauacaaucgaaaauagcacugccaauguaagucuugcagcaauugcaaaucaggcgguugucuuaauggguuuagauaaggguuggccuauauccaaaauggacuugggcgugccucuauuggcacuagguuguuauucucaagucaauccguuaacacuaacagcagcuguauuacuguuaaucacucauuacgcaauuauuggacccggcuuacaggcgaaagcaacccgagaggcucaaaaacgaacagcagcagguaucaugaaaaauccaacagucgaugguauuaugaccauugaucuugauccugugauauacgauucaaaauuugaaaagcagcuuggccaaguuauguuauuagugcuuugcgcuguacaauuguuacucaugcguacuucgugggcguuaugugaagcacuuaccuuagcgacaggaccuauaaccacacuaugggaaggaaguccuggaaaauuuuggaauacgacaauagcuguaucaauggcgaacauauucagaggaagcuacuuagccggugcaggcuuagcguuuucuauuaugaagagugucggaacaggaaaacgagggacaggaucacagggagaaacuuugggcgaaaaauggaaaaagaaauugaaccaauuaaguagaaaagaauuugacuuguauaagaaaaguggaauaacagaagucgaucguaccgaagcuaaagaaggacuuaaaagaggagaaauuacacaucaugccguaucacgagggagugcaaaacuacaaugguuuguugagcguaauauggugaucccagaagggcgaguuauugauuuggguugcgguagaggagguuggucauauuauugcgcugggcuuaagaaaguaacugaaguuagaggcuacacuaaagggggaccuggacaugaagaaccaguacccauguccacuuacggguggaauauuguaaaacuuaugucagggaaagaugucuuuuaucuuccucccgagaaaugcgacacacuucuaugcgacauaggagagucgucgcccucgccgacugucgaagagagucguacaaucagaguacuaaaaaugguagaaccguggcucaagaauaaccaauucuguauaaagguucuaaaccccuacaugccuacuguuauagagcauuuggaaagauuacaacgaaaacauggcggaauguuggugcgaaaucccuuaucaagaaauucaacgcacgaaauguauuggauuucaaaugggacaggcaacauaguagcaaguguuaacaugguaucacgucuucuucuaaauagauucacaaugacccaucgcagacccacaaucgaaaaagacguggaucuuggagcaggcacuaggcacgugaacgccgaacccgagaccccaaacauggaugucauaggcgaaaggauaaaacgaauaaaggaagaacacaacagcaccuggcacuacgaugacgaaaauccuuauaaaacuugggccuaucacggaucauaugagguaaaggcaacuggcucagcaaguaguaugauaaacgggguaguuaaacuauugacgaaacccugggacguugucccgauggugacgcagauggcuaugacagacacaacaccauuuggucagcaaaggguauuuaaagaaaaaguagacacgcgcacuccaagaucaaugccaggaacgcgaaggguuauggguauaacggcagagugguuguggagaacucuuggacgcaauaagaaaccgagacuuugcacacgagaagaauuuaccaagaaaguuaggacuaacgcggccaugggcgcaguauucacagaagaaaaccagugggacucggcuaaggcugccguugaagaugaagauuuuuggaagcuaguagaucgggagagagaacuucacaaauuggguaaaugcggaucaugugucuauaacaugaugggcaaaagagagaagaaauuaggggaauuuggaaaagccaaaggaagucgagcaauaugguauaugugguugggagcucgguacuuggaguucgaggcucuaggauuucuaaacgaagaucacugguuuaguagggagaacagcuauaguggggucgaaggugagggauuacauaaauuaggauauauucuaagagauauaucuaagauaccuggaggagcgauguacgccgacgauaccgcaggaugggauacaagaauaacagaagacgacuuacauaaugaagaaaagauuacgcagcaaauggauccagaacauagaaagcuggcuaaugcaauauuuaaacucacuuaccaaaacaaagugguaaaggugcagagacccacacccacggggacagugauggauauaauuaguagaaaagaucagcgaggaagcggccaggucgguacauacggacuuaacacauuuaccaacauggaagcucaauuaauucgacaaauggaaggugaagguguacucucaaaagcugacuuggaaaauccucaucugccggaaaagaaaauuacacaaugguuagaaacuaaaggaguggaaagguuaaagcgaauggccauuucuggagaugauugcguaguuaaaccuauagaugaucgauucgcgaaugcacugcuagccuuaaaugauaugggaaaaguccguaaagacauaccccaauggcaaccaaguaaaggauggcaugacuggcagcaggucccguuuugcagucaccacuuucacgaguuaauuaugaaagaugggagaaaacuuguaguaccauguagaccacaagaugaguuaauaggcagagcaagaauaucacaaggcgcugguuggaguuugagggaaaccgcaugucuggguaaagcauacgcacagauguggucauuaauguauuuucaucgucgagauuuaaggcuagcgagcaacgcaauuugcucagccguaccuguccauuggguaccaacuucaagaacaaccuggaguauacaugcccaucaucaguggaugacaacggaagauaugcuuacaguuuggaaucggguguggauagaagacaauccuuggauggaggacaaaacgccaguaacuacaugggagaacguaccauaucuuggcaaacgugaggaccaauggugugguucacuaaucggcuugacgagccgugcgacaugggcacaaaacauuccaacagccauacaacaaguacgaagccuaaucgguaaugaagaguucuuagacuacaugccuucuaugaaacguuucaggaaggaagaagaaagcgaaggugccauuugguaa

SEQ ID NO: 23066 - RNA, 9873 nt, Artificial Sequence
  derived and/or modified CDS sequence (opt6) from DENV-3__GU131868__SS-prME
acgccacuaugucuuaugaugauauugccugcagcuuuagcauuucaucuaacuucucgggacggggaaccaaggaugauaguugggaaaaaugaaaggggaaaaucacuuuuauucaaaaccgcaucuggaauuaauauguguacuuuaauagcuauggaccucggagaaaugugugacgacacuguuacauauaaaugcccccacauaacugaaguagaacccgaagauauagauugcugguguaaucugaccaguacuugggucacguauggaacgugcaaccaagcgggggaaagaagacgggacaaacggucagucgcauuagcaccccacgugggaaugggucuugacacuaggacucaaacuuggaugagugcggaaggagcguggcgucaagucgaaaaaguugagaccugggcacugcgucauccaggguuuacuauucucgcauuauucuuagcacacuauauuggaacaaguuuaacucaaaaagucgugauuuuuauacuacuaauguuaguuacucccaguaugacaaugagaugcguagguguuggcaaccgcgauuucguggaaggucugagcggcgcgacuuggguugacgucguauuagagcacggagggugugugacaaccauggcuaaaaauaaaccaacauuggauauagaacuacagaaaaccgaagcuacccaacuggccacacuccguaaacuuugcauugaggguaaaauuacgaacauuacuaccgacagucgauguccuacccaaggagaagcaguauuaccagaagaacaagaucaaaauuauguuugcaaacacacauauguagauagaggauggggcaauggaugcgggcuauucggaaaagguaguuuggucacgugugcuaaauuccaauguuuagaauugauugaagggaaagucguacaauacgagaaccucaaauacacuguaaucaucaccguacacacgggagaucaacaccaaguaggaaaugaaacucaaggaguaacggcugaaauaacgccccaagcgucuaccaccgaagcaauccuuccagaguaugguacauuaggccucgaguguucacccagaacgggacuagauuucaacgaaaugauacuuuuaacaaugaaaaauaaggcuuggauggugcauaggcaaugguucuucgauuugccucuuccuuggacgagcggggccacaacggaaacacccacauggaaccguaaagaacuucuagucacauuuaauaacgcgcaugcuaagaaacaagagguaguaguauugggcagccaagaaggugcaaugcacacagcgcuuacuggagcaaccgaaauucaaaauucuggaggcacaagcaucuucgcuggacauuuaaaaugccgauugaaaauggacaaacucgaacuuaaaggaaugagcuaugcaaugugcacaaacacauuuguacucaaaaaggagguuucagaaacucaacaugguaccauuuugauuaaaguagaauauaaaggggaggaugcacccuguaaaaucccauucucaaccgaagacggucagggaaaagcccauaauggucguuuaauaaccgcaaauccuguaguuacuaagaaagaagaaccuguuaauauagaggcggaaccaccguucggagaaucuaauauuguuauaggaauaggggacaaugcuuuaaaaauaaacugguauaagaaagguucgaguauaggaaaaauguuugaagcuacugcaaggggcgcccgaaggauggcaauacuuggugacacugcaugggacuuuggauccgugggaggcguacucaauucauuagguaaaaugguucaccaaauauuuggcagugcauauaccgcccuauucuccggcguaagcugggugaugaaaaucgggaucggaguguuauuaacauggauaggccugaacagcaaaaauacuucgaugaguuuuucuugcauagcgauuggaauaauuacccuauaucuaggcgccguuguucaagccgacaugggcugcgugauaaauuggaaaggaaaagagcuuaaaugcggaaguggcauauucgugacaaaugaaguacacacguggaccgaacaguauaaauuccaagcugauagccccaagcgauuagccacggcuaucgccggugcgugggaaaacggugucugcggaauaagaagcacuacccggauggaaaaccuucuauggaaacagauagccaacgagcuuaauuauauacuuugggaaaacaauauaaagcuaacaguaguugucggcgacauuauagggguacuggaacaaggaaaaagaacuuuaacgccacaaccaauggaguugaaguacucauggaaaacauggggcaaagcaaagauaguaaccgcagagacgcaaaacucuucuuuuaucauugauggaccaaauacuccggagugucccagcgcaucgcgagccuggaacgucugggaagucgaagacuauggcuuugguguguucacuacaaauauauggcugaaguuacgagaaguguauacgcaacuaugcgaucauagacuaaugagcgcagcuguaaaagaugaacgggcuguacaugccgauauggguuauuggauagaaucgcagaaaaauggaucauggaagcuagaaaaagcgucccuuauagaagucaaaacuuguaccuggcccaaaucacacacauuaugguccaacggcguucucgaaucugauaugauuaucccuaaaucccucgccggaccaauuucccagcauaaccaccgaccgggauaucacacacagacagcagguccuuggcaucuaggaaaacuugaacucgauuuuaauuauugcgaagggacuacagucgucauaacggaaaacuguggaacgaggggcccaucucuaaggacaacaacaguuaguggaaaacuuauacaugagugguguugucgaaguuguacacuaccaccguuaagguauaugggagaagacggauguugguauggaauggaaauaaggccuauaagcgaaaaagaagaaaauaugguaaaaucacucguauccgcgggaucuggaaagguggacaauuuuacaaugggaguccucugccuugccaucuuguucgaagagguuaugagaggaaaauucgguaagaaacauaugauugcgggaguauuuuucacguuuguucuuuuauuauccggacagauuacuuggcgagacauggcgcauacccuaauaaugauaggaucaaacgccucagacagaaugggaaugggaguaacuuaccuagcucuuauagcgacauucaaaauucaaccuuucuuagcccugggguucuuucugagaaaguuaaccaguagagagaaucuuuuacuaggcguaggauuggcaauggccacuacuuuacaauuaccagaagacauagaacagauggcgaacggcauugcucucgggcugauggcauuaaaauuaauaacacaauucgaaacuuaccaacuauggacggcuuuaauauccuuaacuugcaguaacacaauguuuacuuugacaguggcguggcgcacugcgacucuaauccuugcugggguuagccuguugcccgugugucaauccagcucaaugcgcaagacagauugguuacccauggcugucgccgcuaugggagugccaccccuaccacuuuuuauuuucucgcucaaagauacguugaaacgaagaagcuggccgcuuaaugaaggcguuauggcagucggacuugugucgauacuagcuaguagccucuugcgaaaugauguaccaauggcgggcccccucgucgcuggaggucuauuaauugcauguuaugucauuaccggaacaagugcugacuugacuguggaaaaggcggcagauauuacgugggaagaagaagcagaacagacgggaguaagucauaaccuaaugaucacgguagaugaugaugggacaaugcggaucaaagaugacgaaacagagaauaucuuaacaguuuuguuaaagacagcacugcuaauugugagugggguauuuccauauaguauuccagccacuuuacucguauggcauacguggcaaaaacagacacagcguucuggaguucuuugggaugucccauccccgcccgaaacucaaaaagccgaacuugaagaaggggucuauagaauuaaacaacagggcaucuucgguaaaacgcaagugggaguaggaguccagaaggaagggguauuucacacaauguggcauguuacacguggagcagugcugacauauaacgguaaacguuuagaaccaaacugggccagcguuaagaaagauuuaauaucauacggagguggauggagacuaucugcccaauggcaaaagggggaagagguacaagugauagcuguugaaccuggcaaaaauccaaagaauuuccaaaccaugcccggaacuuuucagacuacaacgggagaaauuggcgcuauagcguuagauuuuaaaccagguaccagcgggaguccaauaaucaaucgggaaggcaaaguaguugguuuauauggcaacggcguuguuacuaaaaauggaggcuacguguccgguauagcacaaacgaaagcggaaccugauggaccuacuccggaacuugaagaggaaauguuuaagaaaagaaaccuuacaauuauggaccuacauccaggaaguggcaaaacuagaaaauacuugccagcgauaguaagagaggccaucaaaaggagguuacguacuuuaauuuuagcuccgacuagaguuguugcugcugaaauggaagaggcuuuaaaaggauuaccuaucagauaucaaacaacggccacaaaaucugaacauaccggacgagaaauaguagacuuaaugugccacgcgaccuuuaccaugcguuugcuaagcccaguacgaguaccaaacuacaaccuaauuauaauggaugaagcccacuuuacggaccccgcauccauugcugcucggggguauauuagcaccagagucggcaugggagaggcuucagcaaucuucaugacagcuaccccaccaggaaccgcugaugcguuuccgcagagcaacgcaccaauacaggaugaagaacgcgauauaccugaaagaucauggaauagcggaaacgaauggauaaccgauuuugcgggcaagaccguaugguucguacccaguauaaaagcagguaacgacauagcgaauugucucaggaaaaacgguaagaaggucauacaacuuucaagaaagacauucgacacugaauaucagaaaacaaaguuaaacgacugggacuucguuguaacgacagauaucagugaaaugggugcaaacuucaaagccgauagaguaauugacccucgcagaugccuaaagccugucauacugacugauggcccagaacggguuauccuugcugggccaaugccugugacagcugccucagcagcacagagaagaggaaggguuggaagaaacccacaaaaagaaaacgaucaguacauauuuacaggacaaccauuaaauaaugaugaagaucacgcgcauuggacagaagccaaaauguuauuggacaacauaaauaccccagaaggaauaauuccugcacuuuucgaaccagaaagagaaaaauccgcagcaauagauggugaguacaggcucaaaggagaaucaagaaaaacauucguugaacuaaugagacgaggagaucuuccaguaugguuagcucauaaaguagcgagugaaggaauuaaauauacagacaggaagugguguuucgacgggcaacgaaauaaccaaaucuuggaagaaaacauggauguagaaaucuggacgaaagagggagaaaagaagaaacuuaggccacgauggcuagacgcgcgcaccuacagugacccuuuagcucuaaaagaauuuaaagauuuugcagcaggucgaaaaucaauagcacuugauuuaguuacugaaauagguaggguuccaagucauuuagcgcacagaacaaggaacgcuuuagauaauuuaguaaugcugcacaccagcgaacauggugguagagcuuacagacaugccguugaagaacuaccagagacuauggaaacucuucuauugcuaggguugaugauauuguuaacggguggcgcuauguuauucuuaauaaguggcaagggaauuggcaagaccagcauuggauuaaucuguguaauagccagcagugguauguuguggauggcagaaaucccccuacaauggauugcuuccgcaaucguuuuagaauuuuucaugaugguacuacuuauuccggagcccgaaaaacaaaggacaccucaagacaaucaauuagcauauguaguaauagggauacuuacucucgcugcaauuauugcagcuaaugaaaugggauuguuagaaacaacuaaacgggaccucggcaugagcaaagaaccaucaguagucucgcccacgucauaucuggauguugaccuccacccugcaucagcuuggacacuguaugcaguggcaacaacuguuaucacaccuauguuaagacauacaauugaaaauagcacugcuaauguaucuuuagcagcaauugccaaucaagcuguaguguuaaugggguuagauaagggauggcccaucuccaaaauggaccuagggguccccuuauuagcacugggauguuauucacaaguuaauccccuuacacuuaccgccgcuguauuuuuacuaauaacccacuacgcuaucauuggcccuggcuuacaagcaaaagcaacaagagaggcacagaaaaggacugcugccggaauaaugaaaaauccaaccgucgaugguauuaugaccaucgaccuugacccuguuauauacgauagcaaauucgagaaacaacuaggucaaguaauguuauugguacuaugugccguccagcuguugcuuaugcggacgucuugggcauuaugugaagcacuuacauuagcaacgggacccauaaccacacuaugggaaggaucgccagguaaauuuuggaauaccacuauugcuguaucaauggccaauaucuuccgcgggagcuaccucgccggugcaggucuggccuuuucuauuaugaaaagcguaggaaccggaaagcgagguacugguucacaaggagaaacguugggagaaaaauggaaaaagaaacuaaaucaauuaucacgcaaagaguucgacuuauacaaaaagucagggauuacagagguugaucgaacggaagcaaaagagggccucaaacgaggagaaaucacccaucaugcagucucucgagguucugcaaaacuacaaugguuuguagagagaaauaugguuaucccagagggaagaguuauagauuuaggaugcgguaggggcggauggaguuauuauugcgccggucuaaagaaagugacagaaguucgggguuacacaaaaggagggccaggucacgaagaaccaguuccaaugagcacauauggauggaacauagucaaacuaaugagcgguaaggauguauuuuaucuuccuccagagaaaugugacacauuauugugugauauaggagaaucgucaccuagccccacuguugaggaaucucgaaccauaagaguacuaaagaugguagaaccaugguugaagaauaaccaauuuugcauuaaaguuuuaaaccccuacaugccaacugugaucgaacaucuagaaaggcuucaacggaaacauggugguauguuaguucggaauccguuaucccgcaauuccacccaugagauguacuggaucaguaacggaaccgguaauauaguugcguccguaaacaugguuucacgauuguuacuuaauagauucacaaugacacaccgaaggccaacaauugaaaaagacguagacuuaggggcagguacgcgacacgugaacgccgaaccagaaaccccaaacauggaugugaucggcgaacgaauaaaaagaaucaaggaagaacacaauucuacguggcacuaugaugaugaaaacccauauaagacaugggccuaccacggaucuuaugaaguuaaagccacagguucggccucgucgaugauaaaugggguugucaaacuacuaaccaaacccugggacguagugcccauggugacccaaauggcuaugacugauacgacucccuuuggucaacaacgcguauuuaaagaaaagguggacacaaggacuccaaggagcaugccugggacuagacgagucauggguauaaccgcggaauggcuuuggaggacauuagggagaaacaagaaaccaagauuauguacgcgcgaagaguuuacuaagaaaguacggacaaacgcugcaaugggcgccguuuuuacugaagaaaaucaaugggacucugcaaaagcugcuguggaagacgaagacuuuuggaaauuaguugauagggaaagagaguugcacaaacuugggaaaugcggaucguguguauauaacaugauggguaagagagagaagaaauugggagaguucgggaaagccaaagguaguagagcuauuugguauauguggcucggagcccgguaucuugaauuugaagcacuuggcuuccucaaugaggaucauugguuuucucgagaaaauucuuauucaggugucgaaggugaaggacuacauaaguuaggauauauauuacgcgauauauccaaaauaccggguggagccauguacgcagacgacacagcaggcugggauacccggaucacggaagaugaucuucauaaugaagagaaaaucacacaacagauggacccagaacacagacaauuagcgaacgcuauuuuuaaauuaacauaucaaaauaaagucguaaaggugcaacgaccuacacccacuggaaccguuauggauauuauaucgcguaaagaucaacggggaucugggcaaguaggaacuuauggccucaacacauucacuaacauggaagcgcaguugauacgccagauggaaggggaaggcguuuuaaguaaagcggauuuagaaaacccacaucuacccgaaaagaaaauaacgcaauggcuggagaccaaaggagucgagagacuaaaaagaauggcaauuuccggugaugacuguguuguuaagcccauagaugaucgauucgcaaaugcgcucuuggccuugaaugauaugggcaaagugagaaaagauauaccacaguggcaaccauccaaaggguggcaugauuggcaacaaguuccauuuugcagccaccacuuucaugaguugauaaugaaagacggacguaaauuaguaguaccgugcaggccgcaggaugaacuuaucggacgugcacgaauaagucaaggagcaggauggagcuugagggaaacggccuguuuaggaaaggcuuacgcgcaaauguggucacuuauguacuuucauagaagagacuugagauuagccaguaaugcgauaugcuccgcgguaccuguacauugggucccgacaagccguacaacauggaguauacaugcacaucaccaauggaugacaacagaagauauguuaaccgucuggaauaggguuuggauagaagauaauccauggauggaggauaaaacaccagucacgacuugggaaaaugugccuuaccuuggaaaacgugaagaccaauggugcgguucccuaauaggguugacaucgagagccacgugggcgcaaaacauaccaacagcuauacagcaaguaagaagucuuauagggaacgaagaguuuuuggauuauaugccgucaaugaaaagauucaggaaggaagaagaaagugaaggagcaauaugguaa

SEQ ID NO: 23067 - RNA, 9873 nt, Artificial Sequence
  derived and/or modified CDS sequence (opt6) from DENV-3__GU131869__SS-prME
accagcuuguguuuagugaugauauuaccugcugcauuggcguuucacuuaacaucacgggauggagaacccaggaugauugucgguaaaaaugaacgggguaaaucccuacuuuuuaaaacagcaucugggauuaacauguguacucuuaucgccauggaucuaggagaaaugugugaugauacaguaacauauaaauguccacauaucacggaaguggaaccugaagauauagauuguugguguaaucuuacauccacauggguaacguaugggacuuguaaucaagccggugaaagacgaagggacaaacgcucugucgcguuagcaccacacguuggaaugggccuagauacaaggacucaaacauggaugucggccgaaggagcguggcgacaaguggaaaaaguagaaacgugggcacucaggcauccuggguucacaauacuugcauuguuccucgcacauuauauaggaacaaguuuaacgcaaaaagucgugauauuuauauuacucaugcuugucacaccuaguaugacaaugagaugcguagggguagguaaccgcgacuuuguugaaggauuaaguggggcgacuuggguagacguuguauuagaacacggaggaugcguuaccacgauggcgaaaaacaaaccaaccuuagacauagaauuacagaaaacggaagcgacccaauuagcaacauuaagaaaauuauguauagaagguaaaauaacaaacauaacuacugauaguagauguccaacgcaaggagaagcaguucuaccggaagaacaagaucaaaauuauguuuguaaacacacauauguugauagaggauggggaaaugggugugguuuauucggaaaaggaagucucguaacuugugcuaaauuucaaugcuuagaacccauugaagguaaagucgugcaauacgaaaauuuaaaauacacuguuauuauaacgguacauaccggagaucaacaucaagucggaaacgaaacacaagguguuacagcugaaaucaccccacaagcaucaacgaccgaagcuauccuaccugaauauggcacguuaggacuagaauguagcccacguacaggucucgauuuuaacgaaaugauauugcuaaccaugaaaaacaaggcuuggaugguacaccgacaaugguuuuucgaccuaccuuuaccauggacgucuggugcaacgaccgaaacuccaacguggaauagaaaagaauuauuggucacuuucaaaaacgcgcaugcaaagaaacaagaaguuguagugcuaggcucucaagaaggugcgaugcauacagcuuugacaggugcgacagaaauucaaaauucuggagggacaucaaucuucgcuggacaucuaaaaugcagauuaaaaauggauaaacuagaguuaaaagguaugagcuaugcgaugugcaccaacacuuuuguucucaagaaagaaguuagcgaaacccaacacggaacaauacuaauuaaaguggaauaucggggagaagaugcaccuugcaaaauacccuucucaacugaagauggccaagggaaagcgcacaacgggagacucauuacagcaaacccaguugucaccaagaaagaagaaccagucaauauagaagccgaaccuccguucggugaauccaacauaguaauugggaucggcgacaaugcacucaaaaucaacugguauaagaaagggucauccauuggcaaaauguuugaagccacagcgcgcggcgcaagaagaauggcgauauugggagauaucgccugggauuuuggaaguguaggcgguguacuaaauaguuuaggaaaaaugguacaucaaauauucgguuccgcuuauacagcucuauuuaguggaguuaguuggguaaugaaaauaggcauagggauacuauuaacauggauugggcuaaacucuaaaaacacuucaaugucauuuaguugcauagcaaucggaauaauaaccuuauaccuaggagcggugguucaagcagauauggguugcguaauuaacuggaaagguaaagaauuaaaaugugggucuggaaucuuuguuacaaaugagguucauacuuggacagaacaauacaaauuccaagccgacagucccaaaagauuagcaacagcaaucgccggggcaugggaaaacgggguaugcggaaucagaucaaccacacggauggaaaaucuauuauggaaacaaauagcaaacgaguugaauuauauuuuaugggaaaacaauauaaaauuaacggugguaguaggugacauaauagguguuuuagaacaaggaaaacgaacacucacaccucaaccaauggaauuaaaauauucuuggaaaacuuggggaaaagcaaaaauaguaacagcagaaacacaaaauagcucauuuauaauugaugguccaaacacgccagaaugucccuccgcaaguagagcuuggaaugugugggaaguagaagacuacgguuuuggaguuuucaccaccaauauauggcuaaaauugagggagguauacacucaacuaugugaccacagacuaaugucggcggccguaaaagaugagagagcaguccacgccgauaugggguauuggauugagucccagaaaaaugguucguggaaacuugaaaaggcuucauuaauugaaguaaagacaugcacuuggccuaaaagccacacguuaugguccaaugguguauuggaaucugacaugauuauaccaaagucccuugcuggaccaaucucccagcauaaucaucgaccggguuaccacacccaaacugcaggaccuuggcaucuuggaaaauuagagcuugauuuuaauuauugcgaagguacaacggugguaauaacggaaaacuguggaaccaggggaccauccuuaagaacaacaacaguauccggaaaacugauccacgaaugguguugucgaaguugcacacuuccaccauuaagguacaugggcgaagauggguguugguacgggauggaaaucagaccaauaucugaaaaagaagaaaauaugguaaaaagucuagugucugcaggaucugggaagguggacaauuuuacuauggguguguugugcuuggccauacuauucgaagagguuaugagaggaaaauuugggaagaaacauaugauagcugggguauuuuucacguucguguuguuacuuuccggacaaauaacuuggcgugacaugacccauacacuaauaaugauagguagcaaugcuucagaccguaugggcaugggaguaacuuaucuggcgcucaucgcuacauuuaaaauccagccauuccuggcauuaggcuuuuuccuucguaaacugacuucacgcgagaaucugcuucuugggguuggacucgcuauggcuacgacccuacaacuccccgaagacauagagcaaauggcaaauggaauugcacuaggucugauggcucuuaaacuuauaacccaguuugagacauaucaacuuuggacggcuuuaauuucguuaacgugcagcaauacgauguucacccugacaguagcauggagaaccgcgacauuaauucuagcuggagugucauugcugcccguaugccaaucaucaagcaugcgaaagacagauugguugccaauggcugucgcggcaaugggagugcccccacugccacuuuuuauuuucucccuaaaagacaccuuaaaaaggagaucauggccucuuaaugagggcgugauggccgucggauuaguuucaauccuugcaaguagcuuacucagaaaugaugugccaauggccgguccucucguugccggaggacuuuuaauagcuuguuacguaauuaccggaacaucagccgacuuaacaguagaaaaagcggcggauaucacaugggaagaagaagccgagcaaacaggaguaagucauaaccuuaugaucacagucgacgaugacggcaccaugcgcaucaaagaugaugaaacagaaaauauacuuacuguacuacuuaaaacagcucuauuaaucguuuccggaguauucccuuauucaauaccagccaccuuguuaguuuggcauacauggcagaagcaaacgcaacguaguggaguauugugggauguaccgucuccgcccgagacucaaaaagcagaauuagaagaaggaguauaucgaauaaagcaacagggaauauuuggaaaaacacagguugguguaggcguacaaaaagaaggagucuuccauacgauguggcauguuacaagaggcgcgguuuugaccuacaacggcaaacgauuggaaccgaacugggcuucagucaagaaagaccucaucucuuauggagguggguggagacuuucagcgcaauggcaaaaaggagaagaaguucaagucauugcaguugaaccuggcaaaaauccgaaaaacuuucaaaccacgcccggcacauuucagacuacgacaggagaaauaggagcaauugcacuagauuuuaaaccuggaacaucagguucaccaauuauuaauagagaagggaagguaguaggacuuuacgguaaugggguagucacuaaaaauggcggauauguaucagggauagcucaaacaaaugcggaaccggauggaccuaccccagaguuggaagaagaaauguuuaagaaacgaaaccuaacaauaauggaucuacacccgggauccggaaaaacucgcaaauaucuaccggcgauaauacgagaagcaauaaaacgaagauuaaggacacuaauccuugcaccaacgcggguaguagcagccgaaauggaagaggcuuuaaaaggccuaccaauucguuaccaaaccacugccacgagaucagaacacacaggucgcgaaauuguagaucuaaugugucaugcaaccuuuacaaugcgucucuuaaguccaguccgaguuccaaauuauaacuuaauuauuauggacgaggcccacuuuaccgauccagcaucgauugcugcuagagguuauauaaguacucgaguaggaaugggcgaagccgcugcaaucuucaugacagccaccccuccuggcaccgccgaugcuuuuccccaauccaacgcaccuauucaagaugaggagagagacauccccgaacggucguggaauagcggaaacgaauggaucacugauuuugcuggaaaaaccgucugguucguucccucgauaaaggcaggaaacgauauugcuaacugucuccguaaaaauggcaagaaaguuauacaacuaucacgaaagacguuugacacugaauaucagaaaacgaagcucaacgacugggauuuuguugugacgacagacauuucagagaugggugccaauuucaaagcagacagaguuauagacccccggcgcugucuaaaaccgguaauauuaaccgauggcccggaacgggucauauuagcuggaccaaugccagucacagcagcuucagcagcucagcgcagagguagagucggccgaaacccacagaaagaaaaugaccaguacaucuuuacuggccaaccacugaauaaugaugaagaccacgcacacuggacagaagcaaaaauguuauuggauaacauaaauacaccagagggaaucauaccagcucuauuugaaccggaaagagaaaagagugcggcuauagacggugaauacaggcucaaaggagaaagcaggaaaacauucguagaauuaaugcgccguggagaccuaccagucuggcucgcccauaaagucgcuucagaaggaauaaaauauacugaucgaaaaugguguuucgauggacaaagaaacaaucaaauucuagaggaaaacauggauguggaaauuuggacaaaagaaggagaaaagaagaaauugagacccagguggcuugaugcuagaacguauuccgauccccuagcgcugaaggaguucaaagacuucgcagcagggaggaaaaguauugcacuugaucucguaacagaaauuggucgaguacccucacaucuugcacacagaacgaggaacgcgcuagacaaucucguaauguugcacacaagugaacauggggguagggcuuaccgacacgcugucgaagaauuaccagaaacaauggagacccuacuuuugcuuggacuaaugauuuuauugaccgguggagcuaugcuauuucugauuagcggcaaaggaauaggcaaaacaucuauaggacuuaucugugucauagcaagcuccgggauguuguggauggcugagauaccuuugcaauggauugcuucagcaauaguacucgaauuuuucaugaugguccuucuuauaccugaaccugaaaaacagcgaacaccucaagacaaucaauuagcguacguuguaauaggcauucucacgcuagcggccaucaucgcagcaaaugaaaugggguuguuggagacuacaaaaagagacuuaggaauguccaaagaaccaggugucguaucgccaacaaguuauuuagauguggaccuacauccagcuuccgcuuggaccuuauaugcgguagcaacaacagucaucacaccaaugcucaggcauacgauagaaaauucaacagcaaauguaucauuagcagcaaucgcaaaccaagccguagucuuaaugggcuuagacaaaggauggccaauaucgaaaauggaccuaggggugccuuuacuugcacuuggauguuacagucagguaaacccguuaacacugaccgcggcuguauuauuauuaaucacacauuaugcaauuauaggaccaggccugcaagcgaaagcaacccgggaagcacagaaaagaacagcggcagggauaaugaaaaaucccaccguagaugguaucaugacaauagauuuagacccuguuauauaugauucuaaauuugaaaaacaauuaggucaaguaauguugcugguauugugugccguacaacuacuacucaugaggacuucaugggcucuaugugaagccuugaccuuagcuacuggaccaauaacgacgcuaugggaggggucacccggaaaguucuggaacaccacuauagccguuagcauggcaaacauauuuagaggaucauacuuagcaggagccggucuggccuuuucaauaaugaaaucaguaggcacagggaagcggggcacugguucacaaggggaaacgcucggagagaaguggaagaagaaacuuaaccaauuguccagaaaagaguucgaucuguacaagaaaucuggaauaaccgaaguugauagaacugaggccaaggaggggcuaaagaggggagaaauaacacaucacgccguaagcagagguagugccaaguuacaaugguuuguugagagaaauaugguaauacccgaaggucgugugauagaucuugguuguggucgaggcgguuggagcuauuauugugccgggcuaaagaaaguaacggaaguaagggguuacacgaaaggcgggccaggccacgaggagccaguaccaaugucuacuuaugguuggaauauaguuaaauuaaugucagggaaggauguauuuuauuugccaccggagaaaugugacacuuugcuuugcgacauuggcgagucgucacccucacccacgguagaagaaagccgaacaaucagaguauugaaaaugguagaaccaugguugaaaaacaaccaauucugcauaaaaguguuaaaccccuauaugcccacaguuauugaacaucuugagaggcuacagagaaaacacgguggaauguuaguacgaaacccauuaagucggaacucuacacaugagauguauuggauaaguaacgguaccggaaacaucgucgcaaguguaaacauggucucacgcuuauuacugaauagauuuacuaugacccauaggaggcccaccauugaaaaagauguagauuuaggugcgggaacaagacauguaaacgccgaaccagaaaccccaaacauggauguaaucggugaaagaauaaagagaauuaaagaagaacauaauucaaccuggcauuaugacgacgaaaacccauauaaaacaugggcauaccaugguucguacgaagugaaagcgacaggcagugcuaguaguaugauaaauggaguaguaaaauuauuaacaaagcccugggauguugugccaaugguuacucaaauggcuaugaccgacacgacccccuuuggccaacaacggguuuuuaaggaaaaaguugacacaagaacaccccgcaguaugcccggaacgcggagggucauggaaauuacugcugaaugguuauggcgaacuuugggucgcaacaagaaaccccgcuuauguacuagagaagaguucaccaagaagguacguacaaaugcggccaugggcgcaguuuuuacugaggagaaccagugggacucugcgaaggcugcuguagaagaugaagacuuuuggaaauuagucgauagagaaagagaauugcauaaacuuggaaaaugcggauccuguguuuacaacaugaugggaaaacgggagaagaaauuaggggaauuuggaaaagcaaaaggcaguagagcaauaugguauaugugguuaggagcuagauaccuggaguucgaggcuuugggauuuuuaaaugaagaucauugguuuaguagggaaaauucauacucaggaguugaaggcgaagggcuacauaaauuaggguauauuuuaagagauauaucaaagauacccggcggggcuauguaugcagacgacacagcuggcugggauacacgcauuacugaggaugaccuccacaaugaggagaaaauuacgcaacagauggauccagaacauagacagcucgcgaaugcuaucuucaaguugacuuaucaaaauaaaguuguuaagguacaaagaccuacgccgacaggaacagucauggacauuauaagucgaaaagaccaaaggggcaguggucagguaggaacauauggacugaacaccuucacuaacauggaagcacaauuaauaagacagauggaaggagaagguguguuaucuaaggcugauuuagaaaauccacaucuaccggaaaagaaaauuacacaaugguuagaaacuaagggagucgaaagauugaaaagaauggcuauuucaggagaugacugcguugucaagccaauugaugaccgauucgcaaaugcuuuacuugcguugaaugauaugggaaaaguacgcaaggauaucccccaauggcaacccucgaaaggcuggcacgauuggcaacaaguaccuuucugcagucaucacuuccaugaacucauaaugaaagacggucggaaguuaguaguaccuuguagaccucaggaugaacuuauuggacgagcgaggauaucacaaggagcagguuggagcuuaagggaaaccgcauguuuagguaaggcauacgcgcagauguggucccuuauguauuuucaucguagagaccuacgcuuagcaagcaaugcuauaugcucagcaguuccuguacauuggguccccacgagccguacaaccuggucgauacaugcccaccaccaauggaugacgacagaagacauguuaacgguauggaacagagucuggauugaggauaacccuuggauggaggauaaaacgccagucacaacaugggaaaaugucccuuaucuuggaaaacgcgaggaccaauggugcggaucauugauaggcuuaaccucaagggcaacgugggcucaaaauauaccuaccgcuauccaacaagugagaagucuaauugggaaugaagaauuucuugauuacaugccaagcaugaaacgcuuucguaaagaggaagaaucugagggagcuauaugguga

SEQ ID NO: 23068 - RNA, 9873 nt, Artificial Sequence
  derived and/or modified CDS sequence (opt6) from DENV-3__GU131870__SS-prME
acaagucuaugcuuaaugaugauucugccugcggcauuagcguuucaucuaacaucgcgagacggcgaaccgcggaugauaguggguaaaaacgaacgcgguaaaagccuacuauuuaaaacugcgucaggaaucaauaugugcacauuaaucgcuauggaucuaggggaaaugugcgacgauacaguuacguauaaauguccccauauuaccgagguagaaccagaagauauagauugcugguguaaccuaacauccacguggguaacguauggaaccuguaaccaggcgggagagcgaagaagagauaaaaggaguguugcauuggcaccccaugucggcaugggauuagauacacgaacccaaacauggaugagugcugaaggagcguggagacaaguagaaaaaguagaaacaugggcccugcgacaucccggauucacaauauuggcauuguuuuuagcacacuauauaggaacaagccuaacacaaaaaguugugauuuucauauuguuaauguuaguaacuccguccaugaccaugcggugugucggaguagggaaccgagacuuuguagaaggacuuagcggcgcaacauggguagauguuguacuagaacauggagggugcguaacuacuauggccaaaaauaaaccaacauuagauauagaauugcagaaaaccgaggccacacagcucgcgacauugcgaaaauuguguauagaaggaaaaauaacaaacauaacgacagauagccgaugcccaacucaaggggaagcaguccuaccugaggaacaagaccaaaauuacguuuguaaacauacuuacguggacaggggcuggggaaacggaugcggucuuuuugguaaagguucauuagucacaugugcuaaauuccaaugccuagaaccaauugaaggcaaaguagugcaguaugaaaaucugaaauauaccguuauuauuacuguucacacgggagaucaacaucaaguagggaaugagacacaggguguuacagccgagauuacaccccaagcuaguacgacagaagcaauacucccagaguacgggacauuggggcuagaaugcaguccacggacuggguuggacuuuaacgaaaugauccuacuaacuaugaaaaauaaggcuuggaugguucaucgacagugguucuuugacuugccacucccguggaccagcggugcuacuacugagacaccaacauggaacaggaaagaacuccuaguaacauuuaaaaacgcccacgccaagaaacaagaaguaguaguucuaggcucacaggagggagcuaugcacacugcacuaacuggagcgacagaaauucaaaacucgggagguacaaguaucuucgcaggccacuuaaaaugucgacuuaaaauggacaaacuagagcuuaaagggaugucuuacgcuauguguacuaacaccuuuguacugaagaaagaagugagugaaacgcaacacgguacgauacuaauuaaaguagaauaccgaggcgaagaugcgccauguaaaauaccuuuuaguacggaagacggacagggcaaggcacauaaugggagauuaauuaccgcaaauccaguaguuacuaagaaagaagaaccagugaauauagaagccgaaccgccauucggggaaagcaauauaguuaucgguauaggagauaacgcuuuaaagaucaauugguauaagaaagguagcucaaucggaaaaauguucgaagccacugcucgaggagcccgaagaauggcuauauuaggagacacagcgugggauuucggauccgucggugguguacuaaacucauuaggaaagaugguucaucaaauuuucggcagugcauauacggcucucuuuucaggaguuucauggguuaugaaaauaggaauuggaauacuauuaacauggauagguuuaaacucgaaaaacacgucaaugaguuuuucauguauagcaauagguauuauaacauuguaucugggugcaguaguacaagccgauauggggugcguaauaaacuggaaaggaaaagaguuaaaaugugguagcgguauuuuuguuacaaaugaaguccauaccuggaccgaacaauauaaguuucaagccgacucaccaaaacgauuagcuacagcuauugcaggagcaugggaaaauggaguauguggaauccgaucaacaaccaggauggagaacuuauuauggaagcagauugcaaacgagcugaaucauauacucugggagaauaacauaaaauuaacaguaguagucggugacauuauagggguacuagagcaaggaaaaagaacacuuacaccucaaccgauggagcucaaguauucguggaaaaccuggggaaaagcaaaaaucguaacagcagagacgcaaaauuccucuuucauaauagacgguccgaauacccccgagugcccuucagcuagccgcgccuggaacguuugggaaguagaagacuacgguuuugguguuuuuacaaccaauaucuggcuuaaacuaagagaaguauauacucaauuaugcgaucaucgacugaugagugcugcgguuaaggacgaacgugcaguacaugcagauaugggcuacuggauagaaucgcagaaaaacgguaguuggaaauuggaaaaagccucuuuaauagaaguaaaaacaugcacuuggccuaaaucucacaccuuauggucaaauggcguauuagaaucagauaugaucauuccaaaaucacuagcaggaccaauaagucaacacaaccaucgaccaggauaucauacacaaacggcggggccauggcaucucggaaaacuugaacuagauuuuaauuacugcgaggguacuacugucguaauaacggaaaauuguggaacaagaggaccuucacuaagaacgacgacuguaucugguaaauuaauucaugaauggugcugucgaucaugcacgcuuccuccuuuaagauacaugggugaggaugggugcugguauggaauggagauuagacccauaagugaaaaggaagagaacaugguaaaaagccuagucucagccggaagcgguaaggucgauaacuuuacgauggggguuuuaugcuuggcaauauuauucgaagaagugaugcgaggaaaauuugguaagaaacauaugauagccgguguuuucuuuacauucguauuacuuuuauccgggcagauuaccuggcgagauaugacucauacgcuuauaaugauaggaagcaacgccagugaccgaauggggauggguguaaccuaucuugcuuuaaucgcaacauuuaaaauacaaccguuucuagcauuaggauucuuucucagaaagcuaacaucgcgugagaaucuccuauuagguguggguuuggcaauggcaaccacgcuacaguugccagaagacauugaacaaauggcuaauggcaucgcuuuagggcuaauggcuuuaaaacuuauaacucaauuugaaaccuaucaauuguggacugcgcuaauaucacugacguguucgaauacgauguuuacgcuaacgguagccuggagaacugcaacccucauucucgcuggggugucauuacugcccguaugucagaguucgucaaugagaaaaacggauuggcucccaauggcaguggcagcuaugggagucccgccauugccuuuauuuauauuuucgcuaaaagauacucuaaaacguagaaguuggcccuuaaacgaaggugucauggccgucggacucgugaguauauuagcaucuuccuuacucagaaacgauguaccaauggcagguccguuaguugcuggaggccuauugaucgcgugcuauguaaucacagggacuucugcagauuuaauaguggagaaagcagcagauauuacaugggaagaagaggcagaacaaacggguguuagccacaaccuuaugauaacuguagaugaugacggaacuaugcgaauaaaagaugacgaaacagaaaauaucuuaaccguguuauuaaaaaccgcucucuugauugugucagggguauuuccuuauaguauaccagcuacacuauuagucuggcauaccuggcaaaaacagacgcaacggucagguguacucugggaugucccuucuccaccagagacgcaaaaggcggaauuggaagagggaguauaucggaucaaacaacaagguauauuuggaaagacucaaguaggaguuggaguucaaaaagaggguguguuucauacaauguggcauguaacuagaggagcuguucuuacauauaacgggaagaggcuugaaccuaauugggcaucggugaaaaaggacuuaaucuccuacggugggggcuggagacuuucggcacaguggcagaaaggggaggagguccaaguaauagcagucgaaccuggcaaaaacccuaaaaacuuccaaacgaugcccggaacauuccagacaacaacaggggagauaggagcgauugcauuagauuuuaaaccaggcacuagcggcagcccaauuauuaacagagagggaaaaguuguaggccuuuacgguaacggagugguaacuaaaaaugggggcuacguaagugguauugcacaaacuaaugcugaaccagacggaccaacaccggaacucgaagaagaaauguucaagaaacgcaaucucacuauaauggaccugcaucccgguagugguaaaacacguaaauaccuuccugcaauuauaagggaagcgaucaagcgacgacuaagaacguuaauccuugccccaacuagaguaguugcugccgaaauggaagaagcucuaaaaggacuaccuauuagauaucaaaccacagccacgaaaagcgaacacacuggacgggaaauagucgauuuaaugugccacgcuacauuuacaaugagacuuuuguccccuguaagagugccuaacuacaaucucauuaucauggacgaagcacauuuuacagauccugcaucgauagcggcaagaggauacauuucgacgagagucgggaugggagaagcugccgcaauuuuuaugacagcaaccccaccuggaaccgccgacgccuucccacaaaguaaugcuccuauccaggacgaggaacgugauauaccagaaaggagcuggaacucaggaaaugaauggauaacggauuucgcugguaaaacagugugguucguuccuaguaucaaagcaggaaaugacauugcuaauuguuuaaggaaaaauggcaagaaaguaauacaguuaagcaggaaaacuuuugacacagaauaccagaaaaccaaguugaaugauugggacuuuguaguuacaacggacaucagugaaaugggagcaaauuuuaaggcagaucgaguaauugacccacggagaugucuuaaaccaguuauacucacugacgggccagaaagaguaaucuuagcuggaccuaugccagucacagcugcaagcgccgcccaaaggagaggacgaguuggucgaaacccacaaaaagaaaaugaucaauacauuuucacgggucaacccuuaaacaacgaugaagaucaugcacauuggacagaggcaaagauguuacuggauaacauaaauacaccugaagguauuaucccagcauuguucgaaccagaaagagagaaaagugcggcaauugauggcgaauacagauuaaaaggagaaucccguaaaacauuuguugagcuaaugaggaggggcgauuuaccaguauggcuagcgcacaaaguugcuagcgaagguaucaaguacacggacagaaaaugguguuucgauggacaaaggaauaaccaaauccuagaggaaaauauggacgucgaaaucuggaccaaagaaggugaaaagaagaaauugagaccacguugguuagaugcuagaacuuacagugauccccuagcgcugaaggaauuuaaagacuuugcugcuggccgaaagucaauugccuuagaccuggucacugagauuggaaggguacccucacaucucgcacaucgcaccagaaaugcccuugacaaucucguaauguuacacacgucggaacacgggggacgagcauaccgucaugcaguugaagaauuaccagagacuauggaaacauuacuauuauuaggauugaugauucuucucacagguggagcaaugcuauuucugaucaguggaaagggcauugguaaaaccuccaucggguuaauaugugugauagcuucgagcggaauguuguggauggcagagauacccuuacaauggauugccucagcgaucguuuuagaauuuuucaugaugguccuauugauuccggaacccgagaaacagagaaccccucaagauaaucaacuagcuuaugucguaauaggaauuuuaacauuagcagcaaucaucgccgcaaaugaaaugggucucuuggaaaccaccaaacgggauuuagggaugucaaaggaaccaggaguugucaguccuacaucauaccuugauguagaucuccaccccgccagcgcguggacuuuauaugcugucgcaacuacaguaauaacacccaugcuucgccauacuauagaaaauuccacugcuaauguuucccuugcagcaauagcuaaccaagcuguuguacugaugggauuggacaaagguuggccuauaaguaaaauggaucuaggaguaccguuacuagcuuugggaugcuauagucaaguuaauccauuaacuuugacagccgcuguacuguuauuaauaacacacuacgcaauuaucggaccagguuugcaagcaaaggcuacgcgagaagcacaaaagagaacagcggcugguauaaugaaaaacccaaccguugaugguaucaugacaauagaccuggacccaguaauuuacgauaguaaguucgagaaacaguugggccagguaaugcuauugguauuaugcgcuguccaacugcuauugaugagaaccaguugggcguuaugugaagcacuaacucuugcuacaggaccaauaacuacacuaugggagggcucuccuggaaaguucuggaauaccacgaucgcgguauccauggccaacauuuuccgugguuccuauuuagcgggagccgguuuagcuuuuaguauaaugaaaucaguuggcaccggcaaacgcgggaccggaagccaaggcgagacuuugggagaaaaauggaaaaagaaacuaaaccaauuaucaaggaaagaauuugauuuguacaagaagaguggaauaacagagguugacagaacagaagccaaagaaggcuuaaaacggggagagauuacacaccaugcaguauccagaggaucagcaaagcuacaaugguuugucgagcgaaacaugguuauacccgaaggaagagucauagaccuagggugugggcgcgguggcuggaguuauuauugugcaggacuaaagaaaguaacugagguacgcggauacacaaaaggagguccaggccacgaagaaccaguaccuaugucaacuuauggguggaauauagugaaguugaugucaggcaaggaugucuucuaccuaccuccagaaaagugcgauacauuguuaugcgauauuggugaaaguagcccuagucccacugucgaagagaguagaacuauuaggguauugaaaaugguagaaccgugguugaaaaauaaucaauucugcauuaagguuuugaauccauacaugccuacaguaauagaacaucuagagcgccuucaacgcaagcacggaggcaugcuuguaagaaauccuuugagucguaauucaacgcacgaaauguauuggauaaguaauggaacagguaauauagucgcaucaguaaauaugguaagucgauuguuguuaaaucgguucacaaugacacaccgucgaccgaccauagaaaaagauguggaucuuggcgcgggaacacgacacguaaacgcagagccagaaacgccaaauauggacguaauaggcgagagaauuaaaagaauuaaagaagaacauaauuccacguggcauuaugaugaugaaaaucccuauaaaacgugggcauaucauggcucguacgagguaaaagcaaccgggucagcuuccaguaugauaaauggcguaguaaagcuguuaacaaaaccgugggauguaguuccaaugguaacacaaauggcuaugacugacaccacaccuuucggccaacaacgcgucuucaaagaaaaggucgauacaagaacaccccgaaguaugccgggcacgagaagagugauggguauaacagcagagugguuguggcgaacacucgguaggaacaagaagccgcgacuguguacuagggaggaauuuacuaagaaaguaaggacuaaugcagcaaugggagccguauucacugaggaaaaccagugggacagugccaaagccgcuguggaagacgaagauuuuuggaaacuuguagaccgcgaacgagagcuacacaaauuagguaaaugugguucguguguauauaacaugaugggcaaaagagaaaagaaguugggagaauuuggaaaggcuaagggaaguagagcaauaugguauauguggcugggagcaagguauuuagaauuugaagcacugggauuccuuaaugaggaccacugguuuucuagagaaaauuccuauagcggagucgaaggagagggacuucauaaacuaggcuacaucuuaagagauauaucgaagauaccggguggggcuauguacgcugaugauacggcuggcugggauacgcggauuaccgaagaugaucuacacaaugaggaaaagauaacacaacaaauggacccagaacaucgacaacuugcgaacgcuauauucaaacugacauaccaaaacaaagugguaaaaguucagcggccgacaccuacagguaccguaauggauauuauaucgagaaaagaccagcgaggcucugggcaaguaggaacguauggacuaaauacauucacuaacauggaagcccaacuaauaagacaaauggaaggugaggguguacuuuccaaagcagaccuugaaaauccucaccuaccagagaagaaaauuacccaguggcuggaaacaaaggggguugaaagguuaaaaaggauggcaauaucgggagaugauugcguuguaaaaccuaucgacgacagguuugcgaacgcuuugguagcauuaaaugauauggggaaggugcgaaaggacauaccucaguggcaaccaaguaagggauggcaugauuggcaacaaguacccuuuuguucccaucauuuucaugaauuaauaaugaaagaugggagaaaguuaguggucccauguagaccgcaagaugagcuuauaggaagggcacguauuagccagggggcagguuggucacugcgagaaacagcaugucucgguaaggcuuacgcacaaauguggucauuaauguauuuucacagaagagaucucagacuugccaguaaugcaauauguucugcagugcccguacauuggguuccaacaagcagaacuaccuggucaauucaugcccaccaccaauggaugacaacggaagauaugcugacagucuggaacaggguauggauugaggacaauccuuggauggaagauaaaacacccguuaccacuugggaaaacguaccguaucucggaaagagggaagaucaauggugcggaagccuuauaggcuuaacaaguagagcuacaugggcucaaaacauccccacugcgauacagcaaguucguucacucauugguaaugaggaguuccuggauuauaugccuuccaugaaaagguuucgaaaggaagaagagucagaaggcgcaauaugguga

SEQ ID NO: 23069 - RNA, 9873 nt, Artificial Sequence
  derived and/or modified CDS sequence (opt6) from DENV-3__GU131871__SS-prME
accagucuaugucugguaaugauuuuaccugccgcgcuagcguuucaccuuacuucgagagauggagagccacgaaugauagucgguaaaaaugaacggggaaaaucauuacuguuuaaaaccgcgaguggaaucaauauguguacucugauagccauggaccugggugaaaugugugaugacacaguaaccuacaaauguccacacauuaccgagguugagccagaggacaucgacugcugguguaauuuaacguccacaugggucacuuauggaacauguaaucaagcaggagaaaggcggagagacaagagaucagucgcuuuagccccacacgucgggaugggauuagauacucguacacaaacauggauguccgccgaaggugcuuggagacaaguugaaaaaguugagaccugggcuuugcggcauccaggauucaccauacuagcacuauuucuagcucacuacauagguacauccuuaacccaaaaagucgugauauucauauuguuaaugcuaguuacaccaaguaugacaaugagaugcguaggaguagguaaucgagauuuuguugaaggucuauccggugccacguggguagauguuguccuugaacauggugguugcgugacuaccauggccaaaaacaaaccuacucuggacauagaauuacagaaaacugaagccacgcaacuagcaacgcuaagaaaacuuuguauugagggaaaaaucacgaacauuacaacugacucaagauguccgacacaaggagaagcuguacuuccagaagaacaagaccagaauuauguaugcaaacauacuuacguagauagaggaugggguaacgguuguggccuuuuuggcaaagguaguuuaguaacgugugcuaaauuccagugucuagaaccaauagaaggaaaaguuguucaguaugagaaucuaaaauauacaguuauuauuaccguacacacaggugaccagcaucaaguugguaaugaaacgcagggaguaacugccgaaauaacaccacaagcaucaacgacugaagcaauauugccugaauaugguacccugggcuuggaaugcuccccacguacgggacucgauuuuaacgagaugauacuccuuacgaugaaaaauaaggcuuggaugguucaucgacaaugguucuuugauuuaccgcuuccuuggacuaccggcgcuacuacagagacacccacguggaauagaaaagaacuccuggugacauuuaaaaaugcacacgcuaagaaacaggagguaguuguuuuagguagccaagagggcgcaaugcauaccgcacuaacaggagcaacagaaauccagaacucgggugggacaagcauuuuugcagggcaccuuaaauguaggcuuaaaauggacaaacuugaacuuaaaggaaugagcuacgcaauguguaccaauacauuuguucucaagaaagaaguaucugaaacgcaacaugguacaauauugaucaaaguagaauaucgcggggaggacgcaccaugcaaaaucccauuuucuacggaagacggacaaggcaaagcacacaacggacgcuuaauaaccgcuaaucccguuguuacuaagaaagaagaaccagucaauauagaggccgaaccaccuuucggagaaaguaauauuguaaucgggaucggugauaacgccuuaaaaauuaacugguacaagaaaggauccucgauagggaaaauguuugaggcgacagcucguggugcaagaagaauggcgauauugggcgacaccgcuugggauuuuggaagcguuggaggaguucucaacaguuuaggaaaaauggugcaucaaauauucgguucagcauauacagcauuguucucgggcgucucauggguaaugaaaauuggaauaggaaucuuacuaaccuggauuggacuaaauucuaaaaacacaucaauguccuucaguugcauugcgauaggcauaauaacucuguauuuaggagcaguuguccaagcagacaugggcugcguaaucaauuggaaaggaaaagaacuaaagugcgggucuggaauuuucguaacgaaugaagugcauacguggaccgaacaauauaaauuccaagcagauaguccaaagaggcucgcuacagcaaucgcuggugcuugggagaauggagucugugguauacggucaacaacacgaauggaaaacuuauuguggaaacaaaucgcuaaugagcuaaauuacauacucugggaaaacaacauuaaacuaacagucguagucggggauauaauagggguccuagaacaaggaaaaagaacgcuuacaccgcagccaauggagcuuaaguacaguuggaaaacaugggggaaagccaagauaguuacagcagaaacgcaaaauagcucauuuauaaucgacgggccuaauacuccagaauguccauccgccucacgugcauggaauguaugggagguagaggacuaugguuucggaguuuucacaacaaacauaugguugaaauuacgagaaguauauacacaacucugugaucauaggcuaaugucagcagcgguaaaggaugagagggcuguacaugcagauaugggauauuggauagaaucccagaaaaauggaucauggaaauuagaaaaggcuucucuuauagaagugaagacuuguacauggccaaagucccauacacuauggagcaaugggguacuagaaucugacaugauaauuccgaaaagccuagcaggacccauaucgcaacacaaucaucgcccaggauaccacacccaaacugccggaccauggcaccuuggcaaguuggaacuugauuuuaauuacugcgaagguacuacuguuguuauaacugagaauuguggaaccaggggcccaucauuaagaacaaccacaguuaguggaaaacucauacacgaaugguguuguagaucauguacacuuccgccuuuacgauauaugggagaagauggguguugguauggcauggagauacguccaauuagugaaaaagaggaaaacauggucaaaagccuaguuucagcagguucagguaaaguagacaauuuuacaauggguguacucugcuuagcaauccuguuugaagaagugaugcgcgggaaauucgggaagaaacacaugauugcuggaguguucuuuacguuuguucuccuucuuucaggccaaauuacuuggcgugacaugacgcauacccucauaaugaucggaaguaaugccucugacagaauggguaugggcguuacauauuuagcauugauagcaacauuuaaaauacaaccguuucuagcacucggguucuuucuaagaaaauugacuucucgugaaaacuugcuacuaggggucggucuugccauggcuacaaccuugcaacuuccugaagauaucgagcaaauggcaaauggcauagcauuaggucuuauggcacuaaaauuaauuacgcaauucgaaacuuaccagcuuuggacagcauuaauaucgcuaacauguuccaauaccauguucacacucacgguagcauggagaacggcuacccuaauacucgcggguguaagccuauuaccugucugucaaagcaguucaaugagaaaaacugauuggcuccccauggcaguagcggccaugggugucccuccuuuaccacuuuuuauauuuucccuuaaagauacguuaaagagacgaaguuggccucucaaugaaggagugauggcaguaggauuaguuucuaucuuagcaaguucccuccuaagaaacgauguaccgauggcagggccucuuguggcugguggucugcuuauugcauguuacguaaucacggguaccuccgcagaucugaccguugaaaaagcagcggauauaacaugggaggaagaagcggagcagacuggggugagucacaaucucaugauaacugucgaugaugacggaacuaugagaaucaaagaugaugaaacagaaaacauuuuaacgguuuuauuaaagacggcauuguugauaguaucaggagucuuuccauacaguauaccagcaacuuugcuaguauggcauacauggcaaaaacaaacacagcgaucuggaguuuuaugggacguaccgagcccuccggaaacucaaaaagcagaauuagaggaaggaguauauaggauaaaacaacaaggaauauucggcaaaacucaagucggcguagggguccaaaaggagggaguuuuucacaccauguggcacguaacacguggagcggucuuaacguauaaugguaaaagauuggaacccaauugggcuucagucaagaaagaccuaaucucuuacggcggugguuggagacuuagugcucaauggcagaaaggcgaagagguucagguuauagcgguugaaccagggaaaaaucccaaaaauuuucaaaccacucccggaaccuuucaaacgacgacgggcgagauaggugcuaucgccuuagacuucaaaccagggacaucggggucaccuauuauaaauagggagggcaaggugguuggauuauaugguaacggaguuguaaccaaaaaugggggauauguaucugggauagcgcagacaaacgccgaacccgacggaccuacacccgaauuagaggaggaaauguucaagaaacgaaacuuaacaauaauggacuuacaucccggaagugguaaaacucguaaauauuuaccggcaauaauacgagaggcuauuaaacgaagauuaagaacuuuaauacuagcaccaacacgaguugucgccgcagagauggaggaggcauugaaaggccuuccaauaagauaccaaaccacagcaacuaagucggagcauacaggacgggaaaucguugaccugaugugucaugcgacuuucacaaugagacuauuaaguccaguacgcguaccaaauuacaaucuuauaauaauggaugaggcgcacuucaccgacccggcaaguauagcagcuagaggcuauaucucaacacggguaggcaugggugaagccgcggcaauuuuuaugacugcuaccccaccugggacagcagaugccuuuccccagaguaacgcgccgauucaggaugaagaacgggauauuccggaaagaucauggaacucuggaaaugaauggauaacagacuuugcgggaaagacugugugguuuguacccucuauaaaggccgggaaugauaucgcaaauugucuacgaaagaauggcaagaaaguuauccaacuuucacgaaagacauucgauacagaguaucagaaaacuaaacuaaacgauugggacuucguuguaacgacugauauuucagaaaugggggcuaacuuuaaagcugacagaguaauugacccaagacgauguuuaaaaccaguuauccucacggauggcccugaaagggucauauuagcugggccuaugccaguaacagcagcauccgccgcucaaagaagaggcagaguuggcagaaauccacaaaaagaaaaugaucaguacauauuuaccggccagccguuaaauaacgaugaagaucaugcucauuggaccgaagcuaagaugcucuuagauaacauaaacacaccggaaggaaucauuccugcacuuuucgagccagaacgggaaaaaucugccgccauagacggagaauacagauuaaaaggggaaagucgaaagaccuucguggagcuaaugcgucgaggcgaccucccuguauggcuggcacacaagguagcgagcgaaggaaucaaauauaccgauagaaaauggugcuuugauggacaaagaaauaaccaaauauuagaagagaauauggauguagaaauuuggaccaaagaaggcgagaagaagaaauuaagaccaagauggcuagaugcgcgaacauacucagauccacuggcuuuaaaagaauuuaaagacuuugccgcagggcgaaagucuauugcacuggaucuaguaacagaaauaggaaggguuccgagucauuuagcucaucguacuagaaacgccuuagauaaccuugugauguuacauacauccgagcauggagggagagcauauagacaugcugucgaagaauugcccgaaacaauggaaacacuacuccuccugggcuuaaugauacugcuaacagggggugccaugcuauuccucauauccggaaagggaauuggaaaaacuagcauaggauuaauaugcguaauagccucuaguggcauguuauggauggccgagauuccguuacaauggauagcgagugcuauaguuuuagaauuuuucaugaugguauuauugauaccagaaccagaaaaacaaaggacaccacaagacaaucaauuagcuuauguagucauugggauccuaacacuagcagccauaauugcggcaaacgaaauggggcuacucgaaacaacgaagagggacuuaggaauguccaaagaaccagggguaguuaguccaacuucauaccuagacguagauuuacauccagccucagcuuggacucucuacgcuguugccacaacagucauuacaccaaugcuuagacauacuaucgaaaacagcacagcaaauguuucacuggccgcuauugcaaaucaagcaguugugcuuaugggcuuggauaaagguuggccaauuucgaaaauggaucuaggggugccauugcuugcauuaggaugcuauagccagguaaacccuuugacuuugacagccgcaguguuauuacugauaacacauuaugcuauaaucggaccaggauuacaggcaaaagcuacucgagaagcgcaaaagagaacagcagcagguaucaugaaaaacccaacagucgaugggauaaugaccauagaccucgauccgguaauauaugacaguaaauuugaaaagcaauuaggccagguaaugcucuuaguuuugugugccguccaacuauuacugaugcguacaaguugggcacugugugaagcucucacuuuagcgaccggaccuauuacaacauuaugggaagguuccccagguaaauuuuggaacacgacaaucgcaguuucuauggccaauauauuccgagggagcuaucuggcaggagcuggacuugcuuuuagcauaaugaagucuguaggcacaggaaagagaggaacaggaucucagggugaaacacuuggggaaaaauggaagcgcaaacucaaccagcuuagcagaaaagaauuugaccuuuacaagaaaaguggaauaacugaaguggaucguacugaggccaaggagggacuuaagagaggagagaucacacaucacgcuguaagccgaggguccgcaaaauuacaaugguucguugaacguaacaugguuaucccagagggaagaguuaucgaccuuggcuguggucgaggaggcuggucuuauuauugugcuggccugaagaaaguaacggagguucgaggauauacaaaagguggcccuggacaugaggaaccggugcccaugucaaccuacggguggaauauaguaaaacugaugucuggaaaagacguauucuaucugccaccugaaaaaugugauacauugcuuugugacauaggagaaaguucuccaucucccaccgucgaagagucccgcacgaucaggguucucaaaauggucgaacccugguugaaaaacaaccaauuuugcauuaaaguauugaauccguacaugccuacuguaauagagcaccuagagcggcuacaaagaaagcacggagggauguuagugagaaauccauuaucucguaacucaacucaugaaauguacuggauuucaaauggaacaggaaacauaguagcauccguaaacaugguaucaagauuauuauugaacagauuuacuaugacucaucgaagacccacuauugaaaaagacguagauuuaggagcagggacucgccaugugaaugcugagccagagacuccaaauauggacguaauaggugagcgaaucaaacgcauuaaagaggaacacaacagcacauggcacuacgacgacgaaaauccguauaaaacaugggcauaccauggcucauacgaagugaaagcuacgggaagugcgucaucaaugauaaauggagucgugaaacucuugacgaagccgugggaugugguaccaaugguuacacaaauggcuaugacggacacaaccccuuucggacaacaaaggguauucaaagaaaaaguagacacgcggacuccacgaucuaugccagguacuaggagaguuauggaaauaacagcagaauggcucuggcgcacuuuagggaggaauaaaaagccacgauuguguacucgggaggaauuuacaaagaaaguaagaacgaacgcagcaaugggagcaguauuuacagaagaaaaucaaugggauagugcgaaggcagcgguagaggacgaggacuuuuggaaacuggucgacagggaaagagaacugcauaaguuggggaagugcggaucuuguguguauaacaugaugggaaaacgagaaaagaaauuaggcgaauuuggaaaagccaaaggaucaagagcaauuugguacauguggcuuggagcgagguacuuggaguuugaagcauuaggauuuuuaaaugaggaccauugguucagcagagaaaauaguuauagcggaguagagggagagggauuacacaaauuaggguauauuuugagggauauuucaaagaucccaggaggugcaauguacgcagaugacacugcuggaugggacacgcgcauaaccgaagacgacuugcacaaugaagagaaaaucacucaacagauggauccugaacacaggcaacuugcaaacgcuauuuuuaaacuaacuuaccagaauaaaguagugaaagugcaaaggccuacaccuacuggaacuguaauggacaucaucagccguaaagaccaacguggaucuggacaggucgguacguacggauuaaacacuuucacaaacauggaagcacaauugauacgucaaauggaaggagaagguguuuuaucuaaagcugaccucgaaaacccacaccucccggagaagaaaauuacacaauggcuagaaaccaaagguguagaaaggcucaaacgaauggcaauaucgggcgacgacugcgucguuaaaccaaucgacgaccgauuugccaaugcauuguuggcccuaaaugacauggggaaaguaagaaaagauauuccgcaauggcaaccaaguaaggguuggcaugacuggcagcaagugccauucuguucucaucauuuucaugaauugauuaugaaagauggaagaaaauuagugguaccaugcagaccccaggaugaacugauaggcagagcaagaauaucgcaaggagcugguuggaguuugcgugaaacagcaugccuagguaaagcguacgcgcaaauguggaguuugauguacuuccaucgaagagaucugagacucgccuccaaugcuauaugcucagcaguaccaguucauugggugccaaccucuagaacgacauggucaauacaugcucaucaccaauggaugacuaccgaagauaugcuaacaguguggaaucggguauggauugaggauaacccguggauggaagacaaaacaccaguuacaacuugggagaacguaccauaucuggggaaaagggaagaucaaugguguggcagcuuaauagguuugaccucgagagcaacaugggcacagaauauaccuacugcaauacaacagguacgcagcuuaauagggaaugaagaguucuuagacuauaugccuuccaugaaacgauuccgaaaagaagaagaguccgaaggagcaauaugguag

SEQ ID NO: 23070 - RNA, 9873 nt, Artificial Sequence
  derived and/or modified CDS sequence (opt6) from DENV-3__GU131872__SS-prME
acaaguuuaugccuggucaugauauuaccagcugcccuugcuuuucacuuaacuagccgggauggagaaccaagaaugauaguggggaaaaacgaacguggaaaaucauugcuguuuaaaacggcuucuggcauaaauaugugcacuuugauagccauggaccuuggggaaaugugugaugacacaguuacauauaaauguccacauauaacggaaguagaaccugaagacauagauugcugguguaacuuaacgucaacguggguaacguaugguaccuguaaucaggcaggagaaagaaggcgagacaaacgaagcguugcuuuagcgccucacguaggcaugggguuagauacacgaacacaaacauggaugagugcagaaggagcauggcgacaaguagaaaaaguugaaacaugggcguuaagacacccuggauuuacuauucuagcucuauuuuuggcccauuacauuggaacgucacuaacucaaaaaguugucaucuuuauccuauuaauguuagucacuccaagcaugacuaugagaugcguaggaguagguaaucgggauuuugucgaaggauuauccggcgcuacauggguugacguuguguuagaacacgguggcugugucacaacuauggccaaaaacaaaccaacauuagacauagaacugcagaaaacugaagcuacucaacuagcaacucugaggaaauuauguauagaaggaaaaaucacuaauauaacaacagacucgagaugucccacacaaggugaagcuguucuaccggaagaacaagaccaaaauuauguuuguaaacacacauacguggauagaggaugggguaaugguugcgggcucuuuggaaaagggucuuuagugacuugcgcaaaauuucaaugucuagaaccuauagaagggaaaguuguacaauaugaaaauuuaaaauacacuguaauuauuacagugcacacaggggaucaacaucaaguugggaaugaaacgcaaggugugacagcugaaauaacaccucaagcuagcacaacugaagcuauacugccagaauacgguaccuuaggcuuagaaugcucaccgcguacaggcuuggauuucaacgaaaugauccugcuuacuaugaaaaauaaagcauggaugguacaccggcaaugguucuuugaucuuccucuacccuggaccucuggagcuacuacagaaacaccuaccuggaauagaaaagaacuucucguuacauuuaaaaacgcgcacgccaagaaacaagaaguagugguacuggggucacaagaaggggcaaugcacacugcacucacgggcgccacagaaauucaaaauucagggggaacgagcaucuuugccggucaucuuaaaugcagguugaaaauggacaaauuagaauugaaaggaaugagcuaugcgaugugcacuaacacauuuguacuuaagaaagaagugagcgaaacucaacauggaacuauauugauaaaaguagaauaccgaggagaagaugcucccugcaaaauaccauuuaguacagaagauggccaaggaaaggcacacaaugguaggcuaauuaccgccaaucccguaguaacaaagaaggaagaaccaguuaacauagaagcggaaccaccuuuuggagaaaguaauauagucauugguaucggggauaacgcauuaaaaaucaauugguauaaaaagggaaguucaauaggcaaaauguuugaagcaacugcuaggggagccaggcgaauggcaauccugggugacacagcaugggauuucggauccgucggagguguacuuaauucuuugggaaaaaugguacaucaaauauuuggauccgcuuacacugcuuuauucucugguguuaguuggguuaugaagauaggcauaggcauucuacucacuuggauuggacuaaacucaaagaauacgaguaugucauuuucaugcauagcgaucggaauaauaacuuuauauuugggugcgguuguacaagcugauauggguugcguaaucaauuggaaaggaaaggaauuaaaaugcgguucuggaauauucgucacaaaugaggugcacacauggacagaacaauauaaauuccaagccgacuccccgaaaagacuagcaacagcaauagcuggagcaugggaaaauggaguauguggcauaaggagcacuacaagaauggagaaucuucuauggaaacagauugccaacgaauuaaauuacauucuaugggaaaauaacauaaaacuaacaguggugguuggggauauuauaggcguacuugaacaggguaaaaggacauuaacuccgcaaccaauggaauuaaaauauagcuggaagacauggggcaaagcuaaaauggucacugcagagacacaaaauucaaguuuuaucauagacgguccaaauacaccggaauguccgucugcuagucgcgcauggaauguuugggagguugaagauuaugguuucggcguguuuacgacaaauauauggcucaaacuacgugaaguauauacacagcuaugugaucaucgauuaaugagcgcagcuguaaaagaugagagagccguucaugcggacauggguuauuggauagaaucgcagaaaaauggaaguuggaagcuggaaaaagcaagccuuauugaagugaaaacuuguacguggcccaagagucauacauuauggagcaaugguguauuagaauccgauaugauaauaccgaaguccuuggcuggaccaaucucacaacauaaccauagaccaggauaccauacucaaacugcaggaccauggcacuugggaaaauuagaguuagauuucaauuacugcgaggggacaacgguaguuauaacggaaaacugcggaacgcgcggaccuucccuaagaacaacaaccguuagcgggaaguugauacaugaauggugcuguagaagcugcaccuuaccuccacuuagguacaugggugaagacggauguugguauggaauggaaauaagacccaucucggaaaaagaagaaaauaugguaaaaagucuuguauccgccggaagcgguaaagucgacaacuuuacuaugggaguacuaugccuugcaauucucuuugaagagguuaugcgcggaaaauucggaaagaagcacaugauagccggcguauucuuuacuuuuguccugcuacuaaguggccagauuaccuggcgagauaugacccacacacugauaaugauaggaucgaacgcuagugauagaaugggcaugggaguaacauaucuagcucuuauagcaacguuuaaaauacagcccuuuuuggcauugggauuuuuccuuagaaaacucacgucaagagaaaauuuauuacuaggcguugguuuagcgauggcaacgacccuucagcuaccagaggauauagagcaaauggcaaacggcaucgcauuagggcuaauggccuuaaaacuaauuacccaauucgaaacguaucaacuauggacagcucuuauuucuuugacauguucaaauacgauguuuacguugacuguggcauggaggaccgcgacauuaauuuuagccgggguuucacuauuaccagugugucagaguucaucgaugagaaaaaccgauuggcugccaauggccguugcagcgaugggaguuccgccuuuaccacuauuuauauuuuccuugaaggauacauugaagcgacgaagcuggccacuuaaugagggaguuauggcaguuggcuugguuaguauauuggccaguucccuguuaagaaaugaugucccaauggcaggaccguugguagcggguggguuacuaauugcuugcuauguuauuaccgguaccucagcugaccuaacugucgaaaaggccgcggauauaaccugggaagaagaagcagagcaaacgggcgucucccauaacuuaaugauaacaguugaugaugacggaaccaugagaauuaaggaugaugaaacagagaacauuuuaacuguacuacuaaaaaccgcucucuuaauuguuuccggagucuucccauacaguauuccagcaacucuauuaguauggcauacguggcaaaagcagacacaaaggaguggaguguugugggauguacccaguccacccgaaacucaaaaagcggaauuagaggaaggaguauauagaaucaagcaacaaggaaucuucgguaagacgcaaguaggaguggguguacaaaaggaagggguguuucacacaauguggcauguaacacgcggagcgguacugacuuacaaugguaaaagacucgagccuaacugggcaucgguaaagaaagaucucauauccuacggugggggauggagauuaucugcacaauggcaaaaaggagaggagguucagguuauugcgguagaacccggcaaaaauccgaaaaauuuucaaaccacuccgggaacauuccagacaacgacaggugaaauaggcgcaauugcauuagauuuuaaaccaggcacuucaggaucuccuauuauaaaccgcgagggcaaaguggucggcuuauaugguaacggcguaguaacuaaaaacgguggguacgucagugguauugcgcaaaccaaugcagaaccagauggaccaacuccugaacuugaagaagaaauguucaagaaacgaaacuugacuauaauggaccugcaucccggaucagguaaaacgcgaaaauaucuucccgccauuauuagagaagccauaaaacgacgguuacgaacucuuauuuuagcuccuacuagagucguggcugccgagauggaggaagcauugaaaggacucccuaucagguaccaaaccacggccacgaaaucagaacauacuggccgagagauaguugauuuaaugugccacgcgacauuuaccaugagguuacuaucaccaguacggguaccgaauuauaaucuuauaauuauggaugaagcacacuuuacugauccugcuucaauagcugccagaggauacaucagcacccgaguaggaaugggggaagcggccgcaauauuuaugacggccacuccacccgggacugcugacgcguuuccccaaagcaaugcucccauccaagaugaggagagggauauaccggaacgaucauggaacaguggaaacgaauggaucacugauuucgcagguaaaacuguaugguucguaccgagcauuaaagcuggaaaugacauagcuaacugccugcgcaaaaauggcaaaaagguuauccaguuaaguagaaaaacuuucgauacagaguaccagaagacaaaacuaaacgacugggacuucguaguaacaacagacauuucugaaaugggagcuaauuuuaaggcugacagaguaauugacccucgaagaugccuaaagccagucauccuaacagaugguccugagagaguaauacucgcggguccuaugccuguuacagcagccucagcagcacaacgaagagggcguguaggaagaaauccgcaaaaagaaaacgaucaguauauauucacuggucaaccguuaaauaacgaugaagaccacgcucacuggaccgaagcuaaaaugcuacuggacaacauuaacacaccagaagguaucauaccugcauuauucgaaccagaaagagaaaaauccgcagcaauugauggugaauaucgucucaaaggagaaaguagaaaaacauucguagaacuuaugcggcguggagauuuaccgguauggcuagcucacaaaguagcaagugaggguauaaaauauacagaccgaaaauggugcuuugacggacaacggaacaaucagauccuugaggagaauauggauguagagauauggaccaaagagggggagaagaagaaauuaagaccacguuggcuagaugcacguaccuacuccgacccgcuagcccuuaaagaauuuaaggacuuugcagcagguaggaagaguauugcucuugauuuaguaacagaaauaggaagagugcccagucaccuagcccauagaacucgaaaugcacuagauaacuuaguaaugcuacacacaagugaacacggagguagggcauaucgccacgcuguagaagaauuaccagaaacaauggaaaccuuguuacuguuaggucuaaugauacuuuuaacagggggagcuauguuguucuuaauaucugggaagggcauaggcaagacuagcaucgguuuaauaugcguuauugcaucgagcgguauguuauggauggcagaaauaccuuugcaauggaucgcuagcgcaauuguauuagaauuuuucaugaugguacuacuuauaccagaacccgaaaagcaacguacuccucaggauaaucaacuagccuauguaguuauaggaauacuaacacuugcagcuauaauagccgcgaaugagaugggcuuacuggaaaccacgaaacgagacuugggaaugaguaaggaaccaggcguaguuucuccuacuuccuaucucgacguagaucuucaccccgcgucggcuuggaccuuauaugcgguugcaaccacaguaauuacaccgaugcuacggcauacaauagaaaauagcacagcaaacguaucacuugcagcaauugcuaaucaagcgguagugcuaaugggacuggauaaggguuggccaauuagcaagauggauuuggguguuccacuacuggccuuaggcugcuacagucagguaaacccuuuaaccuuaacagccgcgguguugcuauugauaacacauuacgcaauaauaggaccaggauugcaagcaaaggcaaccagagaagcacagaaacguacagcagcaggaauuaugaaaaauccgacaguggaugggaucaugacaauugacuuggauccaguuaucuacgauagcaaauuugagaaacaacugggacaggugauguugcuaguucugugcgcgguccaguuacucuuaaugcgaaccucaugggcacugugcgaagcacugacacuagcaacaggucccauaacuacacuuugggaggggucuccagguaaguuuuggaauacaacuauagcgguaagcauggcaaauauauucagaggaagcuaucuugcuggugcaggucuagcauuuaguauuaugaaaucuguaggaacgggaaaaagaggaacagguucacaaggagaaacccucggugaaaaauggaagaagaaacuaaaucaacuuagucgaaaagaguucgaucuauauaagaaaucagguauaacagaaguggaucguaccgaagcaaaagagggacuuaagagaggcgagaucacucaucaugcaguaucacgcgggucagcuaaauugcaaugguucguagaaagaaacauggugauaccagaagggagaguaaucgaucuuggcugcggaagaggggguuggaguuauuauugcgcaggguuaaagaaagucacagaggugaggggcuacacuaaaggugguccaggacaugaagaaccggugccuaugucaacauacggcuggaacauaguaaaauugaugucagggaaagacguauuuuacuugccuccugagaaaugugacacauuacuuugugauauaggcgaaaguaguccaaguccaacaguugaagaaucgcguaccauaagaguacuuaaaaugguggaacccuggcuuaaaaacaaccaauuuuguauaaagguacuuaacccauauaugccgacagugauagaacauuuagagagacuucagcgaaaacacgguggaaugcugguuagaaauccguuaagucggaacuccacacacgaaauguacuggauaagcaaugguacaggaaacauuguagcaagcguuaacauggucucaagauuguuacuaaaucgauuuacuaugacucauagaagacccacaaucgagaaagauguugaucuuggcgcaggcacaagacacguuaacgccgaaccagaaaccccaaauauggacgugaucggcgaaagaauuaaacgaaucaaagaagaacauaauucgacuuggcauuaugacgaugaaaaucccuauaaaaccugggcauaucacgguucauacgaagucaaagcaacuggaagcgccucuuccaugauaaacgggguagugaaguuguugacaaaaccaugggacguaguaccuaugguuacacaaauggcaaugacggauacgacgcccuucggacagcagcggguuuuuaaagaaaagguugacacgcguacccccagaucuaugccagguacuagacguguaauggaaauaacugcugaauggcuuuggaggacucuggguaggaacaagaaaccuagacucugcacgagagaagaguucacuaagaaaguaagaacgaacgcagccaugggcgcaguuuuuacagaagagaaccagugggacucagcaaaagcugcggucgaagacgaagauuucuggaaauuaguagacagggagcgugaguuacauaaacuaggaaaauguggauccugcguauauaacaugaugggaaaacgugagaagaaacugggggaguucggaaaagcaaaagguaguagggcgaucugguauaugugguuaggagcgagguaccucgaguucgaggcuuugggauuccugaaugaagaccacugguuuucgcgggaaaacagcuauagcggggucgaaggugaggggcugcacaaauuagguuacauacugagagacauaucaaaaauuccaggaggagcuauguaugcagacgacacugccggcugggauacuaggaucacagaagaugacuuacauaacgaagagaaaauuacgcaacaaauggauccagagcaccgacaguuggcaaaugcgauuuuuaagcuaacuuaucaaaacaaaguuguaaaagugcagagaccaacaccuacggguacggucauggacauuauaagccgaaaagaucaacgaggaucaggacaaguuggaacauauggucucaacacauucacaaauauggaagcccaacuaauaagacaaauggagggugagggcguauuauccaaagcagaucuagaaaauccacaucuaccugagaagaaaauuacucagugguuagagacuaaagguguggaaagacuaaaaaggauggcaauaucgggagacgacugcguaguaaagccgaucgacgauagauuugcgaaugcucuguuagcucuaaaugacaugggaaaaguaagaaaggauauaccacaguggcaaccgagcaaaggguggcaugacuggcagcaggucccuuucuguucacaccacuuccacgaauuaauuaugaaggauggacggaaguuaguaguacccuguaggccacaagaugaauugauaggacgggcucgcauaucccaaggagcaggguggucucucagagagacggcuugucuuggaaaagcauaugcgcagauguggagucuaauguacuuucauagaagagaucuuagacuagccagcaacgcaauaugcucggcaguuccuguacacuggguuccuacauccaggacaacauggagcauacaugcucaucaucaauggaugacuacugaggacauguuaacgguauggaauagggucuggaucgaagauaauccuuggauggaggacaaaacaccaguaacgacaugggaaaauguaccauacuuaggaaaaagagaagaucaguggugcggcagcuuaauagguuuaacaaguagagcuacuugggcccaaaauauaccaacugccauacaacaaguucgcucacuaauuggaaacgaggaguuccucgauuauaugccaucgaugaaacgauuucgcaaagaagaggaaucagagggcgccauaugguaa

SEQ ID NO: 23071 - RNA, 9873 nt, Artificial Sequence
  derived and/or modified CDS sequence (opt6) from DENV-3__GU131873__SS-prME
acgucucucugcuuaaugaugauccucccggcugcacuugcguuccacuuaacaagccgcgauggagaaccccggaugauaguaggcaaaaaugaacguggaaaaucgcuucuuuuuaaaacagcgucgggaauuaacaugugcacauuaaucgcaauggacuuaggagaaaugugcgacgacacgguaacauauaaauguccacauauuacugaaguagaaccugaagacauugacuguugguguaaccuaacaaguaccuggguaacauaugggacaugcaaucaagcaggagaacguagaagggacaaacguucaguugcuuuggcaccacacguuggcaugggacuagacacuaggacacaaacauggauguccgcugaaggcgcauggcggcaaguugaaaaaguagaaacaugggcuuuaagacauccugguuuuacaauauuagcucucuuucucgcccacuacaucggaacaagccuuacacaaaaagucgugauauuuauauuguuaauguugguaaccccaaguaugacaaugcgaugugucgggguaggcaaucgagauuuuguagaaggacuuaguggcgcaacuuggguagaugucguacucgaacauggaggcugugucaccacuauggcgaaaaacaaaccuaccuuagauauagaacuacagaaaacagaagcgacacaacuagcaacauugcgaaaauuauguauagaaggaaaaauaaccaauauuacaacugauucacgauguccuacucagggagaagcgguauuaccugaagaacaagaccaaaauuacgucuguaaacauacauacguagaccgcggguggggcaacggcuguggacuuuuuggcaaagguucgcuaguuacaugugcaaaauuucaauguuuggaauuaauagaagggaaaguuguacaauaugaaaaucuuaaauauacagugguaaucacaguacacacaggugaucaacaucaaguagguaaugaaacccaggguaucacagcggaaauaacaccacaggcuucuacuacggaagcaaucuuaccagaauauggcacuuuaggauuggaauguucuccucguacaggacuagacuucaacgaaaugauauuguuaaccaugaaaaauaaagccuggauggugcacagacaaugguucuuugauuuaccacuaccauggacauccggugcgacaacagaaacaccgacauggaacagaaaagaacucuugguaacauuuaaaaacgcccaugcuaagaaacaggaaguaguaguacuaggaucacaagaaggugcaaugcacacugcacuaacaggugcgaccgaaauacaaaacucaggaggcacuucaauauucgcaggacaccucaaaugccgauugaaaauggacaaacuagaacuuaaagguaugucuuaugccauguguacgaauaccuuuguguugaagaaagaaguaucugaaacucaacacggaaccauccuuauaaaagucgaauauaaaggugaagacgcuccgugcaaaauaccauucucaacggaagacggacaagguaaagcgcacaauggucgccucaucacugccaaucccgucguaacuaagaaagaggaaccgguuaauauagaagcugaaccgccguucggcgagucuaauauugucauugggauaggagauaaugcccucaaaauuaauugguauaagaaaggaucuucaaucgguaaaauguuugaagcaacggcacggggagcacggaggauggcaauacuaggagauacugcuugggauuucggaagcguuggcgguguauuaaauucccuaggaaaaaugguucaccaaaucuucgguucugcauacacagcucuauuuaguggugucuccuggguuaugaaaauaggcauaggagugcuacucacauggauaggccuaaacaguaaaaauacauccaugucauucucuugcauugcuauaggaauaauuacguuauaucuaggugcuguuguacaagccgauauggguuguguaauaaacuggaaaggcaaagaacucaaaugugggagcggaaucuucguuacaaacgaaguacauacguggacagagcaauauaaauuucaagcagacuccccuaaaagacuagccaccgcaauagcuggggcaugggaaaacggaguaugugguauucgauccacaacaagaauggaaaaccuacuuuggaaacaaauagcaaaugaacuaaauuacauacuaugggaaaacaauauaaaacuuacagugguugucggagacaucaucggaguacuugaacaaggaaaacgaacuuuaacuccccagccgauggaacuaaaauauaguuggaaaaccuggggcaaagccaaaauaguaacagccgaaacgcagaauagcucauuuauaauagauggccccaauaccccugaauguccaagugcaaguagggcauggaauguaugggaaguugaagacuauggcuucgguguguuuacuacuaauauauggcuuaaauugcgggaaguauacacucaauugugcgaucaccgucuaaugucagcagcagucaaagaugaacgggcaguacacgcugauaugggauauuggauagaaucucagaaaaauggaucauggaaauuagagaaagccucuuugauagaagucaaaacuuguacuuggcccaagucucauacacuuuggucgaacggaguuuuagaauccgauaugaucauaccaaaaucauuagcaggucccauaucucaacacaaccauaggccaggcuaccauacgcaaacugcagggccauggcacuuagggaaauuggaacuagacuuuaauuauugcgaaggaacaacaguuguaauuacagaaaacuguggaacaagagguccaagucuaaggacaacgacugucucaggcaaacuaauacacgaaugguguuguagaucuuguacccucccaccacugcgguauaugggugaagauggaugcugguacggaauggaaauucgcccaauaucggaaaaagaagaaaacaugguuaaaucccuugugucagcaggaucuggaaaggucgacaauuuuacaaugggaguccucugccuagcuauccuguuugaggaaguuaugagagguaaauucggaaagaaacauaugauagcaggaguuuucuuuacauuugucuuacuacuuuccgggcaaaucacauggagggauauggcacauacacuaauaaugauaggaucgaaugcgucugauagaauggguaugggugucacauaucuugcacuaaucgcaacauuuaaaauucagcccuuccuagcacucggauucuuuuugagaaaacuaacaagucgagaaaaucuauuacuaggcguuggauuggcaauggcgacuacguuacaauuaccugaggauauagaacagauggcgaacgggauugccuuaggacucauggcccuaaaauuaauaacccaauuugaaacauaucaacuuuggacugcuuugaucucccuaacuuguuccaauacgauguuuacacugacaguagccuggagaacggcaaccuuaauccuagcugguguuucuuuauugccagucugccaaaguaguagcaugcguaaaacggauuggcuaccgauggcgguagcggcaaugggagucccuccccuuccccuguucauauucucuuugaaagacacccuaaaaagaagaucuuggccauuaaaugaaggaguaauggcuguaggccuuguaaguauauuagcaaguucauugcugagaaacgauguuccuauggcuggaccucuaguagcaggaggacuuuugauugccuguuauguuauaaccggaacaagcgcugauuuaaccguugagaaagcggccgauauuacaugggaagaagaggccgagcagacugggguuagccacaauuuaaugaucacggucgacgaugacggaacaaugaggauaaaagaugaugaaaccgaaaacauauugacuguccuacuaaaaacugcacuucugaucgucucugguguuuuuccauauaguauaccggcaacauuacucguauggcacacguggcagaaacagacccaacgaucaggugugcugugggacguaccgucaccgccugaaacccagaaagcugagcuugaagaaggaguuuaccguaucaaacaacaagguauauucgguaaaacgcagguuggcgucgguguacaaaaagaagguguguuucauacaauguggcaugucacccggggagcaguacugacauacaauggaaaacgguuggaaccuaacugggccagcgucaagaaagaucuaauuucguacgggggaggauggagguugucagcacaauggcaaaaaggagaagagguacaagucaucgccguagaaccggggaaaaaucccaaaaauuuccaaacuaugccugguacguuucaaacaacaacaggagaaauaggcgcaaucgccuuagacuucaaaccggguacuucugguucuccuauaauaaauagggaaggaaagguaguugggcuauacggaaauggcguaguaaccaaaaauggaggguacgucaguggaauagcucaaacuaaugcugaacccgaugguccuaccccugaguuggaagaagaaauguuuaagaaacgaaacuugacgauaauggacuugcacccuggaagugguaaaacucgaaaguaucuaccagcuauaguucgagaagcaaucaagagaagacucagaacuuugauccuugcuccuaccaggguaguggcggccgaaauggaagaagccuuaaaaggauugccaauuagauaucagacaacugcuaccaagucagaacauacgggccgagaaauagucgaccugaugugucacgccacguuuacuaugaggcuuuuaagccccguacgggucccaaauuacaacuuaauaauuauggaugaagcacacuucacagauccagcauccauugcagcaaggggauacauaagcaccagaguaggaaugggagaagccgccgccauuuucaugacagcaacaccuccaggcacagcugaugcuuucccccaauccaacgcuccaauacaagaugaagaaagagauauaccugagcguagcuggaacucagggaacgaauggauuaccgacuuugcggguaaaacaguuugguuugugccauccauuaaagcggggaaugauauagccaacugccuccguaaaaacggaaagaagguuauacaacuaaguagaaagaccuucgauacggaauaucagaaaacaaagcucaaugacugggacuuuguagugaccacugacauaagugaaaugggagcuaacuuuaaagcggaccggguuauagauccaaggcgguguuuaaaaccggugauauuaacagauggaccagaaagaguaauauuggccggcccgaugccuguaacugcggcuucagccgcacaacgccgaggacguguaggccgcaauccacaaaaagagaaugaccaguacauuuucacuggacaaccccuaaauaacgaugaagaucacgcacacuggaccgaagcgaaaaugcuguuggauaauguuaauaccccagagggaaucauaccugcucuauuugagcccgaaagagaaaaaucagcagccaucgacggcgaauaucgcuuaaaaggagaaucacguaaaaccuucguugaauuaaugaggcguggagaucugccgguuuggcuagcucacaagguggcgagugaagguauaaaauacacggaccgaaagugguguuuugacggacaaaggaacaaucagauauuagaagaaaauauggauguggaaauauggacaaaagaaggugagaagaagaaacuucggccacggugguuagacgcaagaaccuacuccgacccucuagccuugaaagaauuuaaagacuucgcggcugguagaaaaucgauugcccuagaccuggugacugaaauugguaggguuccaucgcaucuugcccaccgaacgcguaaugcucuagacaaucuuguaauguuacacacaucagaacauggaggucgcgcauacagacaugcgguagaagaguuaccagagacuauggaaacacuuuuauuacugggacucaugauccuuuuaaccggaggggcaauguuauuuaucauaagcgguaaggggaucggaaagacaucgauagggcuaauuuguguuauagcaagcagugguauguuguggauggcagaaauaccuuuacaguggaucgcaucagcgauaguuuuagaguucuucaugaugguccucuuaauaccagaaccggaaaagcaacgaacaccccaagauaaucaacuagcguacguuguaauaggcauauuaacuuuggcagcaaucauagcagcuaacgaaaugggucuauuagaaacaacuaaacgagaccuaggcaugagcaaggaaccaggugucguuagcccuacuucauaucuggauguagaccuacaucccgccucagcauggacgcuauacgccguugcuacaacugugauuacgcccaugcucagacauacaauagaaaacagcacugcuaauguaagucuagcugcuauagcaaaucaagcggugguauuaaugggccuagauaagggcuggcccauauccaagauggauuuggguguuccauuacuggccuuaggaugcuacucucaggucaauccccugacccucaccgcggccguucuacuacugauaacacacuaugcaauuauaggaccaggucuucaagcuaaagcgacacgagaggcucagaaacgaacagcugcgggaauuaugaaaaacccgacuguagacggaauaaugacaauugaucuagauccaguaauuuaugacucaaaauucgaaaaacaacuaggacaggugaugcuacuuguucucugugcagugcaacuguuacuaaugcgaacuucgugggcguuaugcgaagcauuaacguuagcaacgggccccaucacgacccuaugggaaggaucaccaggaaaauuuuggaauacuaccauagcaguaucaauggcaaauauauuccgaggaaguuaccuagcaggagcaggcuuagcauuuaguauuaugaaaucgguagggacaggaaagcgaggaaccgggagccaaggagaaacacuaggagagaaguggaagaagaaacugaaccaauuauccaggaaggaguucgaccuguauaagaaaaguggcauaaccgagguugauagaacggaagcaaaagagggacuaaaaagaggcgagauaacacaucaugcgguaagucggggaagcgccaaacuacaaugguucguagaacgaaacaugguaauacccgagggucgaguaauagaccugggaugcggacgaggaggcuggaguuauuauugugcuggacuaaagaaaguaacagaaguaagaggguauacgaagggagguccugggcacgaggaacccguccccaugaguacauauggauggaauaucguaaaguugaugagugguaaagacgucuuuuacuuaccgccagaaaaaugcgacacacuacuaugcgacauuggcgaaagcucuccguccccgacaguagaagagagcagaacaauucgaguccuaaaaauggucgaaccaugguugaagaauaaucaauuuugcauuaaaguacuaaauccauauaugccuacaguaaucgaacaucucgaaagacugcaacgcaagcacgggggaauguugguuagaaacccucuaucacgcaauaguacucacgaaauguauuggauaaguaacggaacuggaaacauaguugccucggugaacauggugucgcgacuucuuuuaaauagguuuacaaugacccauagaagaccuaccaucgaaaaagauguugaucucggagcaggcacuaggcauguaaaugcagagccugagacacccaacauggauguaauuggggagaggaucaaaagaaucaaagaagaacauaacagcaccuggcacuacgaugacgaaaacccauauaaaacaugggcauaucacgguaguuacgagguaaaagcaacaggaagugcaucaucaaugauuaacgggguaguaaaauuacugacaaaaccaugggacguaguuccaaugguuacacagauggcgaugacagauacuacgccauuuggacaacaacgaguuuuuaaggaaaaggucgauacaagaacaccaaggucuaugccggguacucgucgcguuaugggcauuaccgcagaauggcucuggagaacucuagggcgaaauaagaaaccacgacuauguacgagggaagaguucaccaagaaaguacguacaaacgccgcaaugggugcaguauuuacagaagaaaaccagugggauucagcaaaagcagcaguagaagacgaggauuuuuggaaauugguagaccgagagcgagaacuacacaagcugggcaaguguggcagcuguguauacaauaugaugggaaaaagggagaagaaauuaggggaguucgggaaagcaaaaggaucacgggcaauaugguacaugugguuaggagcgcguuaccuagaauuugaagcgcuaggauuucugaaugaagaccacugguucagcagagaaaauaguuauucugggguagaaggcgaagguuugcacaaacucggguacauucuaagagauaucucuaagaucccuggaggagcaauguaugccgaugauacagcugguugggauacucgcaucacagaggacgauuugcacaaugaagagaagaucacacagcagauggacccggaacauaggcaacuagcaaaugcgauauuuaaguuaacuuaucaaaauaaagucguuaaaguucaaagacccacaccaacugguacaguaauggauauaaucagucgaaaggaucagcgaggcucaggacaagucggcacauacggucuaaauacauucacaaauauggaagcccaguuaauacgacaaauggaaggcgaaggaguguuaaguaaggcugacuuagaaaauccgcacuugccugagaagaaaauuacacaaugguuagaaacaaagggagucgagagacuaaaacgaauggcaauauccggagaugacuguguaguaaagccuauagacgacagguuugccaacgcccuccuugcucuaaaugacauggguaaaguucgaaaagauauuccccaauggcagccuaguaaaggcuggcacgacuggcagcagguuccguuuuguucgcaccauuuucaugaacuaauuaugaaggacgguagaaaauuagucguaccauguaggccgcaagacgaacugauaggacgagcacguaucucucaaggugcaggcuggucucuacgagaaacagcauguuuggguaaagcguaugcacagauguggucgcuaauguauuuucaucggagagacuugcgacuagcuucuaacgccauauguagugcggugccaguacauugggucccaacuucuagaacgacauggucaauucacgcccaccaccaauggaugacaacugaagacauguuaacaguuuggaauaggguguggauagaagacaaucccuggauggaagauaagacgccaguuaccacaugggagaacguaccauauuuaggaaaacgcgaagaccaauggugcggaagucuuauagggcugacuucaagagcaacuugggcacaaaauauuccgacagcgauucaacaggucaggagucugaucggcaacgaagaguuccuagacuauaugcccucaaugaaaagguucaggaaagaagaggaaucagaaggugccauuugguga

SEQ ID NO: 23072 - RNA, 9873 nt, Artificial Sequence
  derived and/or modified CDS sequence (opt6) from DENV-3__GU131874__SS-prME
acauccuugugcuuaaugaugaucuugcccgcugcuuuggcauuucaucuuacgagcagagauggugaaccacguaugauaguagguaaaaacgaaaggggaaaaucauuguuauuuaaaacugcuagcggaauuaacaugugcacauuaaucgcgauggaucuaggagaaaugugcgacgauacugucacuuacaaauguccucauauuacugaaguagaaccagaagacauugacuguuggugcaacuuaacauccacuugggucacauauggaacuuguaaucaagcuggcgaaaggagaagagauaaacggucaguugcuuuagcgccacacguaggaaugggguuggacaccaggacacaaacuuggaugagcgcugagggagcauggagacaaguagaaaaaguugaaacaugggcuuuacgacauccaggauuuacaauauuagcauuguuccuagcucacuacauuggaacuucacuaacacaaaaaguuguaauauucauccuacuuauguugguuaccccaucaaugacuaugcggugcguuggagucggaaaucgugauuuuguagaaggacuaaguggggcaacauggguagauguaguucuagaacauggcgguugcgugacgacaauggcuaaaaauaaacccaccuuggauauagaacuacagaaaacugaagcaacacaauuagcuacucuaagaaaacuuuguauagaaggcaaaauaacaaacauaaccacagacaguagauguccgacacaaggcgaagcaguuuuaccugaagaacaagaucaaaauuaugucuguaaacacacauacguggacagagggugggguaacgguugcggauuauuuggaaaagguagucugguuacuugugcaaaauuucaaugucuggaauuaauugaggguaaaguagugcaauaugaaaauuugaaauacacaguaaucauaacaguucacacaggugaccagcaccaaguuggaaacgaaacucaggguguaacagcagaaauaacuccacaagcaagcacuacagaagcuauauuaccagaauacggcacacugggauuggaaugcucaccaaggacgggccuggacuucaacgaaaugauacuccuuaccaugaaaaacaaagcauggaugguacacaggcagugguucuucgauuuaccacuaccauggacaucaggugcaacgaccgaaacucccacauggaaccgaaaagaacucuuaguaacguuuaaaaacgcgcacgccaagaaacaagaagucguaguacuugggucgcaagaaggugcgaugcacacugcguugacaggugcuaccgaaauucaaaacucaggaggaacuuccauuuuugcggggcacuuaaaaugucgucugaaaauggacaaacucgaguuaaaaggaaugucauaugcaaugugcacuaauacauucguacucaagaaagaaguaucagagacccaacauggaacaauauuaauaaaaguugaguauaaaggagaagacgcaccauguaaaauaccauuuucgaccgaagacggacaaggaaaagcccauaaugguaggcuuaucaccgcaaaucccguagugacuaagaaagaggaacccguaaacauagaagcagaacccccauucggugaaaguaacauuguaauuggaacuggcgauaaugcauuaaaaauaaauugguacaagaaagguucguccauagguaaaauguuugaggcaaccgcacgaggcgcuaggagaauggcuaucuuaggcgauacugcuugggacuuugggucuguaggggguguauuaaauagccuuggaaaaaugguccaucaaauuuuuggcucagcguauacggcgcuauuuagcggcguaaguugggucaugaaaauaggaauagggguccuacuuacauggauuggauugaacucgaaaaauacaucaauguccuuuaguuguauagcaaucggaaucauuacuuuguaucugggagccguagugcaagccgacauggguuguguaauaaauuggaaaggaaaagaauuaaaaugcgguagugggauuuucgucacgaacgaaguacacacauggaccgaacaauauaaauuccaggcggauucaccgaaaaggcuugccaccgcuauugcuggagcaugggaaaacgguguaugcgguauacgaucuacgacaaggauggaaaaucuacucuggaaacaaauagccaaugaauuaaacuacauuuuaugggaaaauaauauuaaauuaacaguuguagugggggacaucauuggagucuuagaacaagguaaaagaacacucacuccccaaccuauggaauuaaaauacucguggaaaacauggggaaaagcuaaaauagucacagcagagacgcagaacaguucauuuauaauagaugguccuaauacaccugaguguccuucuaccagucgugcuuggaaugugugggaggucgaagauuacgguuucggaguguucacaaccaauaucuggcuaaaacuaagagaaguauacacacaauugugcgaucauaggcuuauguccgcagccguaaaagaugaacgugcuguucaugcagauaugggcuauuggauugaaagucagaaaaauggaagcuggaaauuagaaaaagcgagucuaauagagguuaaaacauguacguggccuaaaucacauacacucuggucuaacggaguauuagaaucagauaugauuauuccaaaaucacuagccgguccaauuucucaacacaaccauagaccaggauaccauacucagacugccggacccuggcaccuugguaaacuggaauuggauuucaauuauugcgaaggaacaacuguaguuauaacggaaaacugcggaacaagaggacccucacuucgcaccacuacggugucagguaagcugauccacgaauggugcuguaggucuuguacauuaccuccacugcgauauaugggggaagacggaugcugguacgggauggagauaagaccaauaagcgagaaagaagaaaauaugguuaaaagccuaguaagcgcgggaucuggcaagguugauaacuuuaccauggguguccuauguuuagccauacuauucgaagaaguaaugagagggaaguucgguaaaaagcauaugauagcaggcguauucuuuaccuuuguucuucuguugucaggacagauaacguggagggacauggcacacacgcuaaucaugaucgggucaaaugccagugaccgcauggggaugggagucacauacuuggcuuugauagcuacguuuaagauucagccguuuuuagcucuaggauucuuuuugagaaaauuaacaucucgcgaaaauuugcuuuugggaguugggcucgcuauggcaacaacacuucagcuuccugaagauaucgaacagauggccaaugggauagcgcucgguuuaauggccuuaaaacuaauuacgcaguuugagacauaucaacuauggaccgcucucauaucuuuaacuuguaguaauaccauguucaccuuaacuguagcuuggcguacagcuacauugauuuuagccggugucucccuccuaccuguaugccagucaagcagcaugaggaaaacagacugguuaccaauggcaguggcggcgaugggaguaccuccacuacccuuguucauuuucucucucaaagauacuuuaaaaagacggaguuggccacuaaaugaagggguuauggcuguaggucuagucucaauacuugccucaucucuucuaagaaacgauguccccauggcagguccucucguggccggugguuuauugauagcaugcuauguuauaacugggacuucagcggacuuaacaguagaaaaagcagcugauauuaccugggaagaagaagcugaacaaacaggaguaagucauaaucucaugauaaccguggacgacgacggaacuaugagaauaaaagaugacgaaaccgagaacauuuugacuguucuacuaaagacagcacuacugauagugucaggaguguuuccauacucuaucccagcuacauuauuaguuuggcacacuuggcaaaaacaaacccaaaggucggggguuuuaugggacguacccucgccaccugagacccaaaaggcggaacucgaagaaggugucuauagaauuaaacaacaagguauuuuuggcaaaacacaagugggcguuggaguccaaaaagaaggcgucuuccacacaauguggcauguaacucguggagcuguauuaacauacaaugguaaacgacuugaaccuaacugggccagcgucaagaaagaucugauuucauaugguggcggauggaggcuuuccgcgcaauggcaaaaaggagaagaaguacaagugauagcgguagaaccagggaaaaacccuaaaaacuuucagacaaugccaggaacuuuucaaacaacaacuggagaaauuggggcaauagcuuuagauuuuaaacccgggacaagugguucacccauuauaaacagagaagguaaagucgucggguuauaugguaauggcguuguaacaaagaaugggggcuacguaagcgguauagcacaaacgaaugccgagccagaugggccaacaccugaauuggaggaggaaauguuuaagaaacggaaccuaacaaucauggaucuacacccaggaagcggaaaaacgaggaaguaccuaccagcaaucgugagagaggcaauuaaacgcagacuaagaaccuuaauauuagcuccuacacgcguagucgcugcagaaauggaagaggcucuaaaaggucuaccgaucagguaucaaacaacggccacaaagucagaacauacaggaagggagauagucgauuuaaugugucaugcaacauucacaaugcgcuuacucagcccaguaaggguaccaaauuacaaucucauuaucauggaugaagcucauuuuacagauccggcaaguaucgcugccagaggguauauuucaacaaggguaggcaugggugaggcagccgccaucuuuaugacugcaacaccaccggggacagcagaugccuuuccgcagagcaaugcuccuauucaggaugaagaacgugauauaccagagaggucauggaauagugggaaugaguggauuacugauuucgcagguaaaacugucugguucguaccaagcaucaaggcgggaaacgauauagcgaacugcuuaaggaagaacggcaagaaagugauacaacucagccgaaagacauucgauacggaguaucagaaaacuaaacuuaacgauugggauuucguaguuaccacggauauaagugagaugggcgccaauuuuaaagccgaucgcguuauagacccuagaagauguuuaaaacccguaauuuuaacagauggaccagagagagucauucuugcuggcccuaugccaguaaccgcggcgagugcagcacagaggagggguagaguaggaagaaauccccagaaagagaaugaccaauauauauuuacgggucaaccauuaaacaaugaugaagaucaugcacauuggacggaagcaaagauguuauuagacaauaucaacaccccagaaggaauaauaccugcuuuguucgaacccgagagggaaaaaucugccgcaauagauggagaguaccgauuaaaaggagaaucacguaagacuuuuguagaacuaaugagaaggggcgauuuacccguauggcuagcucauaaagucgccucggaagguauuaaauacaccgauagaaaauggugcuucgacggacaacgaaauaaucaaauacuagaagaaaacauggauguagaaauauggaccaaagaaggagagaagaagaaacuuaggccacgaugguuagaugcaagaacauacucagacccauuggcacuaaaagaauuuaaagacuuugccgcagguagaaaaagcauagcucuugaccugguaacggaaauugggaggguuccuucacaucucgcccacagaacacgaaaugcucuagauaauuugguaaugcuucacaccagcgagcaugguggcagagccuaucgccaugcuguagaagaauuaccagaaacaauggaaacacuacuucucuuaggacucaugauccuuuuaacaggaggagcaauguuauuccuaauaaguggaaaaggaauuggaaaaacgucaaucggucuaauaugugugaucgcaucgucugguaugcuuuggauggccgagauaccacuucaguggauagccucagcgauagucuuggaguucuucaugauggugcuucucauacccgaaccagaaaaacaacgaacaccacaagacaaccagcuagcauacguuguuauagguauacuaacccucgcagccaucauugcagcaaaugaaaugggauugcuggaaacgacaaaaagagaucuaggaaugucuaaagaaccuggcguuguuagucccacgaguuauuuagaugucgauuugcacccagcaagugcguggacacucuaugcugucgcaaccaccguaaucaccccuauguugagacacacuaucgagaauaguaccgccaauguaucacuagcggcaauagcuaaccaagcgguaguccugaugggguuagacaaaggguggccuauaagcaaaauggacuugggcgugccucuacucgcgcucggcuguuauagucaagucaauccauuaacauugaccgcagcuguacuucuauuaauaacacauuacgccauaaucgguccaggguugcaagcaaaagcaacaagagaagcucaaaaacggaccgcagcggguaucaugaaaaacccaacgguagaugggauaaugacuauagaccuugacccgguuaucuacgauucaaaauucgaaaaacaacugggccagguaaugcuauuaguacugugcgcggcacagcuauuauuaaugagaacauccugggccuuaugcgaagcauuaacgcuugcuacggguccaaucaccacguugugggaaggaagcccagggaaauuuuggaauacaacgauagcagucucaauggcuaauauauuucgggggaguuauuuagcuggugcuggauuagcuuucaguauaaugaaaucagugggaacaggcaagcgggggacaggcagucaaggagaaacguuaggagaaaaauggaaaaagaaauuaaaucaacuaucaagaaaagaguucgacuuguauaagaaauccggaauuacggaaguggaucguacugaggccaaagaagggcugaaacgaggugaaaucacacaccacgcgguaucgagaggaucggcgaaauugcaaugguuuguagagagaaauaugguuauuccagagggccgaguaauagauuuggguugcggccgaggcggcuggucuuacuauugcgccggucuaaagaaaguuaccgaggugagagguuauacgaaaggcggacccggacaugaggaaccaguaccgaugucaacauacgguuggaauauaguaaaguuaaugagcgguaaagacguauucuaucuuccaccagagaagugugacacacuuuuaugcgauaucggcgagaguucgccaucaccaacugucgaggagucgcgaacaauuaggguacuaaaaaugguagagccaugguuaaagaacaaucaauucuguauuaaaguuuuaaacccuuauaugcccacagugauugagcaccuugagcggcuccagcgaaagcacgguggaauguuaguaagaaacccacuaucgagaaacucaacgcacgaaauguauuggauaaguaauggaacagggaacauagucgcgucaguuaacaugguuucgagacuccuacugaaucgauucacgaugacucaucggagaccuacaauugaaaaagacgucgaucucggugcggguacaaggcauguuaaugccgaacccgagacuccgaacauggauguaaucggugagcgaauaaaaaggaucaaagaagaacauaauucuaccuggcacuacgacgacgaaaauccuuacaagaccugggcauaucauggaucauacgagguuaaggcuacggguagugcauccucaaugauuaauggaguugugaaauuauuaacaaaaccaugggauguaguuccaaugguaacucaaauggccaugaccgacacaaccccuuuuggucagcagcguguauuuaaagaaaaaguagauacaagaacuccucguucaaugccagggacgagaagaguaaugggcauaaccgcugaauggcuauggaggacacuugguagaaauaaacggccaagauuaugcacgcgagaggaguuuaccaagaaaguacggacgaaugcggccaugggagccguguuuacugaagaaaaccaaugggacagugccaaagcagcaguagaagacgaagauuuuuggaagcuaguagacagggaaagagagcuucauaaacuugggaagugcggaucgugcguguacaacaugaugggcaaacgugagaagaaacuaggggaguucggaaaggcgaaaggaaguagagcaauuugguacauguggcucggcgcgagauaucucgaguucgaagcguuaggcuuucucaaugaagaucacugguucaguagagaaaauagcuauaguggcguugaaggagaaggauugcauaaacugggguacauauuaagagacauaucgaaaaucccagguggagccauguaugcagacgauacugccggcugggacacgaggauaacagaagaugaucuacauaaugaagaaaagaucacccaacaaauggauccugaacacaggcaauuagcuaaugccauauucaaguugacauaucaaaacaaagucgugaaggugcaacgucccacaccaacaggcacaguuauggauauaauaagcaggaaagaucagagggguaguggccaaguaggaacuuauggauuaaacacguuuacuaauauggaagcucaacuaauucgccaaauggagggugagggugucuugaguaaagcagacuuagaaaauccucauuuacccgagaagaaaauugcacaaugguuagagaccaaaggagucgaacggcuaaaaaggauggccauuaguggugaugauugugucguuaagccaaucgacgacagauuugcuaacgcguugcuggcauugaaugacaugggaaaaguccguaaggauauaccacaauggcaaccgucaaaagguuggcacgauuggcagcagguacccuucuguucccaucacuuccacgaacuaauaaugaaggauggcagaaaacucgugguccccugcaggccucaagaugagcuaauagguagagcaaggauuucgcagggcucagguuggagucuaagagagacagcaugccuuggcaaggcuuacgcucaaauguggagucucauguauuuccauagaagagaucugagguuggcuaguaaugcaauauguagugcuguuccaguccauuggguaccgaccagccgaacgacauggagcauacaugcgcaccaucaauggaugacaacagaagacaugcucgccguuuggaaccguguauggauugaagauaaccccuggauggaagacaagacaccaguaacuacaugggaaaauguacccuaccuuggcaagcgagaagaccagugguguggaucacucaucggguuaacaagccgagcaacaugggcucaaaacauuccaacugcuauacaacaagugcgaucacuuauugguaacgaagaauuucuugacuacaugcccucaaugaagagauucagaaaagaagaagagucagaaggagcuauaugguag

SEQ ID NO: 23073 - RNA, 9873 nt, Artificial Sequence
  derived and/or modified CDS sequence (opt6) from DENV-3__GU131875__SS-prME
accucgcugugccuaguuaugauucuccccgcugcacuggcauuucaccuuaccucgcgagauggagaaccgagaaugaucgucggcaaaaaugaaagagguaaaucccuacuauuuaaaacagcuagugggaucaauaugugcacacuaauagcaauggaccuuggagagaugugcgaugacacugugacuuauaaaugcccucacauuaccgaaguugagccggaagauauagacugcugguguaaccucacaucaacauggguaacauacggaacauguaaucaagcgggggaaagacguagagauaaaagaucaguugcucuagcaccacacgugggaauggggcuagauacacgcacacaaacuuggaugucugcagaaggugcauggagacaagucgaaaaaguagaaacuugggcacuucgacauccaggguucacaauccuagcauuauuucucgcacauuacauugggaccaguuuaacucaaaaaguaguuauuuucauacuucuuauguugguaaccccaaguaugacaaugagaugcguagggguugguaacagggauuucgucgaaggacucaguggggccaccuggguugauguagugcuggagcacgguggauguguaacgacuauggccaaaaauaaaccaacccucgauauagagcuacagaaaaccgaagcaacacaauuagcuacacuucgaaaacuguguauagaaggaaaaauuacaaauauaacaacugauucacgcuguccaacacaaggugaagcgguauuaccagaagaacaagaccaaaauuacguguguaaacauacguauguugauaggggauggggaaacggauguggacuguuugguaaaggaucguuaguaacaugcgcaaaauuucaaugccuugaaccgauagaaggaaaaguuguacaauacgagaaccuaaaauauaccgucaucaucacaguccacacuggcgaucaacaucaaguaggcaaugaaacucaaggcguaacugcggaaaucacuccacaagcaaguacgacugaagcuauccuuccggaauaugggacuuuaggauuagaguguucaccucgaacaggcuuggauuucaaugagaugauucuacuaacuaugaaaaauaaggcuuggaugguucaccgacaaugguucuuugaucuuccgcuacccuggacaagcggcgcuacuacugaaacaccaacauggaauaggaaagaguuguuaguaacauuuaaaaaugcucaugccaagaaacaagaagugguaguacuagggagccaagagggagcgaugcauacugcccuaacaggagcaaccgagauacaaaacucuggagguacaaguaucuucgccggacaucuuaaaugucggcucaaaauggacaaauuagaguuaaaagguaugaguuacgcgauguguacaaauaccuucguacuuaagaaagaaguaucagagacgcaacauggaacaauuuuaaucaaaguagaauaucggggagaggaugcgccauguaaaauaccauucucuacggaagauggucagggaaaagcccacaauggccggcucauaacggcgaauccaguuguuaccaagaaagaagaacccgucaacauagaagcugaaccuccuuucggugaauccaacauugucauagguauuggagauaaugcacuuaaaauuaauugguauaagaaaggaucaucgauuggaaaaauguucgaagcgacagcgaggggagcaagacggauggcuauuuuaggggacacagcuugggauuuugggagugugggagguguucuaaauucacuaggaaaaaugguccaucaaauauucgggucagcuuauacagccuuguuuucgggugucaguugggucaugaaaauugguauuggaauacuacuuacauggauaggauuaaauucuaaaaauacuagcaugagcuucucauguauagcaauaggcaucauaaccuuguacuuaggagcaguagugcaggcagauaugggaugcguaauuaauuggaagggaaaagaacugaaaugugggaguggaauauucguuaccaacgaagugcauacauggacagaacaauauaaauuucaagcagacagcccaaaaagauuagcuaccgcuauugcuggagcuugggaaaauggcguaugugguauucgaucuacgaccaggauggaaaacuuguuauggaaacaaauagcaaacgaacucaauuauauuuuaugggagaauaauauaaaacuaacaguaguuguuggugauauaauaggaguguuagagcaagguaaacgaacacuaacuccccagccgauggagcuaaaauauucuuggaaaacguggggaaaagcaaaaauagucacugccgagacucaaaauucaaguuuuauuauugaugguccaaauacuccggaaugucccucggcuagcagagcauggaacgugugggaaguagaggauuauggauucggaguuuuuacaaccaacauuuggcugaaacuacgcgaaguuuacacacaauuaugugaccauagguuaaugagugcggcaguaaaagacgaaagggcaguucaugcugacaugggcuacuggauagaaucacagaaaaacggcucauggaaacuagaaaaggccagccuaauugaagucaagaccugcaccuggcccaagucucacacucugugguccaaugggguuuuagaaagcgauaugauaauacccaagucacucgcaggaccaauaagucaacacaaucacagaccuggauaucauacucaaacagccggcccuuggcacuuagggaaacuggaauuggacuucaauuacugugaaggaacgacuguagucauaacagaaaauugugggacaagaggaccuuccuugcgcacaacuacaguuucgggcaaacuuauucaugaauggugcugccgaucaugcacucuuccaccucuuagguauaugggugaagacggauguugguacggcauggaaauucgaccgauaucagaaaaagaagaaaauaugguaaaaucgcuuguaagugcagguaguggcaaaguagacaauuuuacaaugggagucuugugucuugccauccuauucgaagagguuaugcgagggaaauuuggcaagaaacacaugauugcaggaguauuuuucacauucgugcuucuuuugucgggucagauaaccuggcgugauaugacacauacauuaauuaugauaggaagcaaugcaagugauagaauggguaugggaguaacuuauuuagcauugauugcuacguucaaaauucaaccauuccuugcgcuuggauucuucuuacggaaacuaacaaguagagagaaucuccucuugggaguagguuuagccauggcaacuaccuuacaacuccccgaggauauugagcaaauggcaaacgggauagcgcucggauuaauggccuuaaaauuaauaacucaguucgagacuuaccaauuauggacugcguuaauuucauuaacgugcucuaacacuauguuuacucuuacgguugcauggaggacagcuacacuaaucuuggcgggagugucauuguuacccgucugucaaaguagcucaaugagaaaaaccgacuggcuuccaauggccguagcggcaauggggguucccccuuuaccgcuguucauauuuucccucaaagauacauuaaaaagaaggucuuggccuuuaaacgaagggguaauggcaguaggccuaguaucuauucuggcaagcagucuccuccggaaugauguuccuauggcaggcccacuuguugcagggggauuacuuaucgcauguuacgugauuacuggaacgagugcagaucucacaguugaaaaagcagcugauauaacuugggaagaagaagcggaacaaacaggaguuucccacaauuuaaugauuaccgucgaugaugaugggaccaugaggaucaaagacgacgaaaccgaaaauauuuuaacgguacuucuuaaaacggcccuccuaauugugagugguguauuccccuacaguauuccagcgacucugcuuguauggcauacauggcaaaaacaaacucaacgcucugguguuuuaugggauguuccaucaccacccgagacucaaaaagcagagcuggaagaagggguauaucgaauaaaacaacaagggaucuucggcaaaacgcaaguuggaguaggaguccagaaagaggguguuuuccacacaauguggcaugugacaaggggugcagucuuaacauauaauggaaaaagacuagagccgaacugggcaucaguaaagaaagacuuaauuucauaugguggcggguggagauuaagcgcucaauggcaaaagggagaagaggugcaaguaauugcaguagaacccggcaaaaacccuaaaaacuuucaaacuaugccaggaacguuccaaaccacaacuggggaaauaggagcuauagcuuuagauuuuaaaccagguaccucuggcucgcccaucaucaaucgggagggaaaagugguaggcuuauacgguaacggugucguaacuaaaaacgguggauauguaagugguauagcacaaacaaacgcugaaccugacggacccacaccugagcuagaagaagagauguuuaagaaacguaaucuaacaauaauggauuuacauccuggauccgguaaaacuagaaaguaucucccagcuauaauacgggaggcuauuaagcgaaggcuacgaacuuuaauucuggcgccaacucgggugguugcggcagaaauggaagaagcguugaaaggcuuaccaauuagguaucaaaccaccgcgacaaaaucagaacacacaggacgugaaaucguagaccuuaugugucaugcuacauuuacaaugcgauuguuaucaccaguacggguucccaauuauaaccuuauaauaauggacgaagcucauuuuacagaccccgcuucgauagccgccagaggauacauaagcacucgagucgguaugggagaagcugccgcuaucuuuaugaccgcuacuccuccaggcaccgcugaugcuuucccgcagaguaaugcaccuauccaggacgaagagagggacauaccggaacgaucguggaauagugggaaugaauggaucacagacuucgcuggaaaaaccgugugguucguaccaaguauuaaagcgggaaacgacauagccaacugccuaaggaaaaaugguaagaaagugauacaguuaagucgcaaaacguuugauacagaauaucagaaaaccaaacucaacgacugggauuuuguaguuacgaccgauaucagcgaaaugggugcaaauuuuaaagucgauagaguaaucgacccacguaggugccucaaaccuguuauuuuaacggauggaccagaaagaguaauuuuagcaggcccgaugccuguuacugcagcuagcgcggcucagaggagagggagaguuggaagaaacccacaaaaagagaacgaucaauauaucuucacaggucagccgcucaauaaugaugaagaucaugcucauuggacggaggcaaaaaugcuucuugauaauaucaauacuccagaaggcauuaucccugccuuauuugaaccagagcgcgaaaaauccgcggcaauugacggagaauaucgucuaaaaggagagucaaggaaaacauuuguugaauuaaugagaaggggcgaucuacccguauggcuagcacacaaagucgcuagugaaggaauuaaauauacagaucgaaaauggugcuucgacggccagagaaauaaccagauacuggaggaaaauauggacguugagauauggacaaaagaaggagagaaaaagaaguuaagaccccgguggcuagaugcaagaacuuacuccgacccacuagcauugaaggaguuuaaggacuuugcagccggcagaaaaucgauagcauuggaucugguaacagaaauaggacgaguccccagucacuuagcacauagaacucggaaugcccuugauaacuuagucaugcuacacacaucugaacauggaggaagggcuuacagacaugcaguugaagaguuaccggaaaccauggagacucuccuuuuauuaggacuuaugauacuauuaacagguggagcgaugcuauuccuuauauccggaaaaggcaucgguaaaacuucgauaggcuuaaucuguguaauagccaguagugguaugcuuuggauggcagagauaccguuacaauggaucgccagcgcuauaguauuagaguucuucaugaugguacuccuuauaccagagccagaaaaacaacgaacaccacaagacaaucaacuugcauacguaguuauaggaauacuuacacuagccgcaauuauagccgcaaacgagaugggcuuacuagagacaacuaaacgagacuuagguaugucaaaagaaccaggugucguaucuccaacuagcuaucuagacguagacuugcacccugcuagugccuggacgcucuaugcaguagcgacaaccgugauuaccccuauguugaggcauacuauugaaaacaguacagcaaacguaaguuuggccgccauagcuaaucaagcugucguauuaaugggucuagacaaagguuggccuauuucuaaaauggaucuaggggucccuuugcuugcccuggggugcuauucacaaguaaaucccuuaacauuaaccgcugcgguguugcuucuaauaacacacuacgccauaaucggacccgguuugcaagcuaaagccacuagggaagcacagaaaagaacagccgcugguauaaugaaaaacccgacaguggacgguauuaugacuauugauuuagaucccguuauauaugacaguaaguucgagaaacaauuaggucagguaauguuauuaguucuaugcgcuguucaacuucuacuaaugcgaacuucaugggcucuaugcgaggcacucacuuuagccacuggaccaauaacaacacuaugggaaggaucaccaggaaaguucuggaauaccacaauagcaguuucaauggccaauauauuccguggaaguuauuuagccggagcuggacucgcauuuaguauuaugaaaucaguugggacuggcaagaggggaacugggucacagggugaaacuuuaggagaaaaauggaagaagaaacuuaaucaguuaucaagaaaagaauuugaucuauauaagaaaaguggcaucacugagguggauagaacagaagccaaagaaggucuaaaacguggagaaauaacacaucacgcaguuuccagaggaagugcuaaauugcaaugguuuguagagcgaaacauggucauaccggagggccgagugaucgaucugggaugcggacguggcgguuggucauauuauugugcuggucucaagaaagugacugaaguuaggggguauaccaaaggagguccaggucacgaagaaccagugccgaugaguacguacggcuggaauauaguaaagcugaugucaggcaaagauguauuuuaucuucccccagaaaagugugauacccuuuuaugcgauauaggggaaaguaguccuucaccuacgguagaagagaguaggacuauacgaguacugaagaugguagagcccugguuaaagaauaaucaauucuguaucaaagucuuaaauccauacaugccaacaguaaucgaacacuuagaaagacuacaacgaaaacacggaggaauguuaguaagaaacccucuuaguagaaacucaacccaugaaauguauuggauaucaaacgguacuggaaauauaguugcaagugugaacaugguaucccgcuuacuguugaaucgcuuuacaaugacucacagacggcccacaauagagaaagaugucgaucugggugcuggaacaagacauguuaacgcugagcccgaaacaccaaauauggacgugauaggcgaacgaauaaaaagaauaaaagaagaacauaacucaacauggcauuaugaugaugaaaacccauauaaaacaugggccuaucauggcucuuacgaaguaaaagcuacagguucugcgaguuccaugauaaauggagucgugaagcucuuaacgaaacccugggacgucgucccaauggucacucagauggcaaugacugacacaacgccuuuuggccagcagagaguauucaaagagaaagucgacacaagaacuccaagaucaaugccagguacccgaagaguuaugggcaucaccgcagagugguuguggaggacucuaggacgaaacaagaaaccucgacucuguaccagagaagaauuuacgaagaaaguucgcacaaaugccgcgaugggcgcaguauucacagaggaaaaccaaugggauucugcaaaagcugccguggaagaugaagacuucuggaaauuaguagaccgagaacgugaguugcauaaacuaggaaaauguggaucuuguguauauaauaugauggggaagcgugaaaagaaauugggugaauuuggaaaagcaaaaggcagcagagcgauaugguauaugugguuaggggcccguuaccuugaauuugaggcuuugggauuccucaaugaagaucauugguucucaagagagaacucauacagcggaguugaaggagaaggucuucauaaauuggguuacauccuacgagauauauccaagaucccuggaggagcuauguaugcggaugauacggccggaugggauacgagaauaacggaagaugauuuacauaaugaagagaaaauaacgcaacaaauggauccggaacauagacaguuagccaaugcaauauuuaaacuuacauaucaaaauaaaguuguaaagguacagaggccaacuccgacugggacuguaauggauauuauuagcaggaaagaccaaagagguaguggacaaguuggcacuuacggacugaauacuuucaccaauauggaagcucaguuaauaagacagauggaaggagaagggguguuaucuaaggcugacuuagagaauccacaucuuccugaaaagaaaauaacucaguggcuagagacgaaagguguagaacgacucaagagaauggcgauauccggcgaugauugcgucguaaaaccgauugaugauagauuugcuaaugcauuauuagccuugaaugauauggguaaaguuaggaaagacauuccucaguggcaaccaucgaaggguuggcacgacuggcaacagguaccauuuuguagccaucauuuucacgaacucauaaugaaagacggacgcaagcuaguggucccuugcaggccacaagaugaauuaauaggacgugcacgaauuagccaaggagccggcuggucacugagagagaccgcauguuuaggaaaggcuuacgcccaaauguggucguuaauguacuuccaccgucgugacuuacggcucgcuuccaaugcuauuuguucugcagucccagugcauuggguuccaacuucucguacaaccuggucgauccaugcacaucaucaguggaugacaaccgaagacaugcucacaguguggaacagaguguggauugaagacaacccuuggauggaagacaagacacccgugacuacaugggagaacguuccuuaccuuggaaagcgagaagaucaauggugcggcaguuuaauuggauuaacguccagagccaccugggcgcaaaacauaccuacugccauucagcaaguaagaagccuuauaggcaaugaggaauuuuuagacuacaugccaagcaugaaaagauuuaggaaggaagaagaaucagaaggcgcgauuugguag

SEQ ID NO: 23074 - RNA, 9873 nt, Artificial Sequence
  derived and/or modified CDS sequence (opt6) from DENV-3__GU131877__SS-prME
acguccuuauguuuaaugaugaucuuacccgcagcguuagcauuucaucucacgagccgcgauggggaaccacgaaugauaguagggaaaaaugaacgugggaaaucucuccuguuuaaaacagcuucuggaauaaauaugugcacgcuuauugcaauggaccuuggagaaaugugugaugacacagucaccuauaaauguccucacauuacugaaguugaaccagaagauauagauugcuggugcaaccuaaccucgaccugggugacguacggaacguguaaccaagcaggagagagaaggagggauaaaagaaguguagcauuggcgccacauguaggaaugggguuagauacgaggacccaaacguggaugucagcugaaggagcauggcggcaaguagagaaaguggaaacaugggcacuucgacauccaggcuucacaauacuggcguuguuccuagcacauuacauagggacaagucuaacucaaaaaguaguuauauuuauacuguuaauguuagugaccccuucaaugacuaugagauguguaggaguuggaaaucgagauuucguggagggccuaagcggggcaacaugggucgauguaguucuagagcacgguggaugugucacgacgauggccaaaaauaaaccaacguuagauauagaacuccagaaaacagaagcaacgcaauuagccacauuaagaaaauuaugcauagaaggaaaaauaacaaauauuacaacagauucgcgcugccccacucaaggagaagcugugcuaccggaagaacaagaucaaaauuauguaugcaaacacacauacguagaccgggguugggguaaugguugugguuuauuuggaaaaggaucccuugugacgugugccaaauuccaauguuuagagccgauugaaggaaaagugguucaauaugaaaacuuaaaauauacuguuauuauaacuguccauacaggagaucaacaucaaguaggcaacgagacucaaggaguaacggcugaaauaacuccacaagcaaguacgacugaagcuauacuaccugaauauggaacauugggguuggaauguuccccaagaacaggguuggauuuuaacgaaaugauauuauuaacaaugaaaaauaaagcauggaugguccaucgacagugguucuuugaucucccccuaccauggacgucuggagcuacuacggaaacucccacauggaaucgaaaagaacuauuagucacauuuaaaaaugcucaugcuaaaaagcaagagguaguuguacugggcucccaggaaggagccaugcauacagcgcugacgggagcuacugaaauacagaacagcggugggacgaguaucuucgcaggucaccucaaaugucgccuuaaaauggauaagcuagagcuaaagggcaugucguaugcuauguguacuaauacuuuuguauugaagaaagaaguaucagaaacgcaacacggaacaauucuaauuaaaguugaauaccgcggugaagaugcaccuugcaaaauccccuucucuacggaggauggccaggguaaagcccacaauggaagauuaauuacagcgaauccggugguaaccaagaaagaggaaccuguuaacauugaggcugaaccacccuuuggggaaaguaacauuguaauaggaauaggagacaaugcucucaaaauuaacugguacaagaaagguuccagcauugggaagauguuugaagcaacggcgaggggugcaagacgaauggcgauauugggugauacagcgugggauuuuggcagcgugggaggcguuuugaauagucucggcaaaauggugcaucagauuuuuggaucagcguauacagcauuauuuucuggaguaaguuggguaaugaaaaucggcauaggagucuuauuaacauggauaggccuaaauaguaaaaauaccaguaugagcuuuaguugcaucgcaauagggauuauaacguuauaucugggggcggucguucaagcugauaugggaugugugauaaauuggaaaggaaaagaauuaaaguguggaucagguaucuuuguuacuaaugaaguacacacauggacggagcaguacaaguuucaagcagauucaccaaaacgccuugcgacagcaauagcaggagcgugggaaaauggaguuuguggcauucgcaguaccacacguauggaaaaucuauuauggaagcaaauugcuaacgaacuaaauuauauucuaugggaaaauaauauaaaacuaaccgucguagugggagauauaauaggaguccucgaacaagggaaaagaacgcuaacaccucaacccauggaacuaaaauacucuuggaagacauggggaaaagcgaaaauaguaaccgcugaaacucaaaacucgucuuucauaaucgacggaccgaauacccccgagugucccucagcaagccgggcauggaaugucugggaaguugaggauuauggguucgggguauucacaacuaauauaugguugaaacugcgugaagucuauacucaguuaugcgaucaucgauuaauguccgcagcagugaaagaugaacgagcgguucaugcugacaugggauauuggauugaaucccagaaaaauggcucauggaaacuugaaaaggcuucguuaauagaaguaaaaacgugcacguggccuaaaucccauacgcuuuggaguaacggaguuuuagaaucggauaugauuauuccaaagagccuggcgggaccaauaucccaacauaaccauaggccuggguaccacacucaaacagccgguccauggcaucuugguaaacucgaacuugauuuuaauuauugugaagguaccacgguugugauaacggagaacugcggaacaagaggcccuucacugagaacaacaaccgucucaggaaaacuaauacaugaauggugcugucgaucauguacauuaccaccgcuccguuauaugggcgaggauggcuguugguauggaauggagauacgcccuauaagcgagaaagaagaaaauaugguuaaaaguuuagugagcgcgggaucagggaaaguggacaauuuuacaaugggaguauuaugucuagucauacucuuugaggaggucaugagagggaaauucggaaagaaacauaugaucgccgguguauucuucaccuuugugcugcucuuaucaggucagauaacauggagagacauggcucauacguugauuaugauaggcuccaacgcaagugaucgcauggguaugggaguaacuuaucuagcauuaauugcuacuuuuaaaauucaaccuuuucuagcgcuuggauucuuucuucguaaauugacaaguagagagaaucugcuauugggcguaggauuagcuauggccacuacacuucaauuaccggaagacauagagcagauggcuaacggaauagcccucggguuaauggcccuaaaacuaaucacucaguuugagacuuaccagcuauggaccgcuuugauaucauuaacauguucuaauaccauguucacguuaacuguagcuuggagaacagcaacauugauacuagccggagucaguuuacugccugucugccaaucaagcagcaugcgaaaaaccgauugguuaccuauggccguagccgcaaugggaguuccuccauugccgcuauuuauauuuagccucaaagauaccuuaaagcguaggucauggccuuuaaacgaagguguuauggcgguuggucucguuucuauauuggcgucgucauuacuaagaaaugaugugcccauggcugguccauuaguagcuggugguuuauuaauagcuuguuauguaauaacuggaacaucugcagauuuaacugucgaaaaagcagcagacaucacgugggaagaggaagcugaacaaacuggcguaucacauaaucuaaugauaacgguagaugaugacggcacaaugagaauuaaagaugacgagaccgagaacauucuuacaguacuucuaaaaacagcgcuucucauaauaaguggugucuucccguacaguauaccugcaacucuguuaguauggcauaccuggcaaaaacaaacacaaagaucugguguucuaugggacguucccucuccgccugaaacacaaaaagccgaacucgaagaaggcguuuauagaauaaagcagcaaggaauauuugguaaaacgcaagugggaguagggguacaaaaagaaggaguauuccauacgauguggcacgugacuagaggugcaguucuuacauauaacggaaaaagacuugaacccaacugggcaucagugaaaaaggacuuaaucucguacggaggcggcuggcgucuaucagcacaauggcagaaaggugaagaagugcaagugauagcuguagaacccggcaagaacccuaaaaauuuucaaacuaugccuggaacauuucaaacaacuacaggagaaauaggcgcaauugcccuagacuuuaaaccgggcacgucuggcucaccaauuauaaaucgugaaggaaaagucguugggcuauauggaaacgggguagugacaaagaauggcggauaugugagugguauagcccaaacaaaugcggagccagacgguccgacacccgaacucgaagaagaaauguuuaagaagcgaaaucugacaauuauggaucuucauccuggaagcggaaaaacucgaaaguaccuacccgcaauuauacgagaggcaauaaaaaggcgucuucguacuuugauauuggcgccaacccgagugguagcagccgaaauggaagaggccuuaaaaggccugcccaucagauaucagaccacggcaacgaaaagcgaacacacgggacgagaaauaguugaucuaaugugccacgcaacuuucacaaugcguuuacuaucaccgguaaggguaccuaauuacaaccugauuaucauggaugaagcccacuuuaccgauccggcgucaauagcagcuagaggauacauauccacgaggguuggaaugggagaagcagcugcaaucuuuaugaccgcaaccccgccaggaacagccgacgccuucccucaaaguaaugcaccuauucaagacgaagagagagauauuccggaacgaucuuggaacucuggaaaugaauggauaacugacuuuucagguaaaacaguuugguuuguaccguccaucaaagccggaaacgacauugcaaauugccuaaggaaaaaugguaagaaaguaauucaauuaaguaggaagacauucgauacagaguaucagaaaacgaaauuaaacgacugggauuucguuguuacaacagacauaucggagaugggcgcaaauuucaaagcagacagaguuauagacccacggcgaugccuaaaaccgguaauuuugacugauggaccagagagaguaauuuuagcugguccaaugccggucaccgcagcgucugccgcucagaggagaggcagggucgguaggaauccacaaaaggaaaaugaucaauacauuuuuaccggacaaccucuaaacaaugaugaagaucacgcucauuggacagaagcaaaaaugcugcuugauaacauaaauaccccagaggguauaauaccagcgcucuuugagccugaaagggagaaauccgcagcaauagauggcgaauaccguuuaaagggagaaucuagaaagacauuuguugaacucaugcgaagaggggaucuaccaguaugguuagcacacaaaguagcaagugaagggauaaaauauaccgaccguaaguggugcuuugacggacaacgaaacaaucaaaucuuagaagaaaauauggauguggaaaucuggacaaaagaaggcgaaaagaagaaacuacguccuagauggcuagacgcuaggacuuauagcgaucccuuagcccuaaaagaguuuaaagacuucgcggcgggccguaaaucgaucgcccuugaucuuguaacugaaaucggcagaguaccgagucacuuggcgcaucguacaagaaaugcguuagauaacuuaguaaugcuccauacaucagaacaugggggcagagcauaucgucaugcgguagaggaacugccagaaacuauggaaacuuuacuguuauugggucuuaugauauuauuaacaggaggagcaauguuauuccuuaucucuggaaaaggcaucgguaaaacuucaaucggccuaaucuguguaaucgcaucuucaggaaugcucuggauggcggaaaucccuuuacaguggauagcaagugcaauagugcuagaguucuucaugaugguucuuuugauaccagaaccggaaaaacagcggacaccacaagacaaucaauuagcauacguugugauagguauacuuacucuugcagcgauaauagccgccaacgaaaugggacucuuggaaacaacgaagagagauuuagguaugaguaaagaaccgggcgugguuaguccaacauccuaucucgacguugauuuacauccggcuucagcauggaccuuauaugcaguagcaacaacaguuauuacuccaaugcuucgucauacaauugagaauagcacagcaaacguuucgcuugcugcaauagcaaaucaagcaguaguacuuaugggucuggauaagggguggccgauaaguaaaauggauuugggugugccacuacuagcauugggauguuauucccaaguaaacccguuaacauugaccgccgcaguauuacuacuaauaacacauuaugcaauaauuggcccagggcugcaagcgaaagcgacuagagaggcucagaaaaggacggccgcuggaauuaugaaaaauccaaccguagauggcaucaugaccauugauuuagacccaguuauauacgauagcaaauuugaaaaacaguuaggucaaguaaugcuuuugguauuaugcgccgugcaacuucuguuaaugcggacaucuugggcauuaugugaggcuuuaacauuagcaacugggcccauaacaacccuaugggaaggaucacccgggaaauuuuggaauaccacaaucgcaguaucuauggcaaacaucuuuagagguagcuauuuagccggagcugguuuagcauucucaauaaugaaaagcgucggaacuggaaaacgugguacugguagccaaggugaaacgcuaggagaaaaauggaagaagaaacuuaaucaguugucaagaaaagaauuugauuuauacaaaaagucggggauaacggaagucgaccgaacagaagccaaagaagguuugaaaaggggugaaauaacgcaucacgcgguaagucgaggaucagcuaaguuacagugguucguugagcguaauaugguaaucccugaaggacgaguuauugauuugggauguggacgaggaggauggucauauuacugugcuggauuaaagaagguaacugaaguacgcgguuacacaaaaggaggccccggccacgaagaaccuguucccaugagcacguaugguuggaacauagucaaacuaaugagugguaaagaugucuuuuauuuaccaccggagaaaugugauacucuauuaugcgacauaggagaaaguuccccuucgccuacaguagaagagucccgaacaauacgcguacuuaaaaugguagaaccauggcuaaagaacaaucaauuuugcauaaaaguucuaaauccuuacaugccuaccgugauagaacauuuagaaagauuacagcgaaagcacggaggaauguuaguacgaaacccacuaucacguaacaguacucaugagauguauuggauaucuaauggaacagguaacauaguagccucugugaacaugguaucgagguuauugcucaauagauucacaaugacccauagaagaccaacuauagaaaaagauguugauuuaggugcaggcacacggcacguaaaugcggaaccagaaacuccaaauauggauguaauaggagaaaggauuaaaaggaucaaagaagaacauaauucaacauggcauuaugacgaugaaaacccuuacaaaacaugggcauaccauggauccuaugaaguaaaggcgacgggcucggcaucaucaaugauuaauggugucguaaaauuacuaacuaaaccuugggauguaguaccaauggucauacagauggcaaugacggacacaacaccuuucgggcaacaaaggguauuuaaggagaaagucgauacccggacaccuagauccaugccaggaacaagacgagucauggguaucacugccgaaugguuauggagaaccuugggcagaaacaagaaaccgcgccuauguaccagagaagaguuuaccaagaaaguacgaacaaaugcagcaaugggcgccguguuuacugaagagaaucagugggauuccgcuaaagcagcaguagaggacgaagacuuuuggaagcuaguagacagagaacgcgagcuucacaagcuaggaaagugcggcucuuguguuuauaacaugauggggaaacgcgagaagaaacucggcgaguucgggaaagcgaaggggucgcgagcgauaugguacauguggcuaggcgcaagguacuuggaauuugaggcacuagguuuucuuaacgaagaucauugguuuagccgcgagaacaguuacagcgggguggaaggagagggucugcacaaauuaggguauauauuaagggacaucaguaaaauaccgggcggagcgauguaugcggacgauacagcaggaugggacacucgaauaacagaagacgauuuacacaaugaagagaaaauaacccaacaaauggauccugaacauaggcaacuugcaaaugcuaucuuuaaguugacuuaccagaacaaggucguaaaaguucaaagacccacaccuacuggcacaguaauggauauuaucaguagaaaagaucaacgugggagcgggcagguaggaacuuacggacugaauacauucacgaauauggaagcacaauuaauaagacagauggaaggcgagggaguccugucaaaagccgaccuagaaaacccucaucuuucagagaagaaaauaacccaaugguuagaaaccaaagguguugagagguuaaaacgcauggcuauaaguggggaugacuguguagucaaaccuauugaugauagauucgcuaacgcgcuuuuagcauuaaacgacaugggaaaaguccguaaggacauuccacaauggcaaccgucgaaaggguggcaugacuggcagcagguaccauuuuguucacaucacuuucaugaacugauaaugaaagacggaagaaaauuaguaguaccauguagaccccaagacgagcuaauuggaagggcuaggaucucacagggugcaggauggucacuaagagaaacagccuguuuaggaaaagccuaugcacagauguggagccuaauguacuuccaucgcagagauuuaagauuagcauccaacgcgauauguagugcagucccaguccauuggguuccaaccagucguacuacguggucaauacacgcucaucaccaauggaugacuaccgaagauaugcuuacuguguggaaucgcguauggaucgaagauaauccauggauggaagacaaaaccccaguuacuacgugggaaaaugugcccuauuuagguaaaagagaagaucaauggugcggaucccucauaggauuaacaagcagagcuaccugggcgcagaacauaccuaccgcaauacaacagguacgaaguuuaauaggaaacgaagaauuucuagauuauaugcccagcaugaaaagauuccgcaaagaagaagaauccgaaggagcgauaugguga

SEQ ID NO: 23075 - RNA, 9873 nt, Artificial Sequence
  derived and/or modified CDS sequence (opt6) from DENV-3__GU131878__SS-prME
acaucacuguguuuaaugaugauuuuaccggcugcauuagcguuccauuuaacgucacgggauggagaaccacgaaugauuguugguaaaaaugaacgcgguaaaucguuauuauucaaaacugccagcgggauaaauauguguacgcuaauagccauggacuuaggggaaaugugugaugauacugucacguacaaauguccacauauaacagaaguagaacccgaagauauugauugcugguguaauuugacaucgacaugggucacauauggaacuuguaaucaagcaggagaacggcggcgagauaaaaggagcguugcacuugcuccacauguuggaaugggccuugauacgagaacccaaacauggaugucugcugagggagcguggcgccaaguugaaaaaguagaaacaugggcacuucgucauccgggcuuuacgauauuagcacuauuuuuggcacauuacaucggaacaucguugacgcagaaagucguuaucuuuauauuguuaaugcuggucacaccuagcaugacuaugagauguguagggguaggaaauagggacuuugucgagggguuaucaggagcaacauggguggauguaguauuagagcauggggguuguguaacaaccauggcgaaaaacaaaccaacacuggacaucgaacugcagaaaacagaagccacacaacuugcgacuuuaagaaaauuaugcauugaaggaaaaauuacaaacauaacgacugacaguaggugcccaacccaaggagaagcagugcuaccggaggagcaagaucagaauuaugugugcaaacauaccuauguggauagaggauggggaaacggcugugguuuauucggaaaaggcaguuugguaacaugcgcaaaauuucaaugucuagaacuuauagaggggaaaguagugcaguaugaaaacuuaaaauauaccguaauaaucacagugcacaccggugaccaacaucaaguaggcaaugaaacccaagguguaacggcagaaauaacuccucaggcgucgacuaccgaggcgauacugccagaauaugguacauugggacuagaaugcucacccagaacgggcuuggacuucaacgaaaugauccugcuuacaaugaaaaacaaagcauggaugguucacagacaaugguucuucgaccugccgcuaccuuggacaaguggagcaacaaccgagaccccgacuuggaaucguaaagaguuacugguaaccuucaagaacgcucacgccaagaaacaagaggucguaguucuaggaagucaagaaggcgccaugcacacagcucuaacuggagccacugaaauacaaaauucuggggguacuucgauauuugcaggacaucuaaaaugucgacuaaaaauggacaaacucgaacuuaaagguaugucuuaugcaauguguacgaauaccuucguucuuaagaaagaaguaagugagacacagcacggaacaauuuugauuaaaguugaauacaaaggugaagacgcaccuugcaaaauucccuuuucgacagaagauggucaggguaaagcucauaauggccgacucauuacagcaaauccuguaguuaccaagaaagaagaacccguaaauauagaggcggaaccacccuucggagagucaaacauugucauagguacaggggauaacgcacugaaaauaaauugguauaagaaagggagcucaauuggaaaaauguucgaggccacggcgcgaggugcgagacgaauggcaauacucggugacacggcaugggauuuuggauccguuggaggaguucucaauucauuaggaaaaaugguacaucagaucuucggcucugcuuauaccgcauuauuuucaggaguuucuuggguaaugaaaauaggaauaggaguacuccuaacauggauaggauuaaauucgaagaacaccucaaugucuuucucauguauagcaauagggauuauaacuuuauacuuaggugcaguaguucaagccgauaugggauguguaauaaacuggaaaggaaaagaacucaaauguggaagcgggaucuuuguaacaaacgaaguccacaccuggacagaacaguauaaauuucaagcagauucaccgaaacgacuugccacugcuauagcaggagcuugggaaaauggcgugugcggaauccggucaacaacgcguauggagaauuuacuauggaagcagauugcaaacgaguuaaacuauauauuaugggaaaauaacauuaagcuaacgguaguaguaggagacauuauaggaguuuuagaacaagguaaacgaacacugacaccccaaccgauggaauugaaguacagcuggaaaaccugggguaaggcaaagauaguaacagccgaaacucagaacucguccuucauaaucgacgguccgaauacuccagaaugcccuucagcgucccgagcauggaauguaugggaaguggaagauuaugguuuugggguuuuuacgacaaauauauggcuaaaacuuagagaaguuuauacucaguugugcgaccaucgauuaauguccgcagcaguuaaggacgaaagagcaguacacgcagacauggguuacuggauagaaucgcaaaagaauggaaguuggaaacuugaaaaagccucauuaaucgagguaaagaccugcacauggcccaagucucauacacucuggaguaaugggguacuagaaagugacaugaucauacccaaaucacuagcaggcccaauaucucagcacaaucauagaccaggauaucauacucaaaccgcgggaccauggcaccuuggaaagcuagaauuagacuuuaauuauugugaggguacuaccguuguuaucaccgaaaauuguggaacacgagguccgagucuaaggacuacaacaguaucaggaaaauuaauccaugaauggugcuguaggucuugcacucucccuccacuuagguauaugggagaagaugguugcugguacgguauggaaaucagaccaauuucagaaaaggaagaaaauaugguuaagucguuaguaagugccggaucgggaaaaguagauaauuuuacuauggguguuuuguguuuggcuauacuauucgaggaaguaaugagagggaaguucggcaagaaacauaugauagcaggcguauucuuuaccuucguccuacuccuuucaggacaaauuacuuggcgcgacauggcucauacacucauaaugaucggaucuaaugccagugaccgaauggggaugggagucacguauuuagcauuaauagcaacuuuuaagauucagccuuuccuagcacuuggauucuuucuaagaaaauuaacaucgagagaaaaucuauuauuaggcguaggccucgcuauggcaacuacauuacaauuacccgaagacauagagcaaauggcuaauggcauugcgcuuggguuaauggcacugaaacuaaucacgcaauucgaaacuuaucagcuguggacugcguuaaucagccucacauguucuaauacgauguuuacucucacaguggcuuggaggacugcaaccuuaauucuggccggcgugaguuuauuaccuguaugucagucaucaucuaugcggaagacugacugguuacccauggcaguagcugccauggguguuccaccauuaccgcuauuuaucuuuagucuuaaagauacccuaaagcggagaagcuggccauugaacgagggcgugauggcaguuggacuuguaaguauauuagcgaguucucuucuuagaaacgaugugccaauggccgggccuuugguugcugguggacuguuaauugccugcuacguuauaacgggaacaucggccgaccucacuguagaaaaagcggcagauaucacaugggaagaggaagcagaacagacaggagugucgcauaaucucaugauaacaguugacgaugacgggaccaugcgcauaaaagaugaugagacagaaaacauauugacagucuuauuaaagacagcacuauugauaguaucugguguauuuccauacucuauucccgcgacucuccuggucuggcacacuuggcaaaaacaaacgcaaaggagugguguacuuugggauguaccaagcccuccagaaacccagaaagcugagcuggaagagggaguauaucgaaucaaacagcagggcaucuuuggaaaaacucaaguuggcguagguguccaaaaggaaggagucuuccacacaauguggcacguaacuaggggcgcaguccucaccuacaaugggaagcgcuuagaaccgaauugggcgucaguuaagaaagaucuuauuaguuauggcggggguuggagauuaucugcacaauggcaaaaaggggaggaaguacaaguaauugccgucgaaccuggcaaaaaucccaaaaacuuccaaacuaugccgggaacauuucaaacgacuacaggugaaauaggagcaauugcccuagauuuuaaaccagggacaucggguucgccaauuaucaauagggagggaaaggucguaggucuauaugguaacggugugguaacuaaaaacggcggcuauguuucuggaaucgcccaaacaaacgcggagccugacggucccacuccugagcuagaagaagagauguucaagaaacggaauuuaacgauaauggaccuacauccugguagugguaaaacgagaaaauaccuuccagcgauagucagggaggcaauaaaacgacgauuacgaaccuuaauucuagcgccaaccaggguaguugccgcugagauggaagaagcgcuaaaagguuuaccuauacgauaucaaacgacugcuaccaagucagaacauacaggaagagaaauuguagauuuaaugugccaugcaacauuuacaaugagacuauuaagcccuguucgcguucccaauuauaaccuuauaauaauggaugaagcacauuucacagaccccgcaaguauagccgcacgcggauauauuucaacucgaguaggcaugggagaagcugcggcaaucuucaugacagcuacucccccagggacggcugaugcauucccacagucaaaugcaccuauacaagaugaagaacgugacaucccagagaggaguuggaacucugggaaugaauggaucacggauuucgcgggcaaaacugugugguucguaccgucaauaaaagccggcaacgacauugcuaacuguuuacgcaaaaacggcaagaaagucauccaguuaucaaggaaaaccuucgacacagaauaccagaaaacuaaacuaaaugauugggauuucgucgugacuaccgacauuucagaaaugggggcaaauuuuaaagcagauagagugauagacccuagaagaugccucaaaccgguuauauugacagacgguccagaaagaguaauccuugcggggccaaugcccguuacagcagcuucugcagcacaacgaagggggcgcguuggucggaauccgcaaaaggaaaaugaucaguacauuuuuacuggacagccauuaaacaaugacgaggaccaugcucacuggacggaggcuaaaauguuacuugauaauauaaacacaccagaaggaauaauuccagcucuuuucgaaccugaacgugaaaaaucggcugcgauagacggugaguaccgccuuaaaggagagucacgaaagacuuucguggaacuaaugaggagaggagaccuaccaguaugguuagcucauaagguagcaucagaggguauaaaguacacagaucggaaaugguguuuugauggccaacgaaauaaucaaauacuagaagagaacauggacguagaaauauggacaaaagaaggugaaaagaagaaacuuagaccccgcuggcuagaugcaagaacauauucagauccucuggcccuaaaggaauuuaaggauuuugcagcaggacguaagaguauugcgcuggaucuugucacugagauuggcaggguuccuucgcaucuagcacauagaacccgaaaugcccuggacaaccuaguaaugcuacacacaucugaacacgguggucgugccuauagacaugcuguagaggaacuacccgaaacaauggagacauugcuacuacuaggauuaaugauauuauugacgggaggagcaaugcuuuuccuaauauccggaaaagguauagguaaaaccucaauuggacuaauuuguguaauugcaagcucagguauguuauggauggcggccauaccguuacaauggauagccagcgcuauaguuuuagaauuuuucaugaugguuuuguuaauaccggaaccugaaaaacaacgcaccccacaagauaaucaacuugcguauguaguaauaggcauauuaacacuagcagcaauaauugcagcaaaugagaugggccuacuagaaacaacaaagagggaccuaggaaugagcaaagagccgggaguaguaucaccaacuucuuaucuugacguagaucuacaccccgcaucagcuuggacacucuaugcugucgcaacuacagugaucacgccaaugcuacgacauacuauagagaauagcacugcaaacguaucacuggcugccauugcaaaccaagcugucguauuaauggguuuagauaagggcuggcccaucucgaaaauggaucuagguguaccguugcuggcuuuaggauguuauucccagguuaacccauuaacauuaacagcagcaguauuacuacuaauuacccauuacgcgauaauagggccuggauuacaggccaaggcaacccgugaggcgcaaaagagaaccgcggccgggauaaugaaaaauccaacaguggacggaauaaugacaauagaccuagauccgguuauuuacgacuccaaauucgaaaaacaacuuggacaggugaugcuccuaguucuaugcgcuguacaacuuuuauugaugagaacaucuugggcucugugugaggcuuuaacacuugcaaccggaccuauuacaacucuuugggaaggaaguccaggaaaauucuggaauacgacaauugcaguuucaauggcuaacauauucagagguaguuauuuagcgggugcagggcucgcauucucaauaaugaaaaguguuggaacuggcaagagggguaccgggagccaaggcgaaacucuaggcgaaaaauggaagaagaaauuaaaucaacugucucggaaggaauuugaucucuauaagaaaucaggaauaacagaagucgaccgcaccgaggccaaagaaggucuaaaaagaggggaaaucacacaucacgcaguaucacggggaucugcuaaauuacaaugguuuguugaacgcaacaugguaaucccagaagggagaguuauagacuuaggauguggucggggcgguugguccuacuacugugcaggauuaaagaaagucacugaaguaagaggcuacacaaaaggagggccaggacaugaggaaccaguaccaaugagcacauauggcuggaauauuguuaaacuaaugaguggcaaggacguauuuuaccugccgccugaaaagugugacacacuauugugugauauaggagaaucaucaccaucaccuacuguugaagaaagccggaccauacgaguacuuaagauggucgaaccuuggcuuaaaaacaaucaauuuuguauaaaaguccugaauccuuacaugccaacgguaaucgaacaucucgaacgacuacaacggaaacauggagguauguuaguccggaacccauuaagccguaacucaacccacgaaauguacuggauuuccaauggaacuggcaauaucgucgcaaguguuaauauggugucacgauuacuucugaaucguuuuacaaugacucauagaaggccgacuauugaaaaggaugucgaucugggagcuggaacgagacauguuaacgcggaaccagaaacaccaaauauggauguaauaggugagagaaucaaaaggauuaaagaggaacacaauucgacauggcauuaugaugaugaaaacccauauaagacaugggcauaucauggguccuacgaaguaaaagcaacgggaucagcgaguucuaugaucaacgguguaguuaaguugcuuaccaaaccgugggauguuguuccaaugguaacacaaauggcuaugacagauacaacaccauucggucaacaaaggguauucaaagagaagguagauaccaggacaccgagaagcaugccgggaacgcgaaggguaaugggaauaaccgcugagugguuguggagaacacuuggaagaaauaagaaaccaagacuguguaccagagaagaauuuacaaagaaaguaaggacgaacgcugcuaugggagcaguauuuacagaggagaaucaaugggauucagcaaaagcugcuguagaggaugaagacuucuggaaacuugucgaucgggaacgagaauuacauaaauuaggaaaaugugguagcugcguauauaauaugauggguaaacgugagaagaaauuaggcgaauuuggaaaagccaaaggcaguagggcaaucugguacaugugguuaggcgccagguacuuagaauuugaggcucucggauucuuaaaugaagaccacugguuuucccgagaaaacucguacuccggugucgaaggcgaggguuuacacaaacuuggcuacauucuuagagacaucaguaaaaucccagguggcgcaauguaugcagaugacacugcgggaugggauacuagaauaacugaagacgauuuacauaaugaggaaaagaucacccaacaaauggauccagaacauagacaacucgcaaacgcaauuuucaaauuaacauaccaaaacaaaguagucaaaguccagaggccuacaccgacagggacggucauggauauaauaucgagaaaagaucaaagaggaucagggcaaguugggacauacggauugaauacauucacgaacauggaggcccaguuaauaagacagauggaaggagagggaguguuauccaaagcagacuuagagaauccccaucugccggagaagaaaauaacgcaauggcuagaaacuaaaggggucgaaagacugaagcgaauggccaucaguggggaugacuguguugucaaacccauugacgauagauucgcuaaugcauuacuggcauuaaacgauaugggaaaaguaagaaaggauauaccccaauggcagcccuccaaaggguggcacgauuggcaacagguuccuuuuugcucccaucauuuucaugaacuaauaaugaaagaugggagaaaacuugugguacccugucguccccaagaugaacugauaggacgcgcucgaaucucucaaggagcuggcugguccuuacgcgaaaccgccugucuagggaaagcauaugcccaaauguggucgcuaauguauuuucacaggagagacuuacgacucgcgagcaaugccauuuguuccgcaguaccuguucacugggugcccacaucucggacaacguggucuauucacgcacaccaucaguggaugacuacggaagauaugcucacaguguggaaccgugucuggauugaagacaaccccuggauggaagauaaaacgccugucacaacuugggaaaaugucccauauuugggaaagcgcgaagaucaauggugcgguucguuaaucggauuaaccagucgagccacuugggcgcaaaauauucccacagcaauacaacaagugcgaagccuaauaggcaacgaagaauuucuagauuauaugccaaguaugaagagauucagaaaagaagaggaaucugaaggagcgauaugguaa

SEQ ID NO: 23076 - RNA, 9873 nt, Artificial Sequence
  derived and/or modified CDS sequence (opt6) from DENV-3__FJ898455__SS-prME
acgagcuuguguuugaugaugaugcuacccgcaacacuagcauuucaucuaacaucaagagacggagaaccgcgaaugauaguggguaaaaacgaaaggggaaaaucauuguuauucaaaacagcuaguggaauuaauaugugcacacuuaucgcaauggaucuaggagaaaugugugaugauacaguaacguacaaauguccucucauuacagaaguagaaccugaagauaucgauugcugguguaaucuaacaaguacauggguuacauacgguacaugcaaccaagcuggggaacauagacgagauaaaaggagcguagcauuagcaccccacgugggaaugggauuagauacacgaacccaaacuuggaugagcgcggaaggagccuggaggcaaguagaaaaagucgaaacaugggcuuucagacauccgggauucacaauauuagcacuuuuccuagcucauuacauagguaccucacuuacacaaaaagucgugauauucauacugcucauguuaguaacaccgucuaugacaaugagguguguaggggucgggaauagagauuuuguagaaggacucucgggagcaacauggguugacguaguucuagaacacggaggcuguguuacaacaauggccaaaaauaaaccaacccuggacauugaacuacagaaaacugaagcaacucaacuagcuacucuuagaaaacuauguauugaggggaaaauaacgaauguaacaacugauucccgauguccaacccaaggggaggccaucuugccagaagaacaagaccaaaacuauguaugcaaacauacuuauguggaucgagggugggguaacggcugugguuuauuugguaaagguagcuuggucacaugugccaaauuccaaugucuggaaaguauugaaggaaaagcaguucagcaugaaaacuuaaaauauacaguaauaaucaccguccauaccggagaucaacaccaaguagggaaugaaacacaagguguaacggcagaaauaaccccgcaagcgaguacugucgaggccaucuugccagaauauggaacguugggccuggaauguuccccgcgcacgggacucgauuuuaaugaaaugauuuugcuaacuaugaaaaauaaagcauggaugguacaucgccagugguucuucgaucuacccuuaccguggacgagcggagcuacaacugagacacccacuuggaacaagaaagagcuacuugucacuuuuaaaaaugcucaugcuaagaaacaagaaguggugguacuagggucgcaggaaggagcuaugcauacagcgcuuacaggugcaacagaaauacagacuagcgggggcacgagcauuuuugccggacauuuaaaaugucgccucaaaauggacaaacucgaacuaaaaggaaugucuuaugcuaugugucucaaugcauucguccuaaagaaagaaguaagcgagacucagcauggaacaauucuaauaaaaguagaguauaaaggugaagacgcacccuguaaaauccccuuuagcacugaagauggacaggguaaagcacauaacgggcgcuuaauaacagccaauccaaucguaaccaagaaagaagaaccgguaaacauagaagcugaaccacccuucggugaaucaaacaucgucauagggauaggggacaaagcucucaaaaucaacugguauaagaaagggaguucaauuggcaaaauguucgaagcaaccgcacggggcgcuaggaggauggccauucucggggauacagccugggacuucgguucgguagggggaguacucaacaguuuaggcaaaaugguccaccaaauauuuggaagcgcuuauaccgcgcuauuuucuggaguaucauggauaaugaaaauugggaucggcguacucuuaaccuggaucgggcuaaauuccaagaacacaucaauguccuucaguuguauaguuauuggaauaauaacuuuguaccuuggugcuguaguccaagcagacaugggaugcgucaucaauuggaaggggaaagaacuaaaguguggcucaggcaucuuugucacaaacgagguucauacauggacagaacaauauaaguuucaggcagauucuccaaaaagauuggcuacagcuauugcuggagccugggagaauggagucuguggaauaagauccacuacuagaauggaaaaucuguuauggaaacaaaucgcuaacgaacuaaauuauauauugugggaaaauaacauuaaacuuacaauagucgugggugaugucauuggcguacuugaacaaggaaagcgaacuuuaaccccacaaccuauggaacuaaaauacuccuggaaaacaugggguaaggcaaaaauaguaacagcugaaacacaaaauucaaguuuuauaauugauggaccuaacacacccgaguguccaagugcgagucgugcguggaauguaugggaaguugaggauuacggauuuggaguuuuuacaacaaauaucugguuaaaacuaagggaaauguauacgcaacucugcgaucacaggcuaaugucugcugcagugaaagaugaaagagcaguacacgcugacaugggauacuggauagaaucucagaagaaugggucuuggaaacuugaaaaggccagcuuaauagaaguuaaaacauguacguggccgaaaucucauacuuuauggagcaauggagugcuggaaucagauaugauuauucccaaaagucuagcuggaccaaucagucaacauaacuaccgaccggguuaccauacccaaacugccggcccguggcaucuagggaaguuagaacuagauuuuaacuacugugaagguacuacaguuguaaucacggaaaauugugggacacgaggaccuucacuaagaaccacaacgguuucugggaaacuaauacaugaauggugcugcagaucaugcacauuaccuccccuaagauauaugggcgaagaugguuguugguauggaauggaaauaagaccaaucaacgaaaaagaagaaaauaugguaaaaaguuuaguuucugcuggauccgggaaggccgauaacuucacuauggggguacucugcuuagcgauuuuauucgaagaaguuaugcgcggcaaauucggcaagaaacacaugaucgcuggcgcuuuauuuacauuuguauuacuacuaagcggucaaauuacguggcgugauauggcacacacuuuaaucaugauuggcagcaaugcgucugacagaaugggaaugggaguaacuuaucuagcgcuuauagcgacauuuaaaauucaaccauuucuggcuuuaggguucuucuuacguaagcuaaccucgcgcgaaaauuuacuuuuagguguuggauuagcgauggccacuacacugcagcuucccgaagauaucgaacaaauggcaaauggaauagcuuuaggucuuauggcuuuaaaauuaauaacacaauucgaaacauaccaguuauggacagcgcuaguuagucuaaugugcucaaauacgauauuuaccuuaacuguagcauggaggaccgcuacgcuaauacucgcgguuaucagcuugcucccaguaugccaaaguucuucaaugcguaaaacagacuggcuuccuaugacagucgccgcgaugggaguuccucccuuaccacucuucauauuuagccuuaaggacacgcucaaacguaggucuuggccucuaaaugaaggaguuauggccguagggcuagugucuauacuagcaucgucauuucuacgaaaugauguuccuauggcggggccauugguggcuggaggucuccuuauugcauguuauguaauaaccgggacuucugcugauuuaaccguagagaaagcggcggaugucacaugggaagaagaggcagaacaaacagggguaagucacaaucuaaugauuacaguugaugacgauggaaccaugcgaauuaaagacgacgaaacggaaaauauucucacaguuuugcugaaaacagcacuauuaaucguaaguggaauauucccauauucgaucccggcaacacuauuagucuggcauacauggcagaaacaaacucaaaggagcggaguacucugggacguaccgucaccuccugaaacacaaaaagccgaguuggaagaggggguguacagaauaaagcaacaaggcaucuuuggaaaaacacaaguagggguuggaguacauaaagaaggugucuuccauacuauguggcacguuacaagaggagcggugcuuacgcacaacggcaaacgauuagaaccgaauugggcaaacguaaagaaagaucuaauuaguuacgguggcgguuggaaacuaagcgcucaauggcaaaaaggagaagaaguacaaguaauagcaguagaaccaggcaaaaauccuaaaaauuuucaaacaaugccagggauuuuccaaacuacgacaggagaaauuggugcuauagcccuagauuucaaacccggaacuucugguucuccaauuauaaacagagaagguaaaguuguaggacuuuacggcaaugguguaguaacuaagaacggagguuacguauccgguauugcccaaacaaacgcugaaccggacggucccacaccugaacucgaagaggaaauguucaagaaacgaaaucugacaauaauggaucuccauccaggauccggaaaaacgagaaaguaucugccggcuaucguaagagaagcaauuaagagaagacuaagaacucuaauauuggcaccaacuagaguagucgcugcagaaauggaggaggccuuaaaaggucucccaaucagguaucaaacuacugcaacuaaaucggagcacacugggagggagauuguugaucuuaugugucaugccacauuuacuaugcgucugcuaucaccaguaagaguaccaaacuauaaccucauaguaauggaugaggcacacuucacugauccugcaagcauugcggcaagaggauauauuucaaccagggucggaaugggcgaggcagcugcgaucuuuaugacggcaacaccaccuggcacggcugacgcguucccucaaaguaacgcaccuauacaggaugaagaacgagauauuccugaacgaucauggaacucuggaaaugaauggauaacugauuuugcugggaagacugugugguuuguuccuucgauuaaagcaggaaacgacauugccaacugucuacguaagaacggaaagaaaguuauccaguugucgcggaagacuuuugauacagaguaucaaaagacuaaauuaaacgacugggauuuugucguaacaacggauauuagugagaugggcgcaaacuucaaggccgacagaguaaucgaccccagacgcuguuuaaagccagugauuuuaacugauggaccugaacguguaauauuagcuggaccaaugccagugacuguagcuagcgcagcccaaagacgaggcagagucggaaggaauccacaaaaagagaaugaccaauacauauuuacuggucaaccucuaaacaaugaugaggaucaugcccauuggacagaagccaaaaugcuuuuagauaauauuaacacaccugaaggaauaauaccugcuuuauuugaaccagagagggagaagucggcggcaauagauggagaguaccgacuaaaaggggagucuagaaagacuuucguggagcuaaugagaagaggagauuugccaguaugguuggcacauaagguagcuuccgaaggaauuaaauauacggaccgcaaaugguguuuugauggggaacgcaauaaucagauauuggaagaaaacauggacguggagauuuggacuaaggaaggagaaaggaagaaauuacguccuaggugguuagaugcacgaacguauagugauccucuugcauuaaaagaguuuaaagacuucgcugcugguagaaaaagcauagcucuggaucucguuaccgaaauuggacgaguccccucccaucucgcacauagaacacgcaaugcuuuagauaauuuagugaugcuucacacgagugaacacggagguagagcuuaccgacacgcuguugaagaacuaccugaaacgauggaaaccuuacuucuucugggacucaugauauuauuaacuggaggcgccauguuauuccucaucucgggcaaggguauugggaaaacgucgauuggcuugauauguguagucgcuaguuccgguaugcuuuggauggcugauguuccauuacaauggauagcuagugccauaguguuggaauuuuucaugaugguauugcuuauaccagaacccgaaaagcaaagaacaccucaagauaaucaacuagccuauguaguuaucggaauccuuacauuagcugcaauaguagcagcaaacgaaaugggacuucuugaaacaacaaagcgagaucuagggaugucgaaagagccugguguaguuucaccuacaaguuacuuagauguagaucuucauccagcauccgcauggacgcuguacgcggucgcaacaacuguuauaacacccauguugcgucauacaauagagaacucgacugcgaacguuucucuugcagccauugcaaaucaagcaguaguauuaaugggacuagacaaaggauggccgauuaguaaaauggauuuagguguuccuuuauuagcauuagguuguuauagucaagugaauccauuaacacugacagcagcaguacuauuauuaguaacgcacuacgcgauuauugguccaggauugcaagcaaaggcaacgcgcgaagcacagaagagaacagcagcagguauaaugaaaaauccuacaguggacgguaucaugacgauugauuuagacccagucaucuacgauucaaaauucgaaaagcaacuuggacagguaaugcuacucguuuuaugugcaguacaguuacucuuaaugaggaccagcugggcauuuugcgaagcacuaacuuuagcaaccggaccuauuacaacucuuugggaaggcaguccuggaaaguucuggaacacuacaauagcagugagcauggcuaauauauucagagguucauaucuagcgggugcagguuuggcauuuucuauaaugaaaaguguggguacgggaaagagggguaccgggucacaaggagagacauuaggagaaaaauggaagaagaaauuaaaccaauuaagccgaaaagaguuugauuuauacaaaaagaguggcauuacggagguagaccggacagaggcaaaagagggcuugaagaggggagaaaucacacaucaugcaguaucaagagguagugcaaaguuacaaugguucguagaaagaaacaugguaaucccugaaggccgaguaaucgauuuaggcuguggaagagguggcuggaguuacuauugcgccggacucaagaaggucacagaaguuagggguuacacaaaaggagguccuggccaugaagaaccggucccuaugucaacuuauggcuggaacauugucaaacugaugagugggaaagacguauucuacuuaccuccugagaagugcgauacacuuuugugugauauaggggaaaguucgcccagucccacgguugaagaaaguagaaccauucguguuuugaaaaugguggagccaugguugaaaaauaaucaauucuguauaaaaguccugaacccauauaugccaacggucauagagcaccucgaaagacuucagagaaaacacggggguaugcugguccgaaauccacugagccggaacucaacucaugaaauguauuggauaucaaacgguacaggaaauauaguaaguucuguaaacaugguuucuagguuauuauuaaaucgguucaccaugacgcacagacgaccuacaauugaaaaggauguagauuuaggcgcggggacuaggcacguuaaugcugaaccugaaacuccuaacauggacguaauuggagagagaauuaggcgcauaaaagaagaacacucaucuaccuggcauuaugaugacgaaaauccauauaaaaccugggccuaucauggaaguuacgaagucaaagcaacagguuccgcauccaguaugauaaacgguguuguaaaauuauuaacgaaaccuugggacgugguaccgaugguaacacaaauggcuaugacagauacaacgcccuuugggcaacaacgcguauuuaaagaaaagguagacacgcgaacaccacgaccuaugccggguacucgcaaggugauggagaucacugcugaaugguuauggaggacauugggaagaaauaaacgaccgcgauuauguacgcgagaggaguucauuaagaagguaaggacaaacgcugcuaugggagcaguauucacagaagaaaaccaaugggauagcgcacgcgcugcugucgaagaugaagaguucuggaaauugguagaccgagaaagagaauugcauaaauuagggaaauguggaucguguguuuauaauaugauggggaagagagagaagaaacuuggagaguucggaaaggcgaaaggaucaagggcgauaugguacaugugguugggugccagguaucuugaguucgaggcauugggauucuuaaaugaagaucacugguuuaguagagaaaacucuuauucggggguugaaggagaaggauugcauaaguuaggauauauacuuagagauauuagcaagauucccgguggggcaauguaugcugaugacacggcgggaugggacacccgaaucacggaagacgaccuucauaaugaagagaaaauaacacagcaaauggacccagagcaucgacaauuagcgaacgcaauuuuuaaauuaacguaucaaaauaaaguugugaaaguacaacgcccuacacccaaagguaccguuauggacauuaucucuagaaaagaucaaagagggaguggacaagugggaacauaugguuuaaacacuuucaccaauauggaggcgcaacuuauaagacaaauggaaggugaggggguccuaagcaaagccgauuuagaaaacccacaucuacuggagaagaaagugacccagugguuggaaacuaaaggaguagaacgacuaaaacggauggcuauuuccggggaugauugugugguuaaaccgauugacgaucgauucgcgaacgcauuauuggcuuuaaaugacaugggcaaagugcgcaaggacauuccacaguggcaaccgagcaagggguggcaugacuggcaacaaguuccuuuuuguucucaccacuuucacgagcucauaaugaaagauggacguaaguuagucgucccguguaggccacaagacgaguuaauaggucgagcgagaaucucacaaggagcaggauggagucuucgugagacagcaugcuuagggaaagcauacgcgcaaaugugggcacuaauguacuuucaccgaagagaccuucgacuagcgucaaacgcuauaugcagcgcgguuccagugcacuggguuccuaccucuaggacaacguggucaauccacgcccaucaccaauggaugacuacggaagauaugcuuacaguauggaacagagucuggaucgaagauaauccuuggauggaagacaaaacuccaguaaccaccugggaggauguaccuuaucuuggaaagagagaagaucaauggugcggaucgcuaauuggauuaacuucacgagcaacgugggcucaaaauauucuaacagccauacaacaaguccgcucacuaauagguaaugaggaguuuuuggacuauaugccaagcaugaagagguuuagaaaagaagaagagucagaaggagccauaugguag
